United States Patent 11,203,620 (CONSTITUTIVE YEAST LLP PROMOTOR-BASED EXPRESSION SYSTEMS) - sequence listing, part 3

SEQ ID NO: 105 - DNA, 1145514 bp, Pichia pastoris
gaaaaattaaatctttatactagggacgaggttcgtgacaaaagaagacaatcatgagactcaccgtcttgtcatctacaagtttcaataagcttccaacttgagtaacctagccatgtgattagtaactttcgaagcatgattcagaacgttctgctctgccgcgtcaaaaagggcagctacttgaagttaaaagaaagatcaaaaattcctgagcattgttcaaacagctataaatcaaaacagaataagaaataaggccatcacttaccaaggaaaaacaaaaagttcgagagatcaacaatgcacttcagggacgcacctgaacctttacattagtgtaaaaataaattattagattgttcggttcgagcgttagccatatacaaaatgcggccttcaaagtcattggaaaagagctgctttaggacctctccaaaagctaaattgacaaacaggctacctcatatctccatcatctttgccaaccttttcagtaacaaaaacaaaagcaatatcgtttatttgtccattggacgatcatcaaatattgctaggtaggcacttttttcggtaagcgtgtctgcctcctttcttcagtaagatcaattgtcgccggatactatgaatcgatcattgtagaaactaacatgcttctaattacccattcaatcttgtagcactgagtgcatctcgcgtgagacaaattgaactcgcctacttgggtaggataaacggttgggtaacgtagctgcttcatccggctacttgcttggtctgctgcgtgctttacgcgctgattggtggtcgaataaaccggtacattatttgttcttatccacgacaatgagacgaacaagtaacaaaccagaactggtagctcgatgattacagttccacaatatcagccgaatacccacactttttccaacctgtgtcaattgccttagaaattgtattagcacaaaaatcatttcgctgacggctgaacatccgatatttactattcgtcaaggtatttagaattttgtgcgaacttgtgggtcgtggtgaaaaagactattgtgagttgttcgtagctgagtccttgactatactgatacacattaaaagaagctgccctttaagcaactaatgtatttgttatgcgtatatctgtagaaagcaacagtgcgacagttgaagtgttcgaacacacttctcaattttgaatctttctcattctcattcagtgaacgatgaaccaagtacacaaatttggaggtgaataattatgctagggagagcttgctagatcatttcacaattagaatgtgaaaccagacctttagatgtaaatgctaaggctaggataggatcgtaattagtaggatcaacaaactttattgattagcctcacctagactaagtttgatcttttcttcatcgtccaatggacaaataaacgatattgcttttgttttttgttactgaaaaggttggcaaagatgatggagatatgaggtagcctgtttgtcaatttagcttttggagaggtcctaaagcagctcttttccaatgactttgaaggccgcattttgtatatggctaacgctcgaaccgaacaatctaataatttatttttacactaatgtaaaggttcaggtgcgtccctgaagtgcattgttgatctctcgaacttttttgtttttccttggtaagtgatggccttatttcttattctgttttgatttatagctgtttgaacaatgctcaggaatttttgatctttcttttaacttcaagtagctgccctttttgacgcggcagagcagaacgttctgaatcatgcttcgaaagttactaatcacatggctaggttactcaagttggaagcttattgaaacttgtagatgacaagacggtgagtctcatgattgtcttcttttgtcacgaacctcgtccctagtataaagatttaatttttcaaataacttgaaaataccaaaagctcaaaagctctgtatgttcctagtcttaggagtgatacgtatcattctgtattatcagtctgcatataagggtctcggtttgtagttaacttgtagtgtcggtatgaacaagttaattgctcagtttacttgtggtatttctgaaatgcaacataggaattttaatgccactcttgtgttcaagttcctgaagttatggcagcttcaggttaacgtctcgatttgctgcgtcaatcaaagttttctatggctatcccctatggatatgcctagctcttccatctgtagtttcagttgttgttgacgttataggtactatcttctggttctatccagctcacctcaggaagcttcaggaactatagtcgattgtctttggggaaaggaccaattttagcttccgaatgatccagcaattatcctacatgtactttccgtttcaagaaactaacgagatttgtttattccatcgtattctagagagcagcctcttaacgtctttttgaagtcctatctacgtgagcaagcttatggcaatcggctcgcttttaaatggagcagagtaggcagatggaggaaactgaccccttgctctaaatgctcacactagcaaacttatcctcccctatctactattaattgtatggatgcaatgtcatgtcatgaagggcacgcctcaaaagaaacaaaagataattgagctatccagaagtagttgttctttttaataaacgttttgtatgctctctgccttatttggtttgagctccgtaacaatcctaagccgaaaacttaagcccccttacgtggttttggtttcaaagaaacatggcatatttgcaaacggcaatcaagcgtctaataggtactattagatatggcttaacattccccctgctcagacttcactgctacaaatttagacttcaactttaaaattatcaatcaataagaacattgcttggtctttgaagactcttgaaaaatatatcacttgaagttcattggattgatttccagtgtttcgatggtagaccacaacgacacctagagatgattgtgtctcttaaccgttttagactattgattgagagaggctgccagcctaatagagttcttcaaatcgatttactggtatgctatgttgccaggttccgtgttttatgaacttgtaaactcactgaaaccttgttcttattatctagtacccaccgggctccatgcttttgagttgttgtacaacgctagcttacttctttacactttcttctctgtgcccttaacacgatcccttactttttgtagcggtttcaatttatagagctcaggtcattactggcaagttatctgattcggttattacatattactacaagaaaaaaaagaaacatgaaattctgactcgttgacttgtttatcgaacattgccgaagctatgcctctaactatcgttctcagtttatgacgtatctctctgtatcgaaattttcgtggattatgctttaaaatagattaagagccacttgaggcgcacctgaacatgattgcctcgaaacatattagctgtacatccgttttagatcttctagttagcctctgagagtggttctatcttttgaagaaatagtacttactctacattatcaatgtcttttatttcgcgctgccgtgtaagcaagtattggtcgatctttaggtccagtttctacatcatactaaaagcgcgcgtggaggttgcttatgaagaaattggtttagctttggaaattggagcctctcaccgtaaaccaaaaaatctgtcagtactataatttctggtggagaaccacatctagtgcaactggctgttgctagaagattccgttggaccaatgtggaatcagagggtatacaagtacgtgaatattaagacattgattgattcgaacatcagaatctatgtattctaatcctatattgtatcaacaataatattattattgatcctgtatgtagaaggttatgagacttaaaatcacacggtttaagataccgaaatgctaagcaaaaacgtttcgtcgagagaaacaaaaacattgagttgtgaatgggacaatttgaattaaagaatgtatggaaagataacgctgactggtgtaccacttgtcggtgggacttgatgcttggcaagctcaagaagtcacttgatctactacgtagatgtatgaatgaactataaaagttttgttcataatcgacgcagtttaacgacaacagttagtcttcgtattatatagtgcttcaagagacgaggcaagactatcatgtgttcagacctactaagattccgtgtactattgtattgatagaaaatcaaagatgacggcgactgtagacgtaaccatttaaaataattttctcattcttgttgacgccttcggtagtatcttcagagctttttttgtcagttatattaggtaccttataggtggcccttctctcaatttcaatcgcctagatttttcttaattattcgcgcattttgagtaatgttactggttcgtgaaggctagtgctcaaacattggtctagaagctcttcaggtttgactgctagttaatgttagactgtgtgaattaaaattatttgtcggcatgcatcaatcattcggcaaagtgcttgggaactgctgtagtacgtagcgggtctcatctaaaaacagcttgttgaacacttgagacattcaacaagtagatatttgcttactgtttactattgaaatgtactagcccgctggaagcgtcatttaaaacaaaaatgaaaccttgagaagcttgggttacctcataagattgttctcaatgttgatcaatcatgagaaaaacagagtcgttcgaatttgggatctctttatgtggtgtgactagttaaattgtgctagacctatgtcctgtatcttaaacttcaaactctcagtgaagtgaggaatctgtgaatgatctccaccagaaacgaaaagaaaatacaaatgctctctatactagttactttcagtcttctacttttcttgattgtttttttaaggttgaatatcattacaagtattggtataagcatatgacagggattccaatgttggtcttcagattcgttcacgttgaagaaatgtcaatatggctaatttactacggatctacagtatccaaatgctgccccagctttcaacatctatgaaccctcaagcaggcccttctaatatattgcgttcgtattctgcatgggagagcttatgttctacttgattaaagtgctaccttatgaaataaaaaaagaaaatataaacaaaaacgaatgtacttacttatcatttttgacaatccggttcttaatctttccaaattttcctgctaatgttacccttgatgaaaaaaagtacaatccattgtcgaaagaaaaagctgggaactgttgtgcatgaatcctactaattgtaatcacaatcgactagattatcaattgcagccaacagcaattggtttgtactcttgctacaatcatcaccagtcaactgtgaagtttgactaggcgggtaattaaatagcatactctattccttcattggcgcttgacccaaatgtctgctaaacaacgagtatttctcctgttgaattttctggttaggaactcaaaatcttccgaacggtagataacatttcttttggtcaggacagatagacacatttctcctgagtgcgaatattatcttatcaatgagccaaaagcttgcttcaaaaaattaaaattggccattttgcagtgtctgccggctttcagcttttctatttgatctacatgactaactcgaattcattctcaacacctatatatgaattttaatctcgtataatagcttggaatgcaaaacctatgattctgagtaatcaataattgtttgcatcgtcttgtggctgaatgaatttatctttttagagtccgctactaaatgtacttcagctagtcgtgaattttgctaacacacgacttttaaagaaaataccagcaataattcgttgaggtaagttgccagaactacttaatgtctacagcaacccggaaagaaaagagacattgggtattgggccttttgtgtttaagtatagtggttgtcttctgggttttgtcgtcttttttagtagatgagcttttcttgaaccataattactccaaaccatttctgctcacttatttcaatacaggattgtttacaatatatttaacaccatcacttacgaacaaacttcgacaaaattttacgcagccaagatttcaatcatttgtcatgaatcatgttgaagaaggaaggttatcgttcaaagaaactacggttctgtctttacagttttgcctgttgtggtacctttcgaatctggtgacaaatgcttcactaaaatatactactgtcgccaatcagacaatactcagctcgactagcggttttttcacccttttaatcggctggctttttcgaattgagaacccgagtgtcataaaagcggttggtttgggcctatccttcgtaggcatagtgatggttacctgcagagatcaaatcactaaggaagccagtacatcctccttcttgtcaatgtttggtaatttattggcattagcaggtgcgttatgctatggtctctatacgattttgttaaagcggaaagccaagaatgagactagaatcgatacttctcaattttttggtttcgttggtgtctttactctgttgcttttgtggcctttgataattattttagactatctggatattgaacgctttgagcttccgaaaaccaaaaacgtttggtgcataattatcacgaacggctgcataaccatgatatcagactatttatgggctaaagctttacttttaacctctccattaacggtgactgttggtctatcatttacgattccatttgcgatgttccttcaagaggttaaacaagctcaagaaatgtcacctttgtatttgtgtggtgcctcattgatactaatttcgttcattcttgtgaataaggatgaaaaaagagatgtaatagaatcaactttagaaacgtgaatctaatgcattcgataacaggtaggcatgatgatgttcactagcctcaatctacgtagggacacaagttgcctcttatgtcaacgctcactaagcgctgacttttatgaagaccgtaatgtgaatacaggttgttaaacgtttaatccactgtttagaagactttaattcaaaaaatagggatgttaatgaagttgaaggggtaagaaggattctttatgatgaaaatggaggtcagtacgttatagccaagaaacaaaaaagttgcaaataaaagagcaccgaaatttctttgaaggggatttgaaatcataggaatgcatatcaaaactgtgacacatatagccaacgatagatataccactatgctgattagaacctccgagccaaattggtattgctgaccccctgacaaaaacattctggctcctttttcatttgttggtaaaaaaggaacacccctttgggaacaaaaattgtacccacttatggaaataaatatagacaccaaagaaaatacttgccaaatgtagctaccagccagtctttttcttatcttatcgcgtctttttcttattacttgagtaagcaaaaagagacccagtagataactaatgaagtgggacatatcaaactccgattttaggtatagctgaatttgtagaatttcagctagaaattgagcgaattccagtgagttttcttggatgctcctagttggcaatgactctggaacttgataggtcagatgctcagttatttcacccaagcaagaactataatcgccagattttgagtcataatcagctgaatagcccacgctatttattggaggatatatccaaacttgaggcacagtggataaactgacatcatgatggtgctgatatatgtttgaataatccaatacggcaaaaaaagcctttcctgtgtccctgtagccatccatataagcacctactactttctcaaacacaggtgcaaattgttgacatattctacaccctgcttcattttcaacgtctgtaagtagagcgacaataaaataatctcttggaccttggcagaattcattgaatttggaaggattgatgccaattacaccatcagtagttttttgctgaatgtctaatagctctgatttagaaagcatagctatgcacgaggtaatccagataaaaatggcaaacatttgcattgtcacctacaaacaaatctaaacgaaaagaaaactgatagagtgacaacaaatgtgaactagaaattgtaacacccgtacaccggatgataattagtgaggtcgttttatagatggtattgttgtttggggggatccggtcaacaggtaatcgaagagtatagtaagaagctatggatttcaagatagccaatttgatatttcaagaacgagaattaaccaattgtttaagagagcttgctgagctggaaaccaaacgaaaacgacaaatatatcgtgtggttaactacctgattgttttaaaaaatgcggatctaggcaacggtaactcgttgaagaatgtgagtactcacaaggaagatcacctgaaagttctagatgagcttcgggaaacgaaggggcaactgagtcaccttcaatttctgttggacaacgctaatttggaaaagaagaatctagagaaaacttacactgttcgaaaggcaatacttgaatcgaaggttgagatggggcttaaaacgatcaagcgattgaaagaaagaagggattcagcacaacctaaaacgaacaatccatttgcgcagaattcctctacaccctttgcaactactcctgtgctgaacaagatcaccatattcaagacggcagcagaagtgaatggacgtaaaatcaaatctcctgcaaagcatacccctttaccaaagaaatctggcagcaaaataccgctattggctccaggaaaacaaaatgcatctccttcaaaagccataaggagtccccggccccaaaatggatcaagaattgggagaacacttctggcaacgtcaacacctgatgcgacaaataccaaactttatggcttgaatcaaactagtcctttgcgaagtttattgcttcagaacaaggataaacaaaacaatgaaattaccagaacgtctatttttgatgatgacgatgacgacaatgaggatgagatttctgaccattctttcgaaaggaaagttcctactcaaagtgcgatgggtaacaacattcttacagacaagtcaaaccgcaagaagagaaaacttttcagtacacgcaacgggttaaagcgttttctagcagatcatgatagagtagacgatgacggcgatcatttagataactctggcccagcgtcacctattttgaagaagctcaaagagaagcagatcataagtcctttgaaaaaaaaaatcaagctgctagagttaatatatttggcaactaataatgacgtgactaacccttattcagatagtcttgaatactaggaaagcaatagagccaatataaaagtaaacaaaaccaccagactcgtgagatacataagaaccaaaacttttcccaacaatacaatgccatgtatgaccatacaactggtccatttccttcttaatgaaagatgctatttccttctctagagtgtatttttgaagagcatcttgagcaacctcaaatactcgtgcctgaatgtcttctgatatatcagcggcttttaacagagcttgaagttgttagttctactcctatcaattgtcggtaaaaaacttacgctgctcctttggtatatcttcctcacggttcttcgatgacatgtacgcaatctatataaagaatcagaaactagaactgtaacaagtcctgaacgctaaatgttgatgagacgtgtgaatcctaatacaggagtaacttcgcgcggtgaacagagctaaatcaacttgtagagattaccagctcgcaccagcaactataatggatcaggatgataccatatttatcattaccactgaaacttttcgtgacattaaaagacaatcaactgtatactataccataaggtcaaaatacggtattgttaaacggagatatactgacttttattctcttcggaaatgtttatgcaagatgtaccccaccaagccagttccacctatacccgagaaacactctttcaagaaactcatatccaagcctcttagctacaagaatgacccggcaacgatcaatttgaggacacgtttactgggcagctttttaaacaacctgacccaggaattagtgtttcgtgaaagtataatggtgattcgtttcttggatcctgacgaacgcaactgggctgaagctttgaagacgccaccgtttacctcacttcctcagtcaatttttctctcttcaccacgaagtcctctgcagcccaacccataccactcttattttccgataccacctcttagcttagttaagaattttgattcacctttgaaccaagaatttcgtccttcagaattgttttttcgaagaattctgaaatatttaacacatctacacaaacttaacaagcattttgaaaacgatctccatagatataacaaacaattggttggccttgggggcagtttgaatattttctcgctcattgatacaactatctctaaatctaatggcaccactttggatgaaaacaacagtattgaaggagtaggtcagagtgtcgattcatcatttatcaatcttgagaggttcatattgcattttgtggccaacttcaaggagccaataatggaactgcggtcgttttgtatggtgatcataaatcttttacaatatcgcaaattaaaagaattgcagctgtgttacctaaaaagaattattgttaaaaaacaaacaaggacgcagcgtttgcttgatattgaacgcttatctcaaaagttggatattgctttacaacaaggtgcctctcaaagcccaacgattgccaatgctatcagaaacctagaagctcaaccatctgtttatcaaagtgtttattttgatccaaagagttacgctgatgacgaggacagttcggctgagggtgttaacaatcttgtagctagtgatatcgtcgacgatgaagataattacagcatgagcgacaataattccatcaatttgaacagttcagctctctttcacgagtacaaagaccaaagagtctggaacatgttttcaaaggtcacaaagaatattcaagcaatgactccactagaaaggagcttagaaatacaagctaactgtcgtgatttgcaaaagttagtccattgttttcagcttttgaatgatgatgtcacatttgtatccatagaaattgaaaaaagtaccctgcgtgaacggcagtatgtgaaagataggtttctcgagctgttggagaactttaaaatgattctttgcatatacagtagaagtaatcagattgcttgggagaacggcatttaatttggttgagattcagtagattgtctccaatagcaaaagagagcaaacagggtcgctcgtttgataggtttgttattttgaaagaaatcaaagttgtaattgaagttactgattttagtttcactcttgatgctttactgaaatatataaactctgttcgatggtgaatgattgtcgtgatttcacgctttacctttttttgtatatctagaagccttcagtttcaatgcaaaagtgatagaattttattcacggtttccggtcttattgactttactttctatcaaatactgaacttatgtaagtattcataaagatgcattttgagttaatatctcccagctcgtacgcttgtgtgctgatagaataattatccgcagagcaatgacctactaagtaccagctggaggtacagcttaaccagttgtttgaagggacgccgatcaaggctacgtgttgaaaattgtcaagatgatgcttggaaaatcgaaatcattggcaaacttaaagaaatatgcagcctaaatcacacgctgactggttaatggaactaaatgatagcatcattggttttgaaggtacttgcattttcctggtcagtggatttatggtgcgcacaaatgattctaagttaaaacgaagagttttgaggaaataatatgaacacattgagaagtatagatcttgctatgtttttaaaaagagtggtaatggcacctaatccattgtgaatgaagtacgacaacgttcattatttgtgccttcgttttgagtcgctattttcgaaaagctaccgaggaagtctcacctacgattagtgcagagttatcatggcttactagacgatttaaaaataccaataaaatgaacttctcaagtagttagatatgtatctccacatctagctcattactccagcaaaaatgactgaagcatgattcatcgattactagtcaaaaccgatataaggtgaaagccatgattactactacgtacatacttgcttagacattaacttcacttcaaagttctaacaaggtcatttctgctgccccgatagcaatgtaaatgtgggggcaggaagagtgttccttcctttaagaaattccaattccatgacgaacatgaactccaaaataattccgcctacctgtttgaccagtgagcctgcagcagatgcagagccaccagtagcaagaatatcatcaacaacaatgacatttgaatcggcagggatggcgccaacctgcatttcgaaaacatcttcaccatactctttcttgtaacaagtttgaacaattgtgccaggtagtttaccaggctttctaaccggaacaaagccagcacctatggcaagtgctaaagtgggcccaaacaagaatcctctggattctaacccaacaacgaaatctatctttttatccgcaaatgattcctggatatgaattttgaacgcttcaattagtttctgaaagagttcatgatttgcaaagatgggaagaaaatcttcaaaagaaatcccctcgctcggaaaatcagggtatgtcttgagagcagctttcaactctctagccagagaagcggttgacattgcagttcaagttgaaagtagaaagaaaccaggaacgaccagacaaaacagcggtcgtgggctactcataattttcatttcgttccactaggtcactaggtactcactacctccctccctcttccactaaacttcgcagaaagcacctgccacattcctagcggcacacttatatgtcatcttagcgcctttggggggtttcgtccgactgatgtttgaaaaatataatgacaatccttttagcaacgataaagcaagagtaggagatcagtttaacacgttaataattgaaaaatatcttcaatactgctctacagcaaactccgatgaacttttagaatctcacctaattccttttttaagggataagttaggtattccatcaaaactactctcaaatgctgagaacacaagaggtaaactagtttatcacaacacctcaattcttgatcctaaaaaattattctggtacgcaaatttgttactaatcttgcaagagaatctctcttatattgatcaagcctgggagcttttaactgactctgttacttctgatcaactttcacttgaagagcttgtgaagttacagcataaaattaatgataacagtacctatcaaacaatgaaagatatgatacttttggcaactgatggggaaagaattagtatgaacttcgtagattttgcgatgctattgggtaaacttgaggagatagggtgaatgatatgctgttgctgctatccgcagccgaaataagaacatgtcttcaaaaaatgcatgtgagaatatttaaaaatagagagttgggtcattgtgagctacattttagttgattggggttatatattgattgacctccaaaggcagtaggacgttgattgaggagagcaaattcacaaaatgtgttttgaacgaaagtagtttcttaaataattcacctgccataacccaagtcctatcagaagtgcttttccagctataaagaaatttctaacccttctattcgtggattcattcgtatcccttagtctctcttctcgcctttttagatactccaattcgttaagaatttcatctacgagagactccatcttccgaagcgttacttcagctggtttaagtttttcagatgcctgtactgcattccaatcacgcgcagcagatccagcttcaacttccacttcaatttcacgtacaagtgttttgggggtgttggtagtttgggtgttccaaaagcaaatatctaaagcagaagaggtagcagcaaatgcaaattgagcattgtcaacaaaatcaacgatgtttctatactcatctccaatactattggacatacgaagccttaaagattgaccatcaccagtgaagccactggacttgatgcgagctaccaccaattgaccttcaggaacaaattctctgatgcacttctcttgacctggatttctaccggcttccagctcaaaacgaagcgccgagacgaagctgactattgttgacaagagaaacaaaaactgcatatatgaagggtaacaagtaaggggaccacttgtctgaagtaataatctatgactagtttacatttttctacgcgcttttgatttgcttccactacgtgtcttttggttaagtacactactgtgcattcaattagtccactattacagctagattcatttaaatagacaagtaagtccattgcggaaatttcaaaaatctctccggtcctcttcatccaatccgctccacgctggtgtcttagaacctgaaccccaagcaggagttttagcgcctgaaccccaagtaggggttttaccacctgaaccccaggctggagtcttaccgccagatccaccagaaccccatgcaggggtcttaccaccagaaccccacgcaggagtcttaccaccagaaccccaggccggagctcttccatgttgtggctgctgtacatggccagaaatttcatggcgtggaatatttccacctctcctatcggaagcgacaaaatcttcatatggtacccagccatgagtggactcgatgagcaaaaacgagcacggaatgggaatagttttgttaggattatgcaactccacacgaaacctatcgccattggcttctttaacgataccaatcttacccttatatcctccttgtcgaattttgacggttttattcaaggttgggtcccgtcctgtcatcctttgattcgcaactgggatacttggtgggggtataactcttgagggattcatacgagacaagtctggcccggagatttgaccacccgttccgttggatttgctggtgatggttttaactctattagaagacgtaacaaacaccccttggttttccacaatttcccttgatctcaagaataaaaaatttcgataaacatgcaatatagttccttgtcttctctcaccagtaaactctctaacagtgtcgccaactttgacttccacaccattagaatcgatggcgatttgctgattggggttcaaatttaactttgagtagatagaaacgggaggtaaggataacagtttcccatcgctacaaagaacgtcaaatgagtccttttgggctctgataacaattccaaccaaatcagaattcacttgaactagatcatgcagttcaaatctaccactttcgtttattgagactgtgctgtcagttgatttaattaggtagttggaaaaaacaatgactgtgcgcttcgtctgattggaaataaattctaccttgtccccattgacttcgactatcaaacctgtatcatcagtgtgctttccatgaatcactctcacatgatccccaacgttgaatattttccttaggtcagatgtgggtatttccacagtttcgctgttaatagtatcatcatccgaatggagtctaacggaaacaattgtagattgatttaccgaactaacagttcccgttaaatgatttaactccccatttattatttccacattatcaccaggttgaaaagaaaccaagtttttagcagtttctttcaaagaatccgcaatggtgctgagatcaattgttgtagattcctcattcgactgaaacagagagagctcatttaaagttgggttgatgctgttaactatcaggttttgaagacgaaatgtcttgtataaaaatccctcgtaatattcttcacctccgtaagtaacaaatccatctctatccctccttatagttggttcatgaaccctggcttccgcttccgaaaaaagccgttgagcgggtctaaatttgctggtgtaaaatttccgtcgatttttcgtactatcgacactggaacttgtagacaagtggctcaaatcctttccgtaatctaatctggggacaagtttcaatctagcttctaaaccattttccaatacttcatccacttgggccaaatcgcccttgaattttccattcttcactctaacatacgaacccctagtaagtttcacatctgaactctttacaggtctcaaaagatctttgtattcaacgataccgaccaaaaactttgagttatttgagaaaacgtttacatttcctttcaatgcatcattaatagcttcagcttttcgagcttctatgtaaacatgtcccttgaaactatctctttggaaggcggaataaatttccagtggattcttggtgccttcacgggcaagcttttttttgagaatctgacgaacaacgtctttttctttccccaatctgactttcacaccccaaatacctgggtcatctacggtgggtatcaaaagtctttgtggcgcagtagttgatgcacttcccatatatttgcttgaagcagaacgtccgtaccgttgtttaaattcgtcagcaagttcttgagcatcctgatcagctattttctctctagattgatccaattttctgtgaagtcggtcgtcatcaacatgtccagcaatgaacccttcattttgagtttcgtgttgtatgtggtcatcttgaataaaatcatgttttaattcaacatcatcatcatcatcgtcatcatcttcttcgtcatcgacttcagcctcaacatccagaaactgattgtgtcgccttcttttcctagatctgatatcgccctcttcttcaacttcatcgtcctcatcgtagtcatcttccttgaacttatcaaattcaacatcttcgctaggtacaccgtcttcaatttcattatctgcagcgtcccctgtagtattgtgcgcttgtgcagaagatttcacttgcttatgttcctcttgttcgatgacgttacgatctaaaggtacaatgaattggccatcgttcttgctaagatctttgctctgtaaactatgctccttaacagcttcgcttggcccatccggtgaaactgttgatactttatcaagctgattcttgtgagtttcactcatttagccgtgcgtctgaattgtgaagttgggtttagtttccgttttcattttcatctctcttttcgcactcgataccaaaaataaggtagggcactactaataagatacagtagcaacagttcacaaatgttggggaagtgaacttcattcggacagaaagaaaattaaacctacaatacccgatatatgatatcctcttacttaaatgtaaacattctcctaagcatttttatctatttacagcatcatgagtacagtaacatccaaagggactcaaagttaacagtctgttttactacttcaagcttaaattcatttcttgaatctaaaagcgcctcttgtgaagtcccaaggttttgctagttcccccatttttcttctcttagattctgtgaacagaacatgtcttttgactcgagggtcatatcgtacctgactgatagggccagtttgccttggcctgaggagagtctttgtatatcctgtttgagccgtagatagtagcttgattaccacatttcgtgctttagtttctacacaagttaatatccagtactaataaagttcaaattattttacttacttgccatcggaagctaacagttgtattgtcgaaggtgactagattttcaatcgattccaagatatttgtgccgtacactaacaaaagtgttacatctattattatgtaatgagtctacttcttttctggttcttagagtttcgtgggtatctggggtggttggagatgtcgcaatggcacccatatgattcaagccccatactcgatactatcaacaagctgggtgcactaaaagatggattatataatgatgactcgttgtcggtcgaaagatcattaaaaaagtcgtttcatgataccaactcgtttagaatggcaaggtttgatgctgtgtactattccgcctaccgcattgacagcgagcttcaggatcacaaagaagccaagaacaaaagcaaaggaaagtgtcctctagtgcatgatttagaattactgctttctgcaaaattgagcaacaaaggtatttacagcatagcacatctgaaagattattggtgtttttggattgatacgacagggcaaaacatttcagtatttgagcaagacgaatttctgtctcttatacactcctctacaatttcagtcaagcggattacattgggtatgtttaccagtaatgatctctttcaaaacccatcaagctccaaattgataaacaacatatatatcaattttcttagagcattaaagaagcatctcataaagctctttgcagacaattgccctgtcaaaaattctagctcaaaggtgtttccatttagcacacatctgttgcttcagactgataattttaactactttaacgttttgagattagatctcatgattaaccataagaacgaagtattagtttcaacgacagtagccgagaatccaagattttataatcttgcaagcagagagaatttagaaactacagttcagaaatcaagttatgccatctatctttgcccatctggcattcgatgcaattttgctgtaaatggatgtctcaaagattcaatcacgtccgacccacctaaagattatgagcgattactacagctccttaaaaaatacaataacatattcattgatgaaaagaatacaagatgggtaaaagttgttcccaatgtgaaccatttaaataacttatcgccccacatttctagctttttggaggattcacatactggagatggctcaacaagtctgcgatttattgcgtggcctctttcgttatgttttgtacaatacggtgtcaacatagatggtacaattccaccaagtagtcagtatgaccctttcaagttgttagaccaacgtattagttacattaaggagcaacaaaatcatggagtggaagaggcgatcgaagaacttcaagacttctgtcttcctccagaggaagacaatataaagggggttaaagattctatttctccagcattagaagcaacatgtccttcgccaattgttgaggttgatatctctgatgcttacttcgacggggtgctagacgatgtaatgaacgaagaaataagtctacctaaaagtgaatggaatgaactttttggagaggaagctgaagagaatgaaattgcatcacctaatggagagtcatttgttatgaattcaaaagagccagtcaagctacccaccacaacgaatccgttttatgaagatccgggggctccagaacctgcacctctccccattatctccgaaatatccccttgcgttcacaaagctacttcagttttttctccacttcgattcaatccggtaattcatgataatatagatatcaaatactccacaggaggaaagttttatgtagatcgaagcgagtctccatcaggcccacacaaggactcccttacaaatgcgaaactatttttgaaagcgccaacaacaggagttgggatctcgggaaatagctggactagagaggaagatagtgacctcgaatcggacagtgatgacgaccaggatagactacttaaggaggaagaggaagaggaagaggaggagtataataatgaaaaatatcaagaccgaagagatttgatacaaaaagaaggagagaaaaaggaaaatgataagaccaagatccaagaggacttttatcaagtaatgaaaagttctgaaggtgatgaagcgagcccacaggctgactttgacatgatagatggatcagaccacaacgaagggaaaaagttggaagtagagagaaatacagttgccggtaatttaaggattcatatcagggagtgcaacaattcagccctgacaactattccaattccatcgggtggttctaacgatacgatggacaatttgagccaaaattgggtaccgttcataatgcgaaccgtcccgttgtattctattcccgtctgctttctatacaaagccccgagtttaagcaaagatcgtttgaatcaagagctacccattcttctaaaagctatattatttgatttacctggctccttttctaacaaatgtcgtcatgatcatcaggtgcaatcaaaagttgacaagctagttcgagatgttcttccgggaatcgaaaaattaagtttactagattttgttggacctggcagaataagtgatggtctatttaatatagtaaacagagagaactgtcctagcaccacaagtatagaatatgactccagagactcagtttcaaatgaggcctttttgggatcaccatcgctgccaacgactcaggaaggcttcattgaaaaaatgctgccaaatgacactaatctcttgatccacacaaccccaactatgattaatgttaaacgatcagatgaggacctgagtgtaggcattacttccgcaaagttttggaaatctttaggattgcagcctctcgaaggtcctaacaatttccaggccattgcaattgttccagattttgggccacagtttcttgctcaggccactgattttattggaaacttacaggaggaatataaaaccaacaaactaggagaaatgtctctgatcgaaattgcaaatgattcagtgctacggataacacctaacgaacaagaaaaatcgtactggaaaaatgtgcacgataccttacaaagtcatttaaacgacatttgtaacaggctgaaaccggaaatgccccttctgattatttttataaatccttttacttcgttggtcagcgttatagaaacttcccaggttttgagagaattgcgagattccatatctcgtttgctgaacttaaattcttcttcagaatcaaagagaaggaagaagaaatcaacaaatggtcctaatgcgaattatagaaaagggtctgagataaaaaatatttccatttcacaaaaaagcattccgttgaacgattttttttgattgatggcagttactgtgtcccctctcaaaaagtgttaacaagaatttcactgcagttatactgtttagtgactagcggtcattttacaaacaatattgcgctaattgcacaagaaatcccttcagcaattaatttcaaattaacaaaagtgccaattgctagacaattgatcatagacgacttatatatccatcttgcctatgacagagctacagataaaagctggtgcgccgcatgctggaccgatcagtatggtggcctaagggaagtgaaggcatggtattcagagcgaagaaaatttctgaatggaggtgctaacctgatgaaaagttttgaagaaattagcaatgatatttggagtatcactatggaatacattaaatgccaccctggaaagtcatacttgattttaacaaggttgaacaacataattccagatgacgaattgatacagtggaagaggttatcactattgaataaaagtatttatttagtagtccttacgatagacttggaaccgactctgaagctaagtggggtaagcagagaaagtgagggcagcggtggtgtcaataatgtgatgaccactactatgtatcctgactccactgccgggatatatcctaacaccgccgaatccctaggctccagatttgacagtccggatattagcagcaacatgttccaaacgccaagttctccggcgtttaacacctctggaaatttttattcagagtccgatggaaccattgtgaacatctcagaggaacttctcggattagttctctctatacctgtgccactttcaaatcaaatcaatagaatacctatacgaacaggatatttgattcaaacggcgaatttgacggaaggaaagagcattttggaagtgaatctattaagttgtcctgctttcatcgatcctgtagacttgatgaagaagatgctttgccaatatcgaaatttggcagacctaaaaaacttttggtacgcttcaattgtagatgaaacatgcaatccgttcccgtggcacattcttactgtatctaagatactcaaagagttggtacacgttggagttgatgaatgatcatccatctattacatcgctttgatatacctgtataactgcatccaataaaatggttttcaattgtgtgacttagattgcctcgtggagctgcccattaattctattggaacatcggcaacaacttctgttaggtagtaaacgcctcctttacaggtccaagaaacactattttcgctgtagacacttctcttagttttcataaaggataaaacattggtcaaagtaaggtcatcgtgaatggtatagttgagaggaatcactggcttaagactgactatttttgtcccgatactttctttgagacactggaaaagagaaatgactttcgagttcaaagtggcgtcaaagaggtaattgttcaccagtattacttcacatttggaaaccacttccgaaacctgtagattatcttcaaaggtttgtctcagaaaaaactcaactttcccaggcttgattccaaagatatcgcatctagttttgaactcaatcaactgtaactcactgaggaaagaagcatgttccataatttcgcagccgaaactttcacacccatactcaagagcagcctgaaagacgcagtttccgacaccagaacctagatctatgaacttggaacttgaatcaagtttcacttcattaaaggcttgcgttaaaaagtttggaagtaattctccataaacataatttgagaacgccttgtactgacggagctttttcgaatttggagacacagtgcgggcataaacttgattaagaatctcataaatcataggccggggtacttttgtctgggctcttatatgatcatatatgacaccagaacttcgtaaactatcaatgagtatgttgtactcttcaattttcttcaagatgacctcgtaatgcgatctctcgtatgccttaataaactgtccaacgatgcaattcgcaaaggaatcttcattgcgaacaagggaggcatacttcaaggggagataaaacaatgcggaaatctccatcattcgaccaatttcttcgaaaggatttagttcttcgtcctttggaaaaataagctgatatttttccctataggaagaaacaggcatcgataaataaactgcagttgggggtaaattttcatcgttccagtatcggtttttggtttcgttcactagagcaaatgcagatttggcattagagatagttacaggagattcctgtttctcatagatctcgtctacgaaaaacttcctgtttcctactaaaacactttgactttcattgtgaggatcgtattcaatgaaccaaatcttgttttgaaacctttttgaaggctcttccaaggtgggctgtttgtcaggactttcaaattgagtttcaacttgaggtaactcgttattcttaatttttaagcatacctctttagatttggctttaatttgttcttttcttggtctctcagattccttcttagctttcttcgaacctgtatgagtttcctgcgatgtttgagaatcgtgaaagttgcaacggttgttgggttgagttaacctcttcctttgatgcttggaagaaaagtactcaggattatcccttaaatgccaagcagcccctgcccataggtctttcatttccctagtcatacccagagcctttggtgaagctgatcttttatcggtcaagatttttgtagccttcgtagctccctttgtttttgaaatacaacttgtcgaggaaggagctgtcttaaaattcgtttggcaaccttgagtctcaatcgatttgccttctttgcacgtactaattgccgaatgattggatttattatacggcctaggagatacagtactttcgttgaacgaagatggcctgtaccattctgaatcgtctagaagctgagctatgtgggcaggcttagatccagatttgctttctaaaagtagggcttcttgaactagctcatcccgagaagtctcatctgtctgccacaaagggttgatatcaagttcttttgagaggcagcatgcattattttcgtcctctatctttgttccacccataaatacttgtcaaaggtccacacacactttaccatcttgaaatttcgcgttttactcggtaaaaaatacgataactcaaactcagtctacacttagtattgtatataatcttttaatcgctcaagacacctagccgcttctcgcagcatctgatcatccttgcagacggcaaatcgcaaacagtcttttaccaccatcttatgttcttcaatgaaaaactctgtgggtggaattgatactacaccgaactcttgaattagccagtagcagagtttaaaatctctaggcttgttctgaatctcctctggaaactcgacagagtctggaaatttaagcttcttaaaattcactagtaggaaataaccaccttcggcaatagtatagggcaaccccaacttgtcaaatacgtccgtaagaattttgtatttgtaagtatactgcttacgcgtttcctcgaagtaacccacggatttggcagttctcaaagctgatgcacaggcaatctgtaaaggtgaagggctagcaaaacagatgcgggtatgcgctagacaagcaacactgattaaatctttatgtccgatcaaccacccaatgcgccatccagtagcagcaaaggacttgcctgcactaccgactgtaacagttagccgggaaatctccggtgaaagtgttgccatcttaatgtgttctttgtagtaaaggttctcgtagacctcatccgccagaataatgatgttgttccgaacacatatatcacctattctttgtagttcatcacgagaaaaaacttttcctatagggttatgcggagtattaagcactatcatctttgtcctttcatttattgagttctctaactcagtaaaatttattttccagtcagaggagtttacagtttcttggtcaaaacattgagggggatgcaatggaacatacaccaccttcccaccaggaatctctatattactgatgtattggtcaaaaaaaggttcaaaaacaacgacttcgtcgccgggagtcaaaaatgcaagaaacatggataacataccttcattggcaccggtactaaccattatctgggatggggttagcttctctgggtaataggaagaatatgcttcaatcagtgaaccaatcagctctggtctccctctaggaggtgcatattggttaaaggcaggaacgtctagtgcctctttggcagcttggattgcaaatggaggaggactgtaggaaaaaaagccttgtcccaaatttacagttttcttcccagtaagagattctctagaagcagcagtctcattgactaaactccatatatctttaccacctatctggaaataaggattatgcttaggtagactggacatcgttcttcttaatactgaccttgccattctaaaagtttgaacgggcaaaagttgaagtaatatagaaaacacgtgatcttttcaacatctggtaagtgagactttccccagctctctaataagctttcgtttttcgcttagatacagtaaggggcggggcgtcttacgctaggaaggcagttgtctcgtcccagttccagtatcaagaaaaattctatccacccaaggtgggggaaacctatatatagcaagtagttgcattataatgcaaacgcctatcaagtcagctcgccactttatcaatttaacatttattgtggtttgtgcaagctatgaattttttaactttacagattattggcatagctgcataacttgtagaaggactaattcctcattttttccctcaggctttctcttttgatggagttggctacttttcaagcgtgttgatttacatatcaagacctcatatatccaaccttatgatcatttgatctcaactgagtatttcaatttttctaacttcatctccataattcgaatcatttctttcaattgcaatttttttatgttgatgttctccatcttatccccatcaaccctgtgatttatcgattcaatccatctccacaaatcctcttccttctcggcataaagagaagaatctggtgaaagattatctaatgttggaagaagcatatactcagtagaatcgattttgatttgcctcaaaccatttccggtttcattgatttttatgttcacattgcccattttaggaccagctaacatgattactcctgcgactattatgatagccacatatactcgcaatgtctctggtattaggtctacaatctttctgattggacttagccatgcatgagtgctttctagagatgaatcttcggagagcaattcatcctcaagtttctgaacagattttcttgatctagatctcttctgccttaccggcctttccttagcagaagcagccaatgtgtgcttgagctcgttcaccacaaatttccaatattcggtttggccactaatgctgctcttctcaattacccctttcacccatgattttccagaccattcaatcgatgtaagcacattcaaattggtgctactattcttaccccatgtaagaaaaatatttgtctttaccagaaaagaatttccgcttggtacatcaggagtttgcgtagtttggataatatgaatgcaggagttcaaatcaaagttttccaccatttctgtaacaacacattttgtttgtttcggcccaacaggaccattcaatggtttgatgtatgaatagtttctttttgttggcttgttgctatcgaaagctgagattgactctatattgaaattcttctgcttggagaggatctgctcattaaatttgggatcaactagcaataaaaaaaccacacctagaggtgcagatatagtatcatcaacaactatagtatcagttgcttgcttgtcatatccaggtttagtctcaggatgagaaactgctcccactgaaggaaatccattccattgagagtctgttgatgtctccaacttttcagttgtatcttgcggcggacctgttgtgtttcttttaagcatcgaattatcttgggtcgaatttgacgaggtctctgaaacattgtcatctgaagagttgtaatcttcttctaaattgccgtcctcattgctgatgctaccatcagatacatattcttcttcagttgataagtcatcatcagtggttatatcactatcgctatagatatcagatgttttcggccttgacatctgatcatgaacaacttggttccatacattcgtcaacagatcaaaagttatatcccttgtcagaaaagtggcgaaaatgtgcttggtatgtaaagtttgaataacgattccattaggaaataggagagctgtgactttcttgctaatttgaacaacttcactaatgggtataatgacagtcgtttgaaatcctaaaagtttactgtaaaaacagatatgtgcctcgctgatgtaaagttttccttgaactaacaattccttttgcaatgcacagctgtaatcttcaattaatttttcatcttgagaaattgttttgaatatgttatggaactcttgttgtcgcctttcgcttgcataggtaatgcctttcagagattttcttctatgcggcagtgagtgctgctgtttgtaatgtaacctgtgggcgtaatcttcctggccaatattgccagtcaaagattgtccaccgtttactctagtttttcggtctgaatttaaagattttgtatccatatttgcggatgaacgattcaatgagttagaatttcgtctattgggggatcttgatctagcaggtaagtaaagacttgtgtcttccaatggctgtgaggatgtgggtctctctgtacgattgtatgccgacgaagacagtgacccatgtttctggattgtattaggatgttgaaaaactttatcaaatagctccaacgatagcgagccttttccaagtgtaaccaggggagactcgaccttcagaggacgaaattggatattagtgagagaactatgctcatcggatagcattctgtcaatattggcaccatagggaacgttatcacgcattctatgatcacttttttggctctcgatgtttggatattcctcactctggatactggtatcagaataagcatcgttgctagtgatatttaccagatgacttccagcattcttagcaacacttattatggtcgacaaaaatccacttttctcagctgatacgtcagaagacttgcttttcacagactcaatatcttttttggctttcatgtaagatgagtgtgctaaagagggtgcacaagatgaatttgccgaatgacgagaagaatcagtagtgggatgggctactggacgatttacagactcagtaacattgacacgtcccctggcctcagatttaccgtttgacagtatgggaaactcttgtaaattagagttattagtttctgttgaataaatcgaccccacacgatgcttttggtggtacgagtcaccgttttgattatttgatcgcactgaatttatagggggtaaattaagaactgaattaccgtagtctgtattgatggagaaattatcagacgggctgcgtttgggtgagttgtccatttgggacggtgctgatacttttctaaaacctaaagacctggaagagctcgctattgattgtgatctagatctcttaaacatgtttttgaagatagctttagactctgaccgtttccggttactcgaattgtcttcttgacttgctgacgacattttactagaagtaagaatatttattgaaagacaacaaaatgacttttctcaactcgatggtaaattgtattctagtgattatgtgcttaaaacttagaccattaggacaaatatgcaatttgtaaaatacagtagttctagagcttgaagcgggtcgcaactgctgaaacagacaaaaagaaaaactaactaactactcgcgaagacactcttggattaattaaatattcctaagcctacccaaccagaatttcatgaaataccctacctatcttcagcccattcattctctctacgaatggcagcttcctcttcagggctgaaatcgtttacaatattgaaggttttgcgaatttcctcaggtgatttcccacgaatcatctcagctaccatcttacatccgctatagagaagagggcgaatattaagatagttggcagcaagaattatctcgtatagcatttcttgatcgacattgagaaaattcttgtcccattcatcaattggtggcgttttcttagaatcttcatcctggttctcatccggaaaagagatgtctttgtagtgctcacaccattcaattattagtttgagaactgtagagcgaacgtttggtgttggaatttcaatcacatctaagtcgttgttgtcaacggcggcagcatctcttagaagttcattgtcatcgtcattatctccattgtgatcttcgttggagagaagatcctccaacatattcttgatcaaaatagacttttcggcaaccttacgatccaccgtaaacttttcgttatcagatgaaacaatcacaattttcttttctttggacatatttggttcaagggagaaagataatagaatccgaaacgtgatcgctggtaattaacacgaacgataatggaagatacacgacttttggtccaacttgtatgcgaacagatattttaaccagtaaacatagtctaacacagttcttcactcacagaattcctagggtgctctctcattcaacacttctttgagctcctgaatgctgtcccaaatagctaagtatcagatctactttactatttaatgtctgatccaaacagactattttggcttctaaaagtttaatttgttcttgcaattgtctaaattgaggtaaattgcccgcgtccaaacaaacggattcggtaaactctggtactgcagactcagttttatttggttgaggagttccagtcttagaagaattctgtgggtagctggcttcgttcgaatcaggataccctgaaagatgggtttcaggttggccacttcttacgctccttgaggttggccctgacactacgctctgcacattagctacatctttccgtagcaattcaccgtcaatatggtcaatatagtcgactaaccgtcgttttgctatagagcgttgtccacatgtgttctgtaatattgtgtagttagaatatgatccggagcgatcatcatgaacagtgtatgacaaattcgagcctgccatatcctgttcatctctcaacctttttgtctgatcaatcacagcggtatttaggttatctatatttttcaaggatttgttgattttctgcatcattccttgaagttctgagttcatagggcgcacaccatcagttgtacgtgttcctttggggaacgtacccgaagtaccggttacacaaccaatctgattagcggtaacagattttgctaaaaaagctgtgtaactgcgctgtaatgctttgaatcgttccttcagtgtacgtccctgtttaaactgaacatttgatttttcattgaagacattgagagcggcattccacgatttataagggttgcgacacgtcgaaagaatatcgggcaacatcgagtagactatttctaataaacacagatcttgactgtgaatccatttgtgtttattttgagattgttttaaaggccccagctttactgattgtgcggtcattgttttagatttcaaacaacaagaacatactaactaataacgttagagtaaacgcaagtagcgccgaagtactaaaggccatgctagtagtgtgcgtctcacgtttaccaacttcgcgcattctgagccttccgccaccctccagaatgtttcttgattcagctatttaggtacagaaactctcagccctgcaaaatgtttcttacaagaagtgaatatgatagaggtgtgagcactttcagtcccgagggtagattgtttcaggtagagtactctttggaagctatcaaactaggatcgacagcaattggaatttgcacctcggagggaattgtcttgggtgttgaaaaacgagtttcatcaccaatgttggagagtagttcaatcgaaaagatagttgaggttgacagacatattggctgcgccatgtctgggctaactgcggatgcacggagcatgattgatcatgcgagggtaagttcattaacacatgatctttattatgatgaacctgttggtgttgaatctttaactcaatctgtttgcgaccttgctttgcggttcggtgaaggcgctagtggcgagaagaggttaatgtcaagaccctttggagtagcactgttaatcgctggttttgacgaccaaaagggaccgcaattgtaccacgcagaaccatcaggtacattttacagatatgacgcaaaagccataggttccggatctgaaggtgctcaacaagaattgcaaaacgaatatcactccagcttgacactgaaagatgcagagctccttactttgaagattttgaaacaggtgatggaagaaaaacttgactctaagaacgctcaacttgccacagtaaccaaggaaaagggatttcaaatttataatgacgaagcgacttcggaactcattaagagtcttgcagaccaagacgttgacgaagaaagcgagcagatatagtttgtggaacatatgctttgtatctgttcgataatgtttttctcatttcagtcaaccatatcggcgtactctggtacctctcttatcttgctcttcataaacttttcaagcttattcgcgttcttgtaatatgttgtgctctcattgttgtacgatctacaattgttgaatatcaatgtcgcatcatagatgaaatcttctagtgtatggtaatgatcattttcaagcttcgtctccattgtagagaggtccataggctctttgatcacttcgtagtaatcaggtacttcctcacgattcaccgattgcagaaatggccacgaggaaggctgattttgtagttcggttatgagattagccatgaatgcatgatggggacctcttttgggcaattgagccaactcgtccatttcccggacccaccctgcctcctttaatccaggaatttgcattgggtcgacagccttaatcacatttgcagacttgaactgtttcaggcccggatgaacaatattagatttggatatagatctgattttcttcaatatggccgctttctgtaagagcaagattttagaagaatctaggtatcgaattttaggtagaatagaacattgcatcaaagtgccaccttcataatccttgatataccccatccaaacccttttgtcaagtgatatctccttactaaatccctgctttttgaaatagccaatagcatagttgtctgcgtatgttaaaaaatgtttgatgttgcttgttgctttaacgtagtcttttagatgattcattaggtgtgctccgtaaccgcggacttgttcagtagaactaatggcgcaaaacacaatttctgcaaattccctctgattgaaaggtttataagtgatccccccaactacagttaaaggcttcttgataattgcaatcgataaatgacttcgatcatacaccaggcgagatatatattctcttggcattttaggaagctgtttctgaaaaatgtttttcaacccagtcagaaccataatactttccttggtgttatcgttgtttactactctaaattcaattttaccctccttttcctcaataactgctggtctttctttgaacgtgtatttttctccgtaaaagtcaaactctgtgatatatttattttcttcatcgttcgaattcctttcagacaccttacagtctttaacttcttctgcatcatcaacatttttcaattctgcatttgtatcctcattcatttgaaagtcttgactaacttctattttcataggagactcgacgacatgctcgttttgagttgcattatatttggtccttttgttggatgattcttgtctcttttcattattgatgcctctcctattcgtgtcactggtcatatgtctaaagacggataccgtagttaaaataattggtgtgtctttttttgtcttgatctgtctttgaatctgttttggctattctagatattggactaacgcactaccataattgaagaaccaatcgactgatcaaacatcatcatcaaaatatcaaataatgttagagaagtcttcgacggtgttccatccagaaataaataatacgataggtgatatatactctcttacatgttgttccatgttgattatcgtcaagaaaacatcagtgcgctattgcacaagacgttagcagtataattttgtgttttagagatcgaaatctagatttttggattgtagactaatagatggtggctgagctcacttgagtcctgagatatcaccaataaaagagaatcgactttaattgttcaaggttacaaaattatgattcaggtttgggtagttaggaagagcatcgagcatctcgtttctgcttttcatagccacagctcacctacctctattgcagtatgtcccaagcatttaatttggtcctttttacagaaatcaaacaggctcaaaatgtgaaaacaggcaacgataaggaacccaattccaagttaagagcaattgtcaggatatctgaacggagcagcaaaaaaactcctagggccactcccagagatgacttcgtttatacttggaactcgacaatatcacttaaactccgatcacaactgaaacttcctcttatacagatatctgtgtgggataagcaagctcatagaagtgtttatgttggagaagttcgtttctttcttattggactcctcaaatcgttggcttacaatgagcataccagcagttgggaaagtaccccgcaatggtatcagttgtattcatccgaagataagaagtcattttcaagtggtaccatactggttcaatttcgggttcaacaacatttatccaagaagaacctttttttcaatgctaaatctgatgttacactcagtgaccaaactgggtcaagtgacctattgaatcagtacattcaagccatcgaaacatctactcctaggtcacttcagaagaaggcatttgatttatctaatccaaacgaacaaagattttatcctgatatcgagactaatgccttggcctcatctatccttgactgtgaaattgattcgatgttggaagatttcacatacagaaaaccaaatatcaccgaatcttcgctgcacgatgatactttgactgatactgattttgaatctatacactctgatcctactattccgagcagtgctcttgttccaaagagtaaagtgaaaactaacaatcaaaaaaaaaagttttcattacaatctgacaatgatgtattaggaatattgtttattgaaatactctctgtcactgacttgcctccatataagagttttactagggcgacatttgacatggatccgtttgttgttatctcttttggcaagcgaacttaccgaacatcgtggagaaaacatacacttacacctgtgtttaatgaaaggttagcattcgaggtttgtgactacgagaagaactatgacttgcagttttctgtccttgataaagacaaattttcatttcatgaccaagttgcaaccggatttgtttctgtatcagagttattggaagagaaaacgacagataaaccctgcacagatttcaaaccaacatcttccaacttaatccttctagataagccaatgaacgctaatgaaagtgcggataatcttcttgacaccaagaagaagaaatataaaaggaacgtaaacacagatgcgactttacaaggtgggttactaagaaaatatgaattagtaatgtcattggatggaaaaaaaaattggagccgaaaaacgaaagatgagtatatacctatcctaaaattcaacacgaggttcgagcgatatgaaattctgagaaggcaactttggatgcatttacttcaaggcaacgatacgcagatgaaaggaacactagatttgattgaacttaattattttgtggactgccttggttccaatttgtctgataaaacattagcttctttctttgaatactacgacaagaacccttgggtgggagaaacattgacaattgaacaagtgattgactcccttgagagactcgttttcaaaaggcagtgtgcaaacacacatgaaaactatattataaatattgacacatgtccactctgtggccaaggtaggctgtcactaaggcaagaccttgatattttgaaacatttgtcaatctgtgcttctcgtgattggagcaccgtcaacaaggttttgaagccctcttttgtatcttcgaaagcagcaactaggcggtggtactctaggcttctgatcaagttgacttttggtcagtatacattgggaggcaatagtgcaaatattcttattcaagatcgtgacactggctacattcttgaagaaaagatgaatatccacgtcaggctgggaatcaagcttctttacaaatcttttgataaagctaacagcagaaaaatcaagacgttattacggaagttatcaattaggcaaggaatcaagttcgacagtccgagctccgtgtctcaaatacctagtttcattaaatttcataaattggatgtcgatgattgcttgcttcaactggatgagtataaaactttcaatgagtttttttatcgaaagttgaaaccaggatctcgtcctcaagaagatgagaataatagcaatattgctacctcccctgctgattgtcgatgtactgtctttgaatcgattacttttgccaaaacattttggataaaaggaagaaatttcaccactaaaaagttatttggaagcttctactctagggaaatggcagatctctatgatgaatgtagtattggaatttttaggcttgctccccaagattatcacagatttcactctcctgtaacaggaacagttggaaaagtgcaatcaatcagcggtgagtattttacagtgaatcctatggcgataagatcagatctagatgttttcggagagaatgtcagatgcttacttcccattcaaactaaagaattcggcagggttttagttgttccagtaggtgcaatgatggtcggctctataatactaagtgttaaggagaatcaggaggtgaagaaaggcgatgagttgggttatttcaagtttggcggatccacacttttggttctgtttccaaataagagattcaagtttgattctgacctcctagcaaactctaataataaaattgaaacccttattaaggtcggtatgtctattgggcatactcccgaagagccacaattcgaaagacactatcgatcttttgaagaagagcctgttgatcaacagttgcgtatcattagatgcattacgggcgggtcgacttttgaagaaagtaaacaggcaactcaaaggagaaatgagctactgggtaatgaagggtcaccacaggaaaaagatctgcaagtagaaaatcttagttgggaagcaaaaaacatgaacctggaggagctggaagaaaatgagtcacttctattatatgaccttgtcaatgatggcacatagttaatgatgcactaccgaaaattcaaacgatggaagtatagcattagacaaaactataaacgaggtcagtatttcgaagtagaaacggagactccactaagagcatggttatcgacaaaccaactcactcgagtagataatttgtttacgatttcgcatggtaaattggtcttttcttctccaaaaatttgccttaagacaggagattttccttctccttcggcgacaaaagctatattagaggagttctcaaggactggaaatgtgaaagttattctcctcgaaggtggcttgggagaatctgatatagcagcaatgcgttttgaggtttcccttaatagtttgtggttcggaaaaagggaacaagtatgaccatcaggtccacatcccaaaaggacaagatccaaaacactgggaaggtgatgttcatactcacttgctatcattgcatcgtttattcggctttcatctaatagatcctccttgatggtgacaactcttggtagtggcattttgaatttttgtagaggcttcaaaaccatttcattgaatagggcataattggagtcctcgtgattgagttttactaacctttcgtcactgaaatacacatgccatttatcccaggcaatttttgatctgttctcttgattgtctatcaatcccttctttaataccttgccaagggagcctccactgacagcgatcctaaaaacagtattagtttttagtacgtgatcctgaatgtctaatatgtaattggctactgcattagcaatttcatcagatcgttcataggaatagatttgtaccatttcgatattgttatgggatggttaacagacgagaataactaaggctacctaccaacctttttattaacagttcgagaagtgtagcgaactcgtcggtgtatattagtcttaggatgtttttttggtaataccagttgtttaccctttttttttttttcttttcgattatacagatctttctataagctgatgcaaaaagaatttataacctgtgatttagtctttaagttttccatctttcgcataggttctgcgaattggagagggagacaaatagtgaggatttgcaacacgatgttgtaggagtatggtttcagtgattcatttgtcgcgcttctcagagccatcctttgttattccagagttgtagtttattcacgttcagctacttctacttcttttagtattgctcgcttaattcagtttctttcatcgtgccatcaatgtcagactcgatactttccaactggttcaattcattacctttatcggagtatcaacaagcctgggaaactacagttagtcatggacaaccaaaagttccagttactgaacacttaggagacccaaaattgaaagtttctaccggtccacttcttcgtttggtctccgcttttgaaaataagtccaataattacagggcaactattttggtggtgacaaaagacgatgagagtgattattcgaagaacccaacaattaggtatcatattggacccgctcaccgaaacgacttgaaggaacatctgctatcggatgtcatttcaactggtgaatttcctgtaatcaagcttcatcaggagcaaggctacagcttttggagattttctgttgagcttgatttgattcattacgaacagagaattaagtactctctcaacggttttattaacgatagttatcaattttttgttccaaggaatgaccaaaacatgaatgttgtggcattttcttgtaatggattctctttaagtacggatacctccacttttaagggttccttatggctagatgttttgcgaaaccatgacagaaagaactatcatgtgatgattgggggtggcgatcagttatatgctgatgcaataaaattgtcctctgagcctttttcaagatggctgaagcacaagaatttgcattcaaatatgacaatgaacgaagagctgaaagcatcatttgatcagttctacttaaatcactatttacagtggtttgggtctggcttcatgtcaggcttgaaaggcagcactttgcaaactgcatttccaacggctatggcacaaattccctcgatttgcatatttgacgatcatgatattattgacggatttgggagttactctgataggaccatgtctcaacctatctttaaaggagttggtaaagcggcatttaaatattatgttcttttccaacatcatagctctatagaagaggatctttccaaggagcctggaagaatccttggatatgagccggggcccttcattgaccaaaaatcgatttctcttttcacacgacttggaaaagacattgctactattggcgttgattgtcgaacagaaagacgtttgaaaagagttattactcccgagacgtacaaaagaatttttcttaaactagagacagagtttactgctgctcccttccaacatctttatgtgcaattaggtgtccctattgcttatcctcgtttggtatggttggaaaagttgctcgactctaaattattagctccaattaagtttttggcacggaaaggaattgttcttaacagtttagtaaatgagtttgatggatccgtagaagttttggatgacttgaatgaccattggtgttcgcataaccacaaaaaagaaagaaattggttcatagaaaaacttattgatttctccgaacgacacaaagttcgcattaccatcatttcaggcgatgttcacttgtgttgtgttggcagatttcatagtcgaactcacatctctcacccagtgccttcagatgctgtaaaggaggagaataaaaacattttgaaagctccagaacatgactcaagactaattttcaatgtcatcacgtcagctattgtgaacacacctccaccagatatgatggcaaccttgttagacaaaagatcgaaagttcatcattttgattcaactacagatgaggatatggttccaatgttcatgttagatagcaatggaagaaaacgagacaatgttcatttcatgaacagacgcaattggtgtgagttgattccagtcaaaaatctgaacagttcagattataaagttaaagatagagttcttcctggtcctgtagcaaatcaggatgatggtacctctgctaacgcctcgactaacaatattgaacattacacaccctaccctgtcactgaggaaggtgtggtaatgtttcttcatgtagaaaaaaatcatgaggatttaagtggggctacttcagaatatcagctgactattccctccttgacatagcttctcttagtttgtacctatttattgaattgttcctcttgattgtcctcattcgcgtatttttttgaaaaatactagttcaagatgctatgaattactcttgcctgtaactttgaagtgcagcatgggagttttagagaaaatccaacaaattcaagaggaactagctagaacacaaaagaacaaggctacagagtatcatattggtcttttgaaagggaagctagcccgttaccgacaacaacttctcgaacctccccccggagcgtcatcttctccaggcacaggttttgaagtttctaaaagtggagatgctagagtagctcttattggcttcccgtcggtaggaaaatcatcttttctaggtaagataaccagcacgaagtcagaagtagctcaatattctttcaccactctgacatcagttccaggcgttctacaatatgagggtgcagaaattcaaatagtggatcttccaggaatcatcaagggagccagcgaaggaaagggaaggggaagacaagttgtggctactgcaaagactgcagatctgatcctaatggtgttagatgccaccaaaggttcagatcaacgacaaattttagaaagagagttggaaagcgttggcatcagattgaataagtcaaagccaaacatttctttcaaagtgaaacaaaatggcggaataaaattctctagtacgaatcctcccagatatttaaacgaaaaactatgccaagctatcttaagagactatcgtatccataatgcagacatactgataagagatgatagttgcacggtagaagacttcattgatgtgataaatgaaaatcatcgccactatatcggctgtatttatgtttacaataaaatcgatgctgtcgcattggaagaagttgatcgcattgctcgtgaacccaacactgttgtcatgagttgtgagatgaacttagggatccaagacttggtagaggaaatatggtaccgcctacacatgacacgtttgtacactaaaagaaggggggttagtcccaactttaatgatccgatggtcgtgaggcaaaattcgacgattgaagatgtttgcaattctattcataaggatttcaaaagccagtttaagtatgctttagtctggggatcttccgcaaaacatagccctcaaaaatgtggccttggccataaggtgcatgatcaagatgttgtttctattgttacaaagtagtttaaactatcattcttaactactgtcttcccttcattgttaagaactaccgagtataaacataattcataatgtacttagtaccttatataaacaggtctgaagaaatattcttgaactggccctaatgtagtttggaagaatattcgccaatgatgtcggatttattctatctttaagatttcaagaacttgattttgccaaaatttcatctcgatcctacatttggctacaacaggatcagaaacatcaaatgcccagaccgggggcagtagctaaatatcaacgttttcttttgaaaaaactattacctgcctgcaatactttgcaacaagctcggagagaacttttttggatacagaaagagttaccaagtgaacaatggaaacaagcttgtattcaacgagggcgccatctgatgccgcttcaatatattctgggcaaccaacccttcggtagcgtgaacattaaatgcagacctggggtattaattccccgtaatgacacggaagagtggtgtagtgaattggttgacgtatttcgtggaagtgacactttttctgtgttggatatgtgtactggatcaggttgtatagctctgtatcttgccacagaattatctaatgttacagtgttagggggcgatattagccaggattgcatatcccttgctaatgaaaatattgacgtcaacaaagacattattaagggcaagatcaaagttgattcaatggacttatttcaacccctagctggtgataagaaatttgacgttgttgtttcaaatccgccttacattccaactcatgaattggaaaaacaagaggaagtagaaaagtctgtaaggttgtatgaaccaaggcttgcgttagagggagatcttcctgtgttcaaggccatggtaacatattacataataccctctcaatgcaaggtgttcatactagagataggttccagagagcaagggcagtacacaagatcgttactggacgagtcatgggtggtgggattacgtttagattctgcttttaggcctagaaatgtaatcggttttcgaacagacattgaatctagtattaaacgcaaactaatgactacaattattgaactttttaaaaaacaacgttgaaaaaactccatttttcattccaacggttgtctcgtctctactttggggtcgtccaacttcaaccgtttgcttttgattcctcttccaactgcagttacacctccttcttttggtataactcgagtggcgtgcaaaacgtaaccaccacctcctttagttgtcatcaatgggtgaattcggcctataattgtctgatactgtctcacacgcgtctcataaatactaggtgccagaattctatagtctttctgtagaacatgaaacgtttcactcaagatctccttaaaggggctgtaaatgactaccgggcgagacccgcccaaagtatctagtatccttggaattagagttggggggtatagcgtcgatgcgtatatcaaaccgtcaaaatttccttgttcaacagtgtccaaaatattattaactctgtcagcagcccttttctttcgtaagtaatgtgagcgacgaggaggagttaacctgtcaattttttcttgaggatagttattccattgcggcctctgtgtgtccgcttccaaaaattgtaaccagttgagattactaaccatcttttccagtagctctggagaatagttagagtagttaagcgctattaaattagggtgctcattttcatgggctaccaaaattgatccttcattttccattctctctaacatggcatacaggagaacacctccggtttcatcgactagtatgtagttgccacctgggcgaatgttagcatagctcagaataagtcccaaagactcattgctcatgtcaagaaccctttgaggatccttaagtctgtaatattgtaacatttcacttgcaccgagataatctatagtaaatcggcgtaaaaatttttcttgttttcgtttcaagtatttttcttgggaatattgagtcttcttcccaaaagagtcatggccagctatgatttggttgatgatatcttggcctttcccttgtttcttgagctcttcgatgtcttgagtacttagcttttgaaccagcgatccggtatttattagattttgattattctcgctaaacgtgttgctatcctccaaaagtaacggttttgagtcgtcaatgagactgcaaaccggtttcaccaacttgttctccaaaatttcaaagctttgcccaaacttatatcctaatacacctgaaactgagaatgttccaaactttcccaaagagatacatgagtcgcctttcagtagtaccactttcaccgcttctgaaggaagacgaaccaaaacgtgtttgccttcttctattatattgcaccccggcatggaataaaagaaagtgtctccaggttttacgctgttgtaaattttccagatcaaaaatgttgaatctctttcttattgttgagacttacaacatactgctcgaatctttccaagcgagagaaacaaacagtatacgaaacagtataccatagagtaatcctgattgacgaaaaaactacataaatcgagtacacaatccaaacttaacttcttaattcaaatctccggccacttactgtcttcctttccttctcttcatctatgctatcctgacgagcacggttcaatactttcatgaactcacttacgcgataacgcattcgctggtgtaaaaagcatttaactatcttgatgtgataatgaaagtatgagcgaaacaattggatgtgttgaatagtgttccatcttacatccacggaggaaaaatgtctagggaagagtacaaatgtaatatacgtcttctcttcaccggttgtctcattaaaaggattgcttgtaaggttacggatttccaatggcggttctctatgtgagtttatcacctgcggagccgtttgaatggaacgttttctggcatcgctaaactcttgaaggaacactttggaaaataccttatccgtttcatctctgaaaactgtggagaaaataacagtaacccggtcattcgatggtttaatgtatataacctccgagtcacgataattcaaaacgaatacctcttcggtgacagtactaatatcttcgccataaatattgtttggatcaactggcccctcggcagccaagatatcgtgtctgttaaatgccttgtaaaacggagctgagaaacaatgcgattttagcagagataacctcgatgctaattctttcttgttttcgttgtttgcgagtttgaattgagtcaggtcgacatataaactaaaattccatccagcctcaggttccgtgagtataatcaactcatcatacttatctttcaatatttgaaacacgccatatttgacaaggtcattccagcatttgatgttgatcgaaaaaagtaatttttctttagactcaggagttgaaatatggtaagtagtaaaatcaaaatcagtgataattctgtctaatgtagctggaacgtaatcagtgtcaaacgcctcgagaaaagcatcttctaccaaaagattttttgcatctaattgaagcattttctccgtatgttggattaaggaatgctagataatgaaaacaaacagttaatagaataaggagaaatgccaatgatggtcaccgtaacctgattcgaataaagcgcgaatacgatagctctaccatcctcagtgatttgctcagagaagaaatgctatactgccaactacaagcaagaataagaataaaacggctagatagctgcctaataactctgcgataatatgtacaaactctttttaattactcctttgcaggctttttaacaccatacttggatcgtgcattgaccctgttggcaactccgctcaaatccatggctcccctaacaaggtgatacttaacgccaggcaagtcttttactctaccacctctgacaaatactacgctatgttcttgtgcattgtggccctccccgggaatgtatgctgatattaccttaccattggaaagacgtactcgagcagcttttcgttgggctgaattaggtttcttaggctttaaaatcattacacgaacaacaacaccttttttaagagggcacatttccaagtcaggcgattcagtcgcacgcctaatccttctctttcctccgcctcgttttatctgatttaaggtagcatatctttgttgactaggaattgatattaacaacggtctaacccaaaaagaattgaaattaacaaaatttcccagtgtaattcttcttattgaactcgtagatgtgtatagccgcatggggctcaccactttccctatcacaaacttgaacatcgtgaatgatatctgttgattaatattacctactaacgttgtggaagtttgaaaaaaaagatacactgcactacccagaagctacaccttggctggtacacacccacagctttcaataaggaacgtacctattggttgaggccaactatcaaattggagacataattttcttgttcaagcactgtgtatcatgaatagattcaatcatcctattttgagaacggcattcagcaagtccaaatggaatctttcaaagtacacctcccctttattcaggccatcatacgcaagaaccatgattcctctaagaacgtactcttccactccgagcctgacaaaggagataatttacgacagaattgttgagatattagagtcttatgataacgtcaagcagggaagcacgatatctcccgccgcctcattttcgaaagacttaggactagattcacttgacactgttgaagtacttcttgagttggagaacgaattttctatcttgatacctgacaatgaggctgacgaaattaagactgtacagcaggctgtcgactacatagctgcccaagaagattccatttgatccggtttgatgacataatcaagaaaagctcagctaccctgcagttatcgagttactggattataagtatagagataggaccatttatagggagtagtattcaaagccttactcattaagacttgtgctgtttaatttcgtatcccagctctgctagaacctcagtgtaaatcagtttttctggttctgtcaatgcgagtagaaattttgggatcccgtcttcttccatgttggtatcctgatatgacgtttctagccttgtctcaatctcctcggtgacaggtatatcgttcaaagtcttaccatttcgattgatgacaccactttgggttaaccttcgcaaccattgcctgtcgccgtctccgagcacaaatgatgtggcaacgccaaatttattagctctggcagttctaccaacgcggtggacatactcgcgtgtagaaccaggaagatcataatttatgacgtggttaatattgggtaaatccattcctcttgccattacatccgttgccaccaaaacgtctatcttatttcttgtaaagtcatgaaaacgccgctctcgggtttctggatccaatagtgaattcacagatttaactctaagctttttgcgaaaggcttcagccaataagtctagcaatttttccattctagcactagcctcattagagcgaatgaagacaagaacatttgctttgaatggcacactcacattcatgtctcccatacgtgctcggtacacatattctgtcaaaagtttaaacaaaatcagtggcttaaagaattcaacaccgtcagtattggagagagttaaagataattcatccaatgagggagggagctggtacagttctgaggaaccgtctttccctgattctactccatgatcgttaacaactaacagtcttggtctgtacagctgcaaatgggacagtttttcagcatcggtagttaaagtggcagaaaatactaacttttggcaagggactacactcaagtttaaagcagacaaagacttcccggatttaccgtaacttgtagaccgatcattgttgattttccgtaacaatggagcgcaccaatcgaaagaagtagagtgtaaaattcggtcagcttcgtcaacaacaaggaaacgcaaacaatgcagtttcaatcgattagcattgaggtgttcaagaagcctacctggcgtgctaacaattatatctggataattcggtaattcgtagctggtaagtctcattttctcattatcaacagtatcatttctcaactccatgacatttaaatccgtgcccgtacatagctgattcaaagtggaataaacttgggataccaatggcttggtaggtgccagaataatacattttatactggatacccgtctcccaagtattgcctggacaataggtacacagtagcctagagtctttcctgatccagtcggtgcatttgccaacaggtcgcctggtatgctattagagatcctggtctgtttgatatcatgttgcagcgcttggataacagaaatttgcacactaaaagcttctttgtatccaaatttctgcaatatatttttcaataaagaagggggcaagttaagtttctggaagggaagtgtagctctagttgtataatatataggttttgcaagccagtcgattttttgatttagtgtagccaaagaagaaagaactttatcttgaggaagttcaggttgtggtaatgaaataaggtcatgtctctcagactctttttgttgtaacatatgatcttttactttttcttcctgtccttcattcggctgatagagtttctggcgtccctttagtttcattgtttgttgaaaccgatgaaaaacttttaagtgtttaatgtcaacttgatcacctgcaccatccctaatttcttcagtcttcttttgtccttgatgtgtttcaagcgcttgcgtatgctcattctctacttcaatcattgatctagtatcttcatcaggatcgacagggagtacactttcgttacattcagatgagcgtaaatcttttgtcttaggtttcttgcatttgatcgtcttgcctcctttgacttttctctttctagtactatcttgaatagttttcgggaaactttcatattttctttttccaccaatacctgctgagctggatgtgactacctcagtgctgcatttcacactataactctcgtcatctctatctgagtttagagtttttacgggcttactagtcgttccaggatcaaatctagcagcaaacatatatgatcaattgagactatgatgcctacagttattctctagtccaggaaaaaactggagtttacatcccaacaccactattcaacacttcgattatctcagattttttttaggatacaagtaattaactaacgagtaaatgaaagcagctactgtactactccgcagatcggcttggaaaggtaggtaaaatggaagcatatgaaatttttattcagtaacagggactaacaatttgacttaggcccccatatcgtccccttaccgatagcagaatctctgaaatcaggttccgccatcagaacaaatgctagatcatgtacgattctgccccagtttgtcggagtcaaattccaaattcataatggcaaagactatgtgcagtttcaagtgacagatgatatggttggttcaaaattgggtgaatttgctccaacaagaaaaagcttcaagtatacacaaacaaagaataaatagaccgagagtactcaatttagtcatgtatatagtgaacaatccatcagtcaaaatagaaaggaaatattgcaatgtccctttgcccttaagccgtcattgtattatcccgaaactcttgtagatcataaattagtcgacttgtttgggtaataatatcgattaactcattttgtttgtgcgacaggttggctggactatgcatattgtgatgcgaatccagtagttttccagagtcttgaactatttgacaagattcttcttcgtctattgtactcaacctgtctttagggatcttttcatcgctaaaggcagattcctcaagtcctcttcgttgctgaacagcttgccccaccgagtccaggtcccttaatatcattagttgcagcatattctcgaggtcttcttcaacggtgctactactagactctcgttggttgtctacgaccccgacctcacccaaacattgccttaatatgctgttctctactaacttctcaaaataatcaatttcttgctcactgtttattaccttgttagaattgtttaccgccttataagattctgatctatatgaaattgggttacgcatgtattccaaatgcttttccgaatcacacacagcagatcgatggtgggtcaaacggcaatagagagtactcaactttcccatgatactatgcgaagacactccaattgttggcgataagtaagaaatatgataggctgattttaataggaagattttttttaacattattagctgcagtatttctgactggtctgtttgcaaaagtgaggcctactgtcctgtactgagtagattgccaaacacactagtactaacttaaaaaaaaatcaatggtcagaatgggactcggacaaaaaaaaaatgcaggaccaaccaagagtaagacagactcatacctaggactgaaacagggtagtcatcacagtgttaaagagattgaataggaaatttgagtttgcaatctctcatgttttaaggaaagtcgactcgagtatttaacaagacaataaatccagcaaattcttcttgaatttgatatctgtgcaaaccggctggagacaatcaggaaaggacaatttcagttaaatttataaacgaggctttagaaggttaataagagtatattctatgacaacgtattgaaacccaaaaagctcaacaaaatgtgattacctaagataataattacacttaggggtaagtgaaaaaatgaagcttcaagcaatctttgaatgaaatctaaaccgataatctattggttgacctcacaaaatgctctataagttacaaagtcgtcagaggaactaatcaactggatctttacttctggctgaataaagaatataaatcctggcttgcatttcagtttggaatcattctcatcttgaatctgtatggaaccctcaccttttgtgacaattaaaattgatggaccttgcaatccttccacctctcttcttccattcttttcatttaagatagtctgtaggacggcgaactcttcaattggaggatcataaagattgtcgtatccgtttccgtgcgaacgagtaaatatctctggtctcattttttgcatttcaacatcttcataggaataggtcagcatgtcaactagaacattaacgtctttgaacttaggagtgaagcctgctctaaccacgttgtcagatgcggccatgcactctacaatgtccccacgaatataagcatgtatatccctggcttgcaaaaacatggcctctccgggctgaagaatgcaatgattcagcatgagacacccacaaaaaagaccgatgtcatacggaaaatcactttgcatcttctgtattagcttacagagttcgtggccaaacaactcgggttcgtcatatgtacgttttaccagcgatttggtgttcatgtagactttactatcaggcaaattcatgacttttgagaatacttgctgtaaaagttttctattcttatgatcctcttgagaatccattttcactttgcctgtgaaaatattttcatggaacaaatggaccagttcctctcctacaatttccctaaactcaggtatcttttgaagtagggaatccagttcctccagaggtttaaatccacaaaaaccctcaaactctgtcacagctaaagccatctctggtttatgattatcatcaggataattcttgggatctctaaaatgcagcttttgtgccaactctttatcaggatgagcttggatagaaagtacctttccaattgacagcacttttaaaagaaacggaatttctctagtagatctgaacttgttgattacttgagctcccaaaaattcttctggtcttttctcgactagatcccttagagacgttccagtcttgtggtctacagacgccattgactggtgagttcccatccataattcagcatagggtaaacttggatcaatttcaacttttgaaggagtgctattgtgagcaaattgggccacaaccgactttgatccaatatttccccactcatagttctgaactcctgcgtcgatttgaaatagtctgtacgacatgtacgtgttagcaaagttgacggcttctgaaaggttaagaaaaaacgtgtaatttcaaaacaaattctggcagggtaaaatgagcataaaaaaaaaacgaaatgcaagtctcggaagcccaccaaacgatgcagctccagaatcggaataacttactttaggaatccaccagctctcagctttggcgaaaactgcaaagcagaaaatgttctttccttgttattaaggaagagggaatgcacgttgaaaaaagagtttgtgctttcaaaaacttattctattcatggttacagttttttggcaacaattatatatatatgattcgttttctcacaacccagtaaagaaagttgagcaaaactatctgtgtaaaaagttctaaagaagttctcaatttcacaatgagccatctgaagagacaattgcttttttgtatcggtagatatcgctaggctagatgctgcttgaaaaagttcattcaacttatctccacatatcaaggaattatcataaccagtctctttttgactgatttgccagaagaacacggagtcaaattagtagcatcgaataagacgaaagcaaggaagatgactggcgctccattggctcttcttgcttaccagaaaaaaatccaggaacgacaagcggggctggttctttgttcaagggataatgcaagcgtaaaataactgcattgcgaggtaattctctaagacttactttaatccatttggtaagttggggaaagccaaactgaatgtgggtaacgcttgagatacagaccctagttgcaatgactagttgactgatagatcgttcatgtgcttaattatttttctgagtaccactttttactggtgcagaattgtccgcacaattttgattcgcgaacagaataaaccatttgggagagaggacctttaacattttcgaccaatctttagtgacttcccgaccaataaaacatctggagtttctagcgtagaacacaacatgtcctccattgattttaaccaggtcgcccaacagtttacaaccttttattacgaaaagtttgactctgacagaacacagcttggaaatctctacgtaagtttctttttttttcatttttttttgttgaagaggtattaaccacacataagagggatcaatctatgttaacattcgaatcatctcagttgcagggtgctcgagacatagttgagaaattggtcagtttgccttttcaaaaagtccaacaccgtgtgtccaccttagacgcccagcctgcatctccaaatggagacatcttggttttggttacaggagaactacttatcgatgaagaaactaacccacagcgctattcacagtgcttccacctgttaccagatggaaattcgtactatgtgttcaatgacatatttagattgaactactcatagttgaaacacttttagctgactgtcttgattttatatggcagtatttagctagtaaattaataatctagttgtttccactttatttctttttaaattttattagtgttacttctccttgaatctacccttgtcacataatgtctttgcacttcatgcttacttaactacttgggtactagtattcgcgcatattaactccaaagaccaagtgcttcaaaaatctaaaacatctcggttccgctatgtctccagcttctgatccaaaggaagaattgctcgatgctaacgtaagaaaagagtctagcgagttctctaatttgccagatggctgtccagatgtagcaactaatactttgctctttaaccatgatagaagcttatcaatgccttacgatgagtcacccaaaatctcagtacctgaaattcctcgcagacccaaaagaaaaggcccattagtggaggataaagggtcaagcgagaaatcgaatcctactgatccaaagaaccatgttatccccgagtcggtaggttcagataagaatctggcagctttgcagatgtcacaggctgctccaaaggaaacaacgtccgaacaaaagttatcacacttacaaaaccaccactcggaagccgattcgcccattgacgaacagttcagcttaactggtcatgctatcagtgaagacagtcttgatttccaagacagaaacgttcgttccgacatgctgccactggatttctcttccgagaacaaaggtggaaagatcgaacaccttccagcggtcccttctaaaaggcctgtcagatccacaaaaaaagatactggatcggctcaagacggaagcagtacatcctatttagggtcacatatccagcaacctttatcagatcccagtgttgacggtatggatgatagtggagtatcgtatacagcgccacttggtgaggaaacacttattgaatctcaaattggaaaagtagaagaggaaattgatgaatcctccaataaaatgcaactgtcaaaagtaggtcttactgaagaaacaaagccatcgaaaatgacagaatcgactatcgtagatagactttcaacagagttagaagctggttcacaaacaaagcatactgcttccaaaaagccttcttcaaaaattgcggcattccaacaaatgtttgagaatagacaacagggtactaacgcttctttgagatcagagccccattttgaacatcctcctaaagccaccaccactgatcataagcaatcaaaaccgcctttcgaacaagcacatgcacatacacatgcaaaagatgttaatttaaatgctcagttcataaaaaatctgaatggtatgattgggatggcacttccaggtatggtagtacacagtgtcgccacaggatcttccgttgatatggaatctgcaacagaatctgaggtgaagcatgactacgatggtacctctgtctctgaaattcaaccattgaagaataccgtcactggcagaataaaaggaccacgaggtagaagactacctaaaactgttagtgaaccatttgaaaaacctaattcttgctttgaattgtttattgaggatatttggcagctcattactgtaccgtcggctatctcagaaagttcagtggatgctgactacagggtcagtgaagattttacaatgataaaaaaagaaggagctttgtcatcagaaaaccaaagttcgaatggagtttctaaactatgctctgaagtcattcaggagctggaaacagagatgcaatatgatgatactgaaatcttggccaaggggcgccttgttgacccaagaaaggaagtcattacagaaacgccaatacaagctgttgattcaatttctgataatcttagtatagattcagctagtcactagcctttgagaatctacgatcaagattgagtatcccttaatctcaaagcgatgtcaaattgatgattttacgaatgacaaaaacggcttaatggacaaaacctttttttgattttaacgaattgagagatacatttttgctgaaagctcgtgtcttccagaaaggagtagcttaagagcattgcatctttatagtcacatctggttaacttaaaattgtcaagctgcaatcagctaacaagaataaaaggttttcctgtttcttactttttactgccacatttctctttgaataatctttaccaaagaaatttatgtatgtatattagaatgtgagttcaaacgaaacacgagtcgtcaatataattccgatgatcgtgtatatttgagtccacaaatgctgaaaagaaaagtccaaacaaacgggcactcaaaaatcaccgaatttgaccagcaatgaactacttacgaatattaataagcaaagcgatctaaattcacctgaggcttcacattcctaagaaactataatctcttagagagctaatatttgcgcttcaagtttctcgatattattgctggaggttccgatcttgttcttatcttgtcatttaaatgctgggctgataaccattacataatggtggtaaaattcatgttctttggagatctgagctaaatcccaaagcctagtttagatgtctaacttagattggtttagcatcagtaaagatgtcaatagtcaataatcagtagtactcactattgtctatttgaagaaacatctttgactctcgttttgaaaaaacacaatagaacactagaagaaagaaaaaaaaaaaaaaaagaaaaaagcagggcttaaacatgagcttgtttctggtataattccacaatttgatcactgctggtagcttgttctgggctcttatcatctctgacccgtataaacctcggaaaacgcaaagaaacgcctttcccgaagaagttgattcctgccttatacacaggagagagggacaagtcggcagtcaaaacttcaaaaactagtgttggctcaaaccagacgtcaggcgatgcatcgtaaacgtagaaaggtttcggttgttgaataacggttggttttaacgtgccagacagcgtctgaagcatttcttcactaaatccagtccctattttacagcaagtttcatattcaccactgtcttcgttgtaacaggctaataagaagccgccataccatccagttcttttaccctttcctatataccctcccacaactgctaggtctaaagaatcgccaacaccttccaagtagtctttttttagctttaaccaattgacagatctctttgaaggttcgtaatgtgatttatctccatctaacatttttaccatcagaccttcacatgaatctttcactgattgatccaaaaaatgttgtatttctgcaacattatctgcatccatggcttctgcaaactgaaattttccttcgataggcttaacattttcatgaagtattttccttcgctcttttaagggaagttccaaaagcgatttgccatttaagaaaagtatgtcaaatgcaaacagacaaacttggaccttaatgtctttggcatttacatctttacgctttctcgtagagagaacctggaagggtaaaattttgcccttttcaccatcccatgcaacacattcgcaatctaagatcaacgtaattactccgttgcattgggtttttatttggctgacaacgtctattaaatctggatacctttgactcatgtcttcagaattcctagagtatatcttcacagtaccgtcctcctgaacatgtaattgcgcgcgttcgccgtcgtacttatactcacatgtaaattcttgaccgtgaaaatggtctaagacttcagttatggattttgttggctttgccaacataggcttaaggggaataccaggcttcaatgtacaatgtgtagcaaggttggatattccatatttcaaagcttcgtcgacaataatttcatagtttggaatctgactaaaagcctttttaatggcttcttctgcgtcaactaactcctgagggcttacgtggccctttttgcttgacaattcatgttcgtactcagaaaacgcttttgataacgcaaccaacacagatttctcaccaaaattaattctaagctttccctccaaagatctcattagaaatttagcttcagatccttcacacgtagttaacatctgattaattaacccaatttttcgggcttgtgatgcatttcctgaagacttagcaattttagtcaagttttcaaacacagaatgaatagtgaggggttttgatttaaacatagtaggctgtcttgatcttgaattttgggctacaagtccgatgtcaccaagcttatgaagctctgatctaattcgttgaggtgttctgccggtgccttcagcaatagcttttacaagcaacgtttcgccaagacccagctccaaatctaattcataatccggtcccaacctgttaatcataaggtatattacctccaccagagtacgtttatggtttgatcgcaatatttgaagaaaaaactcgctggcaattgctaggtttttcagcctggcaggctcttgctctagtttttcaaaaatatttgtcaacgaactgtaaaaaatttcctgtgattggggaagatcaggactgtcagaatggtatttggactctagttttagcaagctctcagcttcaaccaaaatatttgaatcaacagtgtccttttccaaatcgggatagccaacctttgctaagtggggagaatttaggtcaccacattctagcatagttgagtttttggttcgcttcaaaggagaatagtcagtctctgtagttcgtttttgcgatattagcttcttggaagttgaattaacgatttcaggttttctggcactaaaaaaacgattaagcgattgttggccgctcattataaaacagttgtagtatgaaatatagcacaaaaaaagcctttttgataaattcctagataagtcaagattgggaaacaagagtggcccacagtgtgtcatatatacgacaagttgactagctactccagatttgttatgttccggcgacttgtcgcgcgaggtttggaagcaagaggacacttccgttcgagatgtgggctgcgaaacatggagcaagacagttactactctttgaaaactcatttctgctaagttggccagtacgttcgcacttagtagtaccttgatatacaaatcaagttttacagaagcctgaagttcaaggcagatgaaaatgtggatagaatcgttgtaataaataagtgtacctaaaaaacttagtcaaaggcaagctgttttttgatttccgcaatggctttacctggattcaagcctttcggacaagtacgagcacagttcatgattgtgtgacagcggtatagtgacattgaattctgcaacatttcttttcttgccacagaagcttgatcacgggaatcgatcaaccatctataggcttgcattaaaaccgcggggcctaaatattcctgttgattccaccaataagacgggcaagacgtagaacagcaggcacacaagatacactcgtacaatccatccaacttcttacgatcctcaatagattgtaaattttctttgccatcgctaggcaccgaatctctttgtaaaaatggttggatcgatttgtattgcttgtaaaagtgtgttaaatcaggcactaggtctcggactacaaacatgtgaggaagaggataaattttgagttccgtgctctcattctggtcgatcttgcataaacatgccaaagtgtttctaccaccaatgttcatagcacatgatccacaaataccctcacgacacgatctacggaaggtaagtgtagcatcctgttcgttcttgatcttgagcaaagcatccaaaaccatgggaccacattcgttcagatcaatcttgtattcttgcatatgtggcttaatttccggcgtatcaggagaccaacgatacactttgaatgacttcagcctgggttgattctgcgagaccgtggccaaccctctgacgacagaaagggtagagcaggttctcttagttccagctctcaatactgtgtgagtaagcattgtattaaggattatgctgtttattgaaggcctggaaatcgaactcttgacagagaaatattgagacagtgacaaggaaaggattaaaatactgaccagatgatgggggatcttcagtctggagaagcactgaggtaatcaattctactctcattggctctagcaatctcggaaccgatcggaacacagagcaaaccggaatattggatcatatcctgtccaccgtaaccttccggaattcctttctcggaaccgcgcggttgtttccattttgacagagttatttctcatttctcgaagctacattttattttcgcgtgacttcccatcctaggctacatagattaatcagcgtctttaatgcaagaactaccacaaggttgaagtggctcaataaactacctgaattgttggcaaattctgtaaaatcaggaagtcttggagctgttgtattcaacttagttggtcacttgtcttatgcatgcagctaggtaaagcaaaaggtggcttttgttgcctttttcccatcctagttgtcagaaaacgaattatctgttttgttttcctgtgtatctagacgaatatcaaacatggtttctattaagttccactagatatcatcatttgatctttgtggtggttaaggccgtaacatgagtactgtatcgtagacatcgaacccatgaaatcgaagccagcgatgggcgccctcattattacaatgattatgaggcagccaaccacatatacacgtctacaatataattaacattcaagtgtgcaatttgtagtctactcatagaatttagttagatacaacgtagagctatatttaattgttcaaaaatactaccgattaacagttaggttggactagattaatatgttagaaagaaggtagggccaattcaccactggcatgaaagggctgaacataaatctttcatttgtttttcttccagattagagtggcctccaatacatgagactaaaagtccggcaagggatgtcaataaatctggttgttgttactttgcagaaggaaaaaaaaaatcttagcgagttgggtggcattctaatggatactcgaggtctcgaattctcgactaatacataatcagaaacaagtgttaaagtattcttggatcttgagatgatgaaagttaaaattttacaagtcggaactctttcttgccaattatttaaaaggaggaactccactttacaaattttaactaaatacggtattgatgtcacgactgaagactgtaggcgtgatttagatgatcctatcttgaaccatttgaaaaagcgtggcctattatctcaatgtactcatgaacctgaactctcacaactttgctctaagcgaaggctcagtctctactgtggagctgatccttctgccagatcgcttcatattggaaatcttctacctttgatggtcctcctgcattttaatttgaggggtcataatatattcccccttgtgggaggtgctactggtaaagtgggtgatccatcaggcagagaaaccgagcgaactgaaatacagcatgaagaaagagaatccaatgttgagaatattcgaaaacaaatgaagtcttttttcaggagaggagtaacttttgctcatcggagaaatcaacttttcaaagacgttgaaccgggaacccagatgctgaaaaataatattgaatggtgggaaaatattagaatacttgatttcctctctacttatggaaagtttattaaagtcaatcaaatgctcgcaagagagtctattaaaaaaaggctaaactctggaatgggaattggattcaatgaattcacctaccaaattttacaagcttttgattttttcgttttatacaaaaatcacaacgttcaaatccaggtcggtggaaatgatcaatatggaaacatagttgcaggaattgattttattagcagattgcatagaaataaagctgataatgccgttcatgcccctggagcttttggcataacagttcctttgttgacaacttcaaccggagaaaaatttggtaagtcagctggaaatgcagttttcattgataaatatatgaccccatcctatcaactttatcagtatatgatcaatttatcagacggtgatgttgaacgttttctcaacaaattctctttacttcctttgagtgtaattgacaagatagtcttaaagcacaagcaaaacaagaaacaaaggattgggcaaaaaattttggctgtcgaactatgcgacttgattcatgggcaaggagaaggaatcagcaaccttataatatcggaaacattgtttggtggttttcttaactttaacacccttgagattttggaagccttcagaaaacaaggcttgctgaaaacttacaaagcttgtatgattgaaaatttgtccattctaaacgtattggaagatatttaccgccaacaaaaatcaagaacagagttaaaaaagctgatcaaaggtggtagtgtcagtttgggagtaaaaaataccagaatttttgattcagatctaaggattaaacctgatgatgctctggatgggaaattgatacttataagggttgggaaaaaggactatcacgtcatagaagtcacatcagaatgactagttgaatgaaattcgatttgaaaaactcttgcagctttgtcttaatgcctttaattcaccatggaggccaaagctttaagtacttatgtcggttctgggattcatagtccttagccaatgatgttaatattgaagtttgtatacacgtgtggcatcgtttcttttgtaagacgctttttagagataatgaaaaatgtgtctggatcctttattgatagattcctaatacatactgaatggatggatgaatagatggattgtttgaggattttttcaacttcaaaacatcaaatacttaaacgaaagatttttgcctgttcttcgtactattagttgcacatactgtatgtgcaatctactacaagcaattgtgggtttcgaacgcccagtcgtatggagccataacatttttggtggagtgcggagaaaattgatcatcttcggtgttatctttagatctggggtgacaaaaccgtacagggccaaaccaagtggaagtgaatagatttaacattcaagtaatactcttggattgcgttacttgcatgtgccgctaacattagtttaagggtgagaattcttactagttgccagtaaactctgaactatcacatctatctgacggatgcaaacttagtatataaacgccttaaatatgttctctaaaataatcagccctacaattcctttatttaactgtctacttgaaatcaatctcagctagtaagagaaagaagaaaaaaaacatacttgaaaatgccgaaaagtaagatatcctagtcagcagaaaatacaagagcaaccgtattccttctcctaaggaaaagaaaacaacgaatgcaagccatgctattgacgtggcactttacaaattttgaatggtgccatattctacataacttgtgatgatctatttcatctccgttctctcttttgaagtgcccgctaaaaattcagaatttacatgtggccaacggtcaccaaaattggtactatatcccaaaaactgatgctgcagctactgctgtagtcggcccaaggatactccgcagcggtgactaatggttcaatgtcagcctgaattgtaagtaaatattcgacttttgtaaatatggtacagcttaactaagctaagactgatagaaattttgatattgagctgaatcaatatattgctgtccattttggtccacatacttgagcagtccatcaatcggatcaacatactggtaaatctgtggctgcatgaaggtttgatcaggtgcttcagagataatcattggctggaatgttgactgttgatggtgtgcgggggcaggtgaactcgatggtctactcaaccagtcagtttccgaattaatcgtggtaatcttgtttgctgttaaggaattttctcttctgcgaggcagaggaggtggtacttcggaattatgtcttgattccgtcttggaggatgaaagttttgtataggatctgtttccgattcttgaaaaatcatcggactcaaaactagggcttttcgatgctgacttagttgaagaacgcggatatcccaaattataatccagttcttcatatgattcatttaggaattttccctttatgtacttgtctttaatccacgcttccatcccagttttatcgtcttcgtcaaaagggaaaggaattcttttgggattccatttcttcgtattctttttgttgcccaaaaccttaagctgctgtagctccttttcattccattcctccaaagaaagagatttcacccttgaaacatcaaaacctaaaactctatgaagagatgcacaccttccacaaaggagaactcccaagttccagctggcccaagtcggataacaagagccacattccccacacttattcgaattctcggagctgtttataatctccaatagtaaactttcagacctcgaagcttttgccatattcaagctactatgaacaagtacgccagaaagtacaaagtttaatctgatcgaattatagaacgtttgaatcaactcacttgataataaccgcgaatttcgaaagtatctgactatgaggagatctattcgcatccaaaaatatacaagcgatgtgaagtaaccatactcctattcatttctctcgtaagctcatttaccctaacagcttttgttcaaaaagaaaccaaattatactattggacactccattatactaatggccattaagagaagaggaacctacgaagctgttgtcgataacactgtgtcaaagcatagtcctgtcaagaaaattcaacaactagccaagtatcatgagttgcctgattggatgaaggacaatcatttcattctagggtcatacgtttcagaaacaagcagcttcaaagcgtgttttcgttccttgacctatgtgcacaacgaaagtgccaacatttacactcatcttataccagcacttgtatctcctacattagcagtctttttcgcttttattttgttccagcaaaatgcatttgaacaaacttttaatcattcagcggtagctgtagactatgttgtatgttctctgtttttgtttggactttttggctgtttcatgtgcagtgcttgttttcattgtttcaagtcccactctcataagattgctatagttggaaacaaattggactatcttgggattgtccttttgatttctacgtcactaatagggattatctattacgccttcatcgataagcccaacttgtattcgattatgatatcagtcacggttattttggctattgtgtgtgcaactgtctcactggatgacaatttcagaagacccgaatggagacctttcagggcttcaatgtttgtgtcctttggcctttggggtggggtgccagttcttgttggattatatacctatggaaaggaagagacagtgcaacgttgtggcttaaagtttattatattggaggcaattttttacattctaggtgcttcgatatatgctttaagagtgcctgaaagattagcccccggtagttttgatctacttggaagcagtcatcaaatttttcatgttttagtggtaattgctgctgtttgccatggaatggcattggtaggctcttataattactccaaactgactagagtctaaaacacagcgcctccactcacgaacaatcttccttcgttcttgagacaccatttgataatctttttgctggtttgcgcaagggcctttttgtcaatatcactacctttgcgaaccatgtacagttcgaaggatggagtggaaataacaaagcccgtcactatgtcgtttttttgggggctagatgaaatacgtgcattcatgttaaaactttcttctaattgggagctactcactttccatttggtgtatttgatgaaattggaagaatcaaaagtaataatctttcgttgtagaatattttctccgttgcattttgtgcttctctggggtgaaactagagtattagtcaccacggcagagtgcaatcgagaataaatgtatctgagcatacgctcatgttctccatcgtcgtctctttttattaaaaaatattgtgcgtgtttctttgatttgaatataaagtctgagataagcggacatattccttctggaggtgtattagtcaacattgacaaataaagctccttgtatagtgtagaggactccatgattcgatcaattattcttttactgatgtctcggacttgataaaattggtctttgtaaggggacagcaaaatcaatcccatctttgtcgtatcaggattgacactttgatcagcagatcctgttcctagtttctctaatgcgtcatctctttgtagttgccagaactgaataaatgcgtaaagaaatccattcgaattaaaccttggaaggcacacaggaacccaaaattcttcgttcacctggaattctggtttgtcggttgaactggtcttaaatgtgttggtattaaatatcatcgagaacagtagttgaagatccgcagtgtggagagtgtgtcttctaggtctcataacagttattaactttccctctgggcccaataataagccataaagaacgcttggagacgtgtacctcagtaatatttgttcaagtttgaccctgatgtgtctcttcacctttaggcatggtaaacctccaataataagacccaaattggagttattagcaaggtccgcacagatattgttcagacaagcaacatcagcatgacccaatagttttctgaagtcgaagctttctctttgcctgaaaactttgtttatgtgaggtttacttagtgtggtgaccaaatagttgtatagaaaatccagttgttgcgttgattctacatcagtttcttgcatgtttgagacgcccattaaaatgatggggtagcggttctcaaaagtaaaacaaacgtcaccgtttttaaaacttcgcaaatctccagttccgataccggcttcggctgtttcttctaaatggaagtaacttacaatggtttgaattagtcccatatatccaacaataatgtcctccgagccatgcattgagtatatcggtttaccagcggacgacaaaatgaagaaatgctttcgcctattgagaaaaagctgcatatcttcacactcatcatctttttcttccggaaaaccaagcttcagagctttggatgagacgggtgttgagtctttcgttatttgcttcaatattgaattcaaatcattatttactgatgaagaagattggtcgcctaggtattcgtctgtgactagtgcccttgattctgcatcgtctgaagaaaagactggattctttagagaggacgcaaccgacttttttgcactcatacaggttggacttcatcagatattactacgatgtgaattaaacggtcggccagaaagcgcgacaataaattgtctctacatattagcgcaaaaagatttcccgttcacacatgaaatccgtgaagtcattttcaacctgcaaccttaaggctaaggttggcaccagggcctgccgtgttgaatctgatattggcataaatggggttcaagccatatgctaaaccaagcactgaggactatgccagcgctatcactaatgccaacaacacccatggcgaactctcgttgatccaaagatgtttcttccaaaacagaaagaaatgtgttgacgtaggaggctcctcccaagagtccctcatagaaaatgatcagcatcatcaaataaacgttagggatatagtagaacatggactgagtaatacatatcatcaaattagtaaactgcaaaaccgagagacatttcaaatgtggaattcggacgagactactggaagatcttgaaatgaaaacgccaagttgatacaatgttgagtatacaacgtacacatctcggaatttcccaaatggcatctcattcaaaggaaagagaagtgagggcgagaccccttgattgatcacatactccgagaagtagactgttgtaagaggtaacatgtaaggagcagcaagcggtttcattcttgtaaatgtgtacaatagatgagctttcaaatcgagtgcaagaaaacgccagtatgaaaaactctgaatgtttctttcctggtcacccaatggctcactcacagaagaagctacgtggattagttcgtaacctggaattttctccgggagcagaatgaaataactccaagcaaatgagaacgggagaacactaaacaaaagcaatgtgatgggaactggaataccaaaaaaagtggtgagagtcaaataagtgaagcttcctaaaattccggccccgccggttccagaactaaatgctttcaaggaaagatcctcataaaaatgtgttaactgaagaaaggttacctcaccaagtccagaacttaaagatgcaaaagccacaccaatgaagattagtttcagctgtttgtaccacgctattacaatcataccagtactgctcaaggctatcagtatcgataccctagctggatagggtatagaatgaagataaaatggagcaacaatctttgctaaaaacgcgggaagtatgtcagccattagtattgcagccttaggtaccccagggttttctttaagaagatcaacagcagcacttagaatgaccacatacagcacattgtttaccactccaaaaagccaaaaggctaaaaatgtccttgttctataatccatatgggacgaagtagtggattatttttttctaggacgcgacttcaggctacgaagcgataaacatgtcaactacagacggaattcagattctttcgcttctgtttgtaggtatcgagttttgaggcgtggggtgtctcatcgattgatctattgattttatcttctttgtactatgatatagatgtgcatttatatatttgtgatctctaaaatattccatttgagttaggcagtcagtttgaggaccaaatttaattagcttcggaatcaaaaaactcaactgttgctgtggtagtaatctgctcacagttttgtccctaagccatttaacctgtacttcatatctttcaaagacttcgaatcaggattccagttgttgaattctgttaggatattttcaaccttgctctttccagaaggaaggaatttgtgtgcttcgaacatcaaccctctcatacaccatggaagatgaaacggattagcagcgagaaattttagttcaaaatgtttgataataacaggctgctttgggaagtagtcatcaaggttagtagtttccaaaaaaaactgtattgccaattcataaacatctctttcattgtaaatcttagagtgaccaccaccagtcaacggacctgccaggacggggctaatctccttaagaacaccatgatcagaaaaacctaggttatacaatgtacaacagatagaaacagtatccgaaacgaactttggagttttggagcagccatctatataggctgcacgaaatatattgggatgacggacatggaacgctagggcggagtaaagtggaactaattgatcatcaattgatcctgcaaaaactattttaactccatggctgataatctcccgtatgctctgcacgtataatttggaaagaggtgttctcaggttttgaaattcaaacagttccatcattgattcattctctatagttgaataggctctgacaaaaaatctttggtcgattccaaagaaagggccgttgcttatcccagccattgccagtattcctattgtccgcttgtcgtccataataccttcagataataattgagctaacaaaattatagaaactggagtgccctggctatgggcggcaaaaaaaatgaaatcagccttacggatttcttcagtccaattcttcatctcactgagaaaatattcaacccggctaataacatttccttctttttctagtgctatcttctgaatactgatatccgcattatgtttctttgcccaagcccttactgccttttctgcctcgttgctgaactttactgaagttcctgtgggctcgccaatcagcggccttaaaacctttgtaggaaaaaatccatgtataccaataatcacaacccttttgggcttcctgggttcaactactctatataatcgccttggcacagaacttttaataccaagaagagacgaaaatctgtagaaacgatcgaataacattgttgtagtgtgcttcaaaggaagacatcctatggacggtaacacagtgcttaattcgtgcttcccatgaggtaacgccacattcgactgatccaaactcagatttctagtcgacgtgattcgggaaaattgcactttgggatttccttggttgctgcttttgtctttatcgtcagttttcgaatcgacaactgagtatgaactattactccaaaaaggccaagagcgatatgatgccttcatttgaagttcttctttatcagtagttgcatcgtatgagcatctctcttcctctattaacaagttctcaacagaattactttgagttccatcatgttttaaagtaggcttacttatctgctcgcaatgtgagaagttgttgtcgccattgaaggctgaaggactactggccacagttgcagttcgatgatgccaaaggagtccaggccaccttttgccgtgattgctagaatctcccatttgattaaactaatggagagttagtatcaaataagatagacacccagaccagaaagtttctacagtaatcttgtgcggtaaattcgagtcaaaacttttgtttgcttgacggggcagtgaagccaaaatagacggcgctgagacgtttgtgtccaacaaaaaaaaagttctcccatactaaccgaaccaggcaacctctctcaaatatttccgtcgtcgaaatttaaaagacatatttccagctgacacttgtggagaaaaccactagtcttgatttgctcactccaaccatggtactagtatgctcttcgcgcgtcccaggagcttttccgactgcctttagttttgactaactcagtgttaagctgatgaccaattataagaagagaatatccgaaggtattgtgagctcgtttaaaaagcaaaagattcttagtgattttttccctacaaaagatatacctctgaatggcttgcaaccagagagtgggtttagttcgattaataaaaagagcgtgttggtggaatcgtcgggcatagtagaagacagtacattaaaaaaaaggcgtagcttatgctctcttcctagagaacaaatgccatcgtgtgctaaatttgataaacaaaaatggatatctgggttgacagatgaggaaagacaacttctggacacagaaatcactaccatggatgattcatggctagcagtattacatgaagagctgcaaaagccgtacttcttagatctcaaaaggtttctagctaccgaagaatgtcgtggtgtagtggtatttccacctagagactcgtggtactcatggacacgtttatctccccttccccagatcaaagttcttattttagggcaagacccgtatcacaattataatcaagcgcatgggttggcattttcagtaaaagaccctaaaactagaattcctccctctttgaagaatatgtacaagctactgaagactgattatcccagcttcaaaatcccggatacagcagacttgacccagtgggctcaaaggggagtcttattgttaaacacttgtttgacagtaagagcccacaatgctaattctcactctaataaaggctgggaaactttcaccaaagctgctatccagaaacttattgactataatacttccaagaaccaaggaattgttgtcatggcatggggtgggccagctcagagaaccattgattcttgccggcttaatggaaatcatttggttctaaagaccgttcatcctagccctttgagtgcgtctagaggtttttttgactcccaccattacaggaaatgcaatgaatggctcgtcaagagatatggcgaagatgctttcattgactggtctcttgtgaagggaaacgtactaatgaatcgttaagtgcaatagagattatggtccagccaaaaaatcaaaaacaaagaaaaaaattgatcaacaatttggtatattcgaagttaacgaaaataagcagctcaacttttacctagtaaaatagataaaattttttgtctcaagattcatgtcatggacatgcataagtatatcgaagttgcgaattcgcacaactacttagattcacgaatcctttttgtagagttaccctccttacttttcttcctacattactacaggttaatttagaggcactaactattacctcaagaaattgactcgcatactattatactctgcagaatctttactggttgtagcctgcagtgagtgataattatatcatgcgatggttgatttggcatctttcatgcgcaattgtatctgcgtttactcataatgtggtcgtcaagaactattctccaaaagcagcagagcttccttgttatactggtcgtaacttggaagacttcaatatcaccaatcttctcttagcttcagatatagaaggaaatattcacgcgctcaatagaaataccggagaagtgttttggacgttattgggtcatcagcccttggtttctgttgcttcaacttcaaactataccgagaaaatagggaagaaaaattactcggacgctgataaaaccatatatttcaaaaccagcactaacaacagtgagctcactgcctctataccagaaataaatgaagatgaccatgtgacatggatcattgaaccctttgaagatggtgcactttactgctttactcctcgggatggactggagagatttccaatgaatataaaatcccttgtactcagctctccatttagttttcaaaatgataagtatatttatactggactacgagaaacatcactttacaagattgatgctcagactggaagaatcttaagcaattatgggcaatcctcccctaatgatttagttgctctttatccccctttattggaaaaagatgaaataccaaagtatccagacgttgacaattcacgtgtcgaagatggcagtccagaatttactatcactttaggtaagaccacttaccaactgacaatatactctcacaatgaattgttgtggaatatcacgtatacctgttggggtccagataacattaacgaagatcttttgaaccaaaaccttgaatcccatgacggcgtatatattgctcctttccacgactcatcattactggctatcgattcgaattctaaatctgcaaggtggatttccaatctaccatccattgctgtaaatgtgtttgatatttactatacagatttgaatcttggacagcctaccaggaaaattaatgggactcctgttcctgaaggtgttattgttctaccccacccgctacaaccagtaaattccccagcttctgatgaggcatcaaaatctgttttcattgacaggaacgaagatggctcctggtatgccatgtctggtattaactacccatcactagtcaggtctgctccaattgccaagtacatgcagaatgaacggtggagatcgacttccgtatttgaaagccctgagctcacaaagatatcaatcagtggggtccacaacccttctttttacagaactaccaacaatcataatgatgcaaatcaagcaacctccttcaataatgtaagagatattattggatttcctactcctattttccaagatggaaacaggccctacccagtacctcctgaggatatacttccagctgaagaaactgacgcgcatggtattaggaaagaactcagtatcaagaattatcctgctcttccaatagcgactaacaaagattatctctccattgatcccccctcagaaaacagcaaagtttcttcgctcatgaatcttcttctacgttgctttgaaaatgcgcttgtaactatgtttatctcacttatagcagttacactttcaaagctaggtctactgcctccacttacccaaatgttgtccaaattcggcttgtttaaacgtacgcagactgcggtagagctggtggatttattgttgaacgaggaaaacaaagttgatattgaagttttcaagaaagaaagatggagcaggctgcgagctcaggatgaagatgagaaaaatgaagatgagactttactagatgaattgaatccttcatcagagtcaagtagagacagcacgccaaattttgagaatagttgtcaggaaaagtctaatggcaccaaagttcaaacgcaaaaacaagtaaaaataattacacccgaggaagacgaacatggctccaagacactaaaaaggagaaagagagggactcgaggtggaaggaaaaacaagaaaagcaatggacaaattatactcacaattgaccaaaccagtcaggactcatcttcttatgatggccaggagagaactctgaacgagttaactacggacaactgtttaaacaagtcgaataatttggttatttctaatcagattcttgggtacggctcacatggtactgtggttttcaagggaatgttcgaaaatagacccgtagcagtcaagcgaatgttaattgatttctacgatgttgcctcccatgaagtcagcttgttgcaggaaagtgatgatcattcaaacgtagtaagatactattgctctcagcaaagtgacaggtttttgtatattgcacttgaactttgcagttgtaccttagagaatatcattgagaaacctaaggaatacaatcccttcgttgaaaccattgatccagttcaagttttgtaccagatagccaacggtttacatcatttgcactcgctgaaaattgtacacagagatatcaaacctcagaacattctggttgttcctccaaaaaaaggtcgaactcggacaagtgggaagcagaacgaagctaattcacctcctaggttactaatctcggattttggcctttgcaaaaaacttgaagcagaccaatcgtcgtttagagctactacggctaatgctgctggaacatctggttggagggcacccgaacttctcgtagacgactgtgattcagcttataatttttcttctgaaaatttaaagcttaaggacgacaagacagaatgcagtatatcttccgagcctctggtttttgactctctgtcccatagaaggttaaccagatctatagacatattctctgcaggctgcgttttttactacgtcttaactggcggatctcacccttttggagatcgttatttgcgagagggaaacattatcaggggcgaatattcattgtctttactagaccgaattccaaatagtattgaatccaaggatctgatttccaaaatgattgcaagggattccaaaaagaggccagatacatttcaaatcctcaatcatccctacttttggcccatttcgaaaaagttggattttcttctgaaagtaagtgaccggtttgaaattgaacgtagggatcctccctctgaacttcttttaaagctggaagatgttgctcctgaagttgttggtgcagaagggtggtacggtatgcttcctgccaattttactgacaatttaggtaagtacaggaagtacaatactttcaaactaatggatttgttaagggccattcgaaacaagtatcatcactacaatgaccttcctgatgatctctacaaggagatgagccccatacctaatggattctatcagtatttttcaagtaagtttcctaatctacttatggtaatttattttgtggtgcaaaggagtttgaaacaagagcatattttttttcctttttacaacacatcttcggagcaattggaatgagtagccattcaactatgcacatacggaaatttatatacttattatacacagtaacgaaacaaagtattaattttggtaacttatgaatcgtttattgcatcgttgcatagaaaaattgcaggtttcacacaaagcaagaaaaaaaaacgagaagcagaaaaacgaaagaaaaagaaaatggaaataatttagaactatttcagtgtagaaacggatacgaagtaaaaaggcaacgaagtaacttagagactgctaccttttttgttagaatggcaggtaaaccgaatagagaaattctcactggaggtaaacgatacaagcaacaatcttcacgaaagcacagagttgaagaggttgtctttgatggagaggccagagtggactacttaacagggttccataaaagaaaactccagagacaaaaaagagcccaagaatttgctaaggaacaagaaaggctggcgagattagaggaacgggccaaaattagagaagaaaggaaaaagaatattcacaagcaattagaaaagtataatagaagtatcaaggagttaaatggggatgtaaccgaactcaacacttcaagtgattccgaactggaagctaatgttgcttacgataacaatgaaaacaggaatcgtagtgaccgtgagtttactcaagaggaggacgataatgcagattgggtaggattcgatgaagagcctgaaaaagatgtccgaggaattttaaaaagaaaagaagtttacgtttccaccagtgagaatgccccaatcaaaggcaaaagctctgttgagatagaagatctagctccccatgggatggatatcactcaaatcgcacaggctaactttgtagacctcacaaaatcaaaagagattctagataaatccattgaaagggctaaaaaatacgccgagttaatcaacgggactcggacacccaaagcaaagtcaaaaaaaaagtttagatatttgtccaaaaccgagagaaaggctaatacaaggaaagaaagatccaaaaaaaggaggtaaatctggctacggttaaaagtattgggctgccaagttaaatttggtattcctggttaggtgtatttaatgtcacccatttcgtaggtattttcgacatctgcgttcatagttttgaggaactctgtttcaactttaataaatagccaaacccatcttcgaaatatttctaagcactgtaaaagaaagtaaccagattctcgctgaaataggtgatggttcagatagccgttgaaccttccaatccatacaaatctaaggcatgtatctataatgatggccagatagtaatataatttgacattgaacattagcttagtacgcaatagctctgactggcccgatagtgtggtcgaaaacatttggaagttccagtcaatagagatatcccagataagcccaaatagtgagtgtatgaatagcgataagtaccaaaggtgtgttattattgtctgcaatttattatggggagttgaagcctgaaggtagattctgatcaacagaggtaataagccggtacaatacttaatgctgttgtacaaatgtagcttattcctatttcctgaaaaatgatactcactcaagcattgattgaatcgaattaaaatcggataagatataatagccatttctagcacagcgtttatatctctgtttatggatacagtctgcgtttctatgttgggtaaaactgatcctcggcgtagagaaagcaagtaaatgataaaatctagcatgactttagaataagaggtcagcgtatcggttaataaaatatcattacttcgaaaatccatgtctatattcccaattagtattcttcgtaccgtttgggttagacgtcttttattgggagaccttccgtaaaacaacctgaggatgatgtaaagtatcactattaatgggatgaactcaatggctttccactggtatccctgaatattgaaaagaatacacccagctactgaacaaaacgatactgctgttatcgataaagtaaaatctaaggttcgtgattggatcttcaaaagatcttgttggctgacttgaagtttaaggacttggaatatatcaatattatgactaagacatacccttacacagaaataccataaccaaagtcccatattcaggagagcaatgatacggtaaggcaaacacaggaatatatcgaaaatggaaagttgttccgcttccttttcagatttttccttcttcgaagtggacatattttctctattctatctcattcagaatcagtaatgggtcttctagcgggtaaacaactgaattgaccccaactcgattcaggtgtttacagaaatgcacgtttaaaagtaaacacttcctgcgaggttgataatatttcagaaaacatggggtcgtgcttcactcacttaaaaatttgatcttgattgtaacagtttggggagtcaaagctttagttaaaactttcatagcaagatgttgaaaatttcaaaacctatcacacttaacgaggtcagtcagttatcaaggaaaatcactctgagagctttttgctcaactagatatcaatttcagcatcgtcatgtatcacaggagagaaacttggtcaaacctttcgaatctcggaaaacgtttctaattgaccagtacaagcaactctactctgaaagtaacattgttttgtttttacatcgtaataacctgacaaaatcagatttaaaatatcgtcatagtattcaagagtcgggaggaaaactaacatttatcagaaataatttgttcaaagtattccttcgtgctgaatctcacgcagaccctgcaagtaaagaagcacaaaggtggatcaaggctagtaataatcgtcaccccctggaagctctgctgaagggtcctaccgcaatcgtaactattaaagattgtagacccgatgttgttaagaaggtgatcaaaattttgaaagcagctaatgagaaacttttcattgtaggcgccaagatagacaacaacatctacaattcaatggaacttaaccaattcaaggatcttcccacgaaagaagagatgcaaggtcaattagttggaatcctcacaatgcttgggggtgctggattagtgagaaccttagaagcttcacctcaccacctatattttacattgggagcttaccttgacggtttaaactctaacagcaagaataatagtagtggcttgtaaatacgattatgcgcatgtattaaatagtaacgaagaactagtgtcacgtgatgtattatttttttttttttgtctttctcagcattttttcgttttgactagaaccatcccaacgaagaatgtcttcagatatacaggaatcaaagaagagcaagaggtctaacacagcttcgttggacgatatttacataagtgaggagacccgcaagcgattgctttaccgaaaagaaaaggagcaaaaacgaaaagttctgaaacatgttagaattgatgacaaagagttagaaaaagagatcgacaagggggtaacagaacttccaaaaaaaagattctacagacagagagcacactctaaccctttttcagaccatcaattagagtatccaaaaagcccgaggcacatggactgggctcggttttatcctgactttattagtaaggattctggtacgcttcctactgataagagagttgaaattgcagacattggttgtggatttggtggcctactggttgatctatctcctgagtttccagaaacgctaatactcggaatggaaatacgtgtgcaggtgacaaattatgtagaagacaaaattatcgctctaagagcacagcataaaggaaccgggaagtactctaatataaatgttattagaggcaatgctatgaagtttctgcccaatttttttgaaaagtctcagttgaaaaagatgtttttttgctttccagatcctcatttcaagcaacggaaacacaaagcacgaatcataactaacacattactgtcagagtatgcatatgttcttagagtgggtggcattatttacactatatctgatgttttagatttgcatgagtggatgaagtcgcatctgaatgaacaccctctttttgaaagacttactgagctagaagaaaaagaagacaagtgcgtacaaatcatgacccactctactgaagaagggaaaaaagttgagaggaataaaggtagtaaattcattgcttgttacagaagaataccagatttatagatttttgcataaagtaaactaatacaagcgccccctttaagagtacttgaaaagctgtttcactggcggttccattcatcgaaagcagttgtgttcttatttcgtttactttgtcaaacttacttaaatagagacgtaactgattcactgcctctacgaatgctgcctcgcaaactgttattatctctgcttctataggcggtaatctcttgagatgatggaggctctaaatcttgaggtaagataaaaggagcaccagcctttatatttgggttactggagtaattaagttccgttgaaagtgatggctggtttcttgcttgttgtgccagagagacaaaggatcttgaggaaacattatcgtccaaaacagcaccatagtttgagcgtgagtgcacactggacatgattgatgaagcatcatcaaaaactgagtccatgtcctctagcgtgacgccacttgtttccggatacaggatccataccactagagccgatagcatacatgatgatccatgaataagatataatctccactgtattttctccagcaaaatcggagaaagctcacccaccatgaagttacacagccagttcgttgctgtggataacgaagcacccttggatctgaccgacaaaggcaacacttctccgggaaaaagccagggtatggggccccaactataagcaaaagaagaatttgctgatatgatgaaaagtacaaccaatgcaggtgtatttgggatatcgagaaacatggcataagacaccaaaaccattgacacccccatagtaaggcctccggaaatcaatattggcttacgcccccaggagtcaataagtatccacggaggtagggtgctgagaatatagatgattgcattgatgccggtcatgagaattgcatctcttccaacccagcctgcctgttcaaacactaagggggcataataagaaatcacgttgattccattgagctgggcaaatgcaagagctgacatggcaacaaatagccttttcgggtacctacgaaacatttcggaataagatttttcgccttctaagcgatcaattagcacattttctttgatgctcttgaattcattaacagctttctcatcccgaacgtttccatctgtgtaaagatcagcaataactactatcccctcagcatcatgaccatgggctaacaaccatcttggtgtttcaactataataaacgatccaagaaacaataatgtgcctataacacattgcaaaaacagagggattctccaagcaaaattgttttcaatgtacgaacatgcataatctacccagacggaactagcatagccaaatatgtttccagtgaattgaacgcatgcaagctttcccctgttgtgaggaggtgatatctctgtctgataaatgggaacagtggtagataaaaggcccactcctacaccagttataagccttccgataattaaaactgatattgtgtttgaaatagtttgtagtaatcccccaaatacgaacgtgaaggcaccatatctgattgtgcgtcttcgtccaatgatatcgccaatggtgccaaccattagcgaactagccaaagcaccaatctctaaaattgccactgtggtacctatgaggagacttgaaggattgttgaattggttcttaaaatgagcgccggttataataccactcataactccttgatcgtacccgaaaagaaatactccgatactaacaaatattgaagtgaagtaaagtagcttttttcccacgaggggaccacttgcagggatttcaatatcctccatctttagtctaactatctgctcaatgttgaaaaaaaaggatacagcacgacaggaaataaacacaatttaggtgtagtaggaaagaaagtatcttgggtgctaggatagatatgaaatatacagcctttgaatcaattacgtcatactgcatggtgttatgatgttttaatttgctttacaaacttggtttaaatattacttagcttttcaacaggaaaaacttcagtttctctacagccttgaatctatgactaattgagttcttggtcgcattatccatctcagcaaatgtctgattgaatcctaaaggttgaaatattggatcccacccaaagtttgtcgggccacgaggaggtactattcttccttccgtgattccttgaaatagactcacagtctttcctgggccttcgcaatagccaaaggtacaataagccttagcagatttgttttcaaaacctgcaagcatcttgttcaatccctccaatccaatagatttgagaaaccacttaatatacggtcctggaaggccatttaacgcatcaaatcccaaacatgtgtcttcgacaatcacaggaccacctattaagtccgctgctgatcttgccttatgtattactaccgtgtcaatagatccttgaagctctggaagatcaaccgattgactcacaatctcatagtccccaacaacattcgtttgctcaccatcgttaagtatggcgataaactccttcagtttattcaaatttccagtaacaaaagttagcttcttcatctcgtactcagtgctgaaagttgtaagagtaataaagttacaaatgtttttgatgcattttgtatgacaataattgcatccgtgcaccataaataaaaaatagttctaatgagttcttaactccaatcttagcaaatcaaacgaaccaaatctcacctcttacaagcttatcagattcagtgtgtctctggctgaaaatgtcacccaaaatctttcgtagattacttagtgctatttacttgtttggatatgaaaagagaccgaaggaaactcggtaacctctgcttgaactgtagaatcaatatccaaactctctaacaatccccgaattatcccgcacggataccaaagataatgttttctagtttgatttagggtatcctgaacccctaaaggactatctaaccgtgatatcattgtgaaagaacgatctactaaaacatatgtgcctctatgattggttctcaaattatcaatctgccttccaaatagagattcccaaacattcttacaaacaaatttcattatgttaacaacttggtcgaattttggggtccctgtcccgttttttcccttttgaagatataacaaataatcgactagtttcaatccgatattatatccaatctcctctgttaagtttccttccgctgatgctgtcgcctgctcgtggtctcttacattttcattgtcgcaaacttgtacagtagcctcatggcttattgaggctgtttctatcaaaaggtactctagacatgacttgttaatagtgttatcggccaagaggtcgtactcaagaggcatgatacatagagtctgacaataaacgtacaagtttatctacatacaagatattcgcgatgtttgttgcaatcgtgatagatcgggaccgacgaaatcacttccgtcccatcattcccaaactgtaaccccgtttttcactagtatttgcttatcaaaaatatcatcaggtgaagattctaatcttttccacgtagaaatgtcgtttgattgggaatctactgagaaaagtcttaatcttctggttgttcctccgtaaccaccatatcctccctcaccggccgctccaccatagcatagccacatatttcccgttttatcaccttcttcattttcttcatcgaacaggcagtagtcattgcaatgatcgtgtcctacactgatgactcccactcctaatttaccaaaaacgtttcgggcatgcgagttgaaagtgggcgccatcaccccctctttgtaagatcccacatgcttttcatggaaatctctgtattctggaagtggaatgtgaaagaaacccatggacaagtggatatgagagtaattttcaatatcttccaagtaaggaatgtgcgccttgctaagccattctagttgattctctttgatccagtcgtatccagggtaaacttttttttgttttgagtatttatgagtatccagaaaataaagtgacattgccacgttcgacgacctcgatccataaacaggaacgtagaaattcccaactccatcgatttccgctggacctttctctgatagtgaataaggcaactgctcaacaatttccattagttggtcacggctcaaagatccttcatcgtcatgatttcccaaaatgagcgcgtatggtattttccttgaaataaacggctctaaggccttaaacatggcggtttgggagtcaggagctctatctccgtaaatttggtcaccagttaatactactagatctggattctcaatgtctagaaccttattcaaaaatctaagtgtcctcgcatctgcaaagcaagattcgtttggctttaacggtggttctggatcttggcatgttccatttaatgtactaaaatgtaagtcagcaacttgaagaatcttgaatttaccctgagaatttatcttcagctttggtttgcttgattgtttctcacctttcctgcgaaatgacaaaaagacagggacgcggttcagtaagagaggatttggtaatttaatccacttgtgtctaacttccttggcttcaaatccataaaggacatcaatgtctgttaatgcctgaaattcatcaaaaggcccatactttacccataacccataatcaagcttttcccatcctttttcttttatttgcttagcactgggtattttatatactacttcttcttcctttccatcgtctcctacaattttggatataaattttcgtccactaataccttggagatcattcagtattcgaattggatacaaattcattccattaccagcgactttagaatcctcttctatattggagacagccaagtccagtacaacaagttgatcaccagtaaggtcattccacgagctttgctggtattccacaaatatctgccctatccaatttttgttcagaaacaaatccttttccagtctcatgaatccaggttttggttgacaaaaaacactggaataacactccctgaacgccaattgagttatgacagctttgtgcctattaactggaagaacaaagtgtacactattgggaaaaagccttaagaacaacacatctatccccactaaaacagtaggcagaagaagcaagatatatataagctgtcttacccaccttttagggagaatggacattgtcgacggaaatgtttgtgcatacaggtttctagaatgagttcaaaatgcaaaaacgcgcggtgcactcagcagatgagtccaagaaaccatgaaaatggtttgcttattgttatggtgcaatctacatttaaaatcattaatagttcatcaattataaatatatctgcccactagagattgatttcattgcaaagttaacttgttggttccggtcctctttcaatttgctttactgtttgtaaattatgttagtgattaaacatgttaatttgttcttttttgtttccccccatcttgatcattcgtaccacgggtttcagttaccacttgtgactcctcctcattctttttcataagtatatcctcaatagtaggcctatgctgtccaccaactaacactccaggacggattggcctgggaatggcatggtgagggcgattaatctttgacaaagaaaccttcttatctcctagcatgactgtggtatcatcctgatcatttgggagctttgaaccttgttcttcagttttatctgtcatttgattagaagttggtttgcttccacaacaattatttatatccctttttataatacgcatcctaacattactattttgagctacgatgccctatccttgattgagagtgtagacttttgcttgatgctatttacatactaatagtttcccatccttcattttcgtttatatggccatctcctcctataacagttaggccttgtgcgctattcacaaggtatttctcggctactctttgaatatcgctcaattccacgtctagtaattgttgtcttttaacttgcttcatatcttcatcaataccgtagctgaaacaaagttggccttcatctttcaaagactgaggagcatcaacacgctggaagatagtcaatttagcctgatccagatcctgttctgtaatatggtcactaacgatattctcaagtagccagtgtggtgaaccttcaaaggttgctaacgattccactggatttggatccctgtacgagtaataatggaatactccgttcagaccatcatatcctgatccgcctccataagcacctcctttttccctaatttctttgtgcaaatgtttaaaagtgaagagttgagataatatttgcaacgcagcaccatcttcgttaacgtaaggaacaccagttagagagagcgaggagaaagcaacctgagatggaaccgaaatatatgttttaagtgctggaacaagcttctgatttgaatgtctcacttcaaattcttcattggtagaatttgaagagtttagcatgtcgagtaactgcttgatctgagattctgcattagtaataccctccttgctagagagaagagatactttaaactgatccatattgaatccattaacaacaactcgctgcaatctttctagttgaggaatgaccttatctttcaagactccctgcgtgtcccattcattaagttggttcaaaaaccggatttgttctactccatttagaagttcatctatttgcttaacgggtgatattttactgctactcacactgcgggcgtataaatgtccattactcaccaataagctcatgttatcagatgctaagttccgaatcaacgaggacaattttcgttcattgcggaaatttgtatctaaaagcaacttcttccatacttggattaccttgtgaaagttttggtccattgacatcccactgattccaaaatttaagacaggttcttctagatcgtatggcgatgcatttatagagatgccagacgtaagaccccctgtgtatagttttatttcttcttcaatttcatgcatttcttgagatttggtacccaaatatgtgaagcaatcactaaaaagtggtaagaatttcagcagctcccgtgatatattgacgttcagttgtttttgcagtctaaaatatgttaatccgtttgttttgttgctcactctcttgaaaagctgactaccattatacgaagtctgaaaaatttcttgagtttgaccataccttggaatgtcttcagttgttaaagttggtaaacaagaaacgtcttcttcggcattttgtatctttaaaaggttcatccctctctgaaaaatgagactcttatcttcgtcatccagtttatccacatgtgcctgtaatcgttcactctcttccttctcaatatcataagataattgtttaaacggcttcattgtgaattttagatagggcttaccaatcagatacttgtccagtagatcagtaaatagtttcttgcccttcatttcgtaatcgttgttgaaattcagtattaatttattccattcaagttgttcaaaaggatcaacattgtttacccatccaggaatcaatgaatgaagcacattcataccaaagtctggggtgtgaacctttttagttaactctagctggtgtataatagccttaatgcgtttatctgagattcctttctccttgatttcctgcaatatatcgaagagtaatgattgcagcttaattgaagtttcttcagcaatgcccgataaccctagtgtgaaaatattctgactggacatgctttccaaacctgtgttgatagaaaaatcagaagccaaacctgtttcaattagcttctgatgcaaaatagatgaatggccatcaatgataaggctagagagtattctcaataaaaaggtttcgtatatgtcagagggtctcccgacataccatgacaaggaagttttgaattgtttattgacatccaccatagtatcaattggtccttccgtaacgatttccttgacagtatttaaatcaatgggtaccttcacatcacttttgtgacctcgtcttccgaatccagtgaatgccgcgtctatcttggccaaatgatctgtcaatgggaaattgccataggtataaattttggcgttagacggatggtaatttttgctatgaaactctacaagatccggatactttaaatctgtaataaatttcggatctcctcctgaattttgcaacgatgggtaaatggcattttgaaagttgatccagaaaaagtacgaagagtcactcatttgacctttcatctcgttgtaaacgacacctttgaatatcaaagggctgctctgatcttctgttgtctcattttcaagtctccagccttcttgaagaaagtcttcctcgagtagaagaggctttaaagtactatctaagtacacatccatcaagttttcaaaatctgctttgttggttgtacaaaacggatacaaagtatgatcgtgggctgtcattgcattcataaaattggaaagactcctatttaacattttaaaaaagggatctctaacaggatagtttacggacccacatagagttgtatgttctaatatatggggaacaccagtatgatctggagggttggtcttaaaaatgatactaaatgtattgtttctgtcttccttgtcaatatgaagatgcttacaaccggtcctttgatggactaattcaaccgctgtcaatgctagttctggcacgggtaaaactcgactcaccttgaacccgtgaacaatagagtcgactttatattttctcatcatctttttcgtattatagtctgataaagatgacaaaaatcttacttttatattcaaaccatatggctctagtataggggaagttctaactttggaaaacatatttggttgaatctcacaggaatccgtagtagaaaggatcttgtgaaaagtttacttggtcgcgcaagtggtagaaaagtaagtagcagtacgtgaaatcaacgaacagactgaattggaattgttgtattctcagtgatcggaattcattacaatcaggatgcagagactgctaaataaagagtttggagcaaaattttttggaactccagtttgctcgtggccctcgggcaaactgagttgttatttttggggaaacaaagcctggaatggcggcgctcctgatgccctcgaatagaagggaaataatctccctagatacatcatctggatactccacttacgctgctgcctcaatcaacacattatcatgaacatcaaaattatagttcagagcctcttttttataaacgtagtgttttgccaaaaggcatttattacccagacgaattcgcaatattgcagtggaatgtataacaaaagggactggtctgggaagatcgacccttacatcaaactcgatctggaacagttcaaatacaatggagaacacagtgcaactactgcagctgatgtaagtgttttgatatttgagtacagagatcttccattgctaggaaagattgataataccgggcgtattcgatacgtttgcgatcaagaaatggtcaatatcggagcttgcaccgaggacgaattgaacaacttcttgaccggtgatgactcggataattctaaatccaaaattttgataattaaattgactgatctgggagataatgatgtagcgtataatattgtcaacaccggatactactgcgtggcaacttattctccagcacaagcttcaacaggtggtagcatgttcaactcttataagatcaaggtcaacttccaaaactcttttggttctttggcagcatctgaaattccaaaacttccactatatggcctgctcgccgtggtttatgctgtcttttttagcgtctatctgttccatgtttacaaacaccgagccgagttgctgttgctacagaagtatctagcaggtttttttgccttcctaacagtggaaacaattctcatctggtcgttatatgaaattcggaacaacaataagaaatatcctttgcctggaggaatcaagttttacattactatagtttcattgttgaatgcttttaagctgtccttttctctgtttttgttgttgatcatctccctagggtacggagttgtatatcccaaattgaataagagcttgatgttgaaatgcaaaatccttaccggtgtgaattttgtttttagctccatgttcatcactttttcgtacttcaggtcacaatctcagccaaattccgcaacaactgcttacaaaggagattctggtgccatctggatcttgctgttgacaattccaataatttgtactttagccgcattttattttttgatattatcctcgttatctaaaacggtgaagtatttggcggacaacagacaaatcgtgaagttgaacatgtataaacgattatttcgagttatgctcttatcgtctgtactgcttctattggccttagtgttttccacagtctttgtatttggagattcagtgatagaatcgattgaaaggatttggaagtatgataaagtgattacagacttttggccttcagttttgtatttcgtcattttccttgccatagcgttcatctggagacctactgacacttcatacatgttagctgtatcttctcagttgccgaatgaagttcttgatgaggaaaatagtccagacgtcccaaataatggcacaacttttggtactggtgaagaatttgaaattgatgacttagacaatccatttgcagacaggaataaacctgacgttgagccaccatcatatgatacgttagacaatgatagcattgagtttgatgctgatcaggaactacataaagggcctaaatctgataattctacggttgttgcttccaatttttcatctaacgaaggtccgtctcaagctgcagtttccgaggaattattccaattggaagatgaagaggaagaggctgataagcttaagaggtgaccattatttatacagcacaaaacatagtcaatatataaacgtatagactttggaaaaagtaacttctccttctgtattttatagttcagtggtagccatccgtgatggtagtgtaccgacacatttatccattttgcagccagagctaggaagtaaactgaacatcaatcattcactttagtagttcgaacagctaaagaatctaacccattccagcatagtgttttaggttgttggatcgcaaatatagcctttacccttttttgatattttattacatttgcttttggtgacaacaatggctgaacaggaagctatttttcgatcggctgagatgtccctcattcaactgtacattccgaccgatataagtcgagaggctattttcacactaggtaatcttggggtcgtccaattcagggacctaaataagagtgtaaatgcgttccagcgtttcttcattgacgagatcaagaaacttgataacgtcgaaaggcagcataggtttttccaatcactgttaaacgaaaacctcatagaatcaaaggctgacccatattcagacgaatccttcaattacacaaccattttatctaaagatcgtattgatgatttaactgaaggggcccagtttttggaagaaagactgtcccaactggtagagtctcagcaagatttacagaagaaaaaaatggagctccaacaaatgcaacatgttctaaaggccagcgatgggttttttcttgtctctggtacccaggattcgtttggagaacttcaaccggacagttttctggaaaatggaggtcttgccgatgtcagttacgtcactggtgttatcaatagagaaaagtattctgttctgcaacagatactttggaggtccctacggggtaacttgtatatgaattttgaagagattgaagaacctatctacgatacaaatagcaagaaatttgttgacaagaatgctttcataatctatgctcatggtgaagttattctttcaagaattagaaagatagcagagtcacttgatgcagacttgtattttgtagagcaagagagagcacaaaggacaaaacagtatggcaaggtccacgaaagactcgcagacattgccacagttctgagcacgattgaaagagctttattcgcagagctgactattatttcccgagaattacacggatggtccaatgccattaggatcgaaaaatcagtttaccacgtaatgaacacttgtcacaatgatttacaaaggaaatgtctaattgccgaaggctgggttccgactttcgatttggaaaaagttcaagacagcctggaacgaatttcgaattcgtcgcctgcagacgaccctgtgcagtattccattccaattattgttaacaccttaagcaccaccaagatcccgccaacttatcacaaaaccaataagtttactgctgctttccaatctatgtgtgatgcttacggtgttgcaagttatagagagattaatgcagccctgccaacatctgccacatttccatttatgtttgctatcatgtttggagacttgggtcatgggtttcttatgttccttgccgcggcaacgttggtattgaatgaaaaaaaaattgcccgaatcaaaagagatgaaatattcgatatggcctacgttggacgatatattctgttgttgatggggcttttctctatgtacactggttttctgtacaatgatatcttctccatatcgatgacctggttcaagagcggctggagttggccgtcacgttggaatgaaggcgattcgattgaaggacgccaaactggtgtgtaccctattggattggatccggcctggcacgggactgagaatgcgctgttgttctctaactcttacaaaatgaaattgtcaattcttatgggattcatccacatgacatattcttacattttctcattggtgaactatcttcactttcaatctgttgtcgatataattggtaatttcattcccggattactattcatgcaaggaatatttggttacctttccatttgtattgtctataaatggactgtggactggattgctatcgaaaagcctgcaccttcattgttgaacatgctcatctcaatgtttttaagccctggaaatgttaccgaggaattgtatccaaaccaggctagtgttcaagtgattctacttttggtggctttagtctgtgtcccatggctattgctgtttaaacctttgcatttcaagttcactcacaaacaaaagtatgaacatcttccttcaagtgacgaaccatctgacgaagaagcgaacaactttttgtcctcactaaatattcaagacgacgaggaacatgaagaacatgaatttggtgacataatgattcaccaagtgattcacactatcgagttctgtctaaattgtgtttcccataccgcttcttatttgcgactatgggctctgtccttagctcatgctcagctttcctcggttttatggtccatgacaataggctccgcatttggaatgactggtttgctgggaatcatatttactttcgtcatgtttggaatgtggtttgttcttactgtatgtatcttagttgttatggaaggtacctcagcgatgcttcattctctgagactacactgggttgaaagcatgtccaaatttttcgaaggtgagggagcgccttatcggccatttgctttcaaaatcgtgctgctagatgatgaagaataatctctcagaagcgggcgattactcaattgcctggtcaattctttaaatttctatagaatgtactctttttgaatattttttttccatagagtcactgtaccgtctgaatggcccacggccaagtaacatcgcatagcttcgttcaataaaattaagtcgtcggattcctgatctttgattactggctttgccatacaaagagtgcttgggaacccttgagttgatattgatcgaaagggctgcaacaagttggactccagcaataaaccgagatcccaaatattgatttttcgatcatcacccacagaaataataaacctgctatttggatgtatagctatatctttgacccaggatttgtgctctgtcaacttcaaaatcagctttccttctgggttggtagagggatgcatagttccatcagatcttattaagggtaacggtaaaagccaaatacaaacagagttatctcttcctccagaaatacaatacttgtagtccactttgttataattatcgtcattgattttcaattcgttttgaaattttacccccgcaatatgatccaaatacttattgcaggccattggtagaaattttactttttctactacttgctcatggcctatcattagtccaattccagtgcctgttaacaaactggaaagtctgatactatggtcattagagcttgttagggtaaactctcctgttctattgatgtcaacagatcgaacccagttagaatggcctacaaatgatagaacaatggaacccgttctcgtgtcccaaacctttgtcgttttgtcttttgaacagctgacaagtttagatggctctgttggatgaaaacaaagacatgagattatattttcatggcctgtcagtgttctcaaagctttcaaattggcagaatcttcaatatcccaaattttaatcagaagatctgaagatccagtagccaagagaagtctatttttcttggtgctatggccatccataacttcttggttcataaatttaattgtgtttattgatcttgtgtgagcgttcctaataatctgctgaggctctgtcagattcagtaggttccatattactattgttccatcttgagaagctgtggccattattggctgaaaagggtgtatatcaattgcggttacaggatggccattgtgcatgtttagcttttggaagggctctatacctggtacccaatttattctatctaatgaattggatgtaatatcggaatggggttgcgactgaagttcgatttcaactttatttgactgataacctattgttctttctaattcctctacctttctatgaagtcgcaaaactgcagtccatttcttttcaagatattgtttagggatcatcctttggatctcgttatcaaacttattaaggtctgcatctaacaataatcttgaaatagtgttgaccgccgtatcctgagcaaactcaggaacaaagtaacgcaaatattggatgactgctcttcgtaattcgatatcttgcttttttgtcagtatatcactcatgcaactagtctatatcagaatcgaagaaaataccaaaacttagaaaacaacgcgaatcttaaaatttttgatagggcaaaaagtagaactttactagcacttcactcatttaaactctgcacatattctaaactctcttctatatcgacatgtgtagaagttctacgaaaatatagcaagatgctatacaatttattcatgcagatggcactgctgtatcaacatctccaagcacaatagtatgttgatgattctctgcggagatcacgtttcctctttcatcttgggtacagtacttaatctcagagaaccatccatcttctaaaagatcctttatagttgcccttttctcaacatcaatctctaacaatctagacataataggtctagcagaatgaggtaatagcctcataagtcggtagcgaccatgtatttgcttatgaatcttggtatggccggcatgtcgacgttcaggtttcgaatcttgttgtctaggtaaagatgcctcaggactattgggtcgaacgttgttttctatgtgtatatcttcaaactgctttgtcagggctccagtattctccttatctcggatgatctttaatgtttccctggtcctaagttcagctggccctatttcttcgactccctctacacttttgctgacctcatgctgtgccatttcgttgggatgttttatcgatggtaccagctctttatcagtagtggttgtatttgactctgtgttcaattgtaattccaaagctttttgcttcctcttttgcaatagatgtttgtggtgcaaagcactctgaacataatcatgaggctcgtcgtcattcatagcgtaaagcttgaaactgttgtcagttagttttggagccttccaaggaaaacgcctcaacgtcatgcagcaatatataatagctatagaccacacgtcaacagcttgtggatcataagattttgtactggttagaacttctggggccagatatgggtcagatcctacgattccatgagccgctactggcttctcttcgaaggggtatttaaatatgactgcggatccaaaatcgattaactttatgatgccatcagatgttaccacacaattgtctaatttcaaatccctatgtgctaagccgacagaatgcatgtaagcgactcccaaagtaatctgtttcaaacaacaattgatttcggagcgtgacatttttccagacataacgacagcaaaaaagtcaatcggagcatattccataacctggtaatagtggctgtgttcggaaatgatatcaaaaatttgaatcacattgggatgctttaaagttgacccaatgaaaaactcagcagtgcacttctttgcatactctttggagttttcgttcggtcgcctaggtctgaactcttttacagcgaaagttacaccgtcggactctcttgtcagcaaacgtacggaaccgccagctccagaacctagagtcttacctagctttccatattttttcactaatgatccctcaagatcatctaaaaactttctggaagtattaaggaccatattattgtctgaatcatgcgtaaaagtagcctttgcaccggaattctcaattgatggagttatgggcctagagggagtagtagaagagcttgaggcatgttgaagcttcttagttggtcgaaagaatcgctttaattctaccattgacgatttcgattgttcattgtcattattgtaagttgaatttggtctttgatgattggaagaatggtcttcaaattcggaatggaatgactctgatgaatgagttttgcctaatggaattcctaagaaagacttacgagataccaagtttgatggcttccccaatgggggtgttgtcaatttttccggatctccttccgaatcatggtgattgtagtggtgcttcttgaatgataaaaacttagatggcattatgatgtttgatgtttaaatgtaacgacttttgctcatcaacttagccctgcagaagtttaatataacaaattaaatatctcttatttttttaggtgaagaggcgctagcgacttgaaatctgttttgatataacttgttgtttcttaaagaagaaagcactttcaatttttgtacccgggattacggcctctacaatatagtcacccgttttcttacataagcaatgaggtgtttcttcataaaaaagattaacgcgggaagaaaaaatacgaagcaattataattccgcacttggaaactgtgcagctaccttttttcttcttcagttttcagagttcgtacctcttaaaaaagctaacttcaaaattgcatacgtgtccaattgataatgtgacgtatgtcaaacagtattgccgatctaagaaattgcgaatcaaaagaacattttgaggatgtcggttgtcgagtagtagagatccttagagacccaagctcgtgcttaacgatcgggtccatgttatcctgtcacgcattgatctgggctatttaaatatatgcgcttaggaaggctttactccgcttgtagtcatattcaatctttacgtgggcggggggctgttaataacactgattcagggaactgattacaggtaaatggaatgttttaggtgagaagattcactataacaaaagcactagagtcagttagagcggcacaaagagtccaggtttttataaggttaacccttccaacatcaacaaatgtaaaagaggaacatgcaatcaccctttcaagtacatgtacaatagacctaaatttattcatacgtcaaataagcaaatgtatcataaacaattgcctgtcatttgaggcaaagatcataggtggtggttcttaaagttctggatatggcgtgtcagtagggtcttttgcataccatacattccagtcctcatattcgacgcttagttcactatcagccctatcgatttcatgtttcacaatgatggcactgcggatatcgtagaaatgaacgcagaagcacaatttttgcgaaataacaggatcaatgccaataatgttaccatattttgacaaattttccttaatcttcctgatatcgaagtcgaaagaatagttgatagtcggtgaagggtaccctttgatgagggatgaacttttatttttggtctggacagttttgttcttgaagattaaaattcttctagcagagttggatgcgatatggtctttgattatgggaagcaacgtggtttcctgtagtactctacttgcccattgtagctgaggatgaactccatttatggtgaacattccagtgcatccatagttcagaaacttatgagcgttctcaggggaagcgaaaaacagttgaacagtcaaatgattccatgatatattagaatttgtcacatcctcttctgtaatcggatgggggatcgaaggatgggttaagtataccctctccaacggccctcccatcgcttgagtgagaatactgttcaaggaagccataggcggaagttcgctaaggcgtatgactctgttccccacacttgatattgttctattttcgcttgtcagtgaatcatcctgcatagatggttggttggaaacataatgattcgcggtcaggtatccagacttggagaatggtctatccctcagcatagaaagttgcaggtctcctggcaaaggtgacttcctatcatggagttttaaagaattggtgaacctacccgacattctgtttgcagaattaagtagttttgatctgattttatttttgcgtattgagctgtcttgttcgcagctctcagaatcttgatcattccacaatgagaaagtccgagccagttttttaaagctcttatcggtcttgtggccatgaaacgcagtattcatggagctaactcttcggtttattgatatcactttacctggcgtctccaatgattccgtaattttacctacttccggtccacataatgaatttgacccttgaaaatgtgcaaaataggtcggtttaaacatgtagatatacagcaaagagaaagcaactaactcggcaagatcacagtataagtgagaaaaagataagagtgtatcagaaaggtaaagttaaggtggccgaaactgaaccctacaggttatgtgccatttaatacatgcattaagtagtagggggttgtagtacagaaagagatttgaataatttcgatgtgatgcactctgcgacgtttactcttcttcatgggtgtcacccctacgagaagtttctgtcctcatgagttctcgtaacgccattgttgcataagatgcaacatctaattgcatcttaactataatagcaatcttatcgcccggtttatcttccacaatcctcttagcttccagtaaaggatgagttccttcagcctggttaagtgtaccagaaagctttaacagctccaagtcagttcttaccaatgattcgttgttatccgaataatgtcgtacataatattccaagccattgacggttcctaatagacgtctgtaagtgccagcataggaaaactctcgtacacgacgagacataagaaaaggatcaaggccatctttggccatgaggtcgatgtaaacctgacgaagtatttcgttgctaggatagattacgtcgaatccgggagtcggtaacacaacgtcaaaaattgagtatttttttgactcaatctcttgtttggttacaacttttgcttgcacatattcagacttttttatgtcttcggtttcaccctcgtcattttcatccgaaaattgatcatttgcttggtgcttgagatcttcgtctgtttcatcttgggttagtaatacaaggtcgccttcaacaacgtttagcccaaatagctctattcttttgcttgcaacactattccagataaacgattgataagcatgtccatacataattctgagattccgtggaatctgcataattgcattgaaataggaccctgacgtataattgccatctttctttctctcattagaaagtttttttaatatcgcatattcagcattacatttggagggcatcgtcttcaaagcaagagaagcgtcatgtgtttgtttccatatttttctagattctattgaatcctgcataactagctcttgttctgaaagaagtaactcaacggctcccttccagttactttgcaacaactgaatcccaactatgtgagttggaacagaaaatgtgccaaatcgctgcatgccaaaataattgacaaagccagagctgtctagagtctgtaatctgttctccaagattttctccaaaacaccactatatttcacatcctttatggttattaagaagctattgccattaagctgccccaactttaagggctgagtggcgtaagcgaatgatcctaatttaactcctcggagaactttattcaagtgtgataccctttcaacccgcattttttctagcgacaaccgttgaacagtcactcctcttctatccttggtccccgcgtaggaaatccatttcacgggaattttcaggagcctactcaatgtggacgcaacttccattgtttccttattctcctttagcatcgtaacatgcaaaaattcggttggctttcctaagctatgttccacaatcacagaatcggccttgctccgacgacttcccttagtcaacaaagcaattttaaaccggttattctctgatgttattgtttctaactttccataaaacgcttcccttaaaagtttatggatcttagttctttgctctttgtcgtcgaatgtccgctggctgacaagattatcgccagtcactaacaaagctaataattttttaacatcttcctcgccaaaataactttcaagctttattctatgttcctcagataacttgatagtgcaaggcgtcacatcttgcttcttgcaagagttagcttctctcggaggtcgcttcttgggctcaaaaccaacattctccaaatatataacattcccatcagtgtctatctcattaactaaaaaatctgtgtatctatgcttcaagattcctgtgaaacctgtatcatctttggtgatatactcagtaattccaacatctggttccttgattccggagagcctgtacttttcttttaaggaagtctgaggttctaatttaggcctcttatttgaagcattttcctcagtgaatttcctattttctttcaaggagctcattgtggactgggtggttaagagttcaaaccagcaactggactttatttttctgcaaacaaactagcatttttatttttttcatcgcacagaaaacgatccgcgtttacactgtttagtagaaaaaacgcgatatatatatttcgtagactcctaagttaaagcttgattcatcgacttccagtcataccaaataagtggcaacggcgacaagtgtgttggaaatctgttcaagctagccaaatatctgcccaaattgttttacgtttgtgcgttcaaagttactgtattttggggagtctaacaatgctgcaaactcaacaacaaacgcaggcaacccaaccctcagcacctgaatcaagctataacatacctgaagaattgttgaacagaaaaattatttgcagattgatatgtaccactgcctccggagaaagcaactattttgacctttgtacgtcggccaagtctaaaagctcacaaggcgtatatgaatggatatttgggagaaacacaaaagtttgtgactttaaactaccaagttcttcgtcaagattaagtaatgttcattttaaaatatgggtcaatggaaataaagaagacttagctttggatcatctaatgattcaagatgtatcgacaaatgggacgtatgttaataactgcaagttggtgaaagggacgaataacatcctgacgcaaggcgatgaaataagtgttggtattggtgttcctgctgatgtaataagatacattgtagttcttcctaaagtttattccctagccttacatgactcattagacaaaaaaaagaaacaggaaggcgtacaccgtgatttttttatcaaagatgaagtagttggttctggagcatttgcaacagtaaaaaaggctatagaaaggtcaacaggtgatacatatgctgtaaagataatttcaaagaagaaagctatgactgatggcctagacggagttcaaagagagctagaaattttgaagaagcttcatcatccgggggtcgtacaactcaagtctttttatgaagactctgacaatttttatttggttatggaatatattgcgggaggtgacctaatggattttgtcgctgcatatggatctgtgggtgaaagcgctggtagggagattacgaggcaaattctagaagctcttgactacgttcatgcactcggcatttctcatcgtgatttgaaaccggacaatattcttatagtccaagacgatccagtaaaagtcaagattacagactttgggctagcgaaagtggcagatcaaggttcggcaatgaaaacattctgtggtaccctagcatatttggcaccggaggtgctttcagcacgatatggaatcaccaaccagtttatcggcaaagatgaagcgactaaaaagaatattataaaaaagtcgagagagtcatattcttcaaaagtcgatatgtggtctattggttgcttggtgtatgttatcttgacagcacatttaccgtttagcggttcgacacaagattcgttgacaagaaacatactagaaggtaattatcactactcattgctaaaggagaacggaatctcaaacaaggccaaagatttccttgataggctcttgaatgttgatccaacaattcggttaggtgtcaaacaagctttaactcattcatggatatctgaattgtccgatgaaagccaagtcagcctttcacaaagtcaatcacatcaaagaagaattgaaagtcaggaatctcattcattcatcacgggcatgaatggtgatgcatacgagcgaattgaagaagcagatgaggtagatgagcagtgcgaagatcaagaaggagaacaccctcatgaggcccaaggttcgaaactgcagctagcaaaagaagcgagtttctccgtatctaatctttctcgctccccgtacgttaagaatgaaatttctacttccattatagaaaatagtgtatcactgccagcatcttttactcacaagcaattaaacaaagtaacaatggtctctaagcaattggaatcaccacaggggacctttatcacgttgaatctagttgaaaattcagtgtccaagttcggtgcagtacacataccacaaggaaaaaccccatttgttgttggtagagattcatcttgtgactggttgatcaaagaagaaagaatttccaaaatacactgcatgattgccaaaaaaaggcatcctactgctaatccttccatatttgagtcacctgctttagggctggaagatatttggttactagattttagtacaaactcttgctttgtcaatgacattaaaataggcaagaatcgcaaaactcaaatatttcatggagatgagatatgcttgttcaaagatgcccagaaaaaagagcaactcgtttatagggttcatattgatgatggaacaggccttttccagggaggtgaaagaacccaagccaattctgatgacattctggatattgatgaggttgatgaaaagttaagagaactattgacaagagcctcaaggaaacggcatatcacccctgcattggaaactcctgataaacgtgtaaaaagagcttatttgaacagtattactgataactcttgatggaccttaaagatgtataatagtagacagaattcataatggtgagattaggtaatcgtccggaataggaatagtggtttggggcgattaatcgcacctgccttatatggtaagtaccttgaccgataaggtggcaactatttagaacaaagcaagccacctttctttatctgtaactctgtcgaagcaagcatctttactagagaacatctaaaccattttacattctagagttccatttctcaattactgataatcaatttaaagatgatatttgacggtactacgatgtcaattgccattggtttgctctctactctaggtattggtgctgaagccaaagttcattctgctaagatacacaagcatccagtctcagaaactttaaaagaggccaattttgggcagtatgtctctgctctggaacataaatatgtttctctgttcaacgaacaaaatgctttgtccaagtcgaattttatgtctcagcaagatggttttgccgttgaagcttcgcatgatgctccacttacaaactatcttaacgctcagtattttactgaggtatcattaggtacccctccacaatcgttcaaggtgattcttgacacaggatcctccaatttatgggttcctagcaaagattgtggatcattagcttgcttcttgcatgctaagtatgaccatgatgagtcttctacttataagaagaatggtagtagctttgaaattaggtatggatccggttccatggaagggtatgtttctcaggatgtgttgcaaattggggatttgaccattcccaaagttgattttgctgaggccacatcggagccggggttggccttcgcttttggcaaatttgacggaattttggggcttgcttatgattcaatatcagtaaataagattgttcctccaatttacaaggctttggaattagatctccttgacgaaccaaaatttgccttctacttgggggatacggacaaagatgaatccgatggcggtttggccacatttggtggtgtggacaaatctaagtatgaaggaaagatcacctggttgcctgtcagaagaaaggcttactgggaggtctcttttgatggtgtaggtttgggatccgaatatgctgaattgcaaaaaactggtgcagccatcgacactggaacctcattgattgctttgcccagtggcctagctgaaattctcaatgcagaaattggtgctaccaagggttggtctggtcaatacgctgtggactgtgacactagagactctttgccagacttaactttaaccttcgccggttacaactttaccattactccatatgactatactttggaggtttctgggtcatgtattagtgctttcacccccatggactttcctgaaccaataggtcctttggcaatcattggtgactcgttcttgagaaaatattactcagtttatgacctaggcaaagatgcagtaggtttagccaagtctatttaggcaagaataaaagttgctcagctgaacttatttggttacttatcaggtagtgaagatgtagagaatatatgtttaggtattttttttagtttttctcctataactcatcttcagtacgtgattgcttgtcagctaccttgacaggggcgcataagtgatatcgtgtactgctcaatcaagatttgcctgctccattgataagggtataagagacccacctgctcctctttaaaattctctcttaactgttgtgaaaatcatcttcgaagcaaattcgagtttaaatctatgcggttggtaactaaaggtatgtcatggtggtatatagtttttcattttaccttttactaatcagttttacagaagaggaacgtctttctcaagatcgaaataggactaaatactggagacgatggggtccttatttgggtgaaaggcagtgggctacagtaagggaagactattccgatgatggagatgcttggtctgcttttccttttgagcaatctcatttgagaacttatcgctggggagaggatggactagctggagtctcagacaatcatcaactaatttgtttctcaatggcactgtggaatgagaatgatgatattttgaaggagcgattatttggggtcactggagaggctgcaaatcatggagaggatgttaaggagctttattattatcttgataatacaccttctcactcttatatgaaatacctttacaaatatccacaatcgaaatttccttacgaagaattgatttcagagaaccgtaaacgttccagattagaaagagagtacgagattactgactctgaagtactgaaggataacagatattttgatgtgatctttgaaatggcaaaggacgatgaagatgagaatgaactttactttagaattaccgcttacaaccgaggtcccacccctgcccctttacatgtcgctccacaggtaacctttagaaatacctggtcctggggtatagatgaggaaaaggatcacgacaaacctatagcttgcaaggaataccaagacaacaactattctattcggttagatagttggaagtatggctcaaatagattggtatttgctccttcgcccgccttcagtgaagaatcatcagacattgaacctaagcttcttttcactaataatgaaagtaataaacaaaaactatggaatcaaaaaaatgcgtcaccctacaccaaggatgctttccatgagtacattgtcaatgaagatagctctgcaattaacccacaacaaaagggtacgaaggcctgtgcctggttttcttttgatgaaaatggtggtgttccccctggtgattatgtaactatccgttacagattcacaagaacagatagtgaccagcctgtaattgatgaagaggctttcgataaagtatttgctcgtagacaactagaggctgacgagttttattggaggatttctcccttgccaatcagtgatgagctcagaagtgtccagcggcaagcttttgccggtctcctttggaacaaacagttctatcagtttatccatgattattggtacagaggagaccctgactcaaaaataaagcctactattaacagagctaatggacgaaacaaagattggaagcatctttatataaatgatgtactatctctccctgacaaatgggagtatccttttttctgcacgtgggacactgccttccactgcataccaatagccatgatagatccagattatgcgaagaatcaattagacattttgactcgggaatggtatatgcatcccaatggacaaatgcccgcgtacgaatggaatttcagtgacgtcaaccctccagtccatgcatgggccaccttcagaacttataaaattgaaagaaaaatgtacgggcgtcaggatattccatttttggaacgtgtttttcagaagcttttactaaacttcacttggtgggtcaatagaaaggatactgagggcaaggggctttttgagggaggtttcttgggacttgataacattggcatattcaacaggtcggagcctctacccactggtggaacactggaacaagctgatagtacaggttggatggcttttttttctttgcaaatgttgaatattgcattggaactagcacaatacaatcctgtctatgaagatattgcttcgaagttttttgaacatttcattctaatttctgatgcgatgacagttaacggaggcactggggagaaatcgttatggaatgacgacgacggcttttattatgatgccataagttggggagagtccacatcaatgcagttgcctattcgttcattagtgggcctgatcccattgtatgctagtctgactttggagccagagttaattaagaagtttccctcattcacgaaacgattagattggtttatcaaaatgaaaggtaatgttgcagagcgaaatattgaatccatgagtgcccgaggggttggcgaacggttacttctctcacttgtcagtaaagaacgtttagtttcaattttggaaaaaatgctagacgaggatgagtttttgtcccaatacggtattagatctttatcaaagtaccacgaagagcatccctttgagatggaagttcatggccagaattatgaagtaaaatatcttccaggagagtcggatagtggactgtttggtggaaattccaattggagaggtccaatttggcttcctgttaatttccttatcgttgaatcattacaaaagttctatctatactacggctcgtccttgaaggtagaatgcccgaaagggtccggaaaatacttgaatttggctcaagttgcagaggagattcaacatcgcttgattcatttgttcattagggatgtcaatggaaagagagcttcaaacggagactgtgatctgcttaatgaggacaagcatttcaaaaactatgtattgttctatgagtattttgaaggagacaccggaagaggtttaggagcgggacatcaaacaggttggacggcacttgtagctaagtggattcatgacactggaatatcatgccgggtacccaaaactcccaaaacagatgacagaagaccgtcttactttctacaaaaacacggtacaaacgatgaagacatttatcctgacgaccaagacgatttatcccagagtttctcaccctacatgtcaactcccttccctggaaacctcactagaagaaggtcgggtaaatcactgctgaatctgacgactgacgtcctagatatgacagatgaagagcttaaagctcatcgaagaaatcttcctggattgagtcgtactgccagcttagctagctccaaatctgggtatgtatctgctggtggcgctagtggaagtgaagtgctctcacgcaagagtagttgcagtgaaagtgacgaaattgatttttttaaccaagttcgagacgccatcagtaattatgagctcaaagatgatgataatcttagtggggatgaattagagagtcacattaattagttttctagtagaacttactgactaaaaccagtgcaatcagaatgatcaatactcctatgatggcgtagctaataatcttgttggtggccattcttctggtcattgttctaagagtttgaatagagcgatccacatatccatctgcttgcagtagggtatttcttgaattaacaatttgttccctttggctcctcaaatcatttaggatcccggcaccaatatcttcagtttctaaagcaatacgtgatgtttcacgaagtctatcagaagatcgttctaatgaggcattcgattttagtagttgctgcctttgcgtataagaaagattgtcatccgcatcactaccaaaggaagaaccttgaaatagatgatttctgtcctgttcatcgattcgctgtatcagttgttctttaagctgtgtcaatgtattctgataatctctcagagtaacattatatttagtacgatcacttgtagaaacgttttgcagctctaaattgagtctctctaacaggtcataagagtcgtctaagttttcttctacaagccttatctgccttgttctgtcaacagaattggacgccgatatgttagccagatttcttttagcttcagctaatgtcatctgaatatcagacgagtatgtttcaaataatctggacatagtcagcaggtattaaactggagtattgaataagaggctaaattgtttggttctttggttggctacgcaataatggcaatatgtttggcactcagtatatattagtggtgtaggggtgtatacaatcttgcagtaaagtctacagctatcgccaaagaaaagagaagattacataatgactcaaccgatgaaaactactaggtccattcccattactagcagaaaaaagctcaaaagttcattgtttacagtaattacaagggttcttcagattcgtatgtttgttctcgcctattttctcgttgctttattgacttaggacttccatgatctatcagaagttcactttgaaggtataatcacctatgattatcggctagcgagggcgagatcatagggtcctatcatcttgcctcgcgtagctgcgtccatcatatgcaagtctaggaaagcatttacactttttaatttcaagggcattctgaatttggctcagaccaaacttaacaggtgatcagagaaaactttaatcccaaagcccgaatgtagcctatagggcgtcttcgctgacataagcgaatggaaatctggagtttgtacatcgaagtgtggctcactatcacgtgtgatagagtaactcaacagtatggagtatgaaaatgtttcctcatatattggaaatgttatcccaaagttgaagccgaaatactatcctacacactttggactaatacgaaatgaccggttctgttggtgagattgttaacgtgctcacccatgtgccgaatcgtgggcatgtttacaccaccaagctctcaaagggtctgtcaaataatttcagtaaagctcttgatgatgcctcaatagactatcagagcttagtatcgaataatgacccattcgctctagttattgagactgtcaacaagaactcatttactaccgtgctgactgatgctgaaacacttcttttcagcgttccatttcttagtgaggtcagatcaggtgataagcttatcgtccatgctagattaccgaagaacgattactcgattgtatctgctttgaaggatctagatttcgttgttttgctgtctagctcagtacaagaaacacaagatatagccttggccggttataagtttctgactcagaataataaacctgtacttcactttttcaacgaagactattcggaacccatagtggatcagctgtcacctgaggtggtttcttcatatttgaaaagtgaacaagagccattcgcagagaaactctcaatttataacaactttgagtattcaggagctaagaatcctttggatgtcgttgtttgttgggtgattctggaatttcaccgcctactcacacaatagattatggtattattaacatcagagttttccgaccctttgacatagaatcttttttaaatgtgcttcctttttctactcagagacttgccattgttgaacaatctcccaagaaacctttcgcacagtttcagaatttgttgttggacttcgttggagagatctctctgttattagaaaggaagatatttacagttgttgcatcccagctggcctctcctgatctgttgtcattgcagatgttagtatcaaatttgagactgagttcgccggtccagaacgaggtattcggagattcatcagaatttcaaaatagttctctgcatcttcgaaagtacatcacaggtgcccaagcattagaagatgcttatttgaaaattcttaaacaactgcattctgacggtaatttgagcattctaaatcaacaagatacagagacaacaggatcttctactcctgagtttggctttggtagatttctttttgaagaggaacagcgtcaatcattagtaattcaagttcatagcatcataaagaactctgcagtggtcaatgaggagcttattcagctactcaccaaatggttggtatctgcgaagtcaaattccaagtttttagacaccgatagactgttgcagcttctaaaagaaaacagtgctcttcccgaaattgagtctttactgcagttggaatcttcattgcatctgaaatcatcatggctggtaggttcagattcttgggcatatgatctgggaaactcgggtattcataatgtcctgtcttcccataaaaatctcaatatgctgataattgattcagaaccttatggcaaagtaaatgctaatggtcttaaaaagaaagatattggattgtacgcgatgaactttggagatgtatatgttgcatcagtttcagtttattcttcatacacacaagtattgcaggcatttcttgaagcagaaaaacatgatggtccttctgtggtgttagcatatctcccctaccattcggaaactgatagtgcattagatgtgttaaaagaatccaaaatagcggtagagacaggtgcttggccattgtatagatacaatccggccgcacaatctgaaaatgatatcttcaaattggattcttctgtaataaagcgagagctgcaaagctttctggatagagagaacaagctatccatcctagccaagaaaagtccctcttttgctcgtaacttagcctctcaaaataacagagcaaaggctcaacaaaggttgaaagccaaggcagcgtatgatgagctattggaaagtttgaccggtgcatctctgactgttgcatttgcatctgatggtggaaatgcagaatctctcgctaaaagactagctaggaggggcgctggtcgtggtcttaagaccaccgtattatctatggacgatttgtcattggaagattttgctctcgaagagaatattgtttttatcacttctacttcgggacaaggtgagtttccccagaatggtaaagcattctgggatgggataaaaaattctgcagacctagacttggccagcgtaaaggtatcagtttttggtttaggtgattctctttattggcctagaaagcaagatgcgcattattataataaacccgccactgatttatggaagagactactgtttttgggagcccaacaattggctcctctaggtttgggtgatgatcaggcttctgatgggtttcaaacgggttatgaagaatgggaacctgctctttggatttccttgggggtagatggcgcgcccaccttagatgaacctcctccaataactaacgaagacatgaaacgtgaatcagatttcttgcgaggtactattgctgcaggactacaggacacatccactggcgctatatctgcaagcgatcaacagatgaccaagttccatggtatatatatgcaagatgaccgcgatgttagagatgaacggaaggcccaaggtttggagcctgcttatgctttcatggctcgggttaggctgccaggtggtaatgttactccaagacagtggatcaaattggacgaactggctgacgtgagaggtaatggcaccatgaaaattaccacgagggctacatttcagctgcatggtttggtcaaacacgatcttaaagccgcaattcgtggaatgaactcagtattaatggatacccttgcagcatgtggtgatgtcaatagaaatgtcatgtgctctgccttaccaggaaatgcgaaggtgcacgctcaagttgccaaggccgcttcagatatctcagagcacctccttcctcaaactaccgcatattacgaaatatggctggagggagaagacgaaggtgactccagtcccaaagatagattggtatgggaaactcgtaaggaagggcctaagaagaagaaggttatggttgctggtaactctctagtggatgtggagccattgtatggaaatgattcattgtacctgccccgaaagttcaagatagttattacggttcccccatataatgatgtcgacgtgtatgctcatgatgttggtctaatcgcaattgtggacgaaagcgatgtggtgattggttttaacgtcttggctgggggtggtatgggcacaacgcacaacaacaagaagacatatcctcgtacaggctccatgatgggatattgtgactacgaagatgtgaataccgtttgtgagaagatcatgctagtccaacgggataacggggatcgaacaaatagaaagcacgcaaggctaaaatatactgttgatgacatgggggtagacgttttccgttctgcagtggaagaactgtggggtaaaaaatttcaagctgcaaagccatttgagataaaatctaatattgactattttggatgggttacagatgagatcggtttacatcactatacttgtttcattgaaaacggacgaattgaagatactccagattctcctcataagactggtcttctagaacttgctaaatacatgatggaaaagggggttggagaattccgtttgactggtaatcaacatatgcttatctcgaacatcaccgataaccacctccagagagttaaacaatttctggttgactataagttggacaacacaaactactccgctttgcgactctcatctgcagcttgtgtcgccttcccgacttgcggtttagctatggctgaatctgaacgttatcttcctgttctaattagcaagattgaagaatctttggaggagtatggtttgagacatgattctgtggtgatgagaatgactggatgccctaatggttgtgctcgaccttggctagccgaagtggcactagttggaaaagcatatggtgcatataacctattattaggaggtgggtaccatggacaacgtttgaacaagctttaccgctcgtctatcaaagaggacgagattctggatatactgaggccattattcaaacgttgggccctggaaagaaacgaagatgagcatttcggagactttttgattcgtgtaggcatcatcaatcctacaactgaaggtaagtatttccacgacgacgttcctgaagaagccattgcataaacattatactacttatttattatttattgtttccctgagtcatttatttgctgtgggattcgtgtaattcaacaatcctctttccgcttcagtgacctgtaacaccttagctactgagatcctctgctctctttcaagtgccagcacctgtttaatctttacctcccaaagctttttcagaaccctatctagacgatgattgagtttaatatcgacttctcttaacattgactctttttgaagctgaagtttcctagttctctctgccactacgccctgttagtaatgttacagttgacaaaaccatttgatttctggatagtgacaataaacatttgtagtgcaaacttaccttgagcttccattttccgtataaccaactctctttgatgtttagtgtacctcatgcttccaagggttgaatttgttgtgttgaaaggtacagttgagggcatcaaaaacgatacatccatacatcaggttattccctcgagaagtctggctatctacttgccacccttaagaccccaatatctctcaaatcacatccgacgatggtattggaagctacaatgataattctggacaattcagagtttatgcgtaatggagactatcttccatcgcgtttttctgctcaattagactcggttgattttatttttcatgcaaagaccaattctaacccagaaaatactgtcggcctcatgtcgatgggtggtgatggacctcaagtactcacaactctcacagccgattttggtcgtatattggcgggtatacatgatacaaagatttccaaaggtatacatttcagtacaggcattcaagttgctctcttagccctgaaacacagacagaacaaggtccaccaccagcgcatcatagtttttgtgggctcacccatcgatgaggatgaaaaagaactagaaaagctagctaagcgactgaagaaaaatagtgttgccattgaccttattaactttggagaacatgaagtaaatacttccaagctcgaaaggttcatcgcaatcgtaaacaatcacgacaactcgcaccttgtaacgattccacaaggccccaagttgctatatgaatcaatccagtattcaccaatgtttgcagaagaaggatcctctactggttttgctactgcaaatggagaagacttcgattttggcgcagatcccaatgtcgatccagagctggccctagccctccgtttgtcacttgaagaagagagatctcgacaagcacgagagagggaaagacaagaaacaaaatctaccttacccaaacttgacgagggcgatggccatgacgacggtgatggagattccaaaatgcaagataaataggtgccttctgtatattaaaattcctcttctttctcacttcataatcccagcttttttcctatatgggaggcaggtaacaacagtgatccaacgatcttaagtttgcccatatgcgcgaaaccttgataaatattaactagttaaaaacaagtaactaagttaacacagatacacttccagaaaaaaaaaggctctaacttttctaggctgttgctatttaaattgcccatgagtacagctgacttatctcatataccgggaatcaatgccaactctaaaattatatctcccctcagcagcgacaactcttcatctagtcccaaaagactctttctcaatagagcagtaaaagctttgacgtccaaaaactcctctggaactaatcattcaagcgaaattgagtccataattgagccaaggaacaaaaaaaattccagtatgagacactctcacgcatctcttccttgtcttagtactaccagtataacagctcttccattgactcgatcacatttcttggatgtttatagtaaaggcaagtggaacttatccacagttccagctccaccatgttttgagggaattggtattcttaaacctccagaagcctaccacgaggcagtacgtctcggaattctagactcacttataaatgcgaaacaatgggagaaccatagtgctgaatttcttgaaatcattaaaaaggtaacaagaattttcggagttaaaggtgcctctatttcacttatttcatgcaagtttcaagaagtaaaatatcaacacaaccttggttttgacaagtgtcctagatttttgtcaattgatgcccatgccatattgtctatgtcggattttgtactgcttgacgcctctaaagattggagaactcaaaaaaatccattggttcaaggacctcctatgatcaaattctattgcggggtaccaatctgcagtcgaacaggacatgtgatgggaatactcgcaatttttgatgacatgccccgttcttcatttgatacgaatcaaatcaaagttcttcagggccatgtctcaaagatctggcagttgttggaaactagtgataatatgctagacgaaaaagataaggacaaaaaaatggagtcgatagcctcgcctgcgggaagtaaacctctgttgccaacaaatggaactgctaaccccctattccagcagatcggcagagcgacaagcaactctatctctaacacaagtttcaaacttgcaggggatattttatttgacaaagatagatcaggatctgcatatcagtccagcaagaacttctccatttcaaaacatgatttggcttgtgtttaccgagacagatttgataaatgcctctggcaaaaactattggaaagcaaaagtatgagaaaagctgctggcatcttgtgtgaacaaatttgcatacaaaacggaattaaccttgcatatgttgcggaaataagagtcgtcgaaagattcaaaatccgtcagtcattctttcccccaaagaataattcaatcctgtatgataattacaaatatcaggatcagttggtaaaaagtggagaaccacgatgtgcaattcgagtctacgggaccaactctgataggaggtcgagcgtaccaaatttgagcctggacacacaattgcatctgtctggcttcaagtcaaagttaggactagcctttcaaggcagggatccaaagtcatacgttaaatcaggtatggtcgttccattcttcaaaggcaatgctaaattggttaaaaaaaaacctgagaaaaagtatctggatactgatatggtcgaattgaacttaaaatccaacggctttgttatagtctgtgttaacgataatccgaataaaatcgcagaagaaaaagttgatgggatactaaaaaatgcattcttgttcagaaagatttttctggtgtagtttttttctctctctttcaatattaacattccatgaattatgtcaatctaataaaagaaccttgcttcgttaaaatactgaaattcaaaagattatggattattacatttccttctcctatgtttgggtaatcctccaaattgatattttcattgagtgaaagatcccgaatgagtgctaaaagttcatttctagtctccggggaaaactcttgaacattggaatctaaaatcaatgttaccacctcctttatatcacgcagaagagtcgcattattgggtaatgagaacttatttggattggttgctctgggttctagaaaagaataaggtgagtgagaggtgttggatacttgtaaatcattaataatcatgtcattggtcttagcctcttccttaaaaacagattcgaacaaagagtttcctatcacatcccctttctcaagtctaaacggaacgctcgataatgcatgatatagaatcacagtttctgttttcagagacatcaacgtgctatctggatctgaatatgatacatttgctttgtctgtctctgaacctgggtcattcttcagaagttccaacttctttttcaggtttttcaccagattcttcttaaaattgagatcaataacctccttttccctgaagcggtcttggcgcatagttcgatccaatatattgtagattcataactgaacctcgaagatataaacttacctgataataacttcgcgaactgaagtcaatcagctctggaaggagacgcatcgtagcatcaaatatgaacaacgatattacgttatacgttggaaatcttgccccagaagtagatgaaaagatcatatatgagctgttagtacaaatagcacctattaggaaactgaaattacctaaagatcgtgtattgaggaagcatcttggatattgttttgtggaacttgacaaccccaccagctgcgaatacgccgaaaagttgttgaatggtctgtacatctacaacagacccatcaaagtaaaaagaagtatcgttgacaagcaaaacaaactaataactgaggataatgttctcggaacaaaattattcttggggaacctcgacagactggttgacgaaaagtatttagttggcttgatgaaaaattatggtgtacatgaccaactgctgaaaccaccggagataaaaagagacattcacacaggagaatccatgggatatggaattttaaacttcagagactttgagacgtgcgatctggtgataaagaagttaaacgggcagtttcttatgaacaagaaggtgaaagtggagtacgcaaagaaatctaacggcaaaggttaccatggggataagagtgaacggctattagcatcaaaggctgaagaaaactactatcacataagaaccggtacttcgaagaaaattctgtaaattattgacatatttaaattgacttaattctgcatattctgcagctggctaaccactttgatgttcgtatccaaaaacctgtttaaacagttggccatgcaatcttcctctgctgacgacagctggttacttttgatggaggtaatgcattttttgaaacacaggtccgtaaactgatgaatcgacatttgaactttggatttggaggtttcttgctggacgaattgcattatttcctttttagaagattcatctaaagactgaatttgcgacaaagacacatcagaaagcgacgacattttacaagctttctctctctatagtaagaatggattacggtacaaactttttcacgaataaatgcaaaatgcctatcacaagatgcacgactaaattaacgattataattcaagcaaatttagacatctaaacgcagagcttacgagataatgtatacacagaaatggtacttgatgaaccattttgaatgacatcaatctcagttgaatgacggctttttcttgagattactttccccaagcattatctctccatacaacgattatattaaatgtagagagttcaatcacacccatacatagagcagacaactaagaatctagtttgactcaacaacttgttcactactgttcttcttgtcttcgcctttcaagatataatttgctgtctgcaaagctgtgtctccttttcctattctataagaaaccaacctgaaaacctgatatccagcaacagtaccaagaaaaaagttaactgaagctagaaggtaattttttggtttgatgataagggaccacctggtccatatcattcctgtagccatcaacgccagctgctgagttcctgaaatagaatcaacgggtctttgaagatcgttggctcctgcgatcactagagtccatttcagtacgggtgcccaaaagtggattgtcctagggcctgtctcggaatgcaaaaatctggtgaatttagaagccattcttttttgatagagaagctggatactgttgtcgacctgaacagcttaaaacgaatttgggggactggcgttcgtcgcgacaataatgtcttggattatgagatttcactaaaagaggtcatcagactataaattctagaaagaaacggaatgtaatataaattttcaaatcagtagtccaaggtgaaaagaggaatcaggatatactaagttttggagctagctttcattcactgcccaattgaatggcagattttcaagaaggaaatcgaatgtggacgatcatttgtccgtctaataatttgtatagcataaggagatcaaaatgactagagataactagatctttctgaaaggagttcttgactgtcttgtattttgaagtaatatcatatcttttttttcttacctaaggcccataaatatttgctttatatattatcttgactagatttcataatctttcgagttttccccactttcttaacttgaaatggtagcgaattggtgggaatatttacatcttttacgactcttttcccgtcatgtcagtttgggaaacacagtttaatgttgattggatagatgagaaaccaagaatttgccagtcttccctagaggatattccatcattgacacagattttaacttttttgaatcataatcagccggcttgttaccatagactccttgcctactacgtttatgaaaatcatcaaatttcagaggagcaagtcgaccgaatcattgagataaattctctaaattcccttgttgctttgaaatgcactaggccacaaattgctaacttgctggtgcgtcacttatctttaaaagtcgcacttttggatgacttgaaccagaagtccaagattatttttaatagacaatcaacttatcaactagatcaatttcagagttttcttgtacaagaggaaaagcccatactggaaatattgaataaactattggactgttatcctgaacaatcgtgtacaaatggtcggttaataatagcatcgtgtcttcacctaatagatgcaaatgacctaacactaaagagaacagctgttttattgctttccaagtatttatccatgggccgaaaagctaaagaaaacggccgcattggtgctataaaagaatcaatcaaaccctatctttttttcctcgatgaaaaatacagctccatcaatattgctgcctacgacttaatgatacaaatttcagacagaactcaacgaagcaatttagttgctagatatttgattccatatatgatggcaataaaggagagaaatttggggttgttaaaggactgcatgacaagaatactaatacctttagttgatttgatggaagtgtctataattttaaactattcttcgttgcacgaaaatttgtttctgaatatcctctatgacccatacataacactagacatctctctattactgcaaaccttgggcttgtggctccaaattcttcatttgatcagccctaggattaagaaatacaagtacgacattttgagtatagtttcaatcattgaacaaaaagcagcaggaaactatcaggttcaaaaaaagctcgcagaaattcttcagattttgcgcagctcaacctctgaagtagattgggatcaggatatcgaacttcttgtaaccaaaagtggaggaaggccttttatgttaaaatagtttgctcttgtgtattcaatctcactgacttcggtcaagttactcttattatgctaaataatttgatgtcttctcttacaatttgaactctatcgtaaagacctactattcttggaagtcatcaactcgtttactgcttggtttttcttttgcgtgttgtccttttttgctccatctacgggctcttcatgtaaatcctgatcgtttttgttttcttcttcttcttcttcttctcctcctcctctcctctctacttcttcttccatttggagttgttcattttcctgttccttttcttctccttcttcatcttcatcttcttcttcctcttcgtcgtcgtcttcctcctcctcttcctcttcctcttcgtcaatttccgaagatccaaggtcgtcatcatccatgccacgtgaaataccatctatctcgttcagaacttctttaacatttttcgcaataaatgaattcaagtggctcagcctatcatcccatttgatctcaacgcttgaaacggtagacctctggcggagcagaattttttcatcaatgagtttcaaacgaaacctgtttaatttctctttgtacaacgattcttgcaatctttggatatcagcatcctcgattgtaaaaattcctttctcagtctgcattgggtccagcaaatcatgcctggaaacgttgagctggtctagccattccatatcccttttctcgttcaaaattaccgaaggtagattctctaatttctcgagttgttcatttcggtggctgtatagtttatcgttgttatacccagcagagttcaaatgtagtaagtgttggttattaatttgatctatgtttttgatcttttccctcaatgtgtttgctattttgttgtaggctccctttagttcatttttttttcgtatcaactgtacgttctccaaaacgatgaccctttgagcgctattcatctccacaagcgtagcatcagcaatctcggccccgttacttgaagcaagttcctctagttttgacagcaatcctttcacggatgcaaaagaagcattaatagagtctgcatactgattatactgttggtccatttagtactacaaggttaggtagagtacagaatttcaacatcatcctatcgcggcttggattgtgatcgatcatgtttgaaaagatcgtaactcagagcgaacgaaatttaagataactatcagacaattgtttactaccagagtccgaaaaatcttttttatcataagcttcaatatcagtaaacgtagctcgtagaagattgataatctttttgtaaattatattacagtttctttggtgggtcttcaattgtcgacacggcgcgcgcttgatcactttcattcttaaaatacaaacggactacttttgatcgcaatataatttacaccgattcaatgaatgtcgaacaatattttcatttgtcatctattcttcggcaaaatgcaattcttttggaagagttgagtttctatcagggttcaaaatggtaagtatgtggtcagctgagtgctcttgtataagcggactctaacactttgtccctataggcttctagaagcagttaatagcatgcaacaaccttcgacagaagatcaactgatggttgtgagggaagcgccacatttattaaagcttggaaaggaatcatcttccccttccaacgaagaagagatgctgcttgcgtaccatgagacaaataagataaaactagcgaagacttatttcgactgcaaggaatacgatagggccgctcatgttttgaaagattgccatagttggaaagctacctttataaagctttattctatgtacataagtggagacaaaaggaaggaggaagaaagtgatggtatacttggccaaaataactccaacaataacttctattgcaacaagaacatccctgtgatagtaaaagaattagaaaccctggagcatcccaatttgaacagtaactcgcatttgttgtgtctgtatggtatagttctactggagaataagaactccacaaaaggtcaagaagtattattcaagtctctggtattgaatccattcaactggagttgctggttagaacttttatccagtttcacaagcttttcagaagccactgtatatctgagcaagtttcataaagcattgcagaacgcttttgagtataaaatcatgctgcttttcttcaggcttacagtgaatcaggtgttctttcaatcgtcggaagagattaacagtgatttggccacactttcggctatctttccgtgttttagttacttgaacgcacaaaaggctcttatcgcatacaatatgctagattacaacaacgctgaaatcttatttgaccaaatcttgttatctgaccctctaaggttagatgacttggatacttattccaacattttgtatgtgatggaaaaagactcaaagctatcatttttagctcaatttgcgagcaagattgataaatttaggcccgagacttgctgtatcgttgcaaattattattctctcaaatttgaacatgagaaggcgataatgtactataaaagggcgttgactttaaataagaactgcttgagtgcctggacattgatgggtcatgaatttgttgaattaaaaaactcgcatgctgcaattgagagttaccgacgagcagtagatactaataacaaggactttagggcatggtacggtcttggtcaagcttatgaggtgctagacatgcacctttactctctttactattatcagagagcctgctctttaaagccattggataaacgaatgtggcaggcaatagggaactgttatgaaaaactgggtgaaacaaaggaatcagttaaatgctaccaaaaggcactcaaaatttccacagtggtcgacacacaattattgtacaaaataggaaccctctatgaagtgctgaacgatatcaaaacaacctacaattacatgaaactttgcttcgaagaagagtacaaccaagaagtgactgaagacacatctaaagccaaactttggcttgcgagatacgaatcacagcaaggtaattggtcttttacttacaaattggcaagcgatattagctatggaaactctaatataatagaagaggcacgggctcttgcgagagaggcaagattgaaactggatagatagtatacgttaataacatgaaaatcatacatttctgaggaacggtgaacttatttcgcttagagaggaatcagaaaatcgcggtcttggtataaaaaaataaactctgataatcagaactcaagtaagaagaccaatcgttcaaaattcaaaccattcataattgctgacaggaatgagtaatccaacttttccgttttcttctcattctgtcttatcaaatacggaaaaaaaacaggctcaatcaaatgacaaaagatccatttcccctcctcctccacccccaggcaacaaaaggcaaagatcattgcaaacaaggcctcccccgccacctcctccattgggcccaaagatttcaagtaataggccgttttcaggaagtgagtccatgcggtccatgcgtcctccacctcctcctcctccttctcgaccatccattgctaactcttctactgttccagtgaaagactccggttcaaagaacagagttttagatgggagaaaacggaggtggctgcaactgcaaaagttaagatatgcaaatactactgggatcactaaaaaggcctttgttcatcctaccaaaattgaaatgcctccagaacatttaaggaaaattataaatgaccatggcgacctctcctctaagagatttgataaggataagagggcttatctggggtcgttaaaatatttgccacatgcgattcttaagctgctagaaaacatgcctcaaccctgggaagaaacgaaacaagtcaaagttctgtaccatacaacaggtgctatcacattcgttaacgaaattccaagagtcgtagagcctatctacacttcacaatgggccactacttggctaatgatgagacgagagaaaagagatcgtaaacattttaaacgaatgagatttcctccctttgatgatgatgaacctcccgtagactggggagaaaacattcagggtgtcgctccactggacagcattcaaatagatcttgatgaagtcgacgacaaagccgtcattgagtggttttatgacagctctagacctcttgcagatgatccagcaataatgaatggtgactcctatagaacttggaggttaaacctttctcagatgcacaatctttacagactgtcaacgtcattactttcagaaataataaatccgaactactattatctttttgatagagaatcctttttcacggcaaaggctttaaacatagccattcctggagggcctaagtttgaacccttgtacaaagacttggttaacttagaggatgaagatttcagcgagttcaactctgttgatagaataatttttcggcaacctataagaaccgagtacagagtagcttttcctttcttgttcaattcatacacacggtcagttcatgtttctgcacactcttatcccatgttctgctatactagagttgatgacccaaatcttcccgctttccactttgcagagctattttcacccatctctccaaacttgttggagagcgttgaagttgaaaagcaagtattcgatctggaaactggtgaagacttagccccagattttgtgttaccccaggacttttcatttttactcaatgatgaaaatatcgaacaggaagaaaccaaagatgcaattcagctttggtgggctccgtatccatataatcgtcgcagcggcaagacagttagggcgcaagatgttccgcttgttaagagctggtatctgcaacacccaccagctgattacccagcaaaggtacgtatttcttaccagaagttattgaaaaacaacgtcaagaacgaattacattcagccacccaatccaataagacaagaaacatagctttactcaaatcgcttaaaagcaccaagtactttcaacagacatccattgattgggtggaagcgggtctccaggttgttcgccaaggcttcaacattttaaatcttctaatccatagaaaagggctaacgtatcttcatcttgattacaacttcaacttgaaaccgactaaaactttgagtaccaaggagaggaagaggtcaaggtttggacatgcgtttcatttgatgagagagatactaagagttactaaactaatagtagatgctcatgtacagtacaggattggtaatgttgacgcttttcagttggcggatggaatatactatattttaaaccatcttggtcagttgactggaatataccgttataaatacaaggttatgcatcagataagggcatgcaaagatttgaaacatgtcgtttattatcgattcaataaaatcattggaaaaggaccaggatgtggcttctggcaacctgcatggcgtgtttggctattcttcatgagagggatcatccctcttctagaacgatggctgggaaatttattggctcgtcagttcgaaggaagacaatctaaaggtgttgccaaaacgattaccaagcaaagagtagattcatactacgatttagagctcagagcatctgtcatgcatgatatcctcgatatgattcctgaaggaatccgccaacagaagtccaaaacaatactgcaacatctaagtgaggcgtggaggtgttggaaggctaatatcccgtggaaagttcctggtttacctgagccaatcgaaagaattattcagcgctatgtgaaagcaaaggcggatggttggatatcagtagctcattttaatagggatcgtattcgacgtggggcaactgtggacaaagctgtagccaaaaagaatcttggtaggctgactagactttggatgaaaaatgaacaggaacgccagcagaagtttcaaaagagtggcccctttgtttccccagatgaagcagtgtccatgttcaacgtcatggttcagtggttggagtctagaaagtttgttccaataccttttcccccgattaactataagcatgataccaaattgttagttttggcattggagaacttaaaggagtcttactcagctcaaggtagactcaactctacacaaagagaagagttagctctgattgaacaagcttatgataaccctcatgaatgtttagctcgagtgaagaagtttttgctgacacaacgagtgttcaaagaagttaagctagatatgatggaccactatactcatcttgtcccagtttatgaagttgacccactggaaaagattactgatgcttatttagatcagtatatgtggtttgaagctgataggagaagattatttcctaactggattaagccagcagattctgaggttcctccgcttcttgtatacaagtggtgtcagggaataaacaatatcgatgaggtgtggctcactaaagaaggcgaatgtaatgtgatgttggagacatccttgaataaactcacagagaaaatggattttacgtttgtgaacaggttacttaggctaattgttgattcgaatattgctgactatatgacgtcaaaaaataacgttaacatcacatttaaggacatgaatcacgttaatcagcaaggtttagttagaggtctacaattttccagcttcattttgcagtactatggtctattggttgatctcctcattttgggtggacagagagctgccgaactggcgggcccttctgatcatccaaatgaatttcttcaatttgaaagcagagaaattcagaatagctctcctcttaaactgtattctcgtaatgttgacagggtccatatattttttcgcttttcaagggatgaaacaaacgagctcatacatgaatttttgtctgaaaaccctgatcctaactttgagcaggcaattggttatccaaatagacgttgctggcccagagattcccgtatgaggttgatgaggcacgatgttagtttgggcagagcagttttttgggaaatcagtagccggttgccatcttgtttgacttcaataagttgggatgactcttttggctcagtttacagtgtggacaatcctaatctattgttctcaatgtctggatttgaagttagaattttaccaaaatgcagagcaaacattgaaacttatacccaggaaggcgtatgggatctcattgataatgagacaaaggagagaactgccagggcctatctacaagtgaccgaggaagcagtttcaaacttcaatagtcgtatccgccaaatattgatgtcgtctggatcaaccacatttacgaagatagcatcaaaatggaacacggctttgatctctttatttgcctactatagagaggcaactgtcgccactgactcactgctcgatgtacttgttaaatgcgaaaccaagattcaaactagaatcaaactaggtctcaattcgaagatgccatctaggtttccacctgctgtgttttacactcctaaggaattaggcggtctcggaatgttgagtgcatctcatattctgattcctgcttctgatctcaaatggtcaaagcaaacagatgttggcataactcatttccgttctggaatgggtagcagtgatgagagattgataccaaccgtttttcgatatataaccacttgggagaatgagtttttggactcacaaagggtctgggcagagtacaccattaagagacaagaagctatacaacaaaaccgtcggttggcttttgaagatatggaagatagctgggatagaggtctgccacgaataagcacgctattccaaagagacaggcatactttggcctatgataaagggcatagaattagaagagaattcaaaaagtacagcttaactagattcaatcctttttggtggaccagcaaccatcacgacggtaaactatggaacctgaatgcttaccgaacagacgttatacaagctctgggtggtattgaaactattttagagcacacgttgttcaaaggaacagggtttgattcttgggagggacttttttgggagaaagcttcggggtttgaagattccttgaagttcaaaaaattaactaatgcgcaaaggtcaggattaagtcagataccaaaccgtcgcttcactctatggtggtctccaactatcaaccgagcaaatgtttatgttgggttcctagttcagctagatcttactggaattttcttgcatggtaaaattcccacccttaaaatatcccttatccaaattttccgggcacatttatggcagaagattcatgaaagtttagtagtagatgtttctcaggctttggataatgagtcggatatactccagattgacactgttactaaagaacaaatacatcctcgtaagtcttacaagatgaactcctcatgcgctgacattacgttggcaagtacttatccatggaaaatgtccaagccatctcttcttcatgatcagagagataactttgatgcatcctcgtccagtaaatactggatagatgtccaattacgctacggtgactatgattcccacgatatttctcggtataccagggccaagtttttagattacacatctgataataccagctcatacccagctccgactggattgatggttggtattgatcttgcctacaacatgtatgatatgtacggcacttggtttcctggaatgaaaccacttatgcaaaatgccatgaagagtatcatgaagtcaaacccggcgctgtatgttttacgtgaacgtattagaaaaggtttacaactatatcagtcacaagcgcaagaatccttattgaattcaaacaactatgcagagctcttcgataatgaagctcagctgtttgtggatgattcaaatgtttatcgagtgaatgtacatcaaacttttgaaggaaatgtgactaccaagcccattaatggagcgttatttattttaaatcccaagaccggccaactttttttgaagattattcatacatcggtttgggctggtcagaaacgacttaatcaactagctaagtggaaatctgctgaggaagttgccgctttgataagatcattgcccaccgaagaacaaccaaaacagctcataatcacgcgtaagaatatgtccgatccacttgaagttcacatgctagactatccaaatatttcaattcgtcaaactgagctcaagcttccgtttgatgcatccatgcacgtcgataaaatctctgatgttgtcctgaaagcaagggaaccacaaatggtattgttcaatatctatgacgactggttgaagagcatatcatcattcaccgccttttctcgtttagtgcttttgctaagggctttggggattgacaaagtcaaaacaaaacgtatactgcaaccagacagcaaagtgatggtcaaggatcaccatctttggccaactcttaccgatacacagtggatggaggttgagacacaattaagggatttgatcctcaacgactatagcaaaaagtacaatatcaacgtatcatctcttacacaggttgagatacgggaccttattcttggtcaagatgtaaaagctccatcactgaagaggcagcaaatcgctgaaattgagcagaatgaattgaaaaatgtcagttcgagtcaacaattcactgcgatgaaaactactacaagaaatgtacacggagaagaaatagttaccgttacaactactaactatgagcagcaacagttttcttcaagttcagagtggcgaagtagggcaatatctgcggctaacatctatcttagaacaagaaacatttatgttctgacagacgaagtctctgaatccaagatcacttttgtattgcctaataatctacttaagaagtttgctcttatttctgatctacgtaccaaaactgcaggattcatgtttggcaagtcaccagccgataattcccaggttaaagagatccattgccttgttttggtacctcaactgggatctaacatatccgtttcaatggcgaaattgcctgcaacctgtgagtatttggaaggcctagaacccttagggtggatacacacacagtccactgactcggattatttgtctgctgctgatgttactgagcatgcacgtttcagctcagagtattctggttggaacttggattcaacagtcactttagtcgcagctttcactcccggatcaatatcattatcggcttactctttaacttcagagggtctcgattggggattaaaaaatcaagacacggtttcaataaatcctcaaggatacatgccgcaatttggagagaaatcctcagttttgcttacggatcgtattaagggcttctttctagtgccaagtaccaatctttggaacttcgcctttaatgggaatgcttggactagcagtatggaatatactttgaaactagataccccattacccttttatcatgagctgcatcgtccgattcactttattgaatttaccaatattgaagaggactacttggacataaagacagacgatgttttagttagtacattaattaatcctatataatgttacatcagacatctaacatctttccatttttttcccaccatctagagtaagaattatagaatactttgaacagcggtagttaatgccagatgaaacttccagctctaaaaaatttagttcatctgtaattactgcacataatgcgtgtgaatctgctagagatctatctcgtttgggttacgacttctcagatattctgcagcaaagcaatatcaatgaggaatttcttatagaaaccttcaaactggcaaatttgcctctcacaaaatcaaaagcttccaaaaaaaggattctcagacaagatataagtgatactagtaagaaattccggtctgcgccttttggaaatgataactggattaaagacttagtaatagagctttcagacgatgattttgatcccatgtgggaagagaatgcagattgggtagctcagaaaaacacaagaaaagaagaagagtctagactcaagcaagaattagtagaaaaagaacaaaaaatggaagaactgcgaaaatacattgagtccttggagaataggaaatccccaagctcccacagtgaagaaaagccaacaagcaaacttaggacccagaatactttcattcagccagaaaaggaatttcaagtttctaaaatagccctgcttcaagacagaatactgaaaacttccaaactgctcaacaagtatcaaatagagacagagaatgatcaaatccaaatcgaaaatttagaacgagaattgaacctgaggatgaagagtttgaatacaaaactgaaactgttgactcatgtcactgaaataatggccaaacagcaaagggatttgaaagagctttttaaagagcaatcttacaggaacgattgtggcggcattaacaggttgatcattgatgacatgaaagcaaaaccaaatcctccacctggttatgaactcaactctcagctgctgaactcagccgatcattaccagttacaggagtttccacttgagagagcggaaactgaagactcagcaactgcatatgaacacagtgaacacattgttggtgatcagcttgtatctatgggtacaagagaagaggaagacaccaactgccctataatgaccactcgttctactgcaaaatccttaatagggaggtttgaaccttataattctcccttgatttgtttcaagtcctacagattcagtcccagttttgacgatcgacagatttcttctctaacttggaacagtaaaactaatgctatgaaagaattttgtctttatgaggtattgaacggtatttgtagtgatccagattgcttgttacagcacttttcgcaaacgtctgtcaatggtaagtttacaattaggcctctcattattaaagagtatactaacaagatgcaaataattttcattatttgtgatttcagagactgatataatcatagatttggcaaaagctgtagtaggtaaaagtggagaggagaaacaagcctacatcaaaagcctaacagagctgctatcttctaataagaatgaaccgttcgaaaggatggtgaatattatcaaagggttcaggcagaagcatttaccttctgacacttttttggattggattcattttgagacaatgtgacataatagatatatatacgtgtagtgatgactcttttttaactcgtcaatagggagtctcaaatagcttggtaactactttcgtttttcatcaaacaatctatccatatcctctaaatctacgcctcgagtttctggatatacaaggtaagcaaccagtgcagatgtgaagcaaaaggtagcgtgtatcagataaactctccaagtaattttctctaacagaataggagaaaattctcctacaatgaaatttgccagccaattcgtagcggtggctaaagaagcacccttagacctgaatgttagcggtaatatttcacttggaaagagccaaggaatgggaccccagctataagcaaatgatgaattagctgtgataataaatattacaaccaactgaggggtgttcttcagattaaggcccataaatattgagacaagaagcatcgaaaggcccatggttattcctccacaaatcaatattggctttcttccccagcgatcaatcaataaccaagggggaagtgtactcagaatataaattatggcattgagtccagtcattaaaacagcctctcttccaatccaacctgcctgttcaaagactaaaggagcatagtatgaaataatgttgataccattgaattgtgcaaaagctaaagcactagttgccataaataaccttttagggtaaacggtgaacaaatcaatgtaacgtttctctcctattgcccgtgcttcgagtatactggatttgatagaatcaaattcctttcgtgcacgatgatgatctgtctcaccattagtatagagatcagcaatcacaactaagccctctatgtctcgatctttatgtagaagccatcttggggtttctacaataatgtatgagccacccgcaagtaaagatccaataacacactggatgaaaagaggaattctccacgaaagattgttttcaatgaatgagcaaccgtaatcgacccaaatagacgacgcgtagccgaatatgtttcctgtgaactgagcacatgccagtttgcctctgttgtgggaaggagatatctcggcttggtacatgggaactatggttgataataagccaactccaataccagaaataattctcccagctatgaggacttttagattggaggcggcagtttgcagtaatcctccgacgacaaatataaacgctccatatcgaatagttcgccttctgccaatgatatcgcccactcttccaacagtcaaagaagaaaaaaaagcaccgatctcgagaatggcaacagttgttcctatcatcgcacttgaagggttattaaactgctgtttgaaatattttcctgttataatgccgctcatgacaccttgatcatagccaaagagaaaaacacccaaactcaccaggaatgaggtgaaatagagcagtaactgtcctttgagcttgcctctggactcaagcaaattctcgttaaaatttgaacccccatttgtagacatgttaccgtttactgggtcttgagttagtagtcgttcttcggggtccgtatcgttcagcacagagtcaaaatcatcttcttccagttgagaggtcttgtgaaccgaaactctagatagctgagcggagtctagactagttagctcaattgcttgtgtttccatttgcatttcatccgaacgttgtccaaccggttcagtagaaggttcaacagttgaacgcgcctcaattctccaggaccgatcatttaaaggtaaatactgcttagaggaaggcatttatgcattggaaattttaaaagaggcaaacctagacttaatttcagtgttttgagagtatactcaaaatctgatattcacaatgtaatcaatcaaacattccaaggacgaatttggagaccggaggatgcgcgtgtgcctgacataattgtgacgtcactatatatggaagtgatttcgaggctagtctagtctatatctctatatatgcaaaaaagttcgataagttatgcccttaacctactgatccttcttgaaaacggtactcttcttgcgtgcgtaactttcaatccaaaaaacagcaaaaagcatggtgagaggggtcaagtaggcgacgttgataaaaagggccattgctttgtcggcatttggaatgcatggtttgaaaataccatcaaccatatcgtaatagttaataaaaaggtgaaatgttgccagagaccctcctgcaacaaactggataatctgcatagtcgttaatagctgctttaatgctttgggtacacgaactttcaggcacgacaacgtgaaatagaaatacataacagagtgaatgaacgaattgaacaccacaaaaatccaaattggaggtgaagcaaacctaacgcccgcccacatgctgatcatagcacctgcatgatggtagctttgcaacagggaggaaggccttccttttagtaggatgatgaaggtatcaacaatttcataaaactttgagatgtaaaaccaaaaactgtagaatgagaggccttttagattttgttgtttgttgttaaaccatatcccattatccaaatcacatatggattgccaaaacaactctgatttagggaactcgaactgaaacacatgtttaccctccaaattctgagaataagatgaagcaaacaaactgggtagaacttggttggatatttcatgaattgtcgtagacattccaataaatgtccatactgagtaaatacataagaaaatattgtgcagtagcacaaagtttcgaaacaaacaacctttagtaaagaagaaaggagcagcaggcagttttgatccttcaaaattacccttcgaatttgcaagcctaagctgtctttttcgaatgaaactgttacacacatgaaccaagatgaaatacgagagggcaaacaccaatggaaactctccattcaaaacaaaaaagtagattttgttaagtaccaactgatcaggactgaaaggagaatctggaggagcagtgaaggctggaagcctgaaaacctgagctttgggaaattgtaagctaattagcttgttggttaacttctgaaactctgcgtctaatatttctgccatttcaggatctaaattgtcagtaaagagaaaaatacgatcagaattgaaactcgttagggagagaaccaaggagcatcggtttcaaatctgtgaagccgagaaagttcgtagcaataaagaaatatctgaggtgatggtttcgactctcggaaaatacattattttattggttcaagtgctgactagctggtggaacattcgcgtttccccaagattgtacttcccctttaggaaacttccgtggtgaacaaatgttcagagtagtttgctcggtttcggcttccctagtgcctgtaatatgccatctattacccacccacacaaggcattttattttgttgcatttatacctctcaaatattccatgttaaagtttgtaaccttacctccttcagtttgttaatttgagtcttcactactttcggtttattctcctatgccatcaatgataggcagtttgggttatgagtatttacttgaacagcctggttgcaatgccgaatccattagcttcacagagaacttaggttgttcttccggaccgaaattagtacttgcttcaccttccctgaaatgcctttactcttccaaaaggtcgacgttatcttcacttaggcattacaactgttgtttgcggtcttcctctttagaagaagataattcatcgtctttgatttcgtccgatgaagaccaagatctggattttacatcggtgggatcagatactacggttcctacagtacacaatgactacagcccatatttatccgctcatcgatccacgtatcgtcactcaacacaattacagaaaaagcacagttacgtttcagttacagtagaatgtaacgaggatcatcctttggcacaaccgtatgtttgtgaaaacccaatcaccatgcagatactaagatcaagtaccccaccatacactgaacataggaaccctaagttatcttcattgaagcaaattttgactgctatagccgaaggcattggtagcagaattagagcacggcaaatgactcaacagcgttgcatcgtacaccaaaatacaaatacatctgaggcactacccccgatcccactcagaacgttccagacgaacatgacggtgctggaatctcatcatgatatcgattctgcctctcctcatagcacaacatcaagactgcagcataaagttagagaaccaagagttaattcgaactttcttcggttttacgcacaagattactcaatcaaggaaaagcatcttttgcctgtttcggaagacgacattgatgactatcaatacaaactgggcctgggtgaacccatctctgattctcgctttcattcctattgtaaattaggcttgctatcaagggaacgcttgtggtccagtgtcattcttccaccccgatcagacgaggctgatgatcactcgctctttaacaatgaatacaaacagcttaaaatttgtcctcattccaagaactccatctgcagaactagaggtggcgtgttgccatgggttaaattctgcgacaaaaacagaaacaaactactcgagcctgggcagctattgcgacaaaaatctctcaggccgtatggtgttttgaaccagaatactcaatatgtcgtgaaaggatggataaacgaacgatttattccgattacgtcttcagaatgaaattattcgcaccaaatttcagtctcaatctgatccatgactccctttcaattctttaattgtacattacagaagccttttattacatttcattacattttatttatcgtatagaaaatgagatacattaagctaacaattttcgtctgaatttatcaaactatcataaacaaatttcaacttgtatatctattacggacagccaacagtagaggaggaatcacgaatgatgcgaatatttccatttgctgttttcccttcagaggtgggttaggtctaactcatacaagtatttggactactgtgatgtacaacagagcatctgtggttgcgctcgtctaagtaggcccgtctaaggaaaatcattgtctgctacttaccatataaggaaagacatgactacttgatttgggcaaagagcttcggcagttctcaacatatcccatggtgaaatgtatataagaagccatcggagaaggattcaaaacgtggaacacagtatgtatttcggcaaaattttagtctactccatcttcagtgtcattaccttaggaggtgtagttgtgaacagtgaggaagcgccaacgaaaaaacctgcagaaaaagaagataaatggccagccaaatggtgcgacaaacagtgcactgagaccaaaatatttgctaatgcttgtaaaaagagcaagaagaagtcaattgactgtatctgttcgtcgcactttgctgagaaactaggaaagtgccgcggtgatggatgcggtcaacattacaagagtagccattggccatcacaaattgagccgctgttggaggattgcagcaatggcagataccatgagggtccactctaggtaattgaaaactaagtatcctttcatgtcagtataaccaacagtctgattctctgtagttaatttagtagtgaaattgatatatttctcacgagttctaaggatcaaaattagagtatacacttgcgctgagatcattaagttccggtaaattgtttaagtctgctaaaatagggttctccacagagttgttagtcaacgaaatagactgtttggttatgtttgccagcaaagctgctaatttgtaggggggaaaatcattgagatcaatatcacgtatattcatatctgaaattgggttcggtcgattcttctgtaataggttgagaactatttcatccagaactttggtaatacctagggtagccaatttgttgactatcagattgatgtccgcattgttcagatagttgtttaattcatccaataacatgttcaagctctcagtattgacgatattattgttgaagcgggataaaaagtctaaatcatttgtctgttgcaaaaggaaaaactcaaactctttgggtggtaataaagcgtttgtgataaagttagtgctttttcttccaacaggctgggactggtcttcgataacaccgactcccaaatgtatatcctcttcggtaagatttaaaaccttcaggtcaatacaattttgacatttgtttaaaagctcggcaaactcatttatcttcaattgctgtctgggatttatacctccaaagtgttgttcaacacatggctcaatcttgttctttatctcaagccatcccttgttgagcagccaccaactaaaactcaagaatgcttgttcggataagttttcatcctgagtgttgccagaaaagtcaccattagactcttgatctaccaaatctatcccctgggtctcagaagccagcctgattgcagtctcaagataagacttgcgcgatagaatattaagctgaaggtgtaagaatacaatcagcaaggattcacaatatatcagcgtgagaaatcttgttattgctttgatttttagctcttgccacaattgatttttacttttcagttcaggaggtttgttagtatcctccgatatcgctccctcttgagatgttgagaaatcgtcactaagcacagtggatccggaattcttaacatctttgttgccaatttgtttttctagccgtctaatttggagctgcttggtgatagtctctactggcaaatcgtccataattggttcacaaagtactggcagcagtgatagaaaggtcatgtagcaatcactttgcgtctggtgaaaccgacgcttgatttgctctttggcaaagttttcctctctaattcggttttggaattcttggatcttgttattgatagttttggttacatagtaacctactcctatgattccagaggatataagaaactttttcttgtttcgtcttattaatcctgccgtgtactccaacattacgactttgcaaatatctagtgattgtatgcacttgtgttcctctcagagtttatggctttgcaatgatgatcaaagtaaagatgaggatctaacgagaaggcagggaggagtagcagacttcttacgcgcgggcaaatagtctgttctccacattaggatgagtcgtgcgcgcgtcaagtatcggctacgattcaatttgcttgagaggtctgctcaaagtatttgataatcgttacactatcctcaatccctactgcagtatacaaaatataaatcagttgttagatgcatgataaaaaagggatggccctactctattgttttcaaatcatttggaaaccttgacatttttcttttgagacctttttcttatcttcttggtatttttcttaatcgaatcaacaattttcgttgtgttcgtatcattagtattacatatattttcaaattttatgtgagtgttttgtttattatcattgaagttggcggagctaatggctggggttcctagcgaatccttcaaattgttgtgaatactctccttcatttggatttcttggacttcggactctcttgatctctcttcgaaagttttaactctgttcatgtataattttacccgctgtaggtcgctcataataccatgagtatgcacatcttttactccattaactttcaggtatgcaaaatacaatgaagatagtatatagctcaaagaatttagcattttgcattgatctaattgtgacattttctctatgatatcatctagcttcttaaactcgagaatctcgtccaacgaggcagaaacattgtccagtcttacgtcaagattattcacgagtttctggaccgtatcaacgttttccatcttaagattacagtaagtatcgtccttttgaactgcaaaggtagaaaagttaatttttgatttggtagtacactatgaaacttgctcaccccaatctttcctcctgacaggttgatctttatccctctactaaattgccccaagtgtatcaagtagactagatctcgcgaaagaacagcctaataaactccgaagcatgatggcctctatccggaaaacgttaagagatgtggcaacaggagggcacatagaatttttaaagacgctgaagaatgctatcatagtccgtaaaaatgtgatagtactttgtttagtgcgtacgccacttattcggggccaatagctaaacccaggtttgctggcagcaaattcaactgtagattgaatctctctaacaataatggtgttcaatcccctggctggtcacggggaggactatcttgcgtgatccgcttggaaaatgttgtgtatccctttctcaattgcggaaagcatctgctacttcccataggcaccagttacccaattgatatttccaaaaaagattaccatatgttcatctagaagtataaatacaagtggacattcaatgaatatttcattcaattagtcattgacactttcatcaacttactacgtcttattcaacaatatgtcacaaggaacaatttacttagtactcgcctccccaagatcatctttattcaaggatctgattgaatattacggtctcgatatcaagatctctgacacttccgacccagagtttgcgaagacatttcccttgaagagaactccctccttcaaaggtcctgatttcgtactacatgaagctttggcaatatttgtgtatatcacttcgttgattcctcaaaaccatgggctgtacggttcttccaacttggattacgcccaaaccatcaagtggctatccttcactgcgtctgagatcatatctggcttagttcaagcactgtatccgctcatcggaaacctgccatactccaaagatggcgttgaccaggcactcaaagatttggagtcgtatgttgctgtttatgaaacccagttaaagcaaacgaagtatcttgttggcgataagattactttggctgatctgtttgctgttcagtctatcaggtggggattacaatatatttgggacgtcaattggttgaaacaacatccattgattgatgcctggttcaaggatgttactcaacatccaatcatcgtcaaatctcttggagatttcaagccgttgcagaaggctcttcctaatgctcctcctaagggcaattagtttgatggagcacatctcataacttttcaaacaaatctggttgttcttgtaagaaccaagctaaggagggagcctcagtgcttatgcatatcaggctgttcagtttgtattctttataagtatgtgtaacagtcttattacatgatgatatctatatcacgaaaagaatccagtggaggcagttgttaaatcttgtaggtataaaaagtgattctgcccaggatcgaactggggacgttatgcgtgttaagcatatgccataaccaactagaccacagaaccctttagttgtcagatcacacaagagctatccaagtgcaggaaaattacctaagagcagaagaataagctaaaacgatacgatacattctcttctattatccatagaggaagaattttttttgctgaagctcattaactttctttatcaaagctatcttgggaaaatctattcgcaccaagggtgcctaccttcctacacatacacgctgtcactgggtccaggtccgtgtggaaagctattctcaaagttttcaaaatatgagatgactggcacagtcaactattgactccggcagtgatttcttgaaaggaatatttgatgtatcatgattgtatctagacaacatgaccattgatttatggcttcgccgctttagtcgataactgaagatactactggttcagagtcaaccaatctgcaattcttaaaaactgctgaaaagtatcacagttggattaattagatatgaaaactaattgtttatttacaataagacgcagatagcccctttcgttcagaatagtcatttcatcatatttcctgatatatatgtctacattagtcttcaattgaactctgtcacagtggccgagtggttaaggcgatgccctgctattctttgaaagtagttaaggcattgggttctacctgcgcaggttcgaatcctgtctgtgacgctattttttttttaatttgaagaaaagcgcgaacattttcagtttttcttttgtaagcaaaccgaatttatattgtgcttttcaatcacaaacaaactgaaaactgacatgaagccagagaagtttgaaggagatcaggatacaattagagccgatgtctggattgagttttcgaaaattttgaaaaggtatcgcctgaaacttgatagcgtagatttgtttgaaattgtttcagaatttaagcgggtttgttccgaaaccatcatagaagctgatagagagggcttttctcccgatatacttgagaattggattctggaaacgaagttttggaatttggttgaaatgctcattaaatataggttttttgtggatttcgaaaagacaaactccgatactgatgtcaacccatatagaacagacctttccgtgaaggagcaaatcatatctgctaactcaaacctaaaagaactgatggttataatatcatggttgactcaaaacttcaatctggacctagttgacagagatccctttttaccggactcgaaagattcagaattgcaagcgaataaatggttccatactcgaatcgatatacaaagtaatgaagacaaaccaacattagtaagacaattggatgctgatgccccactaagaggcaaagataataacagattgaatgaaaaagatgttcagtacgattctaacttctttgaaagagtattcaggttacttcttgaaggtaatatcgatgaaattagccagttgtgcaaagaaacaaacaactggagttttgcattggtcttaaggggtttgaaggatttcattgacccagaactaaatggttcattttctcgagatgatgatgaagatattggtgtgaattctcaagaaacaaaaagatgtatcggtataaagaacagaaaattatggagaaagacagtctaccaactttccttgaacgaacaattgactgataaagaacgtggggtttatggatacatgtgtggatctcatgaagtaccggttaagctgaccaattcctgggacaggcaactactgatatattgcaacaatatcttacagcatgatatggaaattgaactagagagagtcacaagaccacttaccggttctgccgatctacaactccccctgcctcccaaaaagcaccgtgatttaaacgatactctcaatgcactagcctcttctaacaatccatcaataagagagcaaagtcagcattccataagagttttgagtggttcattgataacgaatagtattggtgaattgctgaaaaactcctctgacttactcaatgagatgatcacgggtggagatgaatccaagactgaagctgatcttattaaagagtcgtatctgctaagaattttggtccacttggctatttttatgagaatgttggacgattctattatttctgggtctaatttaaacaatctcataaaagtttacattgcaaggttgtctttatacaagcaatatgactcgataccagtttatatatctttcatttccacccatgctgatacaatagagacttacacctttattctatctagcatgatcacagataaagcagatagattgaagcagttgaaggaaatgcgggaacttgaacttcctctagaaacaattgttaaaagaacagttcaaagagtgtttgaggccaccgagtacctgtattcgaatcatactgaaattatcatcagtgcagatgttagccacattgactacaagctcatgcatacatttgattggttcgtcgacgctgatatgagttatgaagctctagatgcgattattgtcttgatgagacggtttttgttgaacggaaaagttgcagcactagtagagctacatgagcacattgccatccagaaaattttggacgactacaagctgcgagatgaagtatggaagaaccacggaagcgacttggcgctgaatctaactacaatacctgagtataagcttatggaggtttcccaatatttgaagctggttcaaatttcaaaacagttacatgagtacgaataccagggaactttagaggaaccttccagatccgttaacttaatcaacagtcttaccaacaatctaaaacagatcatcttatctttcctagaagggttatacaacccacctgctgaaagcgaggtgagtccggaggataaacttatgtaccaggaactcagagaactttacatcccaatttggatagatacattgtttgatatattggtcgagaatcgtaaaatcagcacagtttatgtcaaagaggctgccgatgtcgtcaatcttattgccgatgaaaccaacaagttctattacatgcttttgaaggtcggaaagctagaaccattcctacaaaagtttgctttgatcaccacagatatatttgatgattatgaagatggtatctttgtctaaccaaatacacgataatttcaaagcttaattcaaagttgatgctcgctcatacaacaaatcaacagccttggacatatttttgatcaggtctaagcttatttcgtaactcttgtcagcctgcgattcttcgtagattatcagccacccattaccttgatcaagaacgccaaaaaaaaccttatctagaatcatctgtcctaatttattctccaccacctttgtggatagaccgatttgttgggctaggtatgaaacctcaactactgaataaggttctattagcttgagcaaattctgctcaaagagtgagttgtaaagatccatgatgtgagacttaacaattggatcttgagctagttcttgattgtaaattcttagacattcttcaaactctcttaaagaacgattgtcatgggcttttgacacttccctaatggcttcgatgtctctattatttgtatacttggaaatagttttgttcttcaacaactgaacaacatcatcaacgagattgagcataatcttcgagagtaacatatacttcaaaactattatgctcttcgattcatcatcatgtaacgcaaagttttcgagcgattcgtagaagtaagaaaacgcagtcttgaaatccttgtcctctgcatgcagtataccactcatcaagtccaattcagcttgcaactgagtagggcagtaaatagaattcgctgatgttctggctgaggtgaggcaagctcgggatttggcaaagtttttcagagataagtagttcttggcttctaaaagttggacttctaccaatgaggatttatcatccaatcttttgaattctttcaataacttgtcaatgatggcaatggaatctaagaagcttgttttccgatagtagagtgatgctagtcttaattgtaatgactgacgtaagaatgaacgtttctcttccacagcccaggcaatacagtccttagtgatttcgatagacaggtccagcgaatctggtaaactttccacaagatctattaaatgtttggttattttggcagttttagactttgcaaaggaacccattatagctctagatttcggaatcaaattaacaagttcttgctttttgttatggtccttgtacaattgacctaattccagtatggattgttcttgcttctgaacaagttgttcctttgacgaggacgactgactttctccatttttcaccagtagtatctcctggtaaatcttctctgcattcgaaaaatctccagactcaagggcctttcttgcttcttcaatgggtggagtagacatggaagctagatttcgcaagaagaacattgttactggaaatggtggcaacaaggtagttaacgagaggggcgcgaataatggccatttattactcgatacggggattaaaattcttgttagtcgtttaatacatggatacgaaggatgtaaaccataatctctttactagaatagaggttacagtttgagtgctagggtcagttcagaataccctctttagtttctagttgcttcacaagttcatcagatttctctgccgtttctttatccagtagggcatcaatgatttcgtctaacttataaccgttcaaacagccttcaacattgtgcagcgaatagccacatctatgatctgtgattcgattttgagagaagttgtacgttctaattttatcgcttctgtcggtggaacttacctgccccttcctctcagctaattctttttcctctttttcgactctctctttttcagccagtctagccttgagaatcgtgagggctttggctttgtttttatgctgggacctttcgtcttggattaacaccacaattcctgaaggtatatgagtcaccctaacggcggactcagtagtgttcacgtgctggccacctgaaccactggccctcataacatcaatgcgtatgtcgtcgggtaaaaacgttcgattcaaactggtatcgtcttcatcaatcttgggaagaactactacagcagcggttgaagtgtgagttcttccctttgattctgttgcaggaactctttggacacgatgaaccccagcttcgaatcgcaaacgattatatgatccaggctcgttaattacaatggcggcatcaaccagtccattgcctgaagggtgtggatttcttgaaattatctcatacgaccatctatgatgctgggcgtatttttcgtacatagagagtaaatcctcggtaaacaaatttgcctcgcttcctcctattcctggtcttagttccagaatacaaggcttgtcggcaaattcatgtggcggaagtaacttagtctttagtttggaggttagtctctttaatttaggagcggcctgtgttagctcactttctatttcttcttttaacgaagggtcttcatgcaacatcctttgtaattcttcaacattttcagtttctcggagaaattcattataagtttccaccgtagagaccaacagcgaatagtccctggaatcttgataactgaactcgtcacttgaagaaagctttgattccaagtctttcaattgtgagctcaacctggaagcctttttcagtagcgtcggactgattgattcagtagccacatatgatttgtcagataagggtcgacaataagttaaaagtgattttgcccccaataaatattgggaatttcgaatcaaacaacgacctagcatttagtaagatcgatgttggtgtatggttgatagcacttgttgcatatgatttgaaaaatagcgaagaggaggaggatgattgctgtgtcaaaacggtgcatgcatataatacataggccacatccaatgttttgaactaaaaagtagcactagtagcaaccgaaaaagatgacaacaattaacagaccagttcaaatcgaagagtttgtcttagctataagggagctaccaaacgagagtttggatgccattagatctcaattgagtacctccgtccacagattgaatgagtccaataaactaatggagtcccttcttctaaagatcaggaataaagataaatcgtcaagtgaaatcgatgaacttgaggatctcaataccgaggagaatgatgatcagatttacgaggagagtataagggaaaacgaaattgttcttaagaatcagaaagaaagaattgaacgaattgaacaagagttactctcccgtagtaccgaacggaaagaggagctaccttctgctagtgcatcagcaaagtttgaactcaacacggacaacaatggaattgaatctaatgcagccaacagcgtttttttgtaaattactatgcgttgggaacacataggaatggaagagttcagttagttattttataattcttttgcgtttgttaggttcatacggattagtggttagcatgactaagtagttaaacgctagcggagatactcatttcgctgaagctttttttcttttcatctcgaatgttactattctcttgaatctaattaattgtttctcatctaatgttcaaaataactctctccccagctgaaagatcatatcttcacgaatcgttgtcatgtttgtcaccaataagacctgatgctcgactcaacaaacagtttcgtcctttggaagctacttgttccttcttaccagggtcaaatggtagcgctaggatacgaatggctgacggtgccgaatgtttagctagtgtcaaagcaaaggtagtcagtttgcagctgaacaacgcaaactctgcgcagcacctcaagaatctgattgaagtagatcttgatataaatggaatacgggacgactcgaacttaagctccactatcgcttcatctttgaagggttcactggtcaaacacatcccgctggaaaaattaaggttgacccatagatatgcatttaaattattcatagacattgtggtattatctcatagctctgtctatccgctaactcttctttctttagcaacttatatggctttgaaatctacaaagttgccgctattaacatccacggtcaatgatagagatattgaggaacaacctatgttctcagatgactgggaatcatccctagcattatttggtgacagctcgttgagtcctcctttgctatttgttgttgcggttgtgaaagataatatctttattgatccatctccagaggaggagtcagttagcgagaatggaatatgcctaacttacgctaacggaaagataatttctccactgcaaaccatctcactttccccaaaggataacacaggaataaactcagcacaaatactaaaagcccacgctttggtcaaagaaattggcccattagtagttaagtctttggatgaaattgtttcggatgactccattaagacaatcttttaaacatacgtatattacactaacaatgctggatcgcgtatgcgtggacaatcaccgcagtggcagtttgaatattcattgatctgataactcccacctgtttaatttcaacacaaaagtcaagttcagctagtattgagcttggaataccttccttttccatcccgagtacgataagtgacttttttggaaatttcagctcactgttcagctctacggagtcgtctgtttgctcaagaccaatcaaggtatatccttgttttttcttccgtaacataaacccaattatgttttctttcttgacttcctccaatggcatccatttatcagcagttaccgcgacgttcttgaactgaatatgttctttaactcgcatatcatccaaagtcagcaatcctgctcctaaaacatcactcagtcgacatattcctcctagatttggcggtttatcaactaaagaagccatgacgatcaaatcagatcgtttccggacatgtccatttttatttgtctcatcaacatccataaccgtgctccatgtaccacttttggtttgaagaagcgttccaatatctgcattggaggctgaaaaggagcttttgttggatttttgtttttctggacttctatgtacccattgttctctttgatcttgacctatgggtagcaacaatttttctttctgctcttcagaaacatatttcgcaaattctttttggcaaataaattcagtatatctatcagagacttttaataaaacaccaccacaaatacctaccaatgtcaagtcttcagttatgtcccatatcaatgcatccccagatctataggtgccgaaaccttctgatttaagggccatgttgtagatattctccaatgagcggacaactgctttggggacatttaaattttgtttttaatctcaggaataactgagcataccaaggaaactgaaaagtgacgaatcaatgctcgatttgaagagcatgaaggaattaagtagttaaccagaaaattggttaattcttgagactcactctcaaagtctaattttttgatcaccagatacgaaattctctcaaaagttgtcatataggtcggctgttggttatcaatatcatccttgaaatacgcaagaatagcttccttcgaaggcgtgacattcagcagtgtatagctgaggatccattcaatatagacccgacaaagtgggctagtttccttgaatagaagcggagcaaatacctccgttactaatgtaagtaaatctgacttcccaatagtcttaatggtgagtaccattacgcataacaattggattcttttccattcttctactccatcatttctttttactggtgtttgcaggtgaaagatggagtcattagtcagaataaatctccagatatgaagagcaaacacagaggattttatcgaggcaagaatagccgcaatattggctctgaacgaaacttcttctgctccgtataccctttcgtagatcctgtctccatcgaaattgaactcttgatcataaatggatcccaaaataagctcaagtctgcataggttattattcaattgctgcaggaagaaaccgtatactaaaacttcaccaagccagaaggaattttcaaaaccatcgttgtgtcttaactgaaaacttgagaaacaattaatcatcgtgggaaggagtgattttctaccatatccattgtcgattatttgcagggcaagtctccttaaagattgagataaccgaccactagcttctaaagaacaactaagaattggcacactaaatgccaactcgataaaagccaaatgtagtggtcgctggtttagtattaatctatcgaccgtaagatcatcccaaattaactccataatttggaccaacgacaaggattcgtcagtagtcaaaggatcactcgtttgaattaatacttgaagaagattaatggcttctaactttccatagaagcctgcaaaaaaagcgttatgggaaagtaaattataaactttctctttgaaagtcccatcaattcttgatatttttgctaatagttgaatcatacggaaaagtgatccataaaattgatctttgactttgtaaaaagcagtggaagtatttttgggttggtttttaaaggatgttgcacccagattgaaaacattctcccaggttaagaagctttcggcaacgtcactgaatacagaatgctgaagcacctccacaaaaaaatcaaacttagctgtggcaagagttaaagtcccttcgttactagactcaaactccgtcaatatactaatccaaaaattattcagatctgtattattccaaaacgggtgagaaaatatacttgtatctttaataaggcagttcgtattctcaaaatagatctctgagcaagaactgggatgagtgatcattttgcaaaccaattgttttatttcggaagatataacaggttcattgactatatcagaaaaccaggaagcatgagctcttaactgaatcaaaatcttgcaagattgaggatgttgtgaaatatccgtggccaacaaacttaccatagacttgttatttggaacgatcaaagctagatagacaatgaaattttccatcgaaagctgatttttattgtcttcataaaacgcaagcaactcttgcttctgaaaattcttagaaacactatctaggaaaaaatcaatttgatcactgagtatggtgtacccaagggccccgttgattcgaagaaactttgctagagcttgtagtaacccttgaaagccaactcgatcaaaatccaaaaataataacagtcgtaaatttatagtctgagtcatcaactggaatatttcgttttccgcaactctttcgaaaactttataaagtagtgaaagatcctctttgactataacatggtttaagctcgattgaagcctatacaacccctgaagtagaccttggacaacatacaatcttgcaggatcaaaggtcattctgttgatagccaacatttctagaatgatatgcgttagccttcttacgtgctctttttcagacaaatcctggaggcatccagaaagaaatttaataaccttgtctccaaatggacattcgtattcactatcagttctgaatgtgctatagtagttagctgtgagaatgaagggaaaaaaggtcgtcttcaaaaactcgtaattatcctcctgcagtagatggagccgattagaaggaatggacaaaactaactccaaagagaatttccgaacactttccatggaggcgtgaaacccaatggatagaataattagtgcgaatggagcccttatcgtcgaatcttcggtcaacatacttataatatcccttgtggctgccttcgcttggtgtaacgacgtatccaaaccaataatttcgtataatgtacaaaactttctccagagagctacattctggtctttgaaaggtatctcccatttaataaaggagttctcaaaactctttgcgatggaggtgacagttaatttaataatcgagagagcatactttctctgctcatgaactttacttattaaaccagctttcaggtaaagccagtactggtctttttgaagagcttcctgatactcagagttcaaagaaagtgactgaatggactgcccattcaaatatcttagccaaaatacaaatgcaaggttcacttttttttgatttggagaattcatcagcaactgtattacatcccaaacaaaagaattcatatctgagttctcctttataaatgaaattctccatctaataatttgggagcagcattcacgaaccttgtcgtcctcaaatcctagcagtatacatgcataaaaatcaatcataggttgatgacctattagggcatccctggaaagcacctcaataaatgacagaaggcgtaatgccatagcggtgggtacatcttcttgaagggaaccaaataacccaggtttgccaaaagtgttgctatcgatcagttcgttagatccagattcaaaattcaggccttctttttcaatttcaacaaaacgtgaaagggttccaactatgtgatccactagtgtggcagtgagtttagaggacttccgacttagcattagaatagacgaaaaagcattcatttcgggggtctcatcattatggctgttcaatactttgatggcgaatagctgtagtctagccagaatgaattctttctcatcttcagaaactacatccaggagctcactcaatagaacttcagaagactcatctgctttttgaagaacatgattctcaactaagtcatttaataatctcttccgttcttgtgagctcaaatattgagtcactaatctaattgaaccaacactcatagagtaaccactttggtatttttcaatgatttctgtttatttcacgaaatttataccaatcacgtgataatgattatcttcatcttaccctttttccacctgtctcactctcctagggctactatttgcatgttcggctagccatcggttgtcaatcattgggtctcaatctgtccatcaattttttttgcctggttgttccagccagggcaactgctgaaattcaatattcaaaaaaattcttttttgacgtgtcttgcacatcgcatatcatttatatccatatattaatcaaatgaatagtgttttgggccgcctctaagagtatgttgagcaccaagagcaccaagtaaactaacagatatattgcatcataatgctaagaggtcttgactgattcgattaattcgtcgatatccactgtttccagaatatctatacaacggcttaaatctctcagattcttggtgctaggattccaatcaatgtacgactctactatttcctgcaccaattttatggagttgatatgcttaagttccagtagctgctgaataaagcccctaaatgaccaaggtaaatggtatgggttattgattattgttttggagtttatttcctgatatgccatgggtttagggttcgttaacgaagtggtttgtaaagcattttcaatacctaaagtgtaaacatttaaatccctgaatattttgcagtgtccaccgacacccacagaacctatcaaatatctcgatatttcatagttgagattatggtcgtcacgacccaaattcctaaccatcatacaagatttcattaaattcgttagaaatggagcatgttcactagttttatccacatgtatggatcgaaaaatattggggtggctaacatggaagcatgtggatgaaaaaagagggacaagttgatcatcgagagacccgacaaatgtaagctttgtatcatgacttaccaatatttccaaactctctatcaacttgcgtgattgcaaggtgtcaggatcttggaagtcaaatagttccatcattatttcgttctctaaccgagagtatgcttttatagccagcttggcatccaattctggaaacgggcctaaacaaatgcctgccatgtttagtagcgcaaccttctgattaggatttagcacgttctgcttgaataattgggccgctatatgaatagcaacagggacaccttgggagtgcgaagcaaagtataaaaagtcacagtcccttatcacatccagccaattttctaacaaacttaaaagactgccaaccctttctagtatctttccctcaccctctaacgcaacaacatcaatcttcatattgagatgatgagctcgtccccaagaccggagagcttcagttgcatgggctgcgaaagtgctcgctgtaccagtaggttgaccaactaatgttcgcaccattcttataggtagaaacccatgaactccaatgacaacagctttgaagatagaatttgaatcaagattattttctttgatgtaaagatggttctcttccttgataatcttgctactcagaatttttagtgtactaatcctctgtaagttgagacgggccctggtagtagaagttacaactctgtagttgcattcaattgttggggcaagaattccgaaagactctgaggataaccgcgtcttatctgttgagttagaagaggagccaatatcagcctctttttttgcctgagtatccaaaaggagcatgctttcttccaactcaaggggtgtagccgctagatctacttcaactttgacaggattgctagcactacttgtacctaccactgccaattcagcatattccgcgtgttctgatgatttgaagtaagcccaatgactggttactgtgtttctttttatagcccttttggcatcgtcagcaagttttgcttttgaagaggtggagtaaagtgaggaaaaggagtggttgatttcacagtctagtgaaccatttcgctttgacaaattcgaaagttcatttccccatttccagaattgccagcctctgcccttgggtgctgcggaagctggttcagccgccaccaccgtagattcagcctcagcactatgactggaatctgtttgtgaacaaatgctgagatttaagtgatcatcactcagattctctggttctagtgtactcttgggtggatcagttgctttccaaaaccaaaagttccaagattgtctactagccacagtgtgatgattgatatttggaagttcaggaaactgttcatctgattcacgcaaatcaataggcccaattatatccctctgttttctgtaatcacttaacgttactacgttttgttccaaattgtcatcttcattctccaagttggaaggcacagaacttgaggaagaagccgaatcatgaattggttccgattgttccgattgagccttattttgcattgaacttaatttttcaacatttttaatcggcttagccatagcgtcattggttatacagatgttctgaaaactggtaaattaaactcctttgagatggtctttctgagtttatttctatactatctgtaagcatttaacgttcgcgcgtggcaaggtacaattaattatcttgactttgggaggtttaaatagagatagattacttctacaagttcacaaggctgatcgaagcaaaaaacctgattacaactgttcagctatacatagaagtagcatcagctgatgtaaacatattttttattcgatggacacgtcttcaacaatctcttttcgagttattagatttcgatacccatacaaatcccaacagtctggttgccaactttaaggtcgatctaagtagcatagcccaacgttatctcctacgaactttttgaggaactaaaggcggttagaggtttcattcgtttcttcacttattttgacgtattcgaaagatttacgtgcgctgaccgcgacttctgatatgcacattaagctcttttgtacataaccgcatagttagttacttccgtccaaagataacggctagccatgaatcaagatgactaagaaatccaataagaccaattctacaaatctaatttatcggcagcgtaagtcagttaaggttggggagatctttcgcttcatggttacatatacacctcctcccgaattaaatccggagcaattgcttaagaagtcattccagttcaaggtcaagaacgtagagttattgcccctccgggccgcatatttggcaggaccgtttataatttatgctgatgttacttcttcagagtatgatcataacaagcaatgctttgttactgccgaacaacccaagtataaccccaatattcaaccaggccaaagtttcgttatgagtttaccaatacatgttctaaaagaaagatacgactggcacgtagacattattagccaagtgatcttctctaccacatcagaagttcattttgagtttactattgtcgacgaatcacttagtaaacagcatttgaagccattcgacaaagacctgtatggatgttttagtccagattttagtgttgtgagcaacgatactttagacctttggaataagccattagtgaaagatgattatcctgtgcatctggtagtggtcacccatggtctacattctaatgcaagtgctgacatgttttacttaaaggaacttattgatagaaagtcgaatctagctggagaaaatgtaattgttaagggatattttggaaacgtatgccaaactgaaagaggcgtcaagtacttgggcacaagacttgcagaagctattattaatgaaatgtaccgtccaaatgttaacaaaatatcgttcatttcacactctcttggtgggttagttcagacatttgctattggatacatacaacataattaccctagcttctttcaaaaagttgagcccattaactttatttcactagcttccccatttttgggtatttcaaatgaaaatccaggctatgttaaaatggcgctggccatgggagttgtaggtaaaactggacaggatttgagtctccagcaagcgaagccattactgtatttattacctacagggcctacacacgttgctttgaaaagattcaaaaacagaactttgtatgctaatgcacttcacgatggtattgtacccttgaggacatcagctttgctcttcttagactggaaaggcttatcccaagtatctcaagttattaggaacgaaagaaaatctccaatgaagcatcataaaggaatagaagatagtccaccttcgaacagtgatccaagcttgacaagcggtaatttcgataatgcgacttctgtcggtaagatttctgaggatccagcagacgactccacaggcgatcaactcaaggagtcctggatgagttgttgtctgtcgcctatacaaactgctatcacttattgcataccaactgctcaaataaagaaaaagaagagccgaaaatataggagatatcaaaccaaggacgaggaccatgatgaacaagatcacgacgatttgaactatcagaataacaagggaggaaacagagaggacattatagatgttcttcctaaatcttctgtaatagagtcagctgcaaaagttctgcttcctccgttaccaccaacatcctacatcgttgacccgtccactagagagaacgttataattcatgatcagatttatcatgactcagatcttcctccgagagataaattctccccgaaagacagatcgatctcatttttggaatctctcgatccactcggaagacaaaagcagttagaagagttaattgccagaaaatggcataaaggccttacgtggagaaaagttttggtcaacttactgcccgatgctcacaacaatattatagtgcgcagaaagtttgcgaatgcatacggttggcaggttttggaccatttggtagagaatcattttactgatcaaagaacagatggtcagtgcgattcatctaagactgatagtgagagcattggttctgaatcagtaaaagatgtagactctttcatgaacggaacatcggatttgaaaaagatctattcgcagcagaaggaaaaggcagaaagagatttttcaaagcagctttcaaaatttcaaactgggaagtcgaaaaaaatagattctccgatcatatcacgttactcatcttttactgcaaaggaatcggaaatgaatgtaataacaaatacaaaacaccatggtagagctctgattcctgaacctatcagctttaaagagccaagcaaccaagcacggatcgataatgatattcttacctctgatgtagatacagatgatgacggtaactggatgaatgaatccgacgatgataataaggatggtccttctggaatgctgaataacattggcgaaatggttgagaattttaagaatatttacaatagctacgaatacaaagaggatgaactagagcagaatggcaaagaagaagaagataaactctgtacaggtcagaatgtgatgggcagcttctattaaacagaatcaatgttttaatgccaactctttattaattgcccgatagctttcatccttgggcaatgcgagctgacgccacatatgttgaacgtcatatttcaagttggatactccagcatggttgaacctattaagatgaatgatgtttgagatgatataagctgacaacaacttggagatttcctttttgaagctcaagtaatccgcagtggatatcaagttttcgacaaaagtgagtatgttggctaaagccttaacagggaactctagttctgcactcaatgagctatccggattttcaatactggaccaatcattcaatgagaaatatgatttcattagtgattgaatttctctctccattatcaaaattaggtcatgattgcatttttttactaacttttgataatgtgaaattatggagtaaaaaaaagtagtcgagctagagttatcggtggctgacctatccttgttgataacctcccataaactaacaaaaacaagttcctgtgaccagtgttccagttgaaaaatcatgaactttaatgagcaaataatcctgaataatctttctatggaagaagcgtttaagctggaattgtgatctattggtcttttcatgtagatagactcaaagcttttcaaaccttcttccaatctctggtaatagctattgagtagtgccagctggatttcagataaaaatttgagttgtttgttgaggttgttcatattctcataattcttagtagtgttttctatcagaattttcaagttcaaagaagattttgttgacttaacttctccctttagattagaatctagatcaatttcaaatgcttgtaaatcagtgttaataatatcatcaaaacgattgaacgagaaccggcattcgttttgcagccaagtagcaaacacttgatcgttttccaagatgaaagtatcaataaaacctgaggaactccagtaaaagttgtcagacagtgacttatctaatcttcgtaattccccaatgaaatgagtaagaagggattgattctcatgtgctaacaacatgtctaaatcagagcatattttttctctacagatctctctcacagcagtgatcaaatgatctatgaagaaagtctcttggtaaatagtgtcctttaatgacacactaaaatgcaaattaaaaagggaggcatgctggtccagccatttcagtaaatagtctacccaccactctggtttgcttatattgttggtcttcttttttccggagaaatgaaaagcaaacttaacttgcaaattggtggagagtaagctctcgaacgctactagatgcaatttcgaagcagaaagtactgggtcaagagtttgtagcacaataagatcatgcaactgtgaattgatattaacgaagtgactaatgtctttagaatccattttatcccacgaatctatacggtgatacagttcattaagaagagctttcttctcttcaatcgaatccattatcgtgtcatgcaaagaatcattgacatctgaatcagcgagctgaaaagcattgcttgaaatctccttgattgagttgattgaaaatgggccctgatgttgaattgcctctagtaaagaagatttcatttgtaaacgcctgattgcgacagactcctgaaatttttgaatgacgtttaccataaaatctgtgcttccataatcatgtcttaactgggttaattgtccgatcttatcatcgtctgaagcggttgagccaagtatttccttaattttactaaccaaaagaaccgcattgtcaatctgtacactgcttgtttggttgaatttagaaaccaaagtttctcttttttggctgattgaatctgcagtgagatttaacctttccaaactaggcagattgggaaagctatgattaataaatccctgtaaatcagccatccaccgcaattagtgacaaacaagtccaatttatgttaatgttcgtgtactctacgtccaagcgcgcacgctaatattggttactaactaactacaccgattatccagatgggttagggaaaaaaaaaagaaccactctctaatattctacataaaataaccctttatcttggatgataaaatcctggtatttaaacttttctggaaggcaaacatttgaaggagagaaactattcaataagtggggcttaataacaatactttcatctgaatcggactccgaatagtctgggctttcaatgtattgaaagttaaaagttactttatgtcccaaccatggtttcttcaacttgagcgacttgatacatttgattgcatatcttagattaagaaactcctcataactagaatatgtgacaaaggagttactgtaaggtatactgggaggttcatggtactttttttctgaatcatcgtaacaatcatcgattgttctttcggattgtgaattttcgaatatctcgtagtcataaccatcatcttccaattcttccacatcttgaggcacgttattccgcctatcagctgcattcacaggaacagaattcgctctaggtcttgctatgtccgaggagctgtaatcattcagagaagcaaacgtgtttcttctaccagcggagatacgtctacttcttcttggaatcgtcttgcagttcttttgattgaactctctcaactcgagtggaagagcaatatcgatagcatagactagcttgtagtaccaatttataaactggtacggattgtagcaacataccataaactgttgcagttcacaacgcatacgaattgtaaacggtcgagctatatgatcagaagcagagccgacttggcatcgctgcaatgtcaagctcttagacaattctcccctgatatcctgaatcttgtcataatattgattcttagaatttgaggagatatcgctaaattcgtcctgatgattcaaaacttcagccaccaactggaattcaggtgattccatatcctgcttggctagtttagttattaagggtagacgtctatcatcgacaatggtatccgcctcaccgaacacaaagtttttgagacgtcctctaagccccaccgaattcgggacttttactgcgttaacgggcttcacactgggagactttctggttaacttaccactttttatgttcaagtgtgggtcgaatcttgaagtatgccgcattgcggacaacggtaaacacatttctacaagcatattctcgaagaagtatttcacgtaatgacatagtttgatgtctttcaatttgtatatgttcagttgtgttgagttcaactccatcacgtaaggctcccaatctaactcgctctgcttgttgggaagttgaaacggtgtagtaagtccgtgtttaagcataattagtccattgtagttgagagaggaggaataatcaggtaggatatcttcgtcgattgctgaatcttgtgacgcttgatacgtggggggtagcaatgacgggatctgttccttgttgtgactcatggtcggcagccctagcggtatcttataggtggagatagtatcaaaatattcaagttatacttgctattttgagaaagattaaacaagggtggaacaacagtagaatcggggaaggaacattttccgggtgctaaatcgtcctgattacgtaacaaactgggattgattgaattagcccgaaaggcaaaaactatacatttcaaagtacgaaccactacatggacattgggctatagaaaacggagaagtggcagttgttttatagtactataacaccaaatacttgtgcaatcgcatacgagaaagcctgcggaacctctaaagtaagagcgataattgcggatgtagggaacgaaagggatcatcattaaacaaaaatgaccaagggtcttacgcgcgaaacaatgcacgaaatcagtaatatggggtaaaatgaagtgaggtcgagtacatacgatctgacgaataccgtgtcgaaaacacaggaacataattgaaaaaaacacacactttgtgctttttcacggttactcctccctttattgtgcagctcttatttcttcctagcttcaatctttttatttttttttcatcttatattctatgtcagtatggcccaccttaaaggttgtgaagaagactgcaaatgtttagggcggagtacttctctctcacaaattgagtagaattgttaacaatgtagttcgaagtttcttgctactgattatgaaagtatattcaagatttagtgcggaattaccaccagcgtatgattttattttcatgaaccaatcaggacctatagatgtataactgtacaagtggtggttgaaatcggttctttgtgctgaaggatcaatttctgtataactctgctccaatgatctggaaaatcataaaatcgtaaaaggataatcgtcaagtattttgcagtgaaccttgttcatataagaaattggcctataatggcaacgaaatcaaacgatcccaaccataccaaaaatgatctagcacatttcagcataaaagcaggcgtcaaaacaatatgagaaaagtttagaagctcgccaaatccatttcgtgactatgattacaggttcaaaatcattgttatgggtaagccctactccgcagtaaagaatgggtacaatcgtgatgattggtgagtcaaacggaactgcttcagaagtagcaacgaagatacatataaaatgacgtggtgattactgctctttgttccaacttactttggacaaatcacccatttttcttggaacaaggatgttaaccaacaaaaagactgaggccaataataagcaaacgccacctgctaccacccatgaaatgcccagaaacgaattttttcctcccaaaaccgaccttgtacttatgtaaatggccttcttgccatcataggggagaacagggaaatgtagaccaacagatacttcgtataaccccctttgcattgagtgagtatcatttcggaagtacaacttgctaaacaccggcagtcctcctggagccatccagttttgaaaatcataccacgtactaatgtcaggcatgttgtcttcagtgtacccatcagggtacatcttaacccaattaggaggaggtaccacttcattgggattgtatttggtcttcttgaacctcgcttgattggagctccatgcaatgccatcttttgtcatctcataatccaatccctcacttccatttacagccactggatacgtataagtgtcattatacaacgaattggcgatcagtccacatggatagtacttgataccatcatcattctcgctcagtggctgacagttttgacctactgcgtctttgattgcgctcaaggatgcagcatctccgtttaactgcaattcgctgaaggatttcacatatcttcggtgattagggtaaaagttgtacaatttgtagaagaaaaacaccggtgaaccgatgttattgggaatttcaaactgtacctgacaaattccttgttcaacaggatcagactcactctcatttagtgagtatttccactgaggccgcacagtggtcttggttcggaaagagaaatccacgtactcttccggaatctccgtatagtaatctctgctcgccagtctttcacattgttggtattgtataattagctcctctaccctagaagatccatacagcatagcgacaccaagtggaataaatatgatagcaagtaccagcattgacggaatgatagttcttggggtaaatattgggttgattgccttcaacttttgttgtgtgaaactattctcttttggtcttctatttttctccttttccgacgtgaactcccctgaagaaacagacgaagagtcatcaaaatcattgggattttcagactggttttttttcctaaagttcatcatcgttgcaaatttggggactactagcaggaatccaggaaaagaacggcacgaaaatcatttggaactcaatgcctcaatcttacatcaaatgctcgaaagaggatatacgaatgcttatactcggtaactaactatattatgccgattgtgcatcagacttggtgattgacattattgttttaaaactgttttagtacatacatgatcctacttactattcttcttctatccttgatatcttcgttctcctcatcaacaaaagctaccgtaatcaagtctaaaaggtaagttaaattctgatctttgaacagattcataaccatttccttcatggtaaagtgttcttctttcttcaaggccttcagtagtttatagatcaaatcaattgctgttctgacgaaggttatgtccacattgatctcaatcttaagaaaatagatcagtagcttaattccattggaggaaataaaaagtctccaaatagtcaaattctgctggtgctcctctgaaaacagttgctgtacaatttctaggattcgaagagaaatcttgttcttgttcatttcaaacaaagtaactaaagtatctgacagcccaatcattgtgaaattttccctgagttcacaggtactgtcatggtcgtcaccactgtgctgtaatattaaggaaacaatatccagattcacttgaaccaaatgttgattattaggttttagattcaaaagtttcagaaggataactaacttggaaccatttagcatgggaattacaagtttaggaaactcgttgatcaattcttttagtgacgtagatagtctgaatagttcacttatggaggaactcgacaacagagatagcgatttgaatattgcttttatttgaagttccaatttctccttcaccttttccttattctcatcgctgtattctattttcacaaaaggattatctatatcagcctctgtaggcgtttttagtttaatatcttcggtataatcatcaaaagcatcatcctcattgtctttatatttcgataatcttttattttttagcatctgctcattcttttcggcttcagttcttgtctcattagtctctgagtatgaaagtagcttgtgtttactgtataagagagttgagtcttgtggaatccttgtgcgagacggtattcgatcaaaattaagctgttgatctttaataaagtcaacctcaaactctgtagagtcagactcaacaaaaggcgattttgtcccaatcagtaagtttttatccttggcctcaaaatgaagccatttattttccaatagcgttgatgcatttggcctctcttcactattcatcaccaaacattgctcaataaacttattggcctccaaagatagtgtcaaaggtagttcagggcatccctgagtaccaatggcatgacaagcaaccattggttcgtaatcatcgtagggaggttttgttgtcaaaagttctaaggtagtggcacccaatgaccagatatccgatttaattgaacaaccagtcaaaaggatgatttcaggagccatccagtatggagaaccatccgcacgtatttgtggtttgcgtttcgactgattggaaatattatcatgttgctgctcttcatttgtttgttgctgttgtgaaactccaaaatccgctagcttgactctatacctatcgtcgagaagtaagttggcagctttgatatctctatgaataactcctttattgtgcaaatatactaggccgtttaatgtctccctgatgtagttacgcaccaatggctcgggtattccagatttatactttgttttatataagtgtcgaagtgagccatgagagcagtattctagaattatgttgaggtttgattcagtcattatgtatccatgatacttgactatgttatcgtgttttagcttttttaagaagtcaatctcttccataagaaattctactttggtgttggaggaaatctcgatctgtttgatggcaacaagttgtttgttaaccttattaatagccttgtaaactttggcgcatccaccccttccaacaagttcttcaaacctataggattcaagtgcattaatggacgggttcgatattctggagtgtttctccactctctgagctggtgtcaatgagactttaaacttgtctttaggatgctcattggcatgacgagacgtgacccgtggctctgaaacatgtaatgatgcccctgctgcatcaactgattcgatagaaaaggctctagtccttgaatttagggcatttttgttgattgtttgcaaaggaattggattgaaattggtagtgtgagataccttgaaagggttatcatccgggctgggtatgcgtttcttaggggaaagttcaaaactctttgacaaattcggatctattaatgtgtcatgaaacagctcatcttccttcgagtctcggaataaagataatagttgggacttccctgtcatcttgtgttactgaaacacaaattgtcagtgtttacagatgaaggaaaatcgaagcgcgacgggtctaaagaatttattaacaacgtacattgggatgagagtgaaatggtacaatcgaccaaaacactagttcgtgacgttctttcatccaggttggacctcaacaaaaagtagcgacgaaatagtgctgttgttgtaaagttttgagaccggtagattgattttagcctttctttttttttttcttttttacctttgaatcctgcgattgttaagccagagtatctgttttcattaatatacatgcactatagaactaaacggacaaacctcaaaagtcactcatagtcggaaaagtcttcgtcatcatcgttaaaatagtatgccattttgttcgcagtatcgttttcagagtccaaataatagtatttcgagttattatagccctctctcatgtatgcttcaatttcattggaagggcttgggttgctggaattattcgtagcgacattgaacttgtcttggttaacaacggaatatccatctattcccttgtctatgtgggccaaatcaaaagacgaactagtctccacaatcgaaatttgtttgttatcctgaaaaatggtacggatattgccgttaggagtgaactgaataaaacctccatcaggatgatgaaatactgggtactggttcttaagctggtcgatgtgtttctgatcgttggtattgtcaatagataccaacttactacgttgctgtttcttgggagtaggttcatcgtgcgaatatcgcctttttgttttagttgtgggagagctagccagtagagtcgtattcattattgccagttgaactttcgaagagaacggtatttttttacttgtcttttttcttacaagtgtagctgtgatatgcgaaggaagccttgacacagatttaactggtaacaatgtgtaaaaacaggttgaactgacacaaaaaagaacttagaaccacaacgatgttcaagaaattatgaatgagattctttttaaaaaaaaaaaggtattggcaacactggaacttttcagtccttagttccgttgatgggtatgtagttctgcgagaaggtcggaaaggtgccaggttgaggagcaaggccgcgcctataggtttccttctgaccttcggctttcattcgaggtgtcaagtgcagcgagctagaacaatctttttctctttgactaggtcgtgcattgacaaagttcttagaagaaaaataagatcaagtgtatcttagccagtatatcataatctcgcaagtaaatacaacaaacgatatggatttgtcgaatctctcgaccaaccttccgtcggaacacccaattaatgacgacacaatgcagacgataaacgagtctttgaatgatgaattcaagtccgctgccaaatctgtggcggcgttgtatcgactttcgaacaccaagagtaacctactgaagcaaattggctataaagtttgcgtggatgaacttttggactttttgcaagacgattcgaaaacagttttggacatcaaacaatggctgaaagggaaaaaacatgatttggaaggtacaactgaacatgatcttcagaatatacaggtacaaacacgaaacccaaccgaacagaatgacttaacagtacaaggacaaccaacgaattttactgatattggacaacttcctgaaaggtttgagttcaacgtttctcatccttcaccccacagatttccacccagcatgatagctccttctttaagaagagttacaaataaactatgtcttactgcatctacaaacactcctactacttcaggtgcccatcaaacctcattagcatctaccatagcaactagctcgtcaaccatggcagagtctgaccttgaatccgagcacgatacagcaactccacttgcacaatataagaggattcgtttttgggagaaccacgaccagaagcgtcagaagaaagaagaattgtgcatccacaaagtcgtgcgaaaccaatagaagcatgaatcccgatttggcagtcttgtctgtattcggtgttttccaaacacttcacctacccgattaggccagtaatcccattctaggtagtttgctgtgttttcaattttacataggagttaccataaataagtaaatattcaaaaagggtcagaaaaacaataataatataaaggattactaaattcatcaatatcgcttttcttctttttttcccccaataaacacttttctaccgattttttcgttttaagtaatctttttgaaaacaagtaccaactcataatggtattggttggacttttaacccgtttagttcctttggttctattggcaggtaccgttttgctacttgtatttgtggtcctttcaggaggcacagaccattacccatttgacagattctactggttggaggtaaggactactgattttgagactccgttcgatttggcccgctggacttattggggtttatgtgagaacgttgatggaaggaacagagattgtgtaactggacccgcttacccaatttccccggaagataacttcgaaggtgatgagaaccttaactcagacttcatttctaacagagacacctatttcttcctttccagattcggaaacgtttttctattgttgggacttattttctccggcgtttccttcattcttacgttcttatctagtgtgttgaaatctgcaagggtcactttagctctatttttgttcttagcgactcttttcacagctggtggtgctgctttgatgactgccgtggttgttctagctagaaatcacttcgatggagtggaaacccaaatttctgctaatcaacttggatgcacttggggtgcagtagctgctatatttttaaccgtggcaattcttagtacgtcatctgtcaccacagcttatagaagacacaaggaagctttggcatctcaacaaaactatgaacaacaacaaggaataccacccaacaccggcgctccagttgtcggaacacaacaggatatcggagaccttgattcccagagccctcccccattggccggtgaacctacagctcctactcagaatgaaagtggaatccgctttttcaagattagacataacaagaaagtaactactgctgatgatgagtctttgtaatccccagttattataacatttgtaataccatccaaaaaataaaatgttttcgaactattgagcaatcatattcacatactatacctaaagtagaatttactggatgctgtacttatttttctcccaatagaaaaatgttggcatacacaaaaatactgagatagacggctctaatgataaaaaacttgcaaatgtaccattattacaaacctatatactctaggcctccaagttgagacgaccttgagggttggttaccttgataccaagctccttggctctggccaaaatgtgaactctgttcttggaagaaacggcatgagcgatttcagcagcgtattgctggttgtgtaacagaagaacatccaattccttggcgttgttaacaacaaaggccttgtgtccagattttaacatatacttggttctcttgtcggatccgtaaccaatctttggttgacggatagttcctctgaaacgtcttctaacacaagagtcaatacccttctgctttctccagctctcaccaacacggtggtaacggtcagaatgatgacgcttgaacttctttgtgtacttcttaacaatcgttggacgtggggctgaagtttcagacatctaagctatgttagtaatgaaaatttgatattgaaatccgcaaaggtctgggaatacagtgataacaagaagaagtttattaactggaatagtgcaacgcattgtgttccaattttaggttgcttggtgtcgtccttgtgaatcaaatagccacttgccataaaaagccggcccaaaatcaaactaaacaccatctcttcttctttttttaactgaatgaacgctaagagattgcaactaaaccaatagatgccttgctagcactgtttgacagactttgatacagtttcttcttcttacatacctttgatattaatctcttacctgtggaaaatatgaagttcaatttttttcgcaccgtaattctaccagctatgcgtgtgcttaccaagtgttcctaattctttagcggcgtagccctgctgttaaacacgtgatataaaggaggaaaaaaatcggttccctgcttatctaatctcatgactacataggtttatctcaatctaactttgacttatcagaatcaggcatgtctgagcctcctcagagtacatactatttcatagatgacaaaggtaagtataagttttctattgattgattgtacagcactaaaattaaagcgacttacgacacagaagatccatctcctcaattgaacttcatttctacttttaacttagaccagatagccaagtcagtagcaaggaccaattctgatggcactaaggatgtcaagctgcgaaaatcttacaaaagtcacatatcagaccttttaggtaagcactatatttcaaaagagcataacctttctccaatagtatttggacctcccccagattttgtaaagctggaaccgtttgacaaggactatcttagccgcactctcacatttgagaagagttcaatgaatggaatcgctggattcgatcccagaaaattggctatgaatgaccaagttatagaagagaagaaacccaaaagaaaacacaaaacaatatccccagctgaaagtgaacaagaacagaataagaggcggcacgtacaggtgcatttttgatagatacctgattttctaaagactattgtaatttgagtattgacgtggatataagaaaagacgtagaaaatctatctttgactacatatttcttatctttgctaggtttttctgaatcgaagggaccttctttctccgcttttttattttcaacttatcccgagtaaagatccagtgtgctttaacaatgctttaagcactgccttcttcaaatagttgaccaactcccttagcgaccatatcttatttcttaactctagatctgggacccgaaatacaaaatctgagacattaatcaacctcaagactccaatacctctaaatgtaatagaaagaacaagatcttgaattttgatactgttgaagacggcgaaagtctcagctctgtaagacataacactgagatagtcatttcctgctgaaattgacctcttttctatgctatctggatttgtctcactgtttgatgcaatagtaaccgaactttcctcttcaagaatggaacttccagttatcgaggatgaagacgagacatccccatctgcagtattatcttcttccgaagtggggtactcctgaaacaacattcccccgtcttcactcgaaagctgaaacaactctttttgcaaatctgtaaactcttgaaaattggtgcttgtttcgaaaactttcacatcatgctccggaaatatgtaatcaatcactttttcacctagttcttgctcaagctgaagtttaaagggtttgacatgtatgtcaaagttcttgaaaacttgaatgccggcgacgcttctatacatctcccattgaactctcacaaatgaggtctcatcctcatcattctgctccatcggtgctaacagatcggggaaatatacttgcccttcaaggttataagctgacatcttgtctacctccattagattatagtaccgttcatcgtagtttagtctgcgaaacaaaacattctccacggatagggcaacaaacggcgtctgattcacgtccaacatagtcacgagaagtctatctgcttggattcgccattcaagtgcctctttattgtcaagaatagatgatccccctgttaatatgactttgaccaaaaggaaaagctgttctgttaaagaggaagtagccttttctactgcgagcaactccaaattctcagctgcccctagcacgattcgtcgaaagtaatagttctgtgtaacatcttttaatgcattcagcatttgatgtttttctaatatctccttcgaaatgcctttcaaattgctgaagtctgtggcaagaacaaatttgtgtattttttcacgaagttctttattcacgggttcaacgtaaagcaaaagttccattgctatcttgtaagaggagaggaattccttggagttaactgaagtcataacgcttggtacgtcaacagaaagtttatcatttttgtcttcgttagacctcaaaagcctgttcattctgtcgtaacgaattacaatagaagtatcctcaagaagttgaaggtctaacattgcttcatcttccattccttcaacagaaagaaatggaggccataattctagtgagccgtagctacagtcattgaatatactccttgggagcttgccattttcaatttgacttttctgaagacaaaagacgttggcattattaagcagtgttccatatctggtctccagtttgatatgtttgtaccctataccgtcagattcattcacatccttgctgacttctccaagtgaaagaatctgaagttctattaatggagtagtaactaacatcattgtgtctgaatgtggatgagtaatcagttgaatttggggggaaatgagcttaactaagtaatcctggttacattctcctttggtttcatctataagctttattttgcgaagctcttcaaaaaaattgcgaacactttcgtcagaactcagatactcctcttcatctacgaataatttatctgaaagatctgtcttggctgatggagattccgtattagtacacgagtcattatcagaatcgctactttggctactctcgacgatcttttgaaccttggaaaatgactcgtaacacaacacactccctctctctttcatgaaagagacctcgtgaatatacttcaaaagtaggttacgcccttcacaagtccacttgaacaacatatcttttacaatgaactcattgctgaactttacatctttcaatttcccctctttgctagcatcagaggcaacctccgatcgctcagctgaattgataagacatttatgagaaggttcattgccaaacggctcaatggaatcagactttgaaggattcgtatacgagctagccccactgtcagtatctctgaaatacttgaaattagcagacgataataatggtagtattttcactgcacaggcctggtgtcgtaaagacgaaaggttgcattcattataatcatcataatcaaaccaatcagtatcgttatcatgaacaactattttaactttctcttccccaggtacatcatgacattctgactcaactgcatctcccttttttggtttagcaaacagtgcctgattgactctaagatctaaggagtctaaagaagcttctccaagatacattctcattttgaatatcttttcggaaagctctagtttctgattttgttttagcacagcttcctttctctgatgtaggtctatgacaaacttgtctacttttcccaacaggccaatggcaccaattgtatccccatcggagaactcacgttctcgataaacgtgtgcaatgtagagtggttctatcaagaactggtatttaattgtgtagagataatcagaaaatttctgagattttccccttgtgttgaaaagtttcccgctccttatcggaagagcaagaacaccgttgaaaagtttccaccatttgaaaaatagactgaaagttccgggactcaaatgaatactatttctcgagtgttcagaagcttcattggaatgtagtgctattgtcaaatgtatgaaatcactcctaaaacctctgtaagcatcataggtatccagattgtcaataaattttgggttattcatcttcactttataatggggaaggagttgagttgtccttttgccatcgtctcccactctttcaaagagaaagccaaacacaaaacggacctgccctgtcagcttgatattgattttctcaaaatattcacttttcaacttagaaatgaatagtctatcattttctgttacactattcaaaaaaaaataagtagacagtatcggttataaaggcttttgaggtgggaagaaacacagagtttttagtttctgcacaccaaacaagaagaggttcactaagatggtttggaattccccataaaacttttcctgcttcaacagtaatcaactcggtggagttattattcttattaatgctgaggcaaatatttctctcaaaaacaagtacaaatcctgctgactcgttcaatagctcataagggcttctagatcctttaatgcaaaaatgtaaaaaagattcctcttcgaaattgacgataagttttccgtgcaagattgatcgcactttatcccaaaatcctatttttggagaaggatcaagttgaggtttggagaatgcatccaaattcgtcatcacctgctgaatggcaggtttgtaagaaatacaccaattaatcttggtgggaattttaccattgatgataagacctaattcagtaaatatttttaccgaagcgattgttttcagcaatgttaaagagtaaaatttgccgctgttctcttcagttgcgtttctaacaagtggaacgtaagcagttctaagggaggcaggcccttcaaaaaactgctcggcgataactaaattccctgacaattccaaagtatttcctgtttctgcttttgggatgtacaacattggaagaggaaaatctttgagatggatcctcaactcattaagagacacattaagattcattggagcaagaatcccatattcagtatctgaaggcaaacctttcccaactctgtaaagataatcagtcaaggaactaaacgtaggcttttgaatgatgatggttggactttcaagtattaaggttactaacggtgaactgatcaattcagaaattaattttctatcaaattcatccgatattgaatttcctagaggaccatacaaaaactttgagttttttgtaatgatctttttcatctgtagtttgcaaagcttgatcgtagatatccaggttaatgaaatttgccttttcaagcgatacaatttcgatctcagtcctctcttcatttcgaaggttccctcgccatgaagagaacaactaggcagcttctttgtgtcgagagagtctgtaggaggtatcagaggattcaaaagttcaacctctatttgctcaactgtttgttcaatatcaatatcattgacaacattcatgtacactttagccatttcaatgaaggaattacgtttggccaaacgagctttttgttctatcaaacccagtttgaatatcatacccaactctgcttcaaaaggatcatcttccatagtaagaacaagtcttgaagaagtgaatttacaatttggaaatttcataggctccacaggatgtgcttttaaaatatcctctgcagaatctgaagtcaatgaaagcagcaaatgctgtattacttttgacgaggttatcatattatcaaacaattgatgaaacacaaactggttaggaatattgagacggaatcccaagttagaaccctccaaaatgtgtgactttgaatcttcaggatctaaaaactttttcagacggataattaaagctgctttttgtatgttaacaaattgggcccagtaccctttgactgctggcgactcaacgtgaagtcgaaacagagtgttcttaattatgacatcctgattctcattgtagatcattttaagtttgtttccatcaatgagggtattaaagtcatttgacattccaagttttacacggtaaccattgaccagacaactcaaaattaatctgtcaccaagtttaacttcttgcagagtagaatttttatcttgttcagtggagctctcctgttggaacaattccactaaagattgtatcatagttgatttgagcagatgaatggctgaaagtagaataaacattgaggtcaatgttacatgtgcattgatctggccaaacttgaaaaagattctgacgaaaggacttttttcggggagtttaatgcattttgactggataataatctggtcaactgtgcaaatccttgaacgttttaacatatttcctttgtgattttcgtgatggacagtggctgataaagatgaaaacatagaatcgaatctccaaaaagagtattgatcttcattatcactaagagattcaccacctttactatactcgcttctataatccccttggctcccttcgctatcatcatcgttgtttgagcttccagttgacgactcagttggggacgcttggcttcgatcatctgccccagagttcagcagctcagcattgaaatggctcaaatatatactaaattgccgtagagaacggtccacgtaatcttgcacattttcaatgtacaattgagaagttaactcttttgggattagtagagaacgggatgctagcaacacataaaaactggaaacactgagtttaactgaggaaaaccattctggcaattgattaaaaataatgttcctgatgtcggtaccactttcgtggaccgaatcccgaggcgagtaaggaactatcattttatcatacaaatggtatctcacatcgtcaacaatagcacagaagctatcaaatagggtcaacttagggaacgttaatttggtagtgacaatggaaagctcagttttgcagtctagctttggtatgactttcaagtggcttcttaaggatgaaatctcaatttgtgctactatcgttgaacttggagagaacttcaaatagtcattaatagtagagcattttctgctcttagagtgatcaaaaattttattgtcaattgttatcttaaaaccggaagctttaacctttgaggctaattcgaatatgaacgtgccgttggggtctatttctcttagcgactgaagatccaattctacaatggaaaaggaagcgataaccaaattcgacatgttgctctccgtgttgattcgcttcagcacaagcattggatctctaattagtagattgaaggaaagatatggccatatgtttgaagaaaagaaaaagtacttcgaaaatattgactcttctttatcaagtttattattctttgtatcttgcgaaggtcttcgaagattgagaaatgaccttactacaaaagctaacttatcagttccaacatctagaattggattagacacaatcaggttgcttaaccattgagtttttgaaagcacaccttcatccaagtatctaaacgcttcactaaacccgctcaaatgtgttgtgaagtttacgttcggaactctgaaaagttcataagttttggaacaatcaagatcatgaggttgaaaataattcgtattggcaaaatcggcttcaatgactgattctagtacggtcatcattaaacgtagtggtgtagctggtcgatcaaagtgaatatcgtatcctgtatctgtgggttgtagtcttgatagataaaggtttattgacttgaacccaaagttaagaaaaataacattatcatcttgtagaaaagaaagacagtgagctagtctgaggtcatcgtgatgtattatcgggacgcaatcgattgaaaggtcgttaactaaaacttcaaccttaaaaaacaatgttttaaaaaactgcactatcttcagctgtttctcaagcctctctctaaatgccattttgtgggaaacttgtaattgtaaattagaagcgctcttaccttccgaaaaaaattttagattcttttgaaacagtaccaagaatctatagtacggtaccttcattgagtgtatcaccaggataggagcaatttcagaaagaaaacctttcttcaaatccaagaagataggagttttaaacgtgatccgatcaactagcgtttgatcagaaaattgatcagtggcctccaaaaacaatcgatccagttctactactaatgaaattctgagagcaagggtgttagatgaagttgaaatgttagcaaaactggcctttgaagacaactgatgacaaaaaacttgaagctcaggctgatcatgataactaactgaaatagtcttggttagaattgtgaaatttgagacatgcctcaagaaaaacgacaccacccgtttcttccataggtttttgggatagaagtacagatattcttcgaattcagattgagtgatttcgtttttgttttctttgtgaatattttgttcagtgctgttagtgttggtggaagaaattatctcaatcttaacatgggacacagcaatcaacagaaactgttccttacgttcaaaccaattaactctaatctttatggatttaatggatacagaaaaatcagagtttgagtagattatattggtcaaccggcctcttaaaatagacaagattgaaaactgcacacctaactgccattgtagcacgcaattgacaaaatataaagccaaacatgaaaagaaaaatccaagaaagacaacgttgacttttgaaagcgatataacttccaaagaaaaaatgtctcccaaaggagtttcaaatggcattagttaaggtcaagtgtgctttttaaaattgaatttgggctatatccaaacatgaactagcaatacatgaactaggtaggaatttcagatgtttggaaatcgcgcttcgtacttttagtttgggccatcttagtgacatcatgtgaacatacgcttgtagcttaacactccagcctcaggtcatagctctacaactggacacaatgaggcggattttgtggctgtccagttacaagttattaatccatctctcaagcagtcgattcagcgttacttcgctagttgaattgattacataatctacgtgaggtaaggatactgctgattcctggtctactttttttttctgaaatacgaaaatttttgccaattattacaactaaccataaaaaacacaaatgggtaagtccaactcaccaagatataaaagtctgtctactaacttgtcaattagcacctaagaagatgaccaagatggaccttgggtccttcctagaggatgactcgtttggaggatcctgggcagatgacgacgttgatatgtccgcagtatccttaaccactgccatccctctacctccacctaaagcaccaattggtacattaaagagagatcgagtgaactaccctattcccagatcgggcccctacaaggctgttgtcaataacttgccctgggatatcaacgaagagacgtttgccaaatggctggaccatgttctatccctcacatttgactctattgtagagttatcaatgcccatggatgtaattcacgacaggccaaagggatttgcttttgttacgtttaataaaagaagtgaattagagcaggctgttaacagtgagggcctcacatttaacggcagatcaatctacatctctgtggcttctcccgagagggatgaatctactaaggaattcgattggtctaatgccagaggatccgctcaaaaaccttcctccacctcaagagaagaacatgagtttgattgggataacgttcgtggatctgcccaacctgctgtgcgagaaagaagagctccaagagaacctagggaagaaatagatctggattggggtgctaggggtactgctgtacccaagggaagagagccaagggaatcaagagagtcacgagagccaagacctcccagaagagaggaaccagaacttgattggggtgcaaggggaacagcggtccccaaattcactccaagagaaccaagagaaccaagggaacaaagggagtcaggcgagccaagggagcaaaaaccttttagaccgagaaagcaagaggtagagtttgattggagtgctagaggttcggccgttcccaaagccaaagaaccaagagagcactctaaagccaacaagcctaagaaaccagaacctgaactgagatgggaatcactaagagcaaataacgcacagaaaaaagaagaagttaggcccacttcatctgcttcggctacttctgtccctcaagagaaaaaagatgctcatcgtgtcaaacagtctttgtttcacgttttggcagatcagtctgatgatgatgggcagaatatacaagagttggaaaatcaagccgccgatcttgcacttaacaaggactgaactgactaaacgtgttgtactttaataagcttaacctattaccataatcatacatacctacagtggcactaaactatcctggcggccctatcgacagtattatttgaagaatttaaaggcccttccgtagccgttctttcttgcccgtttgatgagcttcctgctgcttggtcttcagcagccagccttccgattctccgttcttcataaattcgaacaacaaagtaaagatataagtcatgtttcttcactcccaaggaacgccagaatagtacaaaaatgaacttccaccatttatttgttctattagttgcctcctcttgtaaattgtacaagtctgagttgttgtaagcatcggccaagtagttgagggcattgttattgttagcaggattgggtataccagcacctggaacttcattgccacgcgtgttatctggggaggagttcgtggatgttggcaaatttgccgctgtatcctgaggggatgaacctataagctcagtaatgttattgtcaggaatcgctatgggcgattcggggactgtgtcctgcagcctttgactctgacgaagatagtcaattacagagagtaataactgtcctctgtagcctacagtacgtggaatgtataggctgttgtaagggtctagtccactattgtcattaatattattgtttgttaatgagttattatcatcatcgtcggcgtcttgagatgactggatattaccatccttcatatagtaatttcgtttgcacatgggacaacaggcccgcctggtagtcaaccaaggatccaaacagtctgcatggaacacatggccacatattaagcccctcacaagttcgtcttcttctagtgtatcaatgcagatggcgcatgtgcccgaatcaaagtgaagttcatctttctcgtctggcattcccaggtctatctcctttttcataggaaaaaaattctcctggttctgattttggccttcgacccgattcgatccatttggaacattaggttcttcatcattatccaagatcacagacgaggtgtcagatgagttttcatgaataatcatcgtttcgtctctgttgcgctcatcttcctctttacccccattgagccagtcaccgtacgtcttgattggaaataacttctgtacctcgtctgtagtcatttttcgtttcttatacctccttcttctataagttataccataaggaccatacggaccaaacgatccgggtaatgctccttgttgagtcggagacatggtaaaatttcttcgtccagagaatatcagctgttgttgaattgtggaaggaaagacagcaaaacgattgccatttcttccttccacaaatgttggtctcatactgtaggattgtgacggtacgtataagcccaaccgggaacgtacaaaataccgtagggtaaaaaacagaaaaagtaaggcaatacaagcccccactgtcaaagcaataaagaaaaggacagtggatggctttgctccaacaaaaatattgtatgaatctccggttgaatcggaattagaggtgttagttgctgtaccgctagcgctgagtgtagaggacatcgtctcactcggcccactcaagctggaacttggttgatttgcatccgacatcctgatttaacgtcactagtggaaatagaaagctgagaacacaaaggcttgaagtaaaacagtcgcctagttgttcaaggcagaaaacggaatatctggggcaaataatcaagcttctagttagttcagacaactagagacaatagaattcgcgaacgaccagagtgatggtgtaaggatcttacaagggcatataatcacatcttcttccggtctacatttcgtttcgttttgttagcttggtcaccaccacatagaagaaaaggttccatcaatggcagacaaggcaaagtttgtacctggagaaattgtcctagcaaaaatggctgggtatcccaagtggccagccatagtaattcctgaagatagggcccctaagccagtgttggacgctaaaccaaagggccgaactttggttttagtcaaatttttagcagactcatcgttctattggcaaggtccagggacactagaacctttgtccaaaaatttgattgattctagtttgaagacaaagaaaattaagaccaaaaagcaattagctgctgcgtatgaacgcgccctagaagaacctaccattgatgaagaagtggcaattgatgaagaggacgagggccatgatggaaaaagtgaagacatagatgaagacgaagatgaagaagaggatgaaacggggtactcctcagaagaacttgtagatggcaataaagatgagtctgatgacgctgaagaaaataaggaacctgcacgtttggctagtaagcaaagtaagaagaaacaagcaggaaaatcgaaaagatctaaaaataaagtggccagagatcgagtaaaagcaacaggtatagctaaggtagtatcttcacctgaatctgaatatacatatgaaaagaaacacaatgcgatgcgatttttcagggccaatctacaaaagagcttactttcacgaagtgagccgcctgcatatgaagacctgaagcgatccaacaacactttggaaaagctagaaaaatttaacgaagtgactgatgtttcagtagatctgttaaggtcatcaaaactacataaggttctcaaggcaattttgaaagttcctgagctagagaggccggatgattttaagtttcatactcggtcacaagctgtactgaactcatgggggccatacctggaggaactaaagcaagagcgtatcactcagtcaacggtgcctgcaaaatctgaggacgagtcaaaaggaactgatatagagccaaacggggaagggaaaatagaagccaacggggaaaatggaaagaaggcgaacggtgaagatatgaaggaagctggtgtcgaaggcaatgctcaaaataatgaagaaaatgaagagtaacataatctgggacaaagaacatgttcattatgaacaccaacaaaaaacacggacgtaggcatgtactgggatacagatgtctgaggactgaagttttatactatgttacgaattaatatattaaataaagtatagtacagttgattgcaatgttgggctcgcttttgactaggttcttgatattgataggtcaccgtcctgatcaggaacaatttcctgcttgactggaaatagttcctcaattttgttcagcatcgactcacactcatcttcggtgaatcggctatcacattcctctattatagaatacacagacaccaacgatcttggtaataggttgaccatttgtaatttctccaccttgactagttcaaaaccatttaaaaaatttataagttcgacaaagctatcaactcgtgcatcttgtgcaaagcttttatctaaatacgaagaaagatccatggttatacgctccaaattggccaaatgagagtttcgaatgttcttgtcaaacttgtcgactcttgttttcgaagacaagccccatctgttctgtttttgaatttccacaagagcctgctgaacttcaaaattggagagaaatttttctctggctatctcaattttcattgtctagtttaaagttgaatcagagataaaccaaatctttagaagagaaaacaattatctcgaacaatctgaagtgatagaagcataatttttttttgagcagaaatctaaatttttaagcaacggtgaaacttggtcagtagatgaaaagacatcctcaagtggcacatgctagagttatatgtgacactccatcaaacgaggaaaatattatttgcacaaaattgagaactcatcattttgtgaataatttgcggttgatactacctgcatctgactatctcaaggtccaggctctgacggaaaaactgacttttacttactacgaaggtactatagctcttcataaactaataactacacaattcatagataaaattaaagagaacccacagtttttgcttctgacacatagtaaggagattgacaacgataacgttatttgcataacagatgggaccctttatttaagtctgaccgacgagacatacagacgttccggactcttgggtaaacaatccggttttttgttaccccgaaaacaaaaatgcaaatggaatttaagaattgatatctcaaatggtttgaatttggaacgaaatgataaccagcattttaagcttttgtggtttttggagaaagttttaactgaagagtttcaagtcgttatgagctctaacgagcaacagttagatataccaggttttagaaaatgtggagtagcacctcgtgtgtctattttcaagaatagtttacttccagatctccaatttcagcaagatgaaagttggctatgtgaaatacttgaatggattgccttatgtactctaaaaagcaaacaactcgttacttcagaagacccttacatctcagcgtattctgaaaccgtttcaatattcgatagtgaggatgagaattcacggctagatttggttatagtcgaatggattggtttattgctaccaaagcatgccctactctctacaataaagtcgctccaattggaagaggaaaattataggccctcttggtttgcaatggtcgactacggagtcatggacagcaatctaagccacggaaacaatgaacacagctttgaatctaatggggaacacattgatttagttttgggtaagcacaaggaatggctgttatatcaagttctgggggcgagagatggttcataaaaacgtactgaatgtagtaacaatacgaaagacgtgttttaaacacatcagacgcttgttggacaagggctgcaggtgtctgcatgcgctgttaatttgtactcgagccgcagataatccttgcagctgatggtgaattgagaatgatcaggtagattagtgggatgcaaacggaaatgctgcttcaattgtgatgctaaatagtttttataaattcattaaaactggagcttccagaaatattctgtaaaacaataagacataaataactatccaattttcttggtgtcctagtttgagaacgttgtgtatcacatgtctattaagtaccagcttagccatcgtgagctgttactaggttgaatataacaatgtattgcagctggcaaactaggcaccaagaagtcgcatttaactagttctcgtctaattgtagcgttttctcttactagtcagggtgggtagataagtatctcaaaggtaaacaaatacgtgctggaggagtcttttcaatgcagagagttattctttaaattcagcactgaaaaacaatgaaataattcaaaagacagatttcaagaaacttacctctatgcatgaaggtcctcagattggccaccaagttcaaatgcttaattcctactctggagctggttatctactatataaagtttcgcaaaaagaaccatgagaaccatcaacagcaatcattcactacaaatcctgccttgaagtttgagtttttctcagcaatcttaacaaacgaaagatactagtttaattgtgggaaatctgcgagtcgaacgtataggtgatgtggtcttttttggtggagagaaaaaaagaagaaaaaaaaacgacaaaagccgtgcatcgaagaactattattacagatataacctttcaaaaagaaatacacactacactgagaaaacactccatatctcttccacagaaatttactgaaagacatttgttcttcagatattagacgtgagccttatcggaccaacattgatttattggtctttttttttctcgttaaggcttgcatcacccacaaggaggatagaaaaagggattgaccgactggctcatgtcagacgattttctttctaaaaaagcctcacgatactgttggatgcctcctattccacaatcatattcgaatgctaacgactctagccagagtcggcagcacgtaattttgaaccagcaacgatctcaaggctcatatcctgttttggttcagaacaattataattacacattatctaatccagggccaaattcttcagattctaagaatctaatgcataccccaacagcatccataccaagctctcaatatcagcaagaatttcgcttacagtctgtaggctttaataatgaggaaccgagaagtgcctttaagggaactaggaaggatgagtttccacacatgaagtccagcggagaacatttaaatccatattcattgaatcctccgatgtctatagacgagattaaacaaatcaatgaacataatagaagagtgcaaattgaactcgcgttaaaaaaagaaggcttcaatggccaactacctactgatgaaagcatctccaataccatcagccccggaagctcgcttccgactaaaggccatcccgtctcttcagtatctgagtattatgacgaagacgggaagaggcgaaccaaaaggttgaagttcaagaagcaaaagggaactcttccattgttagtaccgttgccgaatgacgttccattgttgcctgagggaaacaatcacacaactaagagagagaataaagaccgggaaaacaatcgtgagtttgaccaccttccacctattaacaaattctacttacatagacagggacctccaaccacttcaaatcccgtttcccgcccactcatggctcaacaactttccaacccttttccttctatacggtatcctccatcacaacgaccagaatatccacaacaacccatcccatttccagcctcaatgcaagctcgggatcaacccttatttgaggtacaacctccagatcagcggttggtatatatgaactactgctaccctcccatttttcacccacaagtgcgacctgagttacaagcaactactcttaccaacggagaaaaagtgagcataatgccgaatcactaccatccggcatcattttctaatgaacaaatatatggccctgtcttaccccaattacagtttatgccgaatcagatagattcacaaacacaaccaaataatattcttcacctaccttccaaacatgacgtcccagatggaagtcaagcggagacattgagaatttcaagatttaccagaggattcgaagagtttcaagaacaaccattacagggcaatcgaaatcacctcactcaactgtactcagagaatgacgaagcactgggtattaatttacttgcttcattgaagctgaacttgagtgtagatgatttgaacgcctaccttgctgcgttaggcattagtagcttaatgaaggcaagagaattatcttaccaagagaaagtacagcaactagaagaagaagaaagactgaaagagaagcaatggagtagaattgagcagacattagaagagttttgccagccggaaaagagaatgcatatcaaaggtttatgtgaccaattatttcatgtagaaaatcctgtcaaacgaaagtttaatagggtacttctttcaaaggcaaacaatttggctgacttcgtctgtggcagagcaggtaactctactaaagcgttcaaagatctgaagagaaagttccaggatatggaagatcataacacattcccacccaatatgcttttacaaaaattttatgagtcttacaaattcactctgtggcaaggtgaactaccggacgatgtaagcccattgaagaatgggaaaagtgggaacaaattgatcgtggataatgacttgaggtctagtgaaaattcagaaaaatacttctttagtcctgattacggacatttactagaaaacgtaccctttgaattagtaaatgcgtcttcaacaaacataaataggaggcgaaaggttctggaactgaatgttcaaaacctggccaagtatgagcttgaacataccaatgaactgaaggaaagaagcatactttccctgcaggatcaaataaaaaaactgttggagcctctagacctcaaacaacagttgataggtaaaaactcaaccgaaaaccaagagtttcagacaaggctaaatgatcttactgaaagaagggattatgaactgatccgttcaatgaactataatcagtacagagtgtcaaagctcatgagccactattataatagaacaaaagatctgtatcaggaaatggtagaattggcaaatctacgactctttagattaaagcattttttgttatgtcaaaagaaactgcttgagagagggaagattgaccgtgattttttgttcgatatctcttcggcgaagggcgtcaaactatgggatcattttgcaaaatggtcatcaatagttgatgctaccactcctagttcaaacagtcgtgaggttacacccgatgcaacaaaatcagaaccaaatgagccattagagtctcagaataataccgatagtgattcaacagatgctagtacaaatactagcgttacagttaaaaaacagggtgccaaaaaaggccgaaaagtacgcaacaaatccgtcaaccactcctttgacgagttttcgccaataatcacagaccaggagtttttcatgttaacaaacaataattccaagtattacgaaaaatacgtactaagatgcaatttcaaagataaagaagttgaagatgttgaaagacaggttgcactgaaaattgctgattccctgcgggatagcaaatcaaacttgagtcggcaaggacgtccttccagaaactcaacaattgaaggttgtgggctatcgcacaatagaaatagtaacccttctagagcagttagagacagcaatgcaagggaaacgttagaagctgagttcccaagaaaaacatacccacaatttccagaattcacaggtgaagtgagaagcaaggaactgggccatactcaatcaacaattgacctttacttctcacactataggacttcatctggaaaacacagtgaggcccaacaaatgaacagaatattcaaacactacagaccaccctatggacttgaggcagaggttattagtgaggatctcagaaagatgggaataaacccagtaggcaaataggacgacatgttgacataagtaaaatcaatggacacttatctatcttctccccacaccgttcatcttcgttacccggcgtaagtctctatcatgtaaaattcagtccggagtagtgtaaacatcatcacgaagtaaagaaaatcaaaatatcaaaaccaaaaattggttggtgcacagagccaacaagatttctaggcgatcaatgggcaattggcttagaaaaaggcattcattttttttctcatttgttttttcacttctctttgaatctccctaactttaatcaaaatggctgaagaagaagtaagtgactcaagcccgaaaacttctctaattttggacgagtaaactggcagttatatttgaacttagtttactaacatcagtagcacacctttgagaccgccgatgccggatcctctttgaccttccctatgcaatgttccgctcttagaaagaacggacacgttgtcattaaaggtagaccatgtaagatcgttgatatgtctacctctaagactggtaagcacggtcacgctaaggtccacttggtcgccatcgacatcttcactggtaagaagttggaagatctttctccatccacccacaacatggaggttcctaacgttagaagatctgaataccaactgttggacattgatgatgggtacttgaacttgatgaacaacgatggtgagaccaaggatgacgtcaaggctccagagggagaggttggtgagaaattgcaaagtgagttcgatgagggcaaagacttgctggtcaccattatttcttccatgggtgaggaagctgctatctctttcaaggaggctcctaaataataagcatgacacatcatatttatcttttttgaattgttggatgcctatgattctttctatataatataataggtatatgttgtactctgtttttaattgtatgccatcacttgatctaccctgtccaaaacgactgcctttgaagtctcttcaatttctccagacatgaacatttcatcaatcactgcgtacactttgtaaaagctgaacaccaggtccaactcacaaacattattgaaatactgatcaagtacctcgaccaacaagtggatactttctaaatacattagctccccatcgtccatatctatacacatgcaaaaaaataagcctgcgtatctccgataaaccaacttcttcttttcaaattctacgaaatttgattgattcttgtggtccctggataaaatcaacctgtggattttttgtctaacttgaaactgctcatccagagatattttgcggtcaaaccacttagagatccgaaccttgccctggcggttcagagccaaaatataatgaattgacattcagggtaactgagtaaatctcttcacaggtaagatgtttatattgcttccaacaagagtgctttgaacggggagaggaatctaacctgggagggagttgatttttcagccgacctacaaatccttgggattcttgttcgcgtaatccacaatgtaccctgttcatgttcccccgcatctcagtagaaatttccgtgcaatcggctaaatctttgaaatagttcctacctcagttttcttccaactagtcaacacttggtcgatgaattccatagatgctgttgttcgttactctccattgagaaacaatctttgcaatttgccatcggcaataaccacaatgctttttagtgcagacttcaacatacaacagatcatagttgaactatcttgggttcctcaccagagagctgcccagaggagaatagcgtattgtggttgggccggtggcattactaaaacaagctcttctaatcccgttatcgagattgacaggtcattggcgagtgctatcgatctacaagagaatgtaaatgtgactgtcaacgttcacatagacgctgtgaaggcaattactgtggagttggaaccagttacaagcaatgattgggaaatagtcgagacgcatgcgcaggtacttgagacttatttactcaatcaaacccgttgtgtttatccaaatcaagttttagtcgtttatccaactccgcaaacaactgcaaggctattagtgaaaaagattgaacctgaagtctctacatttgcccaattatttaacgatacggaagttcaaattgcccctaaagttcaaaaacgtcccagtatatcttccgtacgttcagacagcagtggccacagaattcgacgagtaagatcttccacgtcaactgccacaggtagacgatccgtgacaaacaacggtgaagtgcttccttcaatgctcagaagatccatcacactccccaataacacgtatgctcatgttaacgactcaaaatcgggtggttataaagtttactgtaacctgaatgaattgattccagctctgcaaaatgcgcactttgtctcggtttctgtgctggtaggaccaggaactccagatagaaccgggttgacaagtagcaaaattaagcaattgaatgactcgattgatcaagcagctcaaacgcaaacaaatgctgcgggatcaagccatccaccagaatcatcctacaccgagacaggaaaggtaattgcagaactagtccacgattcgaaatctccaaaaggcaatgtaggcctttctgaactgttagcatgttctttaggaatagagaatacagtgggaaacttgatctctcttgaacaggctcgcaaacctttaataaaaaaacccactgttttagtgcttcacaaatatactacagtatcaccggcttctctcgatagagtgacaataaagcatgccactgaagaacagaaacgtgtccaaaacaagaaagagagggatactctcctgactcagctaatgcaactactttcgcctttgctagattcttgtacttttacaaattgtgtgaaacttccaaagattggtacattgctacctaatggaggattactacaattcaagaggattaaaagcggttggacaactcctttagggaaagacaatgtttctttggagatcggagaggagattcttagaccggagtcattcatcccatcttacgatctcctacctgataggaaaactcatgtgagaacacaaagtgaccagtatcctactgctcaagaaaacttgattgaatcattatctaaaattgcttctggtgggtccctgctttttggtacaagtggtagcggcaaatctctcgtcatatcgcaagtagcacaaatagtcacgaacaagggacactttgtcaagcttctaaactgcgataaaattatgagtgaaagttacaataacttgagaggcatttttgaagatatatttagcgaggtcagttggaaagctccctcgttacttatcctagaagacttagactcattgataccagcagaacaagagcattctgactcgagtcagtcaaggcaattgagtgaatattttattagcaagctctcagctctttcaataaacagagatatcacaattttagcttcttcgaagtctaaagaatctctgaattctttgatatttactactcatttgatagagcatgattttcagctgcgagctccggacaaggaagcaagaaagcaaattttacaaagttatttagatactctaaatgtcttctgttctgaaggagagttactgaacaatattgctgttgaaacggaaggttatttaccgaaagacctgaaggttttgtgtgacagggcctaccatgatttaatatctagggacatcttagcagactctgattctgaactggatattgaagaatctagcacaccaattctaaatggttcagtcggggatattgcaaataaacagtcggagatagagaatggtatatccggattagagttaactaataattcatcatctacaatcgcagttgataaacatggagcgacaattcaaaaagataattttgatagtgctctcagtggctacatacctcaatctttacgtggggtaaaattacaaaaatctgatgttcgctgggatgatattggtggtctacgagatgcaaaatcaattttattggaaactttggaatggcccaccaagtatgcgccaatcttctctagttgcccactacgactaaggtctggtatactactttatggttaccctggttgtggtaaaaccttgctcgcatcagctgtcgcagcacaatgtggattaaatttcatttcaatcaaaggtcccgaaatcttaaataaatatatcggagcgtcagagcaaagtgtccgtgaactttttgaacgagcccaagctgctaaaccctgcattttgttttttgatgagtttgattcaattgccccaaagcgtggccatgattctactggagttactgatagagtggtgaatcaaatgcttacacagatggatggtgccgagggattagatggagtatatgttcttgctgctactagtaggccagacttgattgatagtgctctcttaaggcctggcagacttgataagtctgtaatttgtgatatgccagatttcgatgacagacttgatattcttcagtctgtaaccagaaatatgaatgtctctaaaagtgttaatttgtccagtgtagctggggaatgttcaggattttcaggagcagatcttcaagcattggcttacaatgcttatttgaaagctgttcatgagaaactgaccaaggacgaatcgatggcaatggcaggagagatggatgataatgatgataagaaaagaatggttgagtgttttcaattttccggaaatactgaaaagaaaagcttaatagaattgaaaccctccgatcgtgccactgtaatcaaaaagccagagcacttgtatcagggcaatggtaaccatgcagaaggagaaactaaaagtaaattagctacgactgcagcaaactcggttatcattacttccaaagattttgaggattcgctttctgaaaccaaacaaagtatctctcagtctgagaaaagaaaattggaggccatataccagcagttcattagtggcagagacgggaacatgccggatgggacagcaagcaatgaaatcggagctcggtctacactgatgtgaagtagtatattgaattaagtattagctaacttactctaatgtagtttgacaactcctgaggcattggccttcgacatgatgtagtccttgtagtcataaatgttaccttcaaatctcttcacagtaccatcctcactaacccaaatttcattacagattcgatcaatgctggctacatcatgcgaaaccattaacactccccctttgaatctatgtagtgcttctgacaatgcatccaaaccagcagtatccaaatggttagaaggctcatcaagaattaaaatgtgagggttggagaggcacaaagcagcaaatgcaactcttgatttttgtcctccagataacagctgcatcttttggattgctaaactaccagtgattccgaaagatcccaaatgccttctgtattcttcatcgttcttacctggaaactttttggccatccaagtaacagcatctaatgtaagatccatggaatcaacgtgatgctgcgcaaaatatccaatacggagtcggccgttcttggaaataaacccatccagtggagtaagatcacccatcagcagcttcaacaatgtggtcttaccacaaccattggcaccaacaagtgcgattctagagtccatttgaacatctaaatcaacatgagataaaagcattagtttaggatcatatccaaacgaaacgtcctgcaactgcaagattggtggagaaagcttttcaggatccggaaatttgaaggtaataaccttttcttcctctggcgcctccaagattggcaacttttctagcttcttgattctggattgagcctccgaagattttgcagcattgtaacgaaatttatcgataaaggtctgaagatgttttctatattccatttgtttttcatattccctcctttgattctttaaacgttcctctcttgtattataaaatgcatcaaaattaccggaataataatctaacctttcagaatgttgatggatgatgtcagtggcaacttcgttcaaaaacgccctatcgtgggacacaataagaaccgtagctggataggtttgcaagtaatttgcaagataagtgatggatggcacatccaacatattagaaggttcatctagtaataacaaatctggcttacaaaacagggctcttgctaaagaaagacgcattctccaaccaccggaaaatgatttcgtaggctgcagttgggactctttggaaaaacccagaccaaataaaatagcagcagctctaccctcagccttatccgattccatttcagaaagtttcgagtgaacttccagaatacgattctgcaaatccgaatcttcattatctagttttttgacctccagagagtcctcatcaaattgtgatcttagtttttcaatctcatctattctctcagtaatacctgcttcttcatgcaataattgctttctccaaacatcagcatccaaaactgattgcaaagcaggggtgtcatcacctattatctcctgctcgacatgaagaatagttacatgcttaggaatgtctaattctctcctggaaagagcacgcaagagagtggactttccaataccgttttgaccaattagaccatatctccgaccgtacgccaaagtcagcgaggcatcgctcaaaattctctttccgtcaccaacatataaatcgaacgcatcaagcttgatatcctttgattttccagcggcagaaccaaaatcaattgggttgattttgaggaaaaatgagtcgtagtcctcttgggattgctcattaatgagtttggaggcttcatattttacaaacttattggcacgtttggcaaccttcttggcaattttggcctcagcttttatgagcttcttcttatcaaccttagttgccaacacacggcccccatgtgctatatcctttgtgctttgcagcagagctaaagacgaattaatatcacgttgttgattctttaccaggctgatgtctaatagtctcttagaagtgtcgcctgtaagcgagagctttttcatattctctttcaattttgtctcaaactcttcttgtatcttgtttgtgaaggcagatattttctccttgtctcctccactacttactaacaaatcatgaacaaacgacagttcttgggctatatccagctgttgtgcgataacagcatcctctgtagatccgttcaaatgctgaatatatccaacagtatagtttgcaacaattgggtccaagtttggaaccgcctgtctgacttgtagaccaatgtttcctgacattctacacgaagacgaagaaaatcaaaattcaaatttacaggagaaaaatcctcagtgatccacgaattttactttgcggagcgcactcttcatatattacaactgaactcacaattcatctaatgctagctaatattaacgattgaatcggttataagaccggaaaatagcgtccatatctaatggtagcacagagccaaagacggataccgggttaagagactgttgtttgatgagggcaatttttaattgtccaaattcggcccaaggctggagtacgctcccttcagcatcgtcctccgattctgagaatatttctggtagctcactgggcttttcgtttgtagaaggggtcaccctttgaaaaacattaaaaatggagcgtttggactgaggttgaaccgactttgcaaaaggagatttcgcaccgtttcctaaggaggcagtcttattgagcctgtcggtagaaacttccgcaagtacttttggttcaagcagtctttcggtacgtctgcgttttatatctggtaagtttctctcgactggaatctgtatttgttggacatcaatcttctttcgatttcgaatctcgttttcaagttgtaaccttcgatgctggatctgctcttgaagaattaccctgttaattgatttcttgtttgcttttttatttgacgtttttggttgcacctctaaagatactgatgtaagtgcgggtttacccagcttcttagctattgcagtggtcttagcggatgatactcttcttgatggtggaaggattttaactattggagacaaactgatttttttgggggatactggttcttttcttggtgatacattattgaatctcggatttgaatgtaaaggcgacagatgaactgaatgattaatgattttttgttcttttcgaacattcttttttcttgtaggtgagaactgggattcacagactgttttctcatctgaagcatcgaacttcagtattgttctctctgatagttcaggattgaaccacatgcttccggtttctatttcaacgtgagattggactcttgtcgaaggtgtccctccgacgcttgcaaatccactatctaaaacttcgggagacatcttcaaattatttgtcacagttaaggatgtggacacattatcttttggaggtgcgatgttatccttgaggttctggaactcagaatcggatgcatttttcccagcacttcttttaatacttagctcccttcttgaagggagggatgcaaatggagtggttgcagtagttgctgtgctcctcctgttatcgtcatgtttctcatcctgatcatctttcagggggactttttcttctgttgcatgctcaactattgtaaaattctctccttgagtaggtgccaaaattggggcagagcgaataggagaaagtacttcttcacctaaaatagttggtggggaatcggaactattactggcacgcacagaagtccgcgttaacattgacttccgaacactttctttgatttcttcaaatgaattatcaggtgttgattctctcttaccacctatagcgctttgactaatattaacttgttccctcagttttctatattcatcaaatttttccttcttataactttctgtagtttgcaactctggaatgttatttacgactggttcttggaaaacattgttggtaagaggttcaccatcagctttcctactgggtgactcttgcaacttcttgggagatctcagtgccagcatgacaaggttgggagaaccctctaaaatttctcccatttgttcgtctaaccagtccagttcataattcacagactctgcgaatctttgggtttcggtaaacatcgttcgaacactattttccaattcttgggttatccatttggaagaaccaggcacaataggattggtcatcttttgggaagccatgaagctccaaagattctgtatttccatgaccacgataagaaatactctttcaatgtaccaaaacaaagttgataaatgagcgtgtcttggatagatttaaaacctaactactgtcaaaaaataaatacaaaacatcacgtaagaagtcgcgaagatcatcttgattactatctatgtatatcactatttaagcaaaaagactgctttacgtttaccagtcatctcgttaagaactgacttcatataaactgtcactttgtcaaacacatgcaattctcttttattgccgattttatcattaaatgaaagtttaaactctttttcatcaaacaatccactgctttcatcacccatatcttccaactttatcaagctttctacaccaaaatttggcacgagaacgacgataccgttagtgaaaactttgatgatataaccttcctgagaactttctgtgtttttgataacctgcccaacataatattcgatactggctcttcctgcaaactgtgcatttctatggcgcctgttcatgttcttaacaataaggtccatcttagttttgtccctttgaataggatgcaacggttcgtaccctatggcagcagcaagctgacgatgagccaatacatcacagtaacgacggatcggagaagtgaagtgagtgtaaatgtctgcagcaaggccataatgcttgaattcttggtacgaaaagtttccactaacaaaatactcagctgccatcatacatctggtggccataattctaacaagggtattgaaatattcatcgttcttatcaacacatcgatccaacgaatcagataatgccctagagttctccactgaaatggtcatacctttcctaatatgtaacatttcgttcaacgcttcaaagtttgtagaaggagggggagcatgccttctcagcatcgcaatttgtggaaaagcgtcatagatttttctagctactgaaatgttagctagcaacataaattcttcaaccagtgaattagtgtccaatagttttttaatttcaacttccccaggatcagacgtttcactatccatatgaaccttaacctctggtgacgaaagattcaaagcaccagcatccattctcttcttcttcaatttcttggaaagtgctagtagacttcgcatgccttgagttaattcatcgttattggaagaatcgtcaattctatcttgagcatcttgataactaaatgcttccctcgatttgatgatggatttcatgaaatcaacattgattatgtttgcatcttcgtccaattcccatattacagagaaggaaaacctatcaacatatggcttcaaggaacataaatcagtacctagcagtgtgggtaacatgtctacacgtttgtcgactaagtaaacagacgtacttcttgaagcaccttcttggtcgagtgcagtagcaggtttgacaaagtgtgtgacatcagcaatatgcactccaacttcaaaatttccattaggaagctttctggcatgtaacgcgtcatcgatatcgacacatcctggcggatcgatcgagcaaacaagtttatctctcaaatcacgtctctttttcaactgctcatcagaacttaaatccactggaacaatccattcatgaccttcctttggcagacagtctagaacgtttttactaaatggtctatattcaacatcgtgttcgagtagtaaagcctcctgttctgtgtctttatcctctatagggccaagcgttctaacaaaatgaccttctggatgctttgaggttccaggccaatcatcaattgccacgacaatcctcatattgagcaaatcattggcttttcttgttttgattctgacggcaggcatagatttctcagataatgtaaccaagcaagaattcaatgcatttgtattggtagtaatggtattgggactcaattgtcctgtaaatagtctccatcttcttctaatgaccccaaccacttttgcgctgggctgtaacttagattcgtcttccatttgtgctctacgagcttctttgtttagtaatcttcgctcttggtcagaaattatcaggtcattgtcttcattatcggcatttcctaaggttgtctcgtcaacgatatcattggaaggtgcaacccattgtgacttgggaagcaattctacaactaccaagtcaccatttgtcgcacgattcatattctgacgacctctaacaagtatcggcttaggaaaaattgacggcaagtttattgttccttcaaatatatcgtatgatgacacgttcattggtccctgaaataaaacactactcttaacaccagcaataagtctcgattgtgagtagtattcagcatatttgaattcagcaacctgaagatcatcctgggcagatggcaaagtgtccaacaaatcctcggaattgggcaactgtcctaaatattctctgagagataatgcaagaatatgttcgtctttacattttttgaggttgtctttgtcatcggtaagcagaaatactttaacaccgtagtttgaaagatgtgagttataatactcaccaacttttctaatcaatcgatcattgtaatcgttaatagtttcgcctttctgcctagccacaaaagtattcttgcaaaattcgttgtgaaagacaattaaccttttggcatcagccttggacaatcctcgcagcctagtgtatatcgggtaacttctgtttcttacttcttccaacaccgtttgaggaataatgacatcaaacaaagcctgagaaccttccagtaagtctatggcgttaagtacaatattagtgtccaatataagataatgtttggttaatttggcagtggaaaagggcacatggcttaacactggagtggtttcaagggaatattcacattggtcacagagcttggagtagcatgcgacatcatctcgtaaataatgctcccttacaatttttgttgcacctccatttcgggaccgtacaaacacttttgtagtgactgatagtccattattcagccttttagtggaaggcggcatgtttaattggatttgggagacaagagaaaaaaaaactagtttgatcgcgctgaacagatgcgctttttatgaaaagttcgtacatatcagaaaccatgctgactggcttggtagtctacagagagctgactgcgaggatcagtggacccaaaagattcaaaagattggacagatttgagtggttttatctaagcttcattttctggcttctattccaactccaaaaattgcaatattagggatgaaattacaactcgattcatctatacagtgtactatacatttagatcaacaacagttcgatcttgtccttaatggagtaaatttgattcttgatagcagaggcatcgtttgtagtgacagaggctgcaattacaggtctcgatacaccacaagctctacctaaagcagttcgggagggaacaaaacgtaagggacgttcttatcctcacacaataaaggtaaatgaagaagaatttcaattggctcggtatcagcagccataacaatgaattcagatatacctctgttcagagtcttagtggcttcgttagctcctttcttgagctgtctcaagttctgagcttgttggacgacgtccaagatttgctgggagagagtggagtcagctaaggggaatgctttagggttaggagtagacatttggaatttcaattaaaggttccttgcaatagctcgccttgaagatggaagtaatgaagtagattgattaacaaactaatgtaggaaaactttttttcttctctgctaattttgatgtatgaaaatatttcagatataagagaatgcacgacctcaaacgttacataagcaggctggatatatatctcattagcgtcaatcctccgctataaaaactgatactcaagactaaggggcgcaaaaccctaataaagtatatcagtatgtagtaatttgaacttagaagtgttgtattctataatattacgtgacttataactcgcttcttacccaggccatctaaaggccgaaagttacctccaatcgcccccagcagaagcacggagcgcgcgtatttttcagcacatcatttgaaaagcagccagccaacgacttacaatctgtatcgattctgaacttccatcaacttggcacaacttacaacaagttagaattcctcatttaaatcaacaatgtcagatctttggtaagttcggcgatgctctagataatgagaggattgattgattactaacattacgtttcaaagtcctgtttatgctccattctttggatccattggttgtgctgcggccatcatctttacctgttttggtgccgcctatggtactgctaagtcgggtgtaggtatttgtgccacctgtgtcttgcgtccagacttactgatcaagaatacagtgcctgttattatggctggtatcattgctatttatgggttggtggtgtctgtgttgatctcttcatcgttgcaacagaagcaggctttgtatactggctttatccaattgggtgccggtttatcagttggtctgtcaggtctggctgctggttttgccatcggaattgttggtgatgctggtgtcagaggtactgctcaacagccaagacttttcgtcggtatgattctgattttgatttttgctgaagttttgggtctttacggtctgattgttgctcttctactgaactctagagcttcccaagatgtcacttgttaaagcatcgatctcatatcaaactatctacacattgcccatatccctccacttaggattaaaaaaaggggagatcttgggttataaagtactcaattagtgtgtattggccttatagatacacaattgatcagaacaaaaaaaacaaaaaaaaaataaaatcacattcgtctttttggatctgctattcacttttcctgcgagaagttgtaactgagctggatagctatgttctttctcagggttatcaacaactctgatacagtctggggcaaccgctttgtctttctccaatcgtccgccttgttgtagtcaccacttattgccaattggtatagtagatcagcttgtagaaccgaagatttcctggcatccggtacatcatgtttcagtctagagtcatactcatttagtagttcaatgattataactagttcttgagtgttgaaaaaagcttttcttgagtcattgcttgttaaaaaaggaagaaattgagctagcagcagcggttgaaattttgggggtaggaatggaaatcgaagtagcttaatcaaaagtgaaatacccattctcacattagagcctgaagacaaataattatagactcggcataaaattgcatatggcgaaatgcattgcctcaataccggagacaattcaacattatcactcctatcttcagcgtttacctggtcactgataacagaatccaagagcttgtcaccaattgaatgccccaataacaatgcgttctcaaatattagccagcaagtattagcgaccaatgggatatctcctgacttgctgaatagtaataggctctctaacagtaagcctttgtcttttaggttttgtccttggatcttacatatccttgctgacagatcaggaagctttaggttggcgcaaatggaaaggcaccactccagatcatcgtttgttaggcattcaaatcttggtaagaactcagacacaagttctcggcaattctcattattcagagtaatagttagacctataccggttggaagaagtgggttgttggagaggcatgagtatatcagatttcttaaaagatattctgaaatcaagaacgaatcatcatctgagagggtaatatactccttaaacaacccttgcgcctcacaaagaacagaaacaaaagcagaagtcgctgtgtccaacatctccaatcttgtcagcattctcaaataattcttttccaataaatccaaacatgccagctcccaaactgtttctatttgacccggaaggttgaagttctggctcacgatagccatgtactccaaaataaactcttttgacggaaagctatacatgtagttaaccaatagaacttcataccacgaatcggatggatcgatggaatgattgccagatattaagctgaccagctcgaatacttgtgcagaggtgcctaggcgcttgaagtcaacatcagagtagctgtctcggagttggcatgctgcttgtttccattgcaaaaagcttttagaagacgttgcgaatcccactgtatcgtagttgcttaataaagtttgaaaatcttgaatgaatagaaacagctttccatctatctcctgaagttcctgatactttgactcattaagtacatcaacagcaacctggaacaaacctctctttaccagtttgctgatcaggtatgaccaaaacagaggatgctcgtagggcttttcttcattcattatattctccaccaaaacttcatctggctcaacttgagctcgattgacccacattattaacaacgtgattgtctgagttgagtctccaaactctaatgcgttcagtaaattgaggatatctaaaagttcattatacttgtaggtgtctgaatcatgcattcctgattttagctgattcagtactaagtcattcaagtttttggataaacattcaaataacctctgtaacacaagccgtctctgttttttgttctctgtgatagtattctctaatccaatgtctagatcatcgtccccatcaaatgatttgaattgattgtctttcaggatgattttaaattgctcgtaagtttggctgacatattgtacataggattttgagtcgtcaacggtttcaacagtaaacggatacaattttgtctcttcttcaaatggtgcaagatgaacctcttcatcaccttgtgaaataaaaagcattccttctcctccctgcagcggattcaaggtaatctttaaagaccttcgcagctcctgaaattgctgcacattagagattggcgggtcatctatcgttattattggaaaggcctctgacttcatatcaaggtcggaatctgcgtttacctcatcgtcttcgtcgtaggcatgttgaccattggaggttgtagcacttttattgccattgttgctatgatcaacatcattgaatatgatgctaggtatatcttcaagagtgtctattcttttagaagtgagaacagacatttatcggatttgatagaatgttgatgtttacgtatagaaaggtgagtttagatttgtatgtcccaactttgagagccacacgtcttttttttttttcacaatctaaagacgtaagggaagagaacaggacaaaaccagagttcagttctttcatagtacttggagaatgtcaaaaaacgagcacgatggataatcttctttgagtctagctgtttttttgatgttagaacaaacaaatagcatccctgattaatagtatttgatactcaaaattataaattacatattgtacataaaaagcacgacgttcttagttgaatctgtgcctagcttcgtcttgttcctcgtcttgtttgaagggttgaatgtctcagcattcttaatcgtctgtgttttggccgtcttgatacttccgacaatgatgcaggacggacatctataatctgaacatcactatcggacgaagagtaagaagactgccctgaagaagatctaatggaacgtttattaaggactctacggactggaagtccttcttcgtcttcatcttcgaagaggtctccttccttctcttgttttactgtgtcttgtttctttcttttacttttttgagtaatggtaactccattactcttagcttcaggctttctgttcttgttcaaatccacagtctcaatatcagaagaagcctcggtaactgttgatttcaatttcttagcagtcggtgtttttttggattttagcctagaatttctagcggaagttgatcgaggtatctgctgcaagcggtcggtatcagattcgtcgtcaacagaacttgtttcctcaatgggctcgtcatcactggattctgaaaatacaaaaagattcacagagtttcgttgcttaaacttgtcgggaacggcctcgtcaccttcgtcatcttcgtcatcactttggccatcatcttcctcatcatcttcgtcattatcactatcagaatctgaatatcgcattaattcttgatcaacatcgtaaacttctctcaagggagtttgtggttttttttgaaacttgtattgaggaccaccactcaaagacttcgcacttggaagcaaagaacttgaaggctctgacttccgcgtggtgtttaaagaccgattggttttttgtatagattgatcttgctcgtgctgctttgacttctttttaatttcactggtttctcttcctgtggtattttttctagcaccagaatgtgatcttgaggaggtaaacttttctggtttgcgaaattttgaagacttcaaagcactcattgccttattaatagctgcttcaggttggtccactgtggaatttcctgaagttcttctgaattctacggcagggcttcgataactcctagtataggaacttagtttggatattctaccaccactcattcaataaagaaagacacagtgaggcaaataaaggagatagataaatgctccgttttggataaaagaaaggatattaagccacccaatttgtttttggttttcaagagcgatgatcacgtctcaagatcaattgaagcaggctggatttctgtttactttgtttgttttctgacttatgcaacgagcgaggtatgaaatgaatgttgaagcttggggcgcgcgatacaatgctcatattacgtaatacttgtccaccatcggctaacgaaatattaccttctcctcttcttcttccaatcctcttcgattgcgattatttcaacatggctgtacaagggttgggagctattgatcagcaatacgatggatctgcactgcgaatcggaatcgtgcatgctcgctggaataaggagatcattgacgcattagtagctggagctataaagaagctcaaagcattcaatgtaaaagaggagaacataattgtgcaatcggtcccaggatcttttgagttgcccttcgcttcaagaagtttgctgaaggatgagaatttgaaactagatgcggtcattcctattggggttttgatcaaaggttccacaatgcatttcgagtacatttgcgactccgttactcacgctctcatgagagtccaagaggaaacccataagcctgtgatatttggagtacttacatgtttaactgaagagcaggcaagaaagagggcaggtctagatcctggaatgcataaccatggagaagattggggagcagcagcagtggaaatgcctttaaagtattctcgttaggagacatggacttgtcgtagatgtgtattaagctacaatgttaagtcttgtgactataatagagcgtcgtcagctttgtatttgttaagagccctcttagcctctcttttacgagcacggaatgctctgttcaaatctcctctcttagcttggaaccagtctagaaatttgtctttgctggcagcgttaaatccttgatgcttattcacttgcgactgggcagccaagaatggcgagtcatcatgagtaaaaaaaagccctaagtttctagttttcttggatgactgttcaactttatccttgaactgctgttcaatcgctattcgttcctcaactgacggctcaatttctttgttcacgtcaatgtcatcattggagtcatctacgccaaagagcttgaaagatgagttcgcagggtttagcaattcacgaagggcctctgtctttgatgatgagggagttctctttgtgaagttaggcaaaaattcagtgtctagatcttctgagccttttgaatctttcaattgccttgatccttttgttccagcatttcgacttgaagcgtaatttgtcaattgcccatcatccgaatcatcagaatcatcatcagagctatcatcagagctatcatcggagctttggtcggagctctcgtcggggctatcgtctgaattatcatccgagctgtcattggagctattgtctgagctgtcactagatctgcttgaacctttagaaccgccctcacgtttggatgtcttggaattgttaaccctgttaaccccatcagaacaatcagaattctcgtcattcgaagagctgtattttgagttgtgttcatatgctgtatggttggatgcgccaactgatcccttggtttggtcaatttcaatcacatcttccagttctttcacttcgccattctcgtcaaatatcactactttccctgaaacctcgggtactttcattgtgtcgacattaacaacagagttatgctttccaatcttaagtaatggagcctcagcatcaacttgcccagtctcaaaatcaaatgttgttgtatcgtttgaattgcgatcgtcttctcgattcacaggcttttcaaaatcatagcctcgaaggaatgagtctagaatgctcatattcttttcttcttcaatggtttcaatttccacgtcttggtcctccaagttggtctcagaatgcttcctttttcttgatagtctatccacaacatggtcgaaaccatccctccattcggttcccgaaaatgtataaacgagatctctggcttcacgcttcttgtcatatccccagagcttctgtttgcggcattgtacagtttttagcttgccatttatttttaccctgaaagttaatctacgcttatctttacgctcacatgttctcattcgtccttttaataggtgagtgacaacattcttctgcctgattctttccagtctgacttgggccacttttgctcttttcagacggtcgtctttatacaaatctggccttctagaatcttcaagccacttctgataaaaatccggccttgccatgtcaactacaacccgtgatcccttgtagttcaaaccatttaaagatcctttcaatttagcaaagttttggtcggaaagtttgaggctaatgtatgcaaaataggaatctagcaaaggcttcttgtgtagctccaatggcttctcaagagttccatagcgcttcaaccttgtttccagatttccaatatcgcttgccagatcggcactaatgttgcctatgtagatgcgatgtatcttttctgtcatatagatcctttaaaacggttctaaactttaatttttttttttcatgtcctatggctcgaaacttttcccttcaatgattgaaccaaaaaaacggaggttcccttaagagatgaatctgtattaaaatatcgcgaatatttccaatactgcgaacagacaaactataccacctacaccacctacccacttcttggacatctcaaggctagttccatgtcattacttgatcaagattattatctctctgcactgccagaagataaaagagcggaactggtcaccttacaactgacaatacctttgaaaagtggagatgaagttgtcacgattgatttcaacgaggatgttgatgtttctcaactatgcgtcctattggaaagtgagaacgccagaccagacctgtggttgagtgccgctaaagtatttgtgagcaaggggaatattgctggaagccaggagattattaggaaagctctacaatcgaacgtgatattagactcctccgctagtgtcacttcgctgtttcataacttttcattttggttatccttgatggagtatgtgtccacaaactctcgagaggaccagtttttagagtatgcatcgaactctctgcaagcgtcaaacagtttggactctggattgatcctgaacggaattggaaatggtgtactatatgcaaaaagtcgtcggtatgacgaagccttgaaagaatttgataacttgttgaaaaagaagtcaacaaatattttagcaattttaggaaaggctcagatcctctacaagaggcaaaagtattctcaggctttggaactgtaccaaaaggcattgactattaacccgttgattgtaccggatccaagattgggtattggcctatgcttttggcatcttaacaataagcaactagcagagcaggcctggcataattccctaaaggttcatccccagaacaatttgaatactaagattttaatctgccttgccaagtttgactattgttttaatgaatcaaaagatgatgacgaattcactgctctttaccgagaatccttggaatttcttcactcatgtctaaaagaagacgctaagcatcctcttttgctgatggttctggcttcttactacttttctaaagaggactacgagaaagtagaaaaactttgtaacttggtgctgaaagaaaattcaaggaatgcagcttttgtcagtgcatctcacttctggttagcacgtgtagcatatcataaagaagactatgtgcaagcacagaaacagtttaagcaggctgaagatagtcaaaattcaaatacccttgcaaaattgggttacgcacaatgtctcattgcaagaaatgaagttggtgatgctacaatctatttagaaaagtttttcaaggagaatcaagattcgaaatcaagtgagatgatgttactattgggaattatatactctcaatctggcaaatcatactacaaagcgattatatttttggagaaatatgttgctgtttgtcaagaagaaaattatccaatacttcccgaagcttacctcgtactctcccgagtgtatgagaataaggatttgaatgtggcgttagattatctgatgaaagctaatgatattctaggtgataaggctaatgtttatgtgttaaacaaccttgggatctatcattttttcagaaataacgtatctcaatcttctgacttttttgcacaatcgttagaagctttgaataatgtttcaccccaaaataaagaagctttgtctatcaccttacactataacaaggcaagagttgaggaggtgtctaaccaatctgaagcagagaagctgtattccaaattaatggagaaatgtccaggatacactagcaataaaataagatacatctatctcctggctttaaagagtaatggtaataattacgctgatgttcaacaattgcttgatgattttccttcggacctggaggttcgatcattttatggctggtttttaaagagatacgggcgcaagaacggacttaaacaagacctagagagtcaacatcacaaagacactttgatcaactatgacaagcatgactgctatgcgcttttgtccctgggtaatatttacgcaacaattgcccgggagatgaaagtgacagaccaaaaacaaaatgagataaagagacaacaatatcttagagcagcacagttctatcataaagttttgagtatcgatccaaagaatatatacgccgctcagggtattgccatcatctttagtgataaggagagaactggactagctttggagattttcaaaaaagttagagatacagttcaagatctcggaacttttattaacttaggtcactgtttcatggaagctaaacaatttgggaaagctattgaaagttatactattgcgttggaaaagttcagcaatggaatggacagcaaattgcttgtactgattggcagggcgtggtaccacaggggattctacgagaaatcaatggatgcttataaaaaggccttagaagtcagtgaacaggcttatcaattgtcgaagcttccagctctgcgtttcaacattgtgttcatccaattccagatcgctgacttcgtgaagtcactaccaaatacccagcgagatctcactactttggaaaatgctctttctggactaaatgacgccataaagtctttgctcaagttggcagagttagagcaaccaccttacccttcagaagatctaaaagcgcgtgctacgatgggtagtaataccctgaggaatcaattagagagagctattcaagatcagcaagattatgaaatgtctatccaagagaaacttcgtaccgctaggagaaaacagcagcttgacgaggagaagaggcttgagcaagagcaaaggaggctcgaagaagccagaaagcgacaagaggcagagcttattaaacgtcaagaattgatcaaacaagcagaggaatggaacaaaatggatattgacgccgctaaggacaataatgatgtcttaagtgaagatggaggggaaggcgaaaaaaagacaaccaagaaaagaaaaagaaagcagaaagtaagtgaagatatcgctccagatcttgatcgaataaatgaagagaatggaaacacagaggattatgatcctatattggacaatgaagaggaagaaaactacgatgagaaggactcagagaataaagaaaatggtcaaaatgggcaaaacgaagaggtgtatcctgaaagtgagggagatgatgaagatgatgtaaccaatacgaaaagacagaagaggtctaagggaattgttgacgaagaagattctgagtgagtacgtaatttctggttctatattaaaactgaaaaatgatccaaatacctagcgctgatatttcttttccttttgtttcttaacgttgaacttgaggttttgaatttcgtcttccttagcattgtagcttacattagtgatcccgttcataggattttcaggggacttttgaaattccttgtagcaaagattctccagctgttgtttacggagcccggggttttccaacttcagttcgggtatgcgacgttcttgaaaagcagcataagctgccttgacccgtctctcgggatgtctatcaatgtcagcctgagaaacaccagcatcggattttagtaagtccaatgcacctagtgcgtctgaaatacccgaagcatcaattgtggatgccttattaaagtcattaaacgcgtcatcaatgcctcccttcttcgaggcatttttggcattcttgccagactttttggccttcgcagagatcaattcctcttcttgttttaaaagagcctcccgctcctgcttcttacgtaattcctctgctttttttgcatctttttcggatttttttgcgttcactttcttggatccagattcccagtcctcttcttcactttggacatcctcttgtggctccttggccgacttctttccctttttcgccatttaggttggattagaataattgtcacttattagggggcaagaaaatatcaaccagcgaaatcggtagctatgaccgaagagtgacgggggcaaggcgctggccaatgcttcgcgcgacgtgctgacatgcttcgccgagcattctctgctcggcacaggagttcccttctgagataatcactccattctattgttgctaccgcccattacagagtcctcacctacagccaactttaatttctcagaaaacatgctccctctacagatctattggacacgcaatattagatactattactaatttattacaatattaatacaattaattatctattaataacttaatcaaattagaacagcaaagcggcaccaacagcagcagcggcagctccgatcaaaccagcgttggatgaggccaaatcgacagcaccgttagtggtggtgtcattggattcgttttgagcttgcacaacggcgaaagcagcagagatagtgacaataaccttagagaattgcatttttgtagttatgaaagattgatttatgggttagagagaaagaaaaaaaattaaaatttggaggagatagagaaccttatatagtggtgctatcatttaaggttgcgcactgttgctcgctgaaattttgtggcttggctagagaaaacacgacaatcatgcttcatttactaaaaatagaaataaattatttcctatttgggacattcatacatattcagcagaattttactctaatctctcatgataaagttgctgccctagagacgtgttttatggcacgctgcacgacagcagaagatgcctattgattatagtcatccaaaaacaggtcaactactgcaaaggctacaccaaagctcaattcatagcccattcctccagctccgtagcaatgatatgcaaagctgttttcaacatctggaaccttctctctttcaacacgaactcctccttttctagaaggcctaaatcctacatttggctgtatcacttgaaaatgtcctgttttggcatcctttaattcgggaaataacctgtccgcgcgcgttaggatatccaacgaatcctgcgaccgggggctgcctgaatcgaaatccttttcttgctttgtccctccgagaattacgtaatcttcggtgggggactcaggattgctcaacggacggggaatgaaaaaagtccattggccctctttgctctgatgagtcacggtcttctgcaaatgcggaccactagggaccttcagtagcagtgtttgtccgcggattacgtagcaggcaggatcccatccaccgttcatttgaagtcccaaccctgtgcaattgaagacgtaattgtaaccatttgcacccagatctgggctctgatcattctttgctgcattttcagtaaaagcttcccgtagtgtattcagtttaccttgctttagagttactcgtggattagaacgaagcttcttgaataagtaagacagaaagaaaggtgcattgagcacccatgtcttataagatgcactgaacccatgctcccagtcattcactacgaaatcctcgatctcttctctataaccctgcttcaactcggaataatactcaaagttgggatgacctctctctacaagatcggtgccttctaagaatcgaatactggtctcttcctggggttcaaaggcagctagcttcttgaaatgcccatatgttgcccttgtgtactcaacgtgtcgttggtcaaattctgtaacagaaggaaacggacggaaatgagctcctgcccatggagaagtaaaaaaaggcgaatacttcaaatcatgggacgattcatgaggaaaatcatcactaatgattacgatgtttacattggtcttctctaagagacaagatgccactgcaagaccaaggataccacttccgactacacaaaccgttgccatgatttcttgttctcttcggtcgattagatgagtagtattctttttatcttctgacaggtagttcttctcgaagtagcgacaccgcatggagcatccggaatctcatctgtaaaccgaatgaaaaaaaaaaaaaaaaaaaaaactggaacgaatcaatctctgttagaataaggcagcaatggatcagaaaatcaatactctgattttggacgcatctccattgatcactcaacctgctgctcagctgatgcaatatgcagaaaatttcttcacgacacccggtgttttccttgagttaaaagacgataacgttaagaaacaacttttcatatggggagataaattgaggattaggcatccaaaatcaacattcataaagaaagttcaagattttgctaggctcactggtgatcttgctgtcctcagtacgaatgaccttcatgtgatcgcccttgcgtacgagcttgaatcggagctgaatagcgggaagagtttgaggagtttcccaggagagcgggtatcttttcaaaatgatgcaattaaagagaaaccgaaaaataaaactgatttattaaaagacgcaaattccgacactgcaaagttgaatgaagaagcttcaaagaaggagattgttcacccagaatcatcagtccctgacattgacgacgaaaacacttcaaaagcaaactcctcaaacgagtcggatgaaaacaaaagtgacgatggatttattgtagtcaaaccaaagagaaatcccaaaagtgggcgtaaaacggaaaaggcggccaatccagaaaaagaaaagatcatagagaccaccacgccgacaactcaacagactggaaacgaggaagaaaactcttctcgtggacctgacgctgaaaataaagctgaaattcctgacgatcaaagtgatgatgatggtgattggatcaccccagataaccttatgtcagaaatgctgaaagactctgccaaagttcagcagacagctgaaggattggctgatatcaaagtggcaatgtcaaccgctgattttgcatgtcaaaatgttgccctaaggattggtattcacctgatgaactacaccactgggatgagaatcaaacgcgttaattcatacatgtacagatgccatgcatgtttcaagcttgttcctttatctaagaatggattgcccagacatttctgtcccacctgtggtggaaatacgttgaagaagtgctctgtctctgtcaactccaaaactggtgaactgattcctcatttgaaaaagaactatgtttggaacacacgaggtgaaaaatactctctttcttcaccacagtccaaaaatgccagcagaagacaaggaaatgctggttatcaacatgataagctcaaacgtggagatgaagttttgcttttgagagaggaccaaaaagaataccaacaagccatattgaatgagcagcgtcttagacggcagaatgagaaattgcttgaagactgggtcggtggaggatctgctgacaacttcatctctccgttcacaaacacacagcatatcaagcagagcggagtgaagattggtaaaggaaggcgggctaatgcctcaaagaagaagaagtagctaagaacaataaaactattgagaaggaaggaaacggtacaatattaagagaaagtataattgttaattccagaaataattcagttttgagcagagaccattttttataccttcagtggttattttgatataaatgacctcaaaatgttaaaaaagtgggctaataatttagaattgcagattagtcaaacatacctggcctcgtatcaatttttttttcaatcacagaactaaatacttaatgaatcatcctaagatctgaaaaggttttatgaatcactgggcgtataatttgtgatcattgaaacattcggaatcgaataccaaattattatttttgagtggatataattgtcttcagtaaagtactctatgctgtttactgaacttgcattcagtttcacttattacttgatattaaaccaagtggattaatctatgtataaatgctgctaataatttggcaaacgtttcgcttcccgttttaatataatcttaatctatagccacaaactgcaaaattgctttcagtaagcaacgctctttaagaatctgatacgattcttgctcacagctatatatttaaatatgtaaatatatgtatgtatatccatggcctctagtatagcaactgctattaagtggctcaatgaactacttgcccctccccgttctattgcatattctcgcaaaaccaggataaaagtcgtgttacaaacaatgcacataatttatttagccaccttctcaagctttgtgtgttaactacgactccagttcagtgcaaagaaagaagcgtatttagaagtgtgccaacatgtcaggacctgccgcaggagaagactcttctcgagaccgcaaaatttcatttgtggaccaagaagctgtaaaggatgccgcactccataacttgagacaaacttccccccctagtattttaaacaccccaggtcatagtaccaataatgtaacaaataacaataccgatcttgaatcagagaagttgagaagctcattacagtcaagcccgtcaaacatagcaaccaaaaacagtccaaatttggcaacaacaactacttccgcacaaggatctagggcaccatcaaatgaagctcatcctcattttgaatcaattgaagccactctacaccatctggagatagagaaagttatgactcctccccccattatgtcgaaattgaacaaagaagatggcaaacaccatgtccttttcggagtatgtggttccatttcatcgaagaaggtaaaactaattattcatagattagaggagatctacaatgcagatcggatttctattcatctgatattgacagggtcagccgaacgctttatttcaagggaggacttcccctcagatgtcacgatttggcgggataaggatgaatggttaacttggaaggccagaactgatcctgttttacacatagagctgagaagatgggcagatattctagtggttgcacctttgacctcaaatacatttgccaaaatcgctctagggctgtgtgacaatttgttgacaaatgtcattcgtgcttggaacacccagtttccgatattactagcaccatcgcttgtgagctttgcttataattccccagttactcgaagacacttgaaaaccataaaggaagaaatgccttggatagaggttttaaagccaacagagaaagtgatgggaagctttggagaaattggtatgggaggtatgatggactggaatgagatagttgataaagtggttcaaaagttgggtggttaccctgaggacgaaatcccagatcatgatgacgaggaagaagaagaggaggaggaaggagagggtaatggtgatgaagatgatgacgacgatggcaacaacgatggtaacaataatgatagtgacaatgaggacgacgaagaccaaagtgtcgagaagaagctaaccttggccgaagaggatgagcttgcgcgtttaaaggaccagcaacagcgccagtagctaccgtaagattttttctttagaacacatttcggatttttttccgtatgtaccttccctgtgtaccttactttcccgttacaatgtgaatttgctgtcagtagcgtggatttcgcgactagtcaacaataatatacgatacagttgaaccgcgcgcacttttgaccttgcagaaaacgaaaacaaaacttgagggtttgactacacatctcatatcataggctcataaaatcagtttaatacagcttaaaaagaaaagggttctctgatgtcagataaaaccccaccgagaacgccgcgtacacctccagcccaaaggggactgggcatgcaacactccgaatccttaaaccaaccggagaacatcggtggcaagtcacttctctcccctagttcacggtttattaggagacgaagttcaattgacttcataaacaacagcatgacagttcctaaaacacctgatttacggagtggaactgatcaatttgaaggaactccactgaagtctcccagtttctctccaactaagagacgtagtacagatttttaccagttactgagaacccctgagaggcctggacaatcaactcaacagaatagtggagaaggtcaaggattaggagttagagaagatgaatttttatttcatgaccatttcaagtcaccgaagaagaccagccatagagtcactaagaagaaagatgaactgaaagagatatcatccaatctacgcacgcggcttaattatgcgtttcataaagttcaacagaacgatctagatacgtttcgtgatttctacaagtctaattcacaatcattaccaactccactgagttctgcagtttctaccagcacaggtagtttgagacctctccccaagtcacagtcacatccagataaatccaggaagccctcacttaatgaaattgcttccaacaaactgcgggctaatagtacatctggtgaaccatcacaacgaaggcctctggctgttcatccccaatctgaacaagatgctattatgtctctgatgagcctagcatcacccgttaagaagtcatcatcgtcttccttctactacgaaaatgcaattacagatgttgaagacaatgatgatcaggatgacgagaaagtggatacgacccctattaacattgctaacattcggagtagctttggtggtcgaatctcaagaaacaccgagaatactgatgacgctacagatgaagaagaactagatgccggtgaacggtgatagcacttgaaggtattgtagaataagaataaggaaagccacaggttaacaattcaagcccggcaggcccgcaaggcagaaacattatcacagcgtaattattaagcacatccgcttgtattctattaatataagtcaatatttagagccattatttcccgatcaacgagtttgtaagtctttgctttattgtacatgtttaccatatacaagatagcagtgttatcatcgactaattggtaatcaacacctacaattggagcccaatctgttgtccccaaacataactcttgtcgatacgtatacttgctgggtgtttggactagacggaacaaccatccagttccctccattccaacaataatcatgctactcagttccggaataaaacatgaatgttggaacctgtctctcaaatagtttcgtattaaggagctggacctgtttttcaatctgcgatcatcaaactctaacaaaatagtcatcaattctgcagaaccaaagcagaatcctgatggctggaagtggacttcctgtgtagtacttccatctgaaaatacgtcactcaaatgttgttctgcaggtttttctgaatctgaaaagcttaccttatgagctatatggtcgcaaccaccttgtgtgaccggcactccattccattcatctgatgccgggtatcgtttagaggatgatgttggtggtataccaagggagtccactggcttgaaaaactcactggatacaaatgtcagagtccagatcatttcagaaaaaagacaacaggagagaattgaggagtttatccctgatttgaagtttccatgatcaacaggtgaatcttttatcagccgcaaatcgtatatctcattttcgcagtgttggctaacgtctattcgaaaataggcaacttctccctgtacggacccagccattaatctcacctcagtttttgaatcagtagaatttttaatgaaacaaacggttggtatattatttgatagagttgccaaatttccaaagataaatttttcatcaggtaatatcctgaataccgtaacatagtgactattggaagacactgctatcatattatatttcggataaaaatccaaaccccagaccgacctcttgagtctcaactccaagtcagccgcaactttaattatccgtggattgggagctagtttggacaacgcatcagtataatataactttacggttccattatcagacgctattgcaagaacttcctttccattgatctcgccaatgcggcagtaattgatatcgtagggtaggtctggaaagacgctggcgcttgtgtcccattctgcaggaatctctggcacggtgctaatggtagttatccaacggagctgaggtagtcgatatatctggatatgccgcctataggataaaaacaggagagggtgaaccttgcttatggctactagattgttcttgtactctgaattctcattatgggaaactaaactaatctcatctgtgtgttgcagtactattgaatcgttgtagtatctacctggagggcattccatgaattagtgagataacagagttgggtaactagagagaataatagacgtatgcatgattactacacaacggatgtcgcactctttccttagttaaaactatcatccaatcacaagatgcgggctggaaagacttgctcccgaaggataatcttctgcttctatctcccttcctcatatggtttcgcagggctcatgccccttcttccttcgaactgcccgatgaggaagtccttagcctatcaaagaattcgggaccatcatcgatttttagagccttacctgatcgcaatcaggatttcactactcatataaatacatcgctcaaagctccaactttgcttgttcatacaattcttgatattcacaatgtctaccgaaggtcaagtaagttcaatcaaagtaattgtttgggagggaagaagattgttttattgcgaacctttcaatatcttacccgactaaataaccattacagtgaattttttactaactatatagatcatcaaatgtaaggcagctgttgcctgggaggcaggaaaggatctctctattgaggagattgaggttcttcctccaagagcccatgaagttagagtgaaagtggaattcactggtgtatgccacactgatgcttacacgctttctggtgcagatgcagagggaagtttccctgttgtgttcggccatgaaggtgctggtgttgtcgagtcagttggagaaggtgttgagtccgtgaaggttggggattctgtagtgcttctgtacactcctgagtgcagagagtgcaagttctgtctgtctggtaagacgaacctctgtggtaaaatcagagccacccagggtaaaggtttgttaccagacgggacttctcgtttccgttgtaagggcaaggatttgtttcactatatgggatgttcttccttttctcaatacactgtggtggctgacatctcagtggttaaagtccaagacgaagctcctaaggacaagacatgtctgttgggttgtggtgttaccacagggtacggtgctgctatcaacactgctaagatctctaagggtgacaagatcggtgtgtttggtgctggatgtattggattatctgtcatccaaggtgcagtttccaaaggtgcaagcgagattattgtaattgacatcaatgattcaaagaaggcatgggcggaccaatttggtgcaactaagtttgtcaatcctacaaccttaccagaaggtaccaatattgttgactacttgattgatatcactgacggaggctttgactataccttcgactgtaccggtaatgttcaagtaatgagaaatgcacttgaatcttgccacaagggttggggtgagtcgatcatcatcggtgtcgctgctgctggtaaagaaatctctacccgtcctttccagttggttactggcagagtctggagaggatgcgcctttggaggtatcaagggacgtactcaaatgccatctttggttcaggactatcttgatggtaagattaaagttgacgagtttatcacacacagacatgacctggacaacatcaacaaagcatttcatgacatgcatgctggaaactgtattcgtgctgtgattactatgcactaagtacgacgtatgatgaatgaatgagttatgtaaggcccgatctcagctaggacgtttatagacctatgtatatatatgtatgtatacgtatatacctcaaactcattttatggctataggaaggattgttttcatcgttatgtccgaagatacatcaatacagcgtttcttgatttgtaccaaacgctccccaggtagattctccagtctcgctagttaccttcgcggtattgatcgacgctctgtgaaaaaataaaaaaaaaatgtcaatagtatcgaggttggcttcaaaatctccagcgttctgtatcgggttccgtttttgagcttctactttccttatatccatcatacattcctgtgcttgaattcagcagtagaatgtccgatcgatatattgtgttgcatatcaacaccaccgccaatgagagttctcagcagttcaaacgcgacccttcagagattattgagctagcatgggttctgctagatcctggaaccaactttgaaatagttggtaggggaagtgttctggctaaaccattcaacactcctataaccccgctttgtaccagcatgacaactcttacatgggaaagtgtcaagaacgctggttcactcaaggatgcggtagaggagcttagcagatttattgactcaaacttggtcagcaacggcttgtcattcagttttataactctgaatgcctgggatctccgcttgaaattacccaaggagtcgcgtgaaagaagtatagcccttcccgcgtacttggacttacccaagtactttgatcttagaaaagaattctgtagatgggcccaaaaatcatctgcattgactacaaacggtaatcacatgagtttagcttatatggtatctaaacttgaaacagaagctagtttggttttggacgaggatctaagatcaaaagttaattctgctaggcgtgcccatgttgacgcagaactgacagcaaaagtggctgccacactattgaaaagcaacagcggtctgtttcaaaagcctcatgatttgcagcgtgaccttgaacagtttcttaacgaaaaatcaaaagttctgtatatgagtaatctttctacagatactacacagagtgagttagaatcgtggtttactcagtttgggggaaggcccatcgtgttttggactctaaccagcgacagtggatgcccgccgtctacgggggtcagcacttcttccggacaatcttccatttctgggtcagtttcttcaaatgctgccaacttcaggcctacaggatctggttttgctatatgtgccactcatgaggaggcagttgactccttgacaatgaatgggcgaacccttaacgaccgaattattgaagtgcagccatcttcagttcgtgttttggaccgtgctcaagagattttgagcccgtttccttcgtccaaaaacagacctcgacctggtgactggacttgcccttcgtgcgggttttccaacttccaacgacgtactgcatgcttcagatgctcttttccagtttcatctgccatagctgtccaagattcattttaccctgtaactcaaactcacaactccaggccatctagtggctctgtcccattcagggctggggactggaaatgtgccaacgaaaactgctcttaccacaattttgctaagaacatttgttgcctcaaatgtggagctcgtaaaacacaggcgaacaatagttactatggccataatgcaaatcagcaccatgtttctcaggtctctacgaatatgatgaggcttcaatctcatacgccctatgacgaggatccacaccaggcgcaaattcaacctcagcaccagcatcaacatcaaccacaaccaatctcattcaacaagcctagcatgccagattcttcgaaataccaacagactcgtcgatctcccaactatttgcaaggctttaataacaatacaactcacccagtttatgctaaccagaatatagttccagcacccagctctttgcactctgtttcgcatgtcaactctcagggtattccctctagttcattaaacaatcatgcgtactctgtaaatgagagtttttacggaggttcgcaagcaaacaatttaaaacttctatctggatccaacaaaccagcttatattggaattcctcaaaataattcgaaagtagattcgtcaagttttacaagtggttctgatgcagcgttatctaccccagaccttgctgggctctcacacggaattaagaatttgggtttctctcatgaagttcttgaatttgaaggacaataaaccctaatgattattgttcagttgtgttttttttcttgtatttatttagacggcgggtatatcagggattttttagtattttagtcatagtaaggcatttctcaagagttcatatttatggctactaccactttgttgtaggtgtattatgtcttatctccctgttgcctgtctccttttacattatatttatcattttcgcgcatctcatttgacgatagctagctactccagtttactgtttaatgggattttgatacttagtctgtcaacactaccaaacactgctcaaatggctgatgaccccgaccacttcccttataacccgcagagtcagaacttgacagtgttcaaagttcaggttgtcttttgcacaattcttggattgttcatttttttcttcttttgcatgttgcggttcaagtttcctttggtttatggaatcagaccttatcgaaatcagttgataaggaagcttcctaactcactatttggatggtgctacgtgttgcacaaaatcaaagataatgaagtactccaaatatcaggattagactctttcgtgtttttgagatttttcaaagttggaataaagatacttttgactctatcagtttttagtctgttgataatttctcctttcaggtatctaattgaagggtatttgagcgatacctccctgatccatgttataagcgatgaagatgataaacctaaacacaaaggtttcatgtttgtgtattcccttttcacctatgtttttactgggatagttctttattttatgtttgacgaatcagagttgattatcaaagaaaggcaaagatatttggcgtcacaaagtttggttacggacaagaccataaggatcactaatatacctcaacgtttgttaagtgaatttgcactcaaggattatatcgagaaattgggattgggatctgttactcaagtatctattgtttacgattattctcagctaaacaagttgtttgaacgtcgaaaaagcattgttcaaaagcttgaaagagcgtatagcagcaagtttggtcttcgtcgaaggatttattcgaaagataacgtaccttctactgttcttaacacttcttacagtcttctagaattagaaaacactcaagaacctgaagcagttccaaattctaacgggctattttccaggatatttgcaaactctgggacattaaaaagacttaggccttttggtactaaagttgatcctattttctattattctaccgagcttcaaggagttgacaaggagattgaacagctaaggttttcagccaattttcagccgatcaatgctgcttttgtaactttatcatctgtggaagaggcgcagctagcggcccaagctataatatctcccaaaatatttcaaatgacaacttgtttggctccttctcccaatgatgttaactgggataatttccttataaatgctaaaacaaaacttatcagaaaaaatgccattgagctgactgttatactagtgagtgcgctcctggttgttccaactcgatatatcaccagtctactgaaattgtctgccattaagaaaatgtggccaacatttggtcattatcttgagtcacataagtgggttatgacagtggttacaggtattttgcctacatatctttttaccatcatcaacgtgatattgccatacttcatctactatatcactcagtaccaaggaatgatttccaaaggagatatagagctttcagtgatcaagaagaattttctctacgtttttttcaacttgtttttgattttcacggttttcggtacattgtcaagttattggtcgttactaagcgacacaactagaattgcatatctgctggcgacttcgataaaggagatgtcagtcttttatgtaaatctgattcttcttcaaggtttaacgatgttcccctttaaattgctacaggtgggggatatgttcttccttttttggcaatatgttatgtgttacaggttgcaaacgcccagaaactaccgggatcttttctacaaaccggcagttttcgattttggtctaatcttacctcagcatattttcattttcatcataacattaatctattctgtgatatccactcaaattgtgacatcaggcctatgttacttcatattaggctattacacttacaagtatcagttaacttactccatggtacacttacctcattctaccgggaaagcatggaagattattttcaaccgagtagttttgggcttatttttcttccagttgacgatgattggaactttggctttggaatcgaggtacatattagccggtctattgattccacttctcgctattactgctgctttgcagtatgtcttcaacaagtattatgctcctttgacaacgtacatcgccctagaatcgatcactaatccaccaccaccatcggagccagattcttcttctcatagtcccgtgttaacgcctgaaattttaggggaagaagaaccgttgctcagagttccactaagaaagagaaagagtacgattgaagaagagagggaactggaacaaaaatatgtctatccattaattaaagaaccgttggatggaccctggataggattcaatggggatttcattgagtacatacaatatgagacagatggaacgactttgatacccactgtgaaagtaaagaagcatactagagtcgaatatgattaaactagaatatttaaagcttcaagagattacagcataaccacaccaactttacttcgtcttacctcatcaaacttacctgtctccttgtcaattcctccatcgattggaaatgctctatagttgaagaggtaaaaatgcaaataaccatcaccgagcccaaactttaaatcttgtagaaaaagagtattatcctgggacgtcaatgcgttcagaacatcgatttccagtcgcttagctaacacgagaacatcgccaaccagctctatcagcctgtgtttcaaaacttttgtagcttcagcatcatcagaaagtttcttcaagcctgcagtagttgcatagtagaacagataagcaacgttcacggtcttatgaacgttgccctgtaagacaccaaaaggtaagatatagaatgatacgaaatctgtaatctcacctgagtcgttctctacaacaaaactttggatgactttttcattttggttttgcaaattttgttgttccttgtctccaagaagccagtgttctagctcttctgttgtgaaattttgatacaattcatacttcgattgaaaggtatcgaaaagtactttcaccttgcctagatccttagattccaagggcctaagtccaggtagtttagtggacgagccaatggtgtatctggaaatcatctgttccttagtagtattgtgtggtaagcctgaaaagccgcactcgtagagtttgccaaagttaagcgggcggtgtgtgtatcggcacgtcgacactggagtaggaattacaccaccaccagaataaagagcatgccaaatatcacatttgttaacacgcctagtaatctctttgatcaaaattggagccaaacgcttggatctaagttgtttgtgcacacagaggaagttaatctcaacagattcgattttcttctcacggacagacaggttcacggggattgcactgataaaggcgactaactttccagattctttgacacgcacacccacatgccaatctttcttccaacgtggggattttaacgcccattttaggaacctctggctatattggaaccgaagtgaagagtctttgtcttctacgtaatggttacagagaagctcatacaactgatcagcctggtgatcatcttccatatcaacaatcacccattcaaagcttgataacagcggaataggactatcaggaatatcagcaggagtttttcgttcctctatgggtccttcggactgaatcttttcctcaaagctggcaacaggttgtgttctccaaaatttatattcatcctttcttttaggtggaaggctgctggtttcgttcacctgttgacctacttgcaaagactgaagtagttgctgtaatttctgcagggattgctttttgtcatctgacatgattggtgattttgatggtcaccaagcctggatgagaagggagtcaatcttactgaattttcgagaaccctcagatgttggttgaaagtgtttcaggaggggaatcaattatagatctatatgaatctgataggacgagatgcccaacaataatttgtgcgagtagattactaaagaaaacttgaaactggggacctaccagtcaattttataaagcctaaacaatccacgaacctgaaccaggttaatgcttgattacgggatccaccttatcatgtgaccagcaattttttttttcttctcaaattttttttttcagtttaaagagacagtattgtacacttatgatttcgtctacaacatgggttcccagaggcttcccctcggagtttcccgagaaatatgaaatgaacgatgttgagatggagagaattgaagccatggccaatttgaaactgaaagatgcccaggatgagctggccgaaacacagaaagatgattctgatatttcagaaatgaaagccaacatcaacaaatctatagctagcaaactacagtctcaagatgacattgatgatgatctaaaggaatatgatttagaacattacgatgatgacgaaacgtatgaggattctgttgccaatggcctcaaagtctcgatgctacctgggttatcaagtacgggtgcccgttaccacgaagatgagaacaacgcagatggtgacgcatacatcactcttccaacggaacgtgaaattttagaagagaaacaagagttgcaagtataccccacagacaatatgatcctttccaccagaactgaagacgatatctcctttttagatgtttacgtatacgacgacggtgctggagcccctgatggcgctgaagaagaggacggcgacaaattcgatcctgatgtggcccgtggaatgaccagagatcctagtttgtacgtacatcatgatatcatgttaccctcgtttcctctgtgtgtcgaatggttgagttacaagccattcggaccaaatgacaatagcaatgttgccaactttgctgcagttggtactttggatccccagattgaaatctggaacctggactgtgtagacaaggcttttccagacgtgattttgggcgagccagaagagaatagtgttgctggtcttaccaagaagaagactaagaaaaacaagaaaggatctcatgtaactacccatcacactgatgcagttctttctttatctcataacagaagttttagatccgtgctagcttcttgttcagccgactgcacagttaaattgtgggatttgaaccaagctcaatgtgttaggtccatgaataagattcatcagggtaaacagatatcttcctcccaatggagtgaagaaaatgggtccatactattgactggtggttatgatgggtatgtatccttgacagacgtccgaattactgaagagaaatcaatgaccaaaagattcgtggttggatcaggaaatgaagaagtggaaaccgcctgctggggacccgagaaaactgtttatgcgggtaccgatcaaggtaacatctactgtttagatatcagagcagagaagtcgttatggactttacatgcacatgattcaggtatctccaccctggatcgtaatagatttgtggatggcttgctggcgacaggagctatgggagacaaaaacctcaagttgtggaatgttccgacgtcaacgaactcaggaaatccttcgatgattctgagcagagattttggtgtgggtaacgtgctcgcctcatcctttgccccagatgtcgaagtggcaggcttcattacgattggaggtgcttccggatcactacaaatttgggattctctatcaaaccgcacagttagaaagagtttaggtggccagttaaagagcttacaagatcaggccagagaacgagcaatggaattaggtcgcagctctaggatcagtcgtaaatacagaaccgagcacgagcagattatggttcctgatgctggggaagatgacgatgatgaacgactggaagctgcaccagagacagagcaagtcgaagttgatgacgagtttgtatgataatagtaatagaaaactgagcctattagaaaaaaaaaaaaaaaaaaaccatagtcaggtgacacaacagccgaagctcgctccgctcctcaaggacatggccggcgacgtgctgctgcatctttaagatgcaatcgagggttctctctttgccaatgacaaaacgtattactgctattggctggggtaaaaaccctgataagaaatctcttcgcgaatttacactatgtcagcctcgattgggaatgtccaattaactgactgatctttatctccagatttgggtctcataatctcatttaaccgattcattcgtcgtccaaactctattctcctagaaaaactcttccttctcttttctgtaaagcaaaataaaaatctagatcttgaatttacaggatatattatggaacaagagccagagtacaccccatactcctatgatgaagttccaggaaacagaacctgggcacacactttgcccaaacctggtttaagtacgttgtacaaccaagagtatgaaaaagatgcttgtggggtaggttttgcctgccacattaagggtgttccttctcacaagatagtctctgattccagctacttgctttgcaatatggcacaccgtggagcagtcggttccgatgctagagacggagacggagctggtgtcatgacttctattccacacaagttcatggaacgtgagttccaatatcactgtggggttaaaattcctcgattgggagagtatgccgtaggtaacgtcttcttcaagaatgatgaccaggaagtcatcaaccgttctaaggccacttttaccaacattgccaaatctttggggctgagggtgcttggttggagaaatgtccctcatgactcatccattttgggtcctgcatctctatcccgtgagccattcattcaacagccttgtattgtcttggaagaagcctacggtgaaggcgactctccagctgagtactcagaggctgagtttgaggaaaaatttcaaactagatttgaaaaacaattatttattttgcgtaagcagtccactcataccattggtattcataactggtactatatttgttcattgtccaacaagaatatagtgtacaagggacagcttactcctgcccaggtatttaactactatcatgatttggtcaatgtggagtacgaatcccattttgctctggtgcactcccgtttctctacaaacacttttccatcttgggatagggctcaacctttgcgttgggctgcccataatggtgagatcaatacattgagaggtaataagaactggatgagagctcgtgaaggtgttatgtcaagtaccacttttgaagacgacgagcttgataagctttaccctataattgaagagggtggatctgactccggtgcttttgataatgtactggagctactgatgattaacggagtcctttctcttcccgaggccgttatgctactaatccccgaagcttggcagaacaatgctaacatgcctcctaagatgcgtgctttctatgagtgggctgcttgcttaatggagccttgggatggacctgctttgtttacttttgcggacggtcgttattgtggggccaatctggatagaaatggattacggccatgtcgattctacgtcaccgatgacgatcttatgatttgtggttccgaggttggtgtcattccaaatattgatcccgctaagatcattcagaaaggtcgtttgcgtcctggtagaatgcttttggttgataccaaggagggaagaattgtagatgatagagaattgaaaagcaaagttgcatccagatttgacttcaagtcttgggtacttgctaatcaaatctctatacctgaactgatttccaaacttgaggtaagggacatctctctagcccaagatctgcctgaagatgctggtaatattgacaccgatcccagactgaaagcgtttggatactccttggaacaaataaacttaattattggacctatgggtgccagtggaaaggaagcacttggttctatgggtaacgacactgctcttgcttgtatttccgagaaaccgaaactaacctatgaatatttccgtcaattgtttgcgcaggtcacaaaccctcccattgatcccatcagggaatcgattgtgatgtccttagaatgcccagtaggacctcaaggtaatatattggagatgaaacctcaacagtgtaatagattgttgctgaagtctcctatcctgaccaacagacagtttaaggcactcacagagatcagcaacgtttatcctcagtggaaaatctcgactatcgatatcacgtttgacaaggaggaaggattgttgggatacacgaatgctatatcccgtatttgtcaacaagctctgctggctatctcggagaattcgtccataattatcctatccgatagaaacatttcccaaggtaaccgcattccgctttcggctttagtttctgttggtgccgttcatcatcatctggtaagacagaagcaaagatctaaggttgcaattattgttgaaactggtgaagctcgtgaggttcatcatatgtgtaccttggttggttatggttgtgatggtatcaatccatatcttgctatggaaacacttcttaatatgaacaagcgtaaattgctgcgaagtcccaaaggagagcttactgatgatcaggtaatcaacaactacaagtcctcaatcaacagtggtatcctaaaggtaatgtcgaaaatgggtatttccactctggcctcctacaagggagcccaaatttttgaaattctcggtatggataactcgattgtcgatagatgctttgctggaaccgcctcgcgtattaagggtgtgacatttgagtatctcgctcaagatgcatttactttacatgatcagggttttacaccagaaaagttcaatccagaatccgtaagaaaggaaggtctccccgagactggtgagtatcactggcgtgatggtggagaagctcatatcaatgatcctgcagctattgctagtattcaggatgctgtccgtaataagaacgagaaagcatatgaggcttatagtaagaaggaatacgaggcaatcaagaattgtactctccgtggtttgttagattttgattttgatcattccaccccagttcctatcgaccaggttgagccttggactgaaattgttcgcagatttgcaacgggagccatgtcctatggttctatatcaatggagtctcactcaacacttgcggtcgccatgaacagattaggtggtaagtctaatacaggtgagggtggtgaagacaaggagaggtcccatatcaccgagaatggtgacaccatgagatccgccatcaaacaaattgcttcgggaagatttggtgtcactgcacactatctagctgatgctgatgaacttcaaatcaagatggctcaaggtgctaaacctggtgaaggtggtgagttaccaggccacaaggtatctaaggagattgccagaactcgtcactctacacctggtgttggtctcatttcgcctcctcctcatcatgacatttattccatcgaagatttgaagcaacttatctacgatctaaaatgtagtaaccctagagctcgtatctctgtcaaattggtttccgaagttggtgtcggtatcattgctgcaggtgttgctaaagctaaggccgaacatattttaatcagtggtcatgacggtggaactggtgcttcacgttggactggtatcaagtatgctggacttccatgggaactaggtttggcagaaacccaccaaacgttagttttgaatgacctgcgtggccgtgttgttgtgcaaacagatggtcaactcaaaacaggtagggatatcgcaattgcttgtctgctgggagctgaagaatggggttttgccactgctcctcttattgcaatgggctgtattatgatgagaaagtgtcatttgaatacctgtccagtaggtatcgctactcaagacccagagcttcgttccaagtttgagggtacacctgaacatgtcattaatttcttctactatcttgccaatgagttgagacaaatcatggcaaaactcggattccgtaccattaacgaaatggtgggtagagccgaaaaactgtttgttcgtgaagagttcatgaataccaagaatgttaatattgacttgtcgccaattttgacccctgctcacagtattcgtcctggtgtagcaacccgttgtgtccgtaaacaagactacaagcttcacatgaggctggacaataaacttattgatgaggcagaagttactctagagaatggccttcctgttactattgtttgtgacatcaccaataccgatcgtgcttttggatcaactttgtcctaccgtatctcaaagaaatttggtgaggaaggtctccctcatgatactgtccacgttaatgtcacaggaaatgccgggcagtcctttggtgcgtatcttgcccctggtgtgaccttggaattagaaggtgactgtaatgattatgttggaaaagggctctccggcggtcgcatcatcgtttaccctcctaagtccagtgttttcaaggctgaagagaacatgattgttggtaatacatgtctttatggagccacttccggagcagtatttatcagcggtattgcggctgaaagatttgctgttcgtaattcaggtgctactgcagttgttgaaggagctggtgatcattgttgtgagtatatgacaggtggtcgggtcgttgtgctgggtagcacaggtatcaattttgcagctggtatgtctggtggtattgcttatgtgttagacatggctcaagaatttgaggatacaaaagtgaacaaggagatggttgaactttcgtctttgactgaccccagtgagattgctttcctgcgtggattaatcgaggaccaccgccattacactggttctggactcgctaataatatattgcaggactttaaccgaattctgcctcgctttgtgaaggtattgccttacgagtataagaatgtcttggagaaggaaaagaaggaacttgaaaaggtgaagcaagataaagttcagaatttcttcgaaaaactcaagcaagaccccgaagctgatgttacaaacggagaaattcttcgtaacaagaagtcaagttgtaagaaggcagaacctaaaatcactgatttagaagatgccattctcaacgtaaaatccgaggaaaagaaattagtgaagctagataaactgaagggtttcatgaagtacaagcgacttaatgaaccctaccgcagtgcaaagactaggaccaaagactggaatgagctttccacaaggttgaccaaagatgaattgaaacaacagactgcaagatgtatggactgtggtgttcccttctgtaccagtgacactggatgccccatctcaaacattattcctcaatggaatgaacttgttttccgtgatcaatggtatgaagctttgcagagacttttgatgaccaacaacttccctgaatttacttcaaaggtatgccctgcaccttgtgagggtgcctgtgtggttaatctcactggagctgaagccgtcggtataaagtctgtggaagctggtataattgactacggattcaaacaaggttggattaaacctcagcctcctaagattcgcaccggtaagactattgccatcattggttccggtcctgctggtttagcagctgctgatcagctgaataaagctggtcactctgccacaatctacgaacgtgctgaccgtccaggtggtctcttaatgtatggtattcccaacatgaagctggacaaaggaattgttaagcgtcgtactgatttgatggccgctgagggcgtcgaatttaagtgcaatgttaatgttggagaagatatcacacttgaagagctggaaagagactatgatgctgtcgtggtagccattggttccaccataccaagagatctaaagattccagggcgtgaactgaataatattaaatttgctatggagctattaaaatggaatacgcaagcacttcttgatgattacttagacaatgttcgtgatgaacttgaaggtaagcatgtggttgttataggaggtggtgacacaggtaatgactgtttgggaactgcaactaggcatggggcaaagagtgtgactaactttgaattactgccacatcccccagaaaccagatccagggagaacccatggcctcagtggcctagggtattccgtgtcgactatggacacagtgaagttgctactcattatggtaaagatccacgtcaatactctatcctcagtaaatcatttgagggcgatgatgagggtaacgtaaaaggtatcaatactgtcagagttgaatggaaacagtccgatagtggagcatggcaaatggctgaagttcctggatctgaggatttcttcccagctgacgttgttcttttgtctatgggtttcatgggtcctgaactagacaagagcggattaggttccgcccaaggtcttcacagagacaagcgtggtaacatatccactatttccacctctggatacagagtatccaataaggtatttgttgctggtgactgtcgccgtggtcagtctttgattgtctggggtattcaagaaggacgtcaatgtgccagagaagtggataacatcctcaacaaaggagaaagtattcttccaggcaacggatccatcgagcttcgtaacttcaagaaacttgaggaacttgcagccaaggcctaattaaataaaaaagaaaatttgaaaccgaaaaaatgaggtcctctaattttaaatattctacgtactgattttgttgttattatttgcccaatgtatgattgattattgtattatctagagtaaaaaaacacagaactaactaaagagctttttgatcttacggaagaaaccatttccattacgaggtttggcgtcttcagaagtttcctctctatcttctaatcctcttgactgtgacgccgttaagacgttaccataaccacctctaccaacagcaacatgctgttgttgctcactcatcttctttgagtgaacaggagcaatgcccatttcttcgtccaggtgtgccatttcccctatatccttcttgttctgcatgtttccgaatccaccacgcccagtgctgtaaatcggagacagttcattctcattggtagagatgcgagacctctggggttcgagctttggagaaggcagggactctcctttccccatgttacctgcacctcctctaccggtggagaaaaatatctcctgcgaatcttggccttccttaggggcctgtggtttggcttcagtcattgttagtgtttgtaaacaaagtaaagcgaaagaaggaaataataaacctagtgaatgactgcctggctaatagattactgataagcgcggtcgtgcgacgccgtcttggcagctcgtgtacattttcgcgaaagagggagtcaggcttttcaaaattttttttctttcatctctgccgtgtcaacacagattcgtgtgtagaacagttatttttcaagtagaattcaagcatccttacacctttaagatttaccccttgtgagctggatagagatatcttgcttcgaaattaaaaaaaaaaaacgtaccaaaaatccctgaatattcacgctagttatgtcttgggacgacgaagattttgatatccctagtaaagttcccgcccagagttgggaggatgaagttgatgatgaaccattattagaatcttgggatacagtagacacacccaaagcgcccgtcaagacctccaccaagactgtttcaaaaaagaaggagaataaggctaaccccacccagaaaaagttggatattgaccttgttgatgacaaaacacgtagggaactgttgaagcaagcggagttggacgctgatttgaacaatgctgcagatctctttgacggattaggtgttgctgatgagcaccccagggcaagagcagcccgtgcagcccttgaggccaacggtggtgttggaaaagcagctctcaccaaagatactccattgagggagcatccgatatttgaactagagaccaagcaggactatgtgaacctccgtaaggcactctccacacaactaacatcttacgctaaagatagcatgttgaattattcttcatctttagcaattgatcttataagagatttgagtaaccctctatcgttggagaacctcagaaaggtcatatccactttgagcgtaatggagaaagagaaaatcaaggttgagcgccaggcacgtttggctaaaagtggtggaacttccacaggaggtgcaggaaaaaagaaggccaaaaacgtgcgtgctaatgttggaggctcgttcagaaaggatgatatggataccactaattatgatgatcttggtgatgacgatttcatgtagaaagataactgcttatataattcaaactcattaatagttcacagttgctcactcattttgttttactgtagtcacatcaatgtttgcagtatacagaatagccctttttgagtgattgacgatctgtaccttttattacgttgttccatttgtcgccaatagaacataaccacccctagagctgagcctaaaatctggtggatgtagagagaaaaaaagtgccagcaggaggatgttgcgttatactatctttacagacacaacgccgaaccaacacagctgatatctgaatctacctctcagcaaagtggtattcaagtgagttactatcaacaaaacagaggaattccttcttcagaattgaacaaaccttaaatgctagtcaaaatgctaaaccacacaaacatctatgcaatgatatgcacagaatataaaaacggttgatttagtccgcggtcttttcgttttcatggctttcagctgtcgctatagagtggtaatcttctcagaaaaagccaccgagacatcattgaaaagaacttttcatggacggagaagtctgagaaggatacttcaaagatgtcgccaaagtatggtaggaattactagaataagcaccattgcaaactagtctctgtatgtcacgttcccacatcgtctgcagaaagagaagagaggtttcaaaagcaactcgcgcacggctatgtatatatatatacagaccgagctttctgatgtattttgccgtttcatattaaccgctgcaaaatatgttgaaatttggaagaatttgtaggtcttttgcccaatattccaaagttagcaacagtgtatcgaaaacaaagccagaaattcctaaactgaaatcattaaatgacaatgcctcccgtaacgacaaggcacttacgacttttcaaggcccatcagccagcggatctggcaataataccatcaaattggggttagccctgactcttggtgttgttataggatcattatcttcggcttattcaatcagtgaaaagcctccaccttttcttttccctaaaagtagtaccactccattgaaaggtataattgctccacaatacgctaatgagaaaactatagaacagtgtcgcactaaacttgagcaagtacttggaaaagagaacgttgttactacagaagagacgatcaagagtcacaatgacacttactggaacagtcatcatcccgagagtacccaatttcccaaatatgtagtttatggtacgtcaacggagcaagtgtccgaaataatgaagatatgtcacgaatactctgtcccaatagtaccatttacaggaggaacatctttggaaggacatttcatatccacaagatcaggaatttctttagatctctctcgtatggacaaagtcttggagctgcataaagaagaccttgatgttgtagtgcagccaggtgtcggatgggagacattggctgactatttagatgattatggacttttgtttggaccagatccaggaccgtcggcctgtattggtggaatggtgggtacttcgtgctctggaactaatgcctccagatacggaacgatgaaagaaaacgttctgaatttgaccgttgtcctcgcagatggaacaatcataaagaccaaacagaggcccactaagtcgtctgcaggttataatttaacaggattattcattggtagtgaaggaacacttggagtcgtcactgaggcaactttaagactgcacgtgaaaccaccttttcaaacagtggcagtggtagcttttcctggaattaggaatgctgccagcactgtagctgatattgttggacgaggtcttcaagtggatgcaatggaattagttgatgacaacatgatgaggtacataaacgccagtggtgagactacacagaagtacaacgaagttccaaccttatttttcaagcttggaggtcctacgaaaaatgctgtagatgacttaaaaaagacagtgaaagatatcgcagaccactacggcgcagttaaaatgcactatgcctcagaggaggacgagaaattggaattatggaacgctagaaaggtagctttgtggtcgacaatcaactatggtcgagagagcatttccccagatatccaggtttggaccaccgatgtagcggttcctatttccaggttgcccgatgttctacttgaaactaagaaagatatagactcttccggccttccatcctcaatggttggccatgctggggatggaaacttccatgtatttttgctttacaagaaggatcaacacgaaagagctgctcggatagttgatagaatggtccaaagagctatagctatgggtggaacatgtacaggtgaacatggagtagggtacgggaaaaggggtttccttttagaggaagatggccacgacacagtagatttaatgcgcaagatcaagtttgctattgatcctaagcgtatactcaatcctgataagatattctcgattgatcccaacgatgatcctttaaatcctttagtacatagctagttagatcttcaaagtattagaatgccgaccaactaactcacttgggcgcaagatctaacttgaaccgccgcgcaaaattttttggctctccctacccgcttgtcggctgcagacccccaaaagggaagatttatgtgagatctggggtaaattagtatttcgccttggccagtgttggatactataaaatcttccaacaaagatgatagatcttttgatttaggggtctatagagcttgatatgactacagaatcagagctaccgcctgtccgctaccaacctttctccagtaagtaccctgcttcgtcaaactcaaatacaatgaaagatcatgataagactcttgttctccatggatcccagatgaacattacagggaaaaaaatagagattgatggaatggttcttaatgacacttcacattttattactaatggccagcttaaaggcgttttccctaacgtgcgcactctccgatgcgacttgattttcgaagtccagcaaatggacaacttgatcatgcccaatttgacatctttggaaattgaagtggcacccaagcttaagagtttaccgtccaactgtggaacgttgcgtaatttgaggcttagtgccgtgggactagaaacattggtaggcttccacagcgagtcccttgtcagattggaggtaaaaggatgtccgcagctagaggatattgatggattttttccctcactggaggaattgagcatatcccattctgatttcctttcttatatccctctaaagtgttcttcaaacttgaaaacgttttgcatcaaagggtgtcgaagtatcactacactacaaggccactatccagaactagaatacttagatctggaagagtccaaagtattagagcccaatattcaagcacccaagttgcaacaattcaatcttaactggaacactaccaagatttctaccaaatattacagattgtttcaacatgtgaaggtatttcaatttcccaagaacggcaaactgaactcatccataatatctgctatcctagaaatgggttacctgacagagttggaaactgtggacacaggttcatcaaagatgggacacgatagagagcagctggagctttttcagatcaatatgctgaatgacaagtccgatcgaaaagggaatcgagatgttcaccattccagaactgacagcaataaagatacagaacttcgtgagtttgtacgtgacatgtttatttagttgataccattaatttattcgtaattagaaatctaaaattagacttcctgatatttgactcaggtgattgacatccagtatcccaccatttgaatcggtattttctatgggttgatcttcgacattttctagtttgatgttgtatttggaacgaacttgcccatttcgatctctcctcacttcatccgccctaatgaccgcttcttttgtgaaaatcttaagatactcaatggagagttccaaagtcttggaagatattcttgtatctggttcttcaaacgctacggtatgaaacaaccttgcaagcgtagtctttgataggccgtcattccccatgattgtgatgagaaagaaagcaggcaagctaaaatacttgcctagatactttcgcgtagcgtgttcagaagtagaattgcatgcacttccaattcacacttctggtatattcatgcacgagaagccaaagctaagctgacccgatatttgaacgtgaatgggtatgctaaactcttgcaattgggtttctataggtatgataacgtgattgagtgatacctcaggaggagtagttgaaacttgaactcttagattcccttgatcttcatttaaagattgagtctttacttctgcagttgagtctttcgtctgtcccacaagcttttccgttgttgcacccaatttaaacttcgtgtttggaaaatggtattcggtaccgggagaatatgtgattttgacatccattagctctttggaattattgatgaaatgtagaagaaacttatcttgagatctatccagatatacctctggcacgtagtcttgagcggttgaattgaatttagcagtagaagagacatcggctctatgtactatcaaccagcttttgcaaactctgcagtagacgtcattcttacttcgaactcgagcgagaataggcagtttgtttgttccccaagagggatcaccatcttcattttgttttggaagagatcctttaccttcataaaaagctttcagttggtagtagggcgtgtttttgttcaaattgcgaatgattctactcaatggttgtggttggtgtatcgtaccagtgtcaaagctataaccgcattgacaattgaacatgaaagactttccatccttttcagtagaactagtgatcttgagagccccattacatttaggacagttgaaacaatgcttagggcaattgttgcccgtcgttatctgcgaacatctcgagcagaatttaaccttgataacaggctgagtacatctccaacatttgatacgttgacatttggtgcaaaagtagagctgagccaagtcgtaccaattattataatcttcaagccactctccttctctgcaacaactatacttaattggcatcaactcgagacgatgtgctctccttctgaaaaactaggtcagaaaggagagaagcccatcgcgcaagggcagagttagatgctaagtacagaaacatttatcgctgttcaaacaactatcaattcctgacctactatcgtcgctcggcacatgttcatctaccttctatgttgtttcttggcctgcacgatagcagatcagtcatatcagtcacagtactctactttagttaaagaactagcaaacgcggaagagatatctcctgatgatgtgttctctctatattcgaactcgcagcaacaactagtgctggaatcagcattgggtcgttttttgagtactggcctcatcaatgaagtgaaaaataactgcacagccgtcaatgagttaaggaagctctgtgataatgatcacatcgaagcattagagttacttgcagattgtgggatatactataactattcagtctatattccattggctgactctgtgaaatatttggaacgactttcacaattgagggtcaattctgaagatcacttcaagttgggatttttgtacagtattggggatctgaatcaaacttcagccgatcagggtagggctttattacattatcaacactcagccgatttaggaaacgttaaagctatgatggcattaggaacacgctactggcatggaattgatgtcctcaaagatgaaaatttggcaaacttttaccatgtggctgcactctctaagatataccctcaacatgaagaaatggttaatccagtaatgccttttccattggagaattttaacatccgaattccagattttcatggaggtctctattatgaggcttctgagaccccttcttcaatggtcaggtccttagatgatattcatctgtatgaaaattatgagtatacaccagcggatagcgatctgattcagatatattctttaatgatgtcagattttctgggagactacattcatccaaggaattatacttcggcttttgagttggcacagatttgtgtccgaagagcagattatcttttgggcgaatcaccgacggagctcaactcagtcgatgtttggtattatactcgttgccatgctctgctagggaagttgtatttggcaggaaggggtactccacaaaatatggaagctgctgaaaagcatcttattaaggcaactcttccagatatcaagctcccagccacttccaaagcttatggtgtttttgttccattagaaccttctcaagacttaaagtatcttaacgaaacaaagccagttcctccatttaagattcctagagccagtttgagccagttcacagttgattttcaatatggaacaattgacttccccagccgggaaaatctggcaaacgcaactatagtaaatgtcttgaatcgcaattatgcctatctcactaaaccaagtgatgaatatatagtgcgattaggtgcggcaaaggcttgtatgcctttgatagaacctttagcgtccaatggtatgaaattagcactgcaacatttccttttaggaaactacagggcggcacttgttttgtatcttatgtcagcagaacttggcttagaaacagcacagacgtcttctgcttttatgctgtatcagaaaaatgcagatatccatccaatactaaccccactagctttaaaaaactaccaaagagcctttttgcagggaaacatcgatgctggtttatacttagctgatgctttatatgaaaccaaaatccagggcaaagatgcttatttgagtgcctacaaagaagtggccgagacaaatggcgcacagggagcatataaccttgcaaatttatatgaaatgggaaaagatgtaccacaagattttcatttggcgaaaagatattatgatttggctcttcgaaggaaagatcatttccttccaattcaattagcattaatacggctcaagttgaagatgtggtacaacacttactttggctcatttaactctaaagatgaggcatccagagttacgtatcccccaagatttacacaaattggaaacaacgctgatatgtttaccaaaatgacctttttggagtcagcattaaccatgtcttttattataggactagcgactgctgttatttataaactgtttatgactacagcacgatcacaaaaccaagcacagtaacaagcagtttccagttacttcttcttcaataaattgttaattgatgtcgaacttgtgtgccctgatgaaggtttggtgtggccagtgaagtttttactcctaaaaaaactgtttcctgacaatgtctttaacaacttgggtctagatgaaagagtggtatttgagctagatgacgttgtagtgactccgaattctttcaatcggttgtttatctcgttaagctcctcggggcccaaccctcctgtatataatggagcaagatccggtgttgcactatcggaaccaactgcccgaatataattcgggggattactgtcgatagtctggtcctggaatctcggagaggaagtacaagaatccagctctaaagggtatatttctaactctgaatcaacgatatctgtcatccctggagaacccagaggagtcaaactacgcgagagtattggcgagcgtgatgcgggggcagttccttccagcttgggatcgtatacgtggctgtcatatactggaggaggctggtcatttggaggcctgacatgttttctaaactctgcatctccaaacaatttgatctcttcccttggtttgattctaaatcgtcccaacttatccacttgaatagagcgccctgtaacatcattactggttgatatgtatactgtaactggaacagatgctcgtacttcagatgtgaccccatccaaaattagttcaatgcatattttcagtttatgtttcacggttaacagattatctctaacttcgacactttgagttatttcttttaagtttgaaggtatatcaaaagttctcaaaatatcccagcgatcctgccccagatcatcagtagaaacagctatattcttgcggaaaacaactgacgaatctccaaatatttgagcatgagagttctgaagccaaaaatactgttcgagagatatccttatctttccgagctttaactctttcgtgaaaggtatgattaagatctggacagtagcctgcccagcgatgggaataccttttgatggtaaagtaatttggtattgtagtttgtcagcccaattatcctccagaacacattcttgagagagggctagtgatgattgaagttgagttcgaaaaattctcaaatacttataagttgaaatctctttgcctttagccacattcaatactccatgaagtttgtataaaatagatccagatctcaagccctctacagtgtctggaacatttgcagggagagacacttgaaatggtagagcataattcccttgacttagcttaaacaaacatccttgtaccgaactatcgaacggagttgtgtttggagggcaagaagggaagtttatatgctgtccttttttaaaatttattttagtgttgttcctgcctccaataaaatcattagatggtaaatgtgggtcattcaacaaatcgttgagaaaatctgttggatgagcatatctgaattttggtttctggccgtagtcgccactcgtaatagatccatcacttgttgttagtaaatttgcccagtctacctctaagacagtgccattttcctttaccgcagtcgtagctaccaatctgttattgtcatgaagttgttttaaaaagtcaagcttgaaagtacccagaagcttaagacttatcgatttgacaattatatcttctgacaacgaaaagaccagcgaccctgataaaggtgtgggctggttatcattctctaggctactgactagcaaagtatccttgtaaggagactggatgcgaatatcaaacaatgccacagttgggtgactcttaaacatgaatgaatgtgaactttgattggtgtaataaaaacataagaagattaaataagctcttgaccaaaagaagctttcgaacaataagaggaagacaactctaagcagggcaaaaatctacgtgagatctgcattatgctctaatgattacataatatagtacagataagttaacctataggctcgctatgtaagagagtgcttcttcagtagtacgcactcgcctggtttcaaatgatatacataaaggttggttccagagaagacgaccacattgttggaagagtcgatagtagctatagttgtgggacttggtgagggtaattttatgtgggcaaagtccctttggggttcgattagtgatgtaaagttttgttgaacgttggtaggcaatctcgaggagacttgctgaaggtactctttcaaatggtactttcctttctgtgagaatatattagtaactgatgtagactcctcagtagagagctcaccttgttgtggtatcagacgctcttccctgtcagcttcagagccatcttcctctgtcgatgacgagtcaagtttaaagaaatgaatggttccagtatttgaacagcagctgaggtacctattatcgtgactaaatgagagatgctgtatcctaacttgatatgatcctcttctgaattcgtaaagcttgtcgaatggagccgaggtgctaaaaactcgtattagcgtccccttatgagaagtcgttgctagcaaactcccatctttcgataaacaaatttgctgtagctgggctttatgggcttcaataatggtaataaactcacagtttaacgcatcatacaataccacgccaccagagcctcccgtggaaacggtttctccaagttgatgtcgttcgttggaactactagaatctgatgaaggatatgcaagaattgaagagtcatcagcacttaaggaggcaattgccagtctattggggaccgtttcgatagtctttagttgtttcatacaacttatgtcataaataaacaattgatcatacaagacgaccaccagtcgttttctgttcaacttgaccgcaagaattgcagtggaaaagcttaattcacaaataatagtattcctcttagtattaacaatcttcagttttcttgtggaagtgctaggcttgtctccagtgccaactactgcaactagacttgttgaaaagagcatttccataatgctggcaccaccatcatcgttcttagaaaaacactccccaaaaggatcacaattgtacactttgtagcaatctggaaatccaacagcaatacaactattgttctgattgaaagtggctgttaccatcgatatatatgtgggataagagtgataagcggaagaggacatttgtaggatatctgcacacataggtatcgcgcaagctgggtgtaaggatgagtagaggtgttggggcctgatcggtggtgatcaggaggggaaaggaagtgaacggaacatcagcggaagccgcctcctggaccactatattacaagttacggacagaggactatacgaatttcatttgtagcgttgctccaaaagtctcaatcggaacttttgcattggcgtcagcaattcgtgctcctcagatctgatgacagaaccaatggacataaagagtccaaaggtacctgcagatcctgcaatatattgaccaatggttctcatggcaccattaggaccaggaccttgggtaatgacagcaaagccaccaaagagaacacccgtgactaccccgacacaggtctataagttgttagatgaaaaacaatcgtttggctcaaaaaagagaaaaaaacttacgcccatcataagtcccattttaaatttttgaaagttggtctgttcttgaccatactgaatctgctgcactgggggcatattgggttgtgttcttaatgtgaataaaaggttcaagtgtgtgaaaaaaaatggaagtcctaagttgatgatgttaaggatttcaaaaaaatgggcgtgtgcgacccaataacagataatatagtagacttcgtggagaaaggcgactttatagaggaatcattgaagaatggggcttactagaaagagctattgtggattgcctccgactgtagtcttctccctttgtattgaacgatctaagccttcttgtgtggctcacaagtgtttctgtcaacttcggcactagagttcaccccgtcctcatcgcataggcgcgagtcatccatctcggttggtcgtgtgctaacggagaactatctcttttgaacacctaaagcttcgtaaacgtgtatcgtattagttttcaattcagcaatagcatactatggagcaggttccagtcgcaaaatttttgaggacccatcctctgctcaaacaaagaacggggataaactctgctagtggaagcaaagttgactttttcaggtataagagatgcatcagagcattattgagcgacagttatgctaagaaggtctctaagagtaaaggaactctgccagagatcaaggacgactcccaagcacaggctatttttatacaattgatcaaggctgggatgattcttcccgtagataaactctccacacaacaagctcgtgcggagaatttgaaacctgttaaaggtactccatttgtcaaagttactcaaaaggcagttttacagggcgataaatactttatttggaactttcaaccaagcaatcctcttttggctctgtactcagttttaggagttatagcagtttttgccgtcattttgttcccattgtggcccgcttttatgaggaagggagtatggtatcttagtactgggttattgggtttgattggattgttctttttgttagcaattgtgaggttgataatattttgcattaccgttctcatcttgccaaatgcactatggatcttccccaacctgtttgaggatgttggattttttgaaagtttccaacctctgtatggtttttctgttcctaaggaaaagtcgaagaaaaaaagtaagtcaaaaggtaatgggatcaagacaaacggtgacaaaatatctgaaacgactgccggtgaaactaaatctgagtcaacttcaactgaaggaaattctggttccaaaaggaatgagaccgttgctaagaaagtgcctagggccaccatagaagaagtttatgatgaataagagagaatatagaaactgatcaggagaggtacaaatgaaaaaaaggggaaaaaaaatcgcaatcttatttgcttcatgacggccacagagtgctatgtagtaggcatctgtagactaaccacttagatgcgtccgttttattgtgcctgatttacattacttaataggtgttaagtagttttaagttccctcattaattgagacgtcgcgcataacgatctatatcttggagtattcttttacatctctctctatcttgaggcctgatgattcccctaaaagccaaaataggtttagctatcgtagctacctactcaactttcaccatatatatctcactgcgaacgaagtacgagatttataagcgtgaaataggtatcaaagatcttcagaacaagtactcatcgctcacggtgggaggacgattcgaaaatccattttctgagtaccgaggtcagacgctatttgagtttgcattttgtagaatattggaattgtttgaaggtcgaactagaggtgggcttcccaacagtgaacctgaacttcgaaaactcatcccgctagtgagacctgatatggatctgttgaggaacaactccaatggtcatgaaaatgaaagtggaatcaatctaaaagatcagctcaccttcacatggctgggtcaaagttgctcatacgtgcaaatgggtaaggtcggatttctaacggatcctctgtttgaaaattttttagtcaataagacgcttggtccaaaaagaatcactccatcaccggtaacttttgaggagttgccccgtactgattatgttttggtttcacacaaccatcctgatcatcttgaagaatcatcgattcctaaaatcgggaataactcgacctggatagtgccactaggtctccgaaagtatctggcgaaaaagggaattcacagagtagtagaaatggattggtgggaaacatatcaagttgataacgccctgactgtagtgtgccttcctgccatgcattggtctggaagaaagatacttgacactaatcactctttgtggtgttcgtttttagttctgcattcaaataacccagtattttatcacgcgggtgacactggttacacgtcagaacttttcaaagtaatccaagctaaatatggccctgttaaactttgcatgttaccaatagggcagtactgtcccacctggcatcagaagccaaggcatattgatcctaacgaagcttaccagataatgcaagacctgaaggcaagtaaaatgtttggcgttcactggggaacgtttgttttgtccagtgaaccctttttagaaccaaaagagaaactccatgctttggcccagaaactggatagagacaatgatataatgactccggtgtgtggcaaaacatatattttggatatgtcagcttctgaaaataagaacgaagcaagagactatcaagacagtactatacttggctgatttacatgtattctaatttatacagatagaaatagaaaattatttttctgatcttattctttcaatcagatctttgacttcttcctgagccatgctataagtatgtgtcccttcctctgggtatatgtcggaattaagttctcggcagtactcattgataccgtcaattccttcttggtagaagtttttatattgtctaacgaatttggcaggtttattgttgagcattcctaatacgtctccttggacaagaacttgccccgatgtatacttccctgcaccaattcctatagtaggtagattcagttcctcagttatgattttagcaacttcagatggaatagcctccaacactaataatgaaacgcccaaactctgtagatatttagcttgtctaaaaatctctatagcgtctgttgcagtcttaccctgcactctgtaacctcctagggcgttgaacttttgtggttgtagtccaacgtgaccagtcactggtattcctatatctataagcttcttcacttgatctgttatttcataagagccctccagctttatgctttggacttttcccagcttcatcaactttatggcatttcttccgcattcttctgcagatgtttcaaaagttccaaagggcagatctgcaattataaattttctgtcaatggctcgacaagcagctttgcaacagtaatagaactcttcaaaagacatttccaaagtcgactggtagcccaaattgatcatggaaagagaatctcctatgattacggcatctgcctcgctctcattagcgtattttccacttatataatcgtgagctgtgatgacacttataggcttacgatcctgatactttgagtataatgttctcaaagtggactgcctggaaaccttggccttaggatatatgggcacttgagagtaatttcgtatagctcgcttaaataatagtagcatagttaattttcaagcagttgagagaaaaaaatgcgagagatgcaccgttatttacccgaatatagtttgttcgcggacatctctcatgctaatcttgctccaaagatcaaagtcccgagaactcggctcagattttcccatgtgctttcggtaagatggtttactgccaactttaagtttgcccactatcgattattggaataaagtttttgagattattctgattcgaatcgacagggaaaggaatacgttgactcactcagtaccttaaactctgtaagcgccgtagacatactagcaagtacactactagacctagccacagcacgaaccaagaggcgagcctctcagctctgttcaaactttataccccccaataagactacaagatgccctcaattgcccagcattacaagtacctcgtcattggaggtggatcaggaggtgtcgcttcagctagaagagctgccaaacatggtgcaaagacccttttgattgaaggaaaggcactcggaggaacatgcgtcaatgtcggatgtgtccccaagaaggtcatgtggtatgcctctgatctggctggaaagctctcaatcgccaaggactatggatttaatgtggcaggcgatttttcctttaactggaccacactgaaggagaaaagggatgcttacgttaaaagactaaatggaatatacgagagaaacttagagaaggaaggtgtggattatgtatacggttgggcgaagttcaaccccgatggaaaagtggaagttactttacatgatggtaaaaaagcggtttactctgctgaccatatcttaattgctacaggaggtcagaccgccttaccaagcgaggagcaaattactggggtcaagctcggtattgattctgatgggttttttaaattagagaagcagcccaaaagagtggccatagtaggagcaggatatattggaattgaatttgctggtgttttcaatggtttgggttctgaaacccatttgatcattagaggagacactgtgctaagaaagtttgacgatatcatccaagaaactgtaacttcttactatgagaagtctggaatcaatgttcataaacagagtcaggttacaaaggttaccaaaaatgaagatgggtccttagatttacttttgactactggaaagacagttcaagtagatgaattaatctggactattgggagaaagtcattcttgggactaggattagacaatatcggagtcaagctgaatgataaaaatcagatcattgttgacgaataccaaagaacaaatgttcctaatgtctactctcttggagatgtggttggaaatgttgagctcacccctgtcgcaatcgctgctggtagaaaactatctaacagattatttggtggagatcaattcaaagaccagaaaatggattacaacaatgttccctccgttgtattttctcatcctgaatctggatccatcggattgacagagaagcaggctatagagcgatttggcaaaaaccagattaaggtctaccaatccaaatttgtgtccatgttctatgccatgtccgaacacaaatctcccattgcctataagcttattgttcaaggggacaatgagaaagtggttggactccacatcgttggagactcatctgcagagatcttgcaaggttttggagtggccatcaaaatgggagcaacgaaggctgattttgacaactgtgtagctatccatccaaccagtgctgaagaattagtgacaatggtttagtaaatgtttagtttaggtaattgatcagttcaacttattgaatcctaagcactagttcttaacaaaagagggaaagcatcttcttgaccacgaatcaactttccactttattagtccacgatctgaaccaactgctaaatatgacctcccagttctaaagtcttgaaaccattctaatcctgctaattcaattccacaatattgatgggttggtggtaattgcgtctcaagttgtagctctgaactgttaccaaacagtctaccgtcatcagagtagtttgatgactcaaagttgatcatatcatcaaacttttgaacaatgggctcattgtaaagatattcattgtcctgatagtccatagtggcattacgaatagagtttggtaacattatcactaagtggttagtaaaatcacgggtatccaccatatgtattcgcccagagtgttctgttatgaacagcaaatcatctgttcccttagcaaacttgcaacatcgaaatgctccagattgtgtactttctcgtgttgaatatactttgtgtactggtttgttgaggtttctcacatcatagaccaaagcaaccccatcctgaaaacaggctgtaaagtatatacccgaaggatggaaggaggatgatatcccacagtcataaccattatcacattgtaatgtctgagcttggttcgtagattcttcaggatgtagcaggaagaccttgctcgaatcactacagacaaccagtgtctttgcatccggggactcagttgagtgattcaatgggacctccaagttgacaatatagtcttttgttatttctctgtttccatagctcaaagcgtacagatgtctatcattattgcaaagaattgattgatactgattgtttgattttttagtaatcgataccgagttgtttatcaacgagccaacatccatcgtcaacacactatcatttgcacataatccaaattggcccttccaattgttcattgtttggttttttaaaaatctagtactcatgccagttcggggggaatcattaagtgtgccattacgattttgtttggcgacattgagtccaccagcaacaatgataccatcttgctccttaaacgagcgaggagaaaattcaaactggcatgccttctcggagctattgttcttcattggattcttgctctgcatcttcctcttgctgtgatcgtccatattcaaggacatgatgctctcattgctagagtatagcatcatgttcggattcaatgagttacgacatattagatccctaagttgccaatgtctaaaaagatgttagtagataagtgacacaataaactcctaaactactcacatgaccgtaattttgacattgtaaaattttgatttgggaaataaaaaggatggattcttatggacccggtcagctggatatcttctttgcctgataatgttagtaatattcgggtgcagaaacaaatttcagcttctaactcactttaagtcggtatctttggtcattgtcccaccagttttgtttggatgaagagcaacaatgacctcctttgatgataagggattaggcgatcgtggggtaatctagtcaggtgcaacgtcgcgtgattagctgctttgttatattttggtttttttcacaattatcagattacataattcgtactatatcattattgaccctagaagtatatagcccgtagaatgggaagaagaacttgggaaatgtcatctagaaaccttttcaaacaatttaattgtgtaatgcatataggaggttttcaaatgaaaccatccaacgcattaattgcccgctccaatcgatgtgctcctatcgattgcttctctggatcaattaccataccaacacttaatctgctgagcgaatctacagccttttccagtaacagccgttgtttgtgatcaagcccaataccttcaaactcattgccgataataataccatcagttgagcttagaaacttagccaatgtctgcatagagaatggtctctttttgtcagatgacgaagatactgactttcgatgttttcgcttggcttttttgctctgcttacgcttagtagaatgagcgacctgttgaacgatagtcgtttcctcgtgccctttatcggcatcttcgatatctgtgtaatcttcatcattttcatcttcgtacagctcttccttaggagttgtgggttcttcttgtgaggattgatctgaagaaactggtttcttcgatagatctacagaagaagtgccggagtttgcagtgtgaaatgaaaacatttctgctgctgaaaaactcgagttgttattatctgcaataagcggcttgataggagcaaatcctaggttatcgttttgaaaatcttgtaattctttcataatcttatccaagtcctcggttttacgtttgagcggagacgaaggtgttgtagaggaggttttagacgaagtggaatgcgttgaaaaccgttttgatgtttggtcatctatattcaatgaacttctcttacccaataaatcgagtctctggttttctgttagatggatgcggacataatctggagacaaactttcagacttaggtcgcttatgagaacgaggaggaatggtagggtcaatattcaatactgagaccctttcaggtgacaagttttcttcctttgtaatggttgtcaaaatacccagtccggaaacttttgaagattcagctgactctagtgaggccaaagattctttcttcgggcaatgagactttatagtttcattggagtggtcagttgaagctgctacttgatttttggcagcatcggaaacattttctggttccaatttggagactgttgctgttgttttctcttcactagcaccctggcttgtggaatcgacaatatactggatttggtccacttcattgaccactcccgaatattgggatataaatgataatctgttattggcagtaggctgatcgctagtgttgctagactctgaatgtctatacttggagggagaagaaggaattggaggaggcgaaaaaactacagctttgtctggcatcttgccaagaggggatgaagaatcggactcatggcgtatttcactcaaattgtattcaaaacgactctttttgagaggtgttaattgatcatctgccttaggttcttgggtgctgctttgatcgcttatcctttgacttggcctggatcttataggactttccagctgggcttgacttttcctagtttcataatgtgacgaggagaaggaatgatcttctgaatgacagtcacttccactatcgtggttactcatattcaaagagacgaagagaaagaaaagaagtaaatgaactagttggggtattcgactatgatataatgtttacttttgtctacatgaggcaatttctgattatggataaatgcatgtgccatctgacatcgcgtttgcagctagttgattgagaaatttctagaagtcgcgacatcaagcgtatatatatgaagccaaacgcggtgagcaaatggtagctctggctcctacaaatgcctatcgaaactctaagatatgaccatacaatgcatgggaccaggagttctgatctaatgaacgctcgtaaacggaaaagtgcttttcaagatgagcattgtatgaagaagcgtgtgattgacatcttcagctcacttaatattgacgataaggcccccagcagttttgaaggacaagcgaaccgtagaccgaacggaagtccggaatttctgtatgataggagcagcaacgtatatgacaatggagaaaaggttgttattagagacattgatcagtttctcagggacaatcccgatgaatctatttcacaatatcaaaagatcaagccagaccaaaaggtagaggccggcaaactatacattccaaaggtcgaactgaatgaaattttcaatgaagcctcccagaaatgtaaccaaaaatttctagacgccaaaaaaagagaaatcgaagaaaaaatatatgctcaaagattgagacgaaacctttattcacaggacccagatggaatggtcgacgaggaaccgattgaaatcagcaaggaagagctctattatgaattgtaccttgccagattttggtctcttttaaaatacaaacacagatataacgtcatactcgatcattataaggcttggtgtaagcgtgagaagatgagaaacgatgccataagaaacaataggcaacataaatacaaagacgatcatattcatgatatcaatgaagatgatatgtttgatgagtctgacgttataaggcctactggaatcgttttagaggaagacgatgaagttcctctgcagagacctcagcaagaaatagagtgtggagatcaaatggaaatagatatggaattatgattccagctgtaagtttagcctggtgctactatcctctgtgtattataattgtattatcattttgcttctggtatcgtagtttcttctgtttggagaaggtattgaggtttatcatcatcacctcctattcgagtaagcttaatcagaaattcattcaagtgtgaagtgtcgatatggttgaactctgctgaaattttacccagcatcttctccccttccttagctagtgcactaagcttctctttggcatactggaaactgccagtttgttccatataagtaagtgcaaaccttttcaatttctcatcatttgtcctgagttttaatatgcttaatagccctgtatcgtcactgttttgaatagaatgaataattggaaacgagaacttaccctctgtgatgtcttcgcagaagcctttattttgattatactggtcactcttaaggttcaaataatcatcccgtatttggtatactatacctaaaagattagcaaaatggactaaagaagaagcctttctttccactccatcgtttgggttctgaacaagctccatcaaacggacggtaagcctaaagagacctccggttttgttcatcaccatgtccaaatactgctcttcactaggacaaacaaaattgtctcgccaataaagatccaagccctgtcctcggtgcagattcatcatttcttctatcagaacgtcattcacccttgcatggttgcccaaagtaccagccttttggatggcaacaaaatacatgtagtttgcagtgtttatcgtctgaggaatcccaaaaacattatgcgtagctggtatccctcttcttaaagtagcactgtcctctacatcatccaccatcagcgaagagttatggagtatatcaatgacctgctcaatactctccacagattgatgatccacttctaaaaattcgttgaatagatcaattagaattctacgaaaatgctttccagggaccttcttgatgtacttgtagggttctgtaattaacttctccatttcgtcactccatttaggatcgtgggaccactgtttagacattagatgaggtgatcacaagaccgatgagatcaataaattcgcatttgtaatagcgaggctcgaaaattagactctatagagaaacagaagcaagaaaaaaaatactcagtagcttgcaaacttagcatcaaatcaaatcatcatcatggtttgcacaatactatgtattggaatggctggttcgggaaagaccacttttatgcaaagactgaattctcatttgcattctaagaatagccctccttacgtgatcaacctagatccagcagttcttaaggttcctttcggtgccaatattgatatcagagacagtgtcaactataaaaaggtaatgcacgaatacaacctaggtccgaacggggctattgtcacatcactgaacttattttccacaaaaattgatcaagttataaagttggttgagaaacggtctgacaaatttcaacattgtatcgtagacactccaggacagattgaatgctttgtgtggtcagcctcaggtgccatcataaccgaagcttttgcctctacttttcccacagtgattgcatatatcattgatactccaagaaacacatctccaactacgttcatgtctaacatgctatatgcctgtagtattctttacaagactaaattacccatgataatcgtcttcaacaagacggatgtcaaaaagagtgactttgcagaagaatggatgactgactttgaggcttttcaggaagccttagcttccgatcaagagttgaacgatgaatctcaagggtcgggatatatgagcagcttggttaatagcatgtccctcatgctggaagaattctattcgacgttggatgttgccagtgtgtcatcatatactggtaccggatttgacgactttttggaaactattgacaaaaaggttgatgaatacaatgaattttacaagactgaacgagataatatattgaaagaaaaggagaagcaagatgctttaaagaaggaaaagagtctgaatcatttgatgaaggacctaggtttgagcaaagacaagaaaaacagtaataaagaagaagtcgaggttgtttcggaccttgaagatgaactagaagttggagaggatgacgaggccgaagggttgcaagaaccagatagagagtacacatttgcggaagacagaaatggtgatttcctggatgaagatattcaaaaaagataccaagatgctttggatgctacgtcaaagacctcatctagtgcaactgcggagaacattgcgaagtatattagaggaagtcaaggataaacacttgcgtaatgcaagctattcatttgtttctattgcaaaaataaactatcgatgttgaaactctcaacataatcatctttgaaaatcaaatgtggtttcctgcttgctagatctaaaatagtctttccgaactctgaattgcaccaagagaaccacggtctagtataaagagccccctttggtgtgtaaatgtttatgctttcatgcataagcccaagccctgcagttgttgacttgactaactccaggtactttgtaattatttggtcgtcatctgtagtccttatagccatcaatagagacattggccaggcattttgcaacccgatatgcggtcctccaactccttcaaaaaattggcttttaagaaagtatgggttggatttagagaggatcatttgtcttgtgttgttatatattggatcatcgatttccaaaaagcctagctcaggaagtgagagaagtgaaggaatattggcatcatccatgaaaagagccgaaccatatccatctatttcgtaggcatatatttttccatgtcttgggtgatcaaatattgcattatttttgattccaatcttcatcgattcggagaactgatgtgccgcatctacgaacactgtaatctgagccgtggagccttgtttgctcttcagtagataactgatcttggatagttcaacagccatgtgtgcattggccggaattaaaaattggaatatagtgctgtcgtcagatggtctaaatgctgaacgaacaagccccgtgccaccgtttattgggttacctgttcctgctagaggtaatgtctctgagcctatacgagtgtctctttggaacttgtagtagaatggtagaagagtaccggtgtcagggttgaatgttggcgaagactgtttctgcaacacaattagtatgacttcaaatgcacgaagccatacttcattgacaaaactggaatcaccagtgttctcgtaatattcgttactaagcgtcaaaaacgaagccaatgagtccagttcccatttacattcaaatgcgacataatagtttggacgaggactgacaaaatctacggcacttggctttctttgaacttttgatttcttgggcggttggaaagcattacagtaaggctgggttgaaataaacaatgcctgctgattaattgcacctttcataagtaattgcaattgtctgtcatgcttaacaaaaggctggtaaacactcagctgtctagcagcatctcgtaaccattcggcatggatatcaccagtgacaataaacgaacgcaggtcgttatcatcctcaaaatcagtccataatatcgtcgtatccaaggtgtttggtaggcagttttccagtaaacgaaacaaatctggatctttgaaccggggttccaaggcctcaagggtcttttcaacagccacagacttaaacgttcgacaatcttcaggtggcctcatgtatggcaacttcaatgggccttcactgaaaggctcatgcctctcctcagagtattctaaatattcagggcatttggaattaaaccaatgatggtgtttattcttaggaggctcagggacaacatcttcaacatcgctactaaaaatgtctacctgctcattcgcatcctcccgattaatacttcttagatagaaaaataatgacagtgcaagaataatggccagcattacttttgtctgcctaaatcttctattcaatgtgtagtatttcatcaatgcaaagaactaacagaaggtaaagaggagggaggacagataatacggctgaaatgttagcagtaaccgcgaacgtaaataattagagagatatgatacattaaagctgtgacgcgtgatgcaatgtaatgacggaaattagtgagagcgttggtgaggtcaatgcggtgactctcttatctggtaacaaaaagtaaaccttcctcaccttttttcacattcaaaaggcctagctctcccaatcgttgaagagagtgctccatttcatcctgtttaatgtgtgatcttctggcaatgctcaatagtttggtatattgatcgtcctcagcggcagtagatcccatagactcttgtattcttttcagcgatattgccagatcatggttcgtataggtgcctctgttcaacatggataaccgaacagccaaaagtgaaagcttgttcgaaaacttctcaagaatttccaacaatgtgtcaaaactggacagtccaagatccccgaccccgatgacaaacgagggcaaataggtaaaatgatccttgccaggagtttttacgccttttgtggtgtcgacgtccttaccaagaatttccgatattgataaaccttcattggtgggcttcttgggtgacgtactattcataaagtatcccaagtccctttccagacgagtctcaaacctgatctgctcaaacaaaactagtctcaaattagggtcaataaattccagtataagagggttgattttctggttgtattgacggttttcctgttgtaacttatcatttagttcaaaccacatattatcccttagcttaagattcccttcattccatctgagtagcaatagcatcgggaattgggacaagtgctttatcatgtattcaagctcatttttcctagatcgtcgcaataatttctcacgaagcagcttgtcaacttgccccattagtcgacagatgccgtacctggtaataataggttggaacaggttcatttcagtgtagtgcaacaaccgtaccgagaatgtacgtagtaattgaagccacatacaaacaaactctagggctcagggacgacgaaggaatttcacaacataactgattgctgcatttagtcacattctctgcctgaatgcgtactatgtgaaaatctcctatcatcgaatacgcatttcagacttcagaaataggacataattccataattcctctataatgtagtagtcgcggaatattgtacaacggttttcatgcataaattgccttcaacaatatacaaccaacagatggctggctctacgatgcaagaaactactaggtcattgctgacccaatacggtaatctgcaagatgtgaaataggtttgaccagaagcaactaccctgttccctaaagagccatatgtttagcctcaacggttcaacaaaaaaccagccactcctccttccagtctcaatctagtaatcactgtttactattcaagaagtcaagaggtaaaatttgaggtaaacatgcgcaatgagtttgactaaaggtaccaattagttcaaggtaccaattgctccgaggcctccgtggcattgagtatatatagaggatactttaccacgtatactactcgtgtttcaaacatttgagtcctattgttaacgcgactctgttaccattgcaacaaggcattaaaggcattccaatacttgactcctgtttgacaaaatacaaatataaagtgaaacattgagcactcaatctccagctaaggttccaactaactacattctttaaaaaaccttaccccaactacttacactccttcgtttacccaactcttacgctcattatgaaatttttttactttgcggggttcatatctctgttacagctgatattcgcctttgacaattcagctaaaaacaacgttgctctctattgggggcaaaactctgctggttcccaggagagattgtcttactactgccagagtgactctgtcgatatagtgttactgtctttcctctacattttccccgctaacccacttggattggacttttccaatgcctgtggagaccaatttcccagcggacttttgaaatgtgataccattgctgaagacattcaaacttgtcagtcactgggcaaaaaagttcttctttctctaggtggtgcaacaggaacctatggtttctcctctgattccgaagctgaagactttgctgaggtcttgtgggacactttcttgggtggttctacagatgaaagaccattcggtgattccattctggatggtattgactatgacgcggaaaacaacaatcctactggatacacagctcttagtgctaaacttagagagttctatgcatcagatccatcgcgtacctattacattgcagcagctccccagtgtccttaccctgatgctagtgttggcgatgtgttggccaatgctgatgttgactttgtctttatccagttttacaacaattactgcgctttggcaagtaccagcttcaactgggctacttggctcgattacgcacagaatacctcaccaaatccgaatgttaaactgtatgtcggtttacctggtggccctactggtgcatcctctggatatgtcggaactgatgtcgtcaaacaaagaattgatgagattggtgctagcagtagtttaggtggcatcatgttatgggacgcttctcaaggattttcaaatcaagttgacggaggaaactacgtggatgcaatgaagagtattctaaatggtttagggtctgtcgatgcatctaccacttctagttctcaagctgctgctacgtcgcagactacttcaactttggctacatccatctcgtccactccaggatcctcatcaactgtgtcttcatcctcatccttatcctcatcatcctccccctcatcttcatcatcctctaccacgatttggtggacccctgataccccccaaagttcttcatccagtgttgctgcagtgtcttcagagacttcctcagttttgacatcttctgtttccaccacgcagaattcacatggtgaagttgattccgaaggaacaactttgactggcacttcgacaatctggtggactccatccgaagctcagtcgtatgaaacaagctcgttgtcgtctgtctcatccattcctactggaaataaagatgtcagttcaatcttagtgatcactgatgtcactgattctttaacctccacgaaggaaagttcggattctgctttaactatttctacttcactctcttcatcaccctcccttgctgacagtagcagggatggagaaacatctacagtggtccaggtaactagttcgacaacaacagtagtcggaggaaacactggcaacactgctagccctagctcaacggcttcaggtctttcaagcttcgttttcgatccaaccacattgtctacaaagatcacttcttccgaattagtcgtatcttctacactagaaaactcgttgggaacaactaaaatcgtgttgacgccggtttctacagtaccatcgtcaacagacttaggaaccacaacagattcatcaccagcaccaacagcatcaactactggaacctacttggattgctcttcgttaagtggcaaagccaaggctgcttgcttgaataagaattttgctaacggtttcttcctttctggtttacaaggttgcaaggatggtgatcatgcttgttcgagcgatggatacttttcagtgtgtgaccacggtcagtgggtattcttcaactgcccagctggaacggcttgctatgcctccaaccaagatgatgaaacatttgttggttgtaacttctctgaattaaaggataagttcacgaaacgaagttggctggaccgtttcttctaaatggtgaatggattaaaactatataataccctgacctcgtttaatccaattatcaatgttatagtgtcaaaaaatatgaatatattctggatctgatttctaccgtttcctcatcttcttcaaacataggcttccagttgaccagttcgtgccgatccactttaaactgaaattgctcttcagcaatgtcgaagaattttaaatcttgatcaagtaagtgtggcctatgaggagagaacacaacaaagcagcgaccatcttttgctagaagatctttggtagttcttaataactttagatgctctgtatgattgaaaacaacatcacttaaaatgataagatcaaacttctcaccatttacttctttttgcagctcttcgtagtcgttcccccaaatatatccctttactactatgttctttttggaagcgcagtgatcgacattatactgaatattgtacaaaagatcaggatccggataatctgtagaaacaactttggcagcaccattcaatccgcagattaatgaaggtaacgctgccgctgctccaagctccagaacattcttgtcccgataaagctctggatgctggtccagatagttggcagtatacttgcctgcattccacagcagatgaccccataaaggtgaagctcccactaaccgtagattgattatgcccttattatcaaccctttcataatccacaaagctttccttgggaggttcaggacgaaaactttcaggttcctgaaagatgttctccaggtctagatccatttgggatgcagtgaggttgtgtcccatgatgaataaagggaagtgaaatatcttttgagcgatgtttatgtaatcagagtgatgtattcgtgtctgaaaccattttgctagaacgcgaacgaagaaaaaacaacaaaaaaaagaaaagagactacccaccacaatgctactacaacactcttcctgttgtggaaaacacaccaacttaaaatcggagatacgtggaactgggcaataaaatgcagacggggtgttttacacccccactattaattttccgaggaggggacacatcaaaaaagggagaatgtgctggggctttcctcgtcaaaaataaaaaaaagaaaacacacctaaaatgagtccagaaatctacagtaaaaattgcccagaatagttatttctcgtcagttgaaaacgtccctgttggcttaatgacccttcatgaatagtactgattctagaaccctgtcacttcttccgccctgggaaccttatcggatttcgctctaacggtagacgcgaggggttttgtacatccccagtgtgtgttaaccaatatgtggtcaaatcttgggtagttttcgtctagagcttctttttcctgttattcgaaacccaaatgtcgtacaacagaccattgcctaacactaccagtgtcgccaatcagcaatcccggcagagattggaggatctgcttcaaggcatcaagaaggagtttgaaaacttatccagcgaaacctctttttacaagttgcaccaggatgaagtggaaatgaagtttacacagcagaatagagaacttcaaaacattcgaaatgctgtttacgaacttgatgtagctcacagaaagatgaaagacgcctatgaaaaggagatacttcgttataaacaagaattggagaaacgcgatcgtcttcttcagcaacaacagcaacaacaacatcagccacaacaccaacaaccgggtctggaaaatagggactcctctgcttataaccagcagttgccacctcccaatttgaacgctcatcagtctggaaaactgcttccggctcaagggggtgaacaaaactttgcaagcagtggctcgcttccaccattagttgcaggttcaggtactaacgccaatgcttcaaaaccggagacatcaccctcccaggccccggctccatcattcagcgctcctcccagacaagagccaacggccattgctaaaacttcgcctacagtttctagcgtaccagcttcagcacctgaggaacaagaatccaaatccactaataatcaggagatcaagaaccttagagctcagcacaataagtttttgcccagcttcttaaaggatctggacacttattctgtccttccatacaagaaacaacatgctgagtattacgtgctatacaaccctgacttaccgaaggagatagaagtcgagatggtacattctctagaccattcgtcggtagtttgttgtgttcgtttcagtaacgatggaaagtttttagccactggatgcaataaactgacccaggtgtttgatgttcagactggtgaactggtggctagactgtcagacgattccagtgccaacgcgaacggtacttatgacacagatactggtgacttgtatattaggtctgtttgtttctcacctgatggaaaataccttgcaaccggtgctgaagacaagttaattcgtatctgggatctttctacccgatcgattgtcaaggttcttagaggacatgagcaagatatctactcgcttgactttttccccgatggaactcgtctggtctctggttcgggagacagatctgttagaatctggaacctggtatcttcgcagtgtgcgttgactctgtcgatcgaagatggagtcacaacagttgcagtatcccctgatggaaagttaattgcggctggctcacttgacagagcagttagggtgtgggatgccgagggtggattcttggtggagcgtctagattccgagaatgttggaggaaatggtcacaaggactcagtctactccgtaaccttcactcatgatggtaaaggtattgcgtctggatccttggatagtaccgtgaaattgtggtccctagatgtcaacaaaacctcctcaagcaaaaccaagtccagctgtgaagttacttatgtcggacatagagactttgttttgagtgtatgcgtcaccccagatgacaagtacattctttctggctcaaaagacagaggggttatgatctggcacaaggagaccggtgatccactgttaatgctgcagggccaccgtaactcagtaatttctgtaagtgtcaatcaggaactggaaggcaaaggaggatactttgcaaccggttccggtgattgcaaagccagaatctggaagtggacttgatgtcccgatgctccaaaaaagatattattactggaagttgtattattattagtgttgcttttccccacactccaggcgaggtagagtagagataaaggtttgaagtaaaagcagacctccaacatcccgcactcgcctcctggattaaaatatacatataaagcaataaatcctcactccttatcttctcagtgtcgttgattctcttttcacctggtgccatttgcttaggtagattatgcctatcgattttgtaggtcaaaagaaatacaggctactttgctttctttcccctgaagtgaagggaaaagacgctctatctatcccactatcaggatacagctttctacaagtattggattctgatcctagctctgattacttgaaagacagcatcagaattggggttggaacccagttacaatataagacaggtcgcaagttaggttcaattgacacttcacaatggagattctactggaagaagaaaggtgagggtgttttgtatccactaaggacgttaaacgactttgttagatttgtcgatagccttagtgagttctcattcaatttaataagactagttgtgagcactgatgatcctgttaatgaatgtagaggggagagacgaaaggaaaaacgaaaggcaaagaaggaaaagaaaaagaaagataagagaaaagataagaaaagaaaagaccacaaacttgggacggaactgccacaatttgacatgggagaggaaatcaatgaccctaaatggaacgtgaatgaggacctctctttagcaggttttgattgtctagcaattgcgacttggaataatgaatccagagagaaacccctggatggcttatcgcagggcgaatctgattctgagtgcgaacagaaaaacagttccatcgtaatgaagccagatgaagcgttatctgaaactgtacgagagcggtataaagagttgttgctccttgacgaggaagtggcgaattgcatgtcagaggacacttctggaggggaggaggactacgcgccaagatctcctttatttatcgaatcaatgttgtcggattctgactttgagcaagtcttttgacgctaaccatggtaatagcctgtctttgtttattcaaggggccacctgtcctttcccaaccttttttattttagttccattatttgtattacttaatgtttaatgtttgatctcatttctctgcactttttcttacatcagcaagcgatcgatacctattatccgattttgttttttgcttccagtccattcaccaagccctcccatatgagcgggaaacgtaatttttctctatggaatatctgggtagcaagcacccttctcaaagtgcttctatatccggcataccatagcacggattttgacgtacatcggaattggctcgcaatcacaaacaagttaccgttgaaggaatggtatctggagaacactagccaatggactctggattaccctccattctttgcttatttcgaatggttgttgagtcagttcgttccagcatctgttgctgacgacggttgtcttgatatagttgatgtgggcaactacggttggcctacagtagttttccaaagaagcacagtgattttgagcgagatcgtactcttcttagcattacagaaatacatcaacatttccgccggcaaagaaaaggctagaagctttgttgttgctagttcaattgctctttcgccaggtcttctgatagtggatcatatccactttcagtacaatggcatgatgtttggaatcctaattttctctctactagcagccaagcaaaaaaaatatctacaatgtggagcactgttcagtgtattgctatgttttaaacacatatttctttatatagccccggcatattttgtgtttttgctcagagtttattgtctggatattcatgagacctccttcaagacaccacgatcactattgaagtctgtgcgatggtccaatttgtttaaactgggattcacagttattaccgtatttgtcattgcatttgctcccttcgcctattacggcgtgattcctaacctaatctcaagactgtttccgttctcaagagggttaactcacgcttattgggctccaaatatttgggccctatattctttcctggatagggtgttggttcagttatacctgcatgttccaggtatttccagcatcatctcaagatacattggaccagaaagtctcgtttcaaggctgaaaaactctacagcatctactaagggcttagtgggagatgtggaattttttatagttccaactataactcccaaaatgtcgtttattctaactcttttctatcaaattttggccgtactacctttactgctcttcccgacgttcaagaaatttttaggttccattacattgtgtgcatttgcaagtttcttatttggatggcatgtacacgagaaagccatcatgcttgtcattataccattttcatttatagccgtgagtgatagaaggttattgtaccctttccatactttagtcaacgcaggctacgtgtctttgtttccactattattcaagtctccagaatggcttgtaaaggtcctgtacactttggtgtggtgcattatttatttcctctccttcaatgaggtatccaagctgtcaaagtcattatctcgacgagtcttttacatggatagaacaaatctgatatatattcttggactgatcccattgacattaaccattggtgtattggatgtgctatctgaaaactttgaattattgaagagacttgagtttctaaggctgatgatgtacagcgtttactgtgcactgggaataatcggcagttggaacggattaagctggatctatttcttggatgatacactgaatggagactcgagtgaggtcgcataggacggaatgcgcagcaattaatatgaacatctcgcgtatcataatagacgtatcattttcaccatcgttttcctcgtctcttctttttgcgtaatcggacaacgctgcactctggacaaaaccacttcccctcgggtgccctcgtcaagttcacacatttgtaatgaaaccattcatacttgcaaccgggattgtcacaggcaaccatctttcctaaacctggtcctctacataggcaatagacgtcctcggcgggtggactgggcgctggtattggtgaagggagggctggaggggttataataattttcttagaaggtttgacgactttggacttttgttttccattttgcacttttcttttagtttttgtagcatttattgatttgcgattttgtttagggagggatatgtgaattttaatggcatcccgattctctacagggagggtattaggatgcagatcccctcttttcaacccatgttctttcaaaaactgtttcttgaactgttcaaatgacgctcgtgtgttattctgctcgttgatttttagctgcttcaagcgctccatacagagagaatcactattcaagtagtcttgatggttatctagtttatccttgagatgttgggactctgcaacaatctcctttgagtatttgcttgccaaatttcgaatacttacaatctttgctaacacctggggatcattaaggtccgagtctttcagtatatgatctagctggttcatgtactgatccacccgtaaattgagaaattggattagccataatgatctaaccacatcgcaaggtaaatgatcaagcgctgaaatgttagtacaatgtcattatcccaataacgtgacaaatataagtggtactcactggacacaaaagagttgctcaagtttacgatattcgaagttaacatgacattatttgatatttagtgttatgaggaggtcttgatgaatttgatatcaaccgcgagaattgttacatgtcgcgaaggagaaactacatatcaaatagccctccaaacattgttctcatcttcgacaataaatatcataaactacatctctactaaatgtatcaaactcatcccttatgagggtaatgtgatagcttcatatttaacagtcatctgtacatctataccttggtatgcttattttcttggtggggtccaaacaatctttctattcttgatcggttgccatttgaacttcttgacccaaacagccaacaggtacagagaggatgtgataatgatggccttcagacccatcttctttctctcatcgtgttctggttcagcggcccagttaaggaaggtagtgacatccttggccatctgggaagtggtagcttcagtaccatcttcgtattcaacaagtccatcaaacagaactcttcccatggcaatagctcctcctgggaagtaagggttgtagttagttccaggtggtaattggacacctgcgggaggttcgtctgggtatccagttagcagagagaaaatgtagtcacatgcaccgtgtctagctttaacaatcaatgacaagtcaggtggtagggcaccttggttagcggctctagcagcctgctcattagcatatggacccggaatgtagtccgccagcttacctggtctctttttggggttaccctggtcatctggctcgtcgtcgtactcaaactcttcagccatttccttagcttcggaggtcgtatgagacacaccaaccagatttctccatgcaactctgtctagggagtgacaagccgcacagacttctctgtacacttggaatcctcttctgatggaagcatggtcgaaagtatcgaacataccattgtgggaccaaccgtactctggagggtgcaatccgtgctcagcagcggtcatagcctcagcaacctgtgagtcctggtaaaggacatatgaagcagttaaggctgaagttgctacggctccggtgacaagcttctagaaatggatgttagtatgcataacacaagaaaaaaaatgatcagaggatgacggatgtgcatatcagacactatgaatcaaatacgttttgtattccaaagttgagaccaaaaactgttcgactctgttaatcaatactatcaacaccacaccatgacactaccatgaaatatgattggctaaatgcgatattctgtaaatgaacaatctttcttcaacaacaaacaaaagaagtcttttacttacagtaaaaaactctttgcaagggaatagtctgtttaatatgaaccaaaatacaatttgaaacatttgatataatgaatactgtgtgacaaaatgttcccatatgctttaccttgtcctccttgataattggatacttacactattgattgcacgcttggaagccgaacggaaggagttaaacattgcaaatatcagttctctttgaaattatgttcagtgtactttgctcaacacagttcaaaacaggtcgaagttgccaaaagagatgcatcacctatgtgattttttcttagtggtgcgaagctgattcaacgaactgtgattggttcgcaattcaaaaataccgttttggtttgaaatcacgactgtttccataattggtttttcagggtgtttttcaatagattcgcagaggccaagtcaaacgcgttcatccttccttatccatcctcgcgtggtgtttaaaatgacgatgaccaaccaagaagaacaagcttacttggacctctgtgttcgaatcattaaagaaggtgaacaccgtcctgatagaacaggtactggaacatactctctctttgcgcccccgcaactaagattcaatcttagagatgggcagttcccccttttaacaaccaaaaagaccttcgtcaaaggcatcatacatgagcttctgtggtttgttgaagggtgcacagacggtaagaaattgagcgaaaagggtgttcgtatatgggaaggaaatgggtctcgggaatacttagactccttgggattaaaagatagagaggttggcgatttggggccagtgtacggatttcaatggcgccattttggagctcagtataaagactgtaagacagactacactggacaagggtttgatcaactttctagggtaattgaaactcttcgtaccaatccatatgacagaagaataatcatgagtgcatggaaccctccagattttgagaaaatggctctcccaccctgtcatgtattttgtcacttttatgtttctttcccgaaagataaaaagcctgaattatcttgtttaatgtatcagcgctcctgtgatatgggattgggagttcctttcaacgtcgccagttatgccttgctgaccaaaatgatagcacacgtagtcgatatggactgtggggactttatacataccatgggtgatgcacatgtgtacctagaccatgtagatgccctgaaagttcaggctgaaaggattcccaagaaatttcccacgttaagaatcaacacgaacaccaaagatatcgatggtttcaaatttgaggactttcagatagataattatgatcctcatccacccatcaaaatgaaaatgtccgtgtaatccacataatgagagaaatccgttgctattgcttcattctatcatattctttgggccgcaagattcacattcgactatcaaaaactgattttttagaatgggcatcttttgtgtccgtgaaatcaaaaattgacagatcaccttcctcagatgttgtgtgttgatgattacgactttggagtactccctcaagtttttcccctttgctttgggttgtactatggctgttctgtggtagttctgaaagcacttttctattactattaattgtgacagaaaacttttttctggggtattggttttcatcttggtgctcttgtttaaccttaaacttttgcttttgctcattgtttgcattacgtggggcatttttcttatgttgtggtttcactcgatcagcatcgtcattatcgctttcttcccgtctcattttggatttcagggaaggtaatctgtagtcaaccgatggcttccttctagtccgaattcggcttgaagaatcagtcacagcttcagtattcatgggcattatttgatgggttgctgaatgtactttagtattagatgaaatattagcattttcgtccgggtctttgcattgttgcttatcggtatcaacatctgcatccatttcaattatctgtactcttgatggagaactggatttagtacccctggaagctgaaaaataagacgactgccgccgtttactcctcacttcttctctgacactttcccgcttccgtctaacaggttcattttctttctgagtatccgcaagttgaggaggatgatcaatcaatgcttcctttggattgattaattccaagatttcctcaaacttcatgtaaactagtttctctatctcatctagagcctccctagtcgtttgctttctcttgtagttttcctctttcagccaaagattctcttgcaccaaatcattgattcgtttttcaagcaaaccgaccttgctcattagcccggtgttcgcttttgcaagctccttattttgatttgaataacttcgctgttcccttcgtttcagaatatcgttaatctgaagcccacccatgttcgattttccaagaaacttttcattggacgatgttttatcaagcaacagatgtaaattagtcatgtggtcttcttaagaagttttcaattgctctactgactgtgagtgaacggtgtgtttagggcaggaaaaaataaaagattaacactcctttgtttcatgataagataaagagggttgagcattcgctaagactattttggatcagggaaaacgcgtaaatctttaggacgattcctgatccatattgggttactcctacttccaagtttgtacgaagctgccatggacaaaagcccattgctgttggaaacaagaattcaacagaaacaacaggaactcgaatcttataaacagatcaaggagttaacttctgctctcgctgtatcattatccagactggaggagaaattagctaccttaacagatggtacagaagcagtatctgtagttctcagcaactggaaccacattgttaaggcttccagtttggcatctatgggacttttcaagtttagtgagcaagattacgaaaatatagacaatccacccttgcctgaaacattggtacgttttagattaaaggaggaagccagttcctcagatgtcgaaaacgttacacctcaatcacaaccaccatcacagccacaatcgtaatagttattatatttcaccagtatgtatctacttatagtccacatactttctgggttatgccgacgaaaagaaaaaaataaaaaaattaaaaaaaagagaatcttcaacctcttttattgactaaacatgacagtctctatccaatctgcaatctcatattcctcaataagtgccttcaattcggcgctctcattgttgtactcttttctcaatgcgttcagtttttcattctcctcactatcatcttcatagtcatactcattggcacttccatttccacttcgaagaacttttatctcattgagagtgtactctttggttaaactatccaataactcagctgatggccttctaatgacagaatcagtcgggttcttcgtgttaatgtagccgtggttgaccaaccttttgattatgcgggaaaagctggatttctccaatagttcactaatgtacgactctgatttgttttcagtgttggacagtttagaccagtcctctttgagtaaaagccttttccaaacaaggttttcacactccttaaggaaatatggaactgtactattggacgtgtaaagcaacgccagaaccttgaatgcgtggtaacagttcatctccagtgagtttgttaccggatcgatcaatgttaaaacttctagcaagctggagattgtcaaagattttctatctaacatacgttccaatgacttttctaatgattgcttcattaatggttgtactgattgagtgaatttcgaaatgtcttttttggagatgattaactttgataactcttcagctaaaatctcctgcaaattgatcagggagagatttatgtcaatattttccagcaaattctcaagtaagctagtcgagttaccaatggacagaatgctaagctttgccaaactcaattgcagctttttatgggccattggttcgtcttgatcttcgcttgcttcattaaccaatctttgggcggcagaaaagtaatctttgtaaatcaggtcacggatccaagctaactttcctaaacgatcgctattttgttcaaaaaattgttctaaataatgatcaaactcggggaatcctaataaagcaaccttgggcttgtgattgtcaatgtagtactgatataacgtgctagcaaaatggaaaccatacgtctcaaaaaagtggtgaaactttaggagcagtgcggcctgcttcctttcaatttctggcgtaaggtcgcacttgatttgtgagttgatagtctctctttgatcgtcgagtacgtctagaacggttatgaaatcttgaaactgttcagccatttccagaatatccgaatgctgtcgcaaataaattagcaagttaactattctttttcggtcaaaaatggattgaattgcttcggaaatacttttttgattttcatttctattccatagaattaaatcgttgaaagtataatacagaaaacgactcacatcaaacagtaagtcatggtattccttggaagtgggaagatcttggagggccttgtcaatcagtaggagtaatccagtctctttcaaaaatattgggtgagacaaagtaatttcagatgaatagcgagatactttgaataagctgtacttcagttcactctccaaattcaaaaacgataatgctacagggtcaaacactttcaagatagtctgattagggcattgcttgaacactgctttcataacgtcaatgacatcattggcatggtaaagaacaaatttgttcagagcatcatctggttgtatgccatatttatcgtttataactgagatgagtaactttgtgagtttggaatcctgggagacttcctgataaaaactagtcaaagtagtgagtttttcatagtcaaaaagcactttgagtttaacttgatctgatatatctttgatggcagcaattaattggcacagccggttcattatttcccccttctttttcaagtagtcgactagcactggagcaaattgtggaagatactcgctagtgttcagaagtatctcatcggcaacctcaatgattgccttttcgacttcctttccgtcccgaaatttgttgctgtcaaaattaaggggatttgtttgcattccgccatagtatatagcctgctcaatgtgagactttatcagttccataccatccaagatattgtcattttcagtttcgtctgaaagatgtgacaaaaacctacatatttgcagaattccagactgttttgtcaaaacatataaagtgttaccatcactggggcctgaattcttggaagaagttccaagaattgatatctcatttttcaagttcacagcatcctcccatttcctctccagtcttgtaatcttatcgatggaactaaagaggtccattaaaataatagagtttccactcacgacaaaagcagtgttcttggctgaggaaatatataacgtcggggtctctttggaattgctgtaatgagaattgatcttgtacgaagcgttgattaaaatatcatctttttgaatttgaattgtcaagagcatcaaatatcgttcatctgtaattggttccttgtggaaagaacacaagataagaaaatcgctgggctgttccagttgtgcaatgtcatggactttgaatgaataaccaacatgaggatacacttcagctaaagatgaagttaaacggtctttcaaattcaagccaaccagctgagaaacggagtctctattgcaatcgacaattgatagagaaccttctgaatctaagattacaatgctgtttgtggaaagattccctttaagtaacttagtgcttacaattttcggtgtttccaatttagaatatgagtgatatgtttgtctgtgaagcaggccactcaaaaatgacgtttgttgatgttgtatttccatgtgtgatataaatggtttgccagcagaatctttgagccgcagtaaaaacactctcctttttgaagtagaaacaatgactcctacctgcttgtaataatctgttttagtgataaactcgccacttaatggaagttggtgttcaataattttgttgtttagaatccctacagatggcgaactactgatctcttcgaagtacttcaccaatcccgtagagctgttgaatagcaataagccaggatcactagctctttcattgaattttcttggcaaggagtctaccagcactgccttccagggtatatcatctttctgttccacgtcaaatgcaattgttacagggactgtttctttactattataattccaaacataaacagatttgtttgacaccaccagtccatatccaagttgagaatcaacagtcccttcgtaaacatgttcagattcgtcccaacgggcgtaatttctcaaaaatgcaggctgcgaaggaagtttactgactgagtattgatctatcctcgtcagttcaattagttgaaaatcgctcacgtccgaaacgcccccttgagagctcgggctcttatcactgacctctgtctgatggtccagaaattcctttcttgctgcgaatattgaagacatcactggagtttcgattgacaggtaaacaagaaagtgagcttcgaaatggaaaatttccagattctattagtggtgtacagatgtgtatacatttttttattatcattaaagggcgaccaaagatctcattatggagatctttctctcaatctccagtgtgctcctgtcaagtttggtagaaatgaactgtttcgttgagtctggcaattggtagaaatattgtattagatcaccatccaccacaccctgagctggaacatagtaacctcgatatttcaagtggcttcttcctgttagaaggtgcttggatttcaacagttcttgccgtagagagtcctccaaagagacgaaaaagtctatatctgaaggtgtctgaattggagacaagataccgattgtaccctgtaggcctgtgtagataatagactgtttcccacctacagttaaactgcctctggataaacttgtaaccacatcttgaacgtagtaacttgctaattgcttcagtttaaacgggcattctcctatcattttggattttgcttcaatgtaatcaagatgatctttattgaccttttcagggcatctcaatacggaaatagttccaaatcggtcaccagtgactacggtagaatagtccaacattttggagcaggtaatgtgtctttgagtaatatcgtcacatagggaaataaaacggttttcttcagcattaaaggatagaaacattgaagattgtttcatgtctgaaatgacaattctaaatccctgataatcaatgctagttatttgatgaaaactggtttgggtaagggatttcttgagcaattttttcaatcccagatcatacaaaaccagaaggtttcctactcccgccaatagcttcccttgaaattccgttaaagaataaactagttggtccgtttctgtgctgtgcagaaattgtaggccctcttctgtaatcttgtatgtccttagttgcgttcctttgttgatgttgggaagtaactcttgctcaacagagcatgacacgatgaagtacacctcatctgggtgagacgcaaaactgactttagtgcttccaaaaatagccaattccttatccagatttatagcttggattacttgctggctctgaatatcaactgtctcaatcacagagctccaatgagaagacttttcgtaacctatctgttgatacagttctcgtgattcttctgtggcaacggagttcaaatatggattcttagtgtaatgctgggactctgtaacaactactacatcctctgaaacgagggtgatccttctaggtgtaaaagttaatggaatatctttaacgttcatatcggtatcaagttgatcaattgtgaaaatcgtaaggttttctgcagatactccgacaactccattttcaggacactcctcactaataaaaccacagccataggtaaactttccgtcacataaaggtgttatcttggcatcaaacccggaattataactgagatatgaggtatccgagaaagcaagaaccaagttctttccaaatattttaactggagataaagacactcgttttggtccaagataatttactcttgtatcactcaactgccctgatatacggttgagaagagttcgaatataaataccgctgtccagtcctatgtgaacaaaatatccagcaccttgttcaaggtttgtgatttgaagatcagaagggattgaagatagagcttgcaaggagagcacctctagacaggaattaggatccgtgctgagtattttgatggtcatgtcgttgcaacccaccgctaaaaaaggggatctcagtcgaccatctggaatttggcccagagaaagcgctgaaatcctacctgacatttctttcctttctttgtgttcgatcagctgatcatattcgtcaatttcgaagtataccaattctctgttactcagaccaagagctatctgcgaatttgtcatcgaagcaacaagaatctcagcccctacaggtggttgccataaacttttttcaaaacttggttcgttcaaaccctttaaatgcactattccatgtgaatgaacctgggctaatgaatttcttccaacctgctgcacagcgattgtagatacctgaagctctaaccctgaatcagacacctcatcaacagattccccgatactgagtaccagtgtcccatcaataaagctaataaccatgtatttgtcgtattgatctttgtgcgaaactttagtagtaaaaatattgagggcacttcccggtaattcagaagatgctagttcgttgatggctagttcgtgttttagtagcttcaacgagctccgactgctgccaccagatgtcaacaccaactgagacttttcttggtctagtaagccatcagtgattggattcaggcaatctagtatatacaccagagataaattatctaactccttggtgtcaaagtaaatatggtgatcctcatagacggattcctcgtccggatagttttctgaactccaaatggtaccatcatcgtcgtcacccagcttttcaaactgatacaaatacttatctccagtttcagtgtctgcaaacagaaacccagatttgaaaatatgcaggtccaaacacacggggagagaatcaaagtatttgatttcaatactactcacttctttcgtgtcataggtatcgtcttggacctcttgatatgtaacagaaaccttaaagatgtctcctagatcactttgaagcaagaagaagaatgaatttttcatcttgtggcattctccatttattatgtaactgagctctttctggttttttcgcttaggaatgggcaaacagtgagtccttttgttgagaaacttgaactggatgataccttgagagcaaaggagcagtccagacgggccttctgcatctcggggaattgaaatcaagaaattgctcttgaaaggaatttcctcagtgtattttttcacaacatggttcaatcccagatctaattcatagtacgagaggtatttcttcgtgggagaatcatagttgcattctattgtagcggttaaaggattgtcgtaacccacatccaatgcacacgtataaaaggttacaaccttgctaatattggcctccaatggtgacgatattttaatggtgttatcttccgagttcctattgagaaccgttatcattttgtttttctccaaggcacagagcataaaacttctattctttggatccactgcaatgtagcaggatggatttagccttctcaatccagtcttagtcagcggatggttgaccaagctctcaaattcgatcttctcgttcaatcttgtcagcgtgatatttccactatctgaggttattataaggcaatgctgtatggatccgggtattctaaactttgcaatattctgcacaatgcagaacagctcgtgttcacgctctttatgcagttgtcccgtttctgtatccaaactatagacaattaatgaagagtggagggcaacaatgagctcctgtttgcttttatgcccagtaaaacttccaattacagatttgacacttgcagacggtcttttcagagacaagtggtacaaaaccagctctggctggttagagttcataggctttaaataacttcagggtaaatattagccttgattgtggtgtcgttacaagttatcggttgtttgaatagtggagcttctcattccatacaaaatctctatggttatgaccactgatgctcatctctgaaaaaattcagatttaattttttttttccctctctcccttcagctatctctaaaggcaatatccaagcacaatgatcagaactatcaaaccaaaaactgcccgtgccaaaagagaacttggaaagagggatccaaagattgtagagaatgtcaagaatgccctttttgtaccgggcaagtcttcaaacaaagttctacacgacgttgtcgtggacctcagttccttgaagaagccaaatatgaaaaggttcaataaaaaaacgatatcctaccatttgaagacccttccagtcttgaattcttcagtgaaaagaacgatagttctttgctggtgctgagctctcataataagaaaagaccaaacactttgacatggattcgtacctttaactacaaactatatgatatgatcgagctctctatattgaataactacaaacttctgaatgaattcaagcaaagcagagttgacgtcggtatgaaacctatgtttgtgttcaatggtcctatttttgatagtcatcctgtttaccaacacttgaaatccttgttcctagatttttaccgtggtgaagagaccaacttgctggacttaaaaggtctccaacatgtgattagcataagtgctggagagattgatgatgttgaggaatccatttcaaagttacccttagttcatttcagagtctatcgcttgaaaacctacaaatctccagaaccaaaacttccacgagttgaattggacgaagtcggtccaagattgacctttaaagttggtagatatcaatcaccagacccagaggtcgaaaaggaggcccttactcaacccaaacaacagcaacctaaggttaaaaagaacgttcagactgacattattggtgacaaagttgctcaagtccatgttggttctcaagatctgtctaagcttcaaactagaaagatgaagggtttaaagaaaagatatgaccaagttgaggtggacaatggtgacgaagacttcggtagcaataagaaggccaagactgattgattgtgaacctacgtaattcacaatctgcattcacaaattcaatcaacactcacctacacgttgaccgaaccaactaaaacataatcattcatacttgtaatggcaactcagttaattatagcttagtcaaatttgcatttctcgtagaaagtttcccaaagttcaatgatttccttttgcgtttcaataagtgactcccagtatatttcaaccatagaacggaaatcatcaactttcttatcttcaaatatttctagttgtttctttacattgtctacaatcatgtcccgtttggcagtttcttgatctaccgcattcgataaggcagaaagctctctttcgtacctctgtatcttatccacctgattatgttgtttggttttcgctttattcagtttcttctcctttgtagctacctgactttttagattgaggagattgttgattaccttgaaccggttttcaaaaacaattcttatggacccaattatacgcacatactcgtcaagagtggtagttaaagttagcacttcttgcatattggttctttcaagtagctccttcgacttggtttgtagattgtgtaactccaagaaaatggctgaaacatcattactcacctccaagtcaatgagctcatttatagtgttcaaaaactcttcaatcgtggtcaccaattcctctctctgctgggttatcaagtctaaggtttttaagagatttttcagctgttgatccaattgctcaatgtaattagctttttcaataaagtacttgtcgttctcaacatatttgggagctgaaatagaaagagcattcgatatcgaagacataaatccagaattgttcaatgaagcgccagaactcatagtatcgttttcactgacaacggctgtggagctattcatattatggtggtgaataacttcccgctgtttagattcctcttggaacttttcgcttgatatgaaaatgataaaatccatgtctttctgcagtgatctatccctactaatattgaccagcattttttccaagcccagccttctgttttcaatgaacttgctctcaaatcttccaacaacttgttttccaggcggtggtgggataataaaacctggatgattactgaccagctgattgtataaccaaaggaaatctctgtatcttcgagtaacactaagttccttgcttgctactaactcggaatcagtcctagttttaattttgtacacaacatgcgcagacgtaagctctccaacttttatggggtcatcaacaacaatgtcaaagcggtccatgttttcattagagtcaggaattgccgacgtgggttttgcagcttttcgttcttttttgggggaaacggttggacttattatggttttctttgtaatattgaataagggttcatcaactgattcgatcaacaactttccaacagagggggcatccctatttgcttctgtttcattggacagatcatcatctttactgctattcaatggatcatcttgaggctctgaaggaacgacaaccttaccgcctattcttctgggtctaggtctgaaaacagttttctttcgattcgaagatgaaaatgtatgacgatctggtgaagttgttgacgcctccatagctgacttaagttcttcggtgttagtgtcaccaaaaaggttaccatcaggtccaaagttacttgtcttcacttctttttcaataccctcggttaagctgcttaacagctctgtctttttcagtttgatctgctccttggctatatcagcctcctgttgttgttgggagtcaggttcaatatcctgaccagaaactcctgtatttatgtcattattggaccccgaagcaaaagaattggcagcgttatcgtcaaggtcctcttcgtgcaaatttggttggcgttcctcatccttggagacggtttcggcatcactttctaacgaaacctcttgtagagcgcccactacttcatcgtcttcctccttgaatggattcaaagttggatcgacttcatccggcacgttgaatatcgaactagatggcgcattgtcatcccaatgagatccggaaaggggttcgtcgttcatggtggtttcaacggtcctttttggagatctatcgggaactcgatattcattcgaatatcgcactaggtatttggtgtaaagatgtaatttgggcgaaggaggtcaggtttttaaaaagagaatcgatttgtggggagtaaactgaaaaattggactcaacaacgctaataatcttgtgtaattctcgtactatttgaacgtaggttgctttcttgttattttctaaaagtggccgctcaactctaatctagggctcagttaaccgcttctatgtctcttcacagtttagattgatggttacgtaatcagtcgcttaggtggtacgctgctttgatcttcatcagtacatatatactattcagcaaagtcctgcaatgtctgatctaactgttctgtttcagaattgcgttcatatctacgaacaaacaggtgatatacgtacgaaatctgcaagaaaaacagctaatgacgaaaacaaaccccaagatactcttctgaaagaggcattagaggtgagcaagttcttgtcacatatactcaaattcatcaagagtgtcagaaaaccttacctcctatcatcaaccgtaagccgtcagaatcagaaggaagacgagtcgttgacagaagatcagaaagataaaatcgacgaggagatcaaccttcaattgcataaaatatcccaaaagatcaagttcttggaaacatacgaggacaagcattaccaaaatatgattcagaacagaactctaccaagctacttgggcaaaaagatgatgcattcgcacagagtagaagaacaggaactgtatgaggacaccatgagaaggttcaagaaacaggtgctcacatatcttaccatgagtttgaaggaaacttccacctcgtttatggagatgaaacagcaaaggttgagtaaaaaaagggagcttcagaagtcaaatttttttgcagactctttgctggaggagaatgaaatcgaagatgatcatgtgtctgaagatgaacaggcagaagaacctaacgagagctttccaccagcaagtagccagcaattgcaaatattggaacaggagaatacagaattattgttggcaaataagaacaaagagcttgcaaaggcaaagtctctggaaaattccattatggatatcacggggcttatcaatgaaatatctctgcaactaagtgaccagtcttcagctatcagtcaaatgatggacaaccatgaggacgttctacaagatgtgaagttgggtaatctagagctactgaagacccgagatagaaattctaaaagcacaaaatccattgtcaccataatcatggcattgagcatatttttactggtggttgactttttgttttagactacctagcttaatgaacaatgtcacaccgaaaaaactgcattaagttccatctttagatctgtaggctacagagcttcgataatctggcccgccccaattatcgaactgtcttttctaatgacaactctccttactttctcttcccaagttataattggcaatttgctttctattgcaacagacactatagctcgctgtcttgatgataaatgtctagggattttcttcttttgggagttcataatctgttcgatctcaataattctagctgggaccgatacattgtttctaaatagaacaaacggtgtacctttgagtaacggcttgtccatatcaaacaggtgaatttccatccttaagttagaagaaattggaatttcctcatcaattgacacgcacagatcaccaagtctgattaaactcttttcctcaaccgacttgactaccttcatccttagaaccacaaattctccagcaatgcaaatatcctgtgcttcgtttgatttgagaatcttgttgattctgcagaaatcaaacgatggaagaagcttgactgtttcaccagcttgtacaaacccggaatttactctcactttgagagtcaagttgtcatgagcttgatcttctacatcaataatagtcatgatcaacttctgctcagcgattggttgggattgctttactttattctcgtgataaagcaaatcaaccagtggcaagctgttacctttgcccttaactacattatcaccattcaatccagaggctggaatgaactgacagtcatcttgacgatattgcaaatcttcaaaaaggtaacttcccatggattcgacaatcttattataatgatccatattccagtcgcaaaggtccattttattgacaacaacaataagtttgttcaagttcagagatttggctatccttaattgctccttcgtctgaccatggttaaatgtcttggcaaaatcactggaatccacgattaacacggctatatcagcctggcataccccgttaatcatctgaggaatgaaatcttgatggcctggggaatcaatgattgtgaattgtttattcttgtagttgaaagatgtctgacatatatcaatcgtcactccgcgctccctctcttccgatgtttgatccatgatccaggccaaggcaaatgatccctttccaatactggaagattccttggttaacttgtggagagtcttactatctaccaccttcaaatcgtacagcagtctcccgattattgtagatttaccggagtcgacatgaccaaaaactacgaacgaaatattctggctttccagtttgctgattgcagcgtttatgtccaaggatttaattggtttggtatgcttgatagtcagtttttgtaacttttcttgaactgtttcaagtctctctggttcttctgaaacttcagactttttgcttacagcacttctgggttcgttagctaatacatcaactggattgggcttgctaaaattggctttaactttttctatatctatgttagtcaaacttgaattaatcaaggtcaagatttttgagtcatgggaagtctttctcctcttgggttctctggtggtttcaaataaagcagaaattgctgactggggcgtatctacaatgatagaacgatgtgcatcctcaaacttaagttgaatcatacgaaatggaatcacgttctcctttatcgtctcatttttctcaatggggctgggttcattttgaggggttaaatcctcagactttgtgtcttttgcctgttgattatgttcttttagctgtgatttttttggtttttcctcttctttgaagcctttcaacgagaatttaggtcgattatcaagatcgatatcatccaataaagagaatgttcccttttcatcaacattcttactcaacagactatccaaacctgaatgcgctctagatgagtgagatgtgtcccccgtctcattattcctttttgcccttcgactcttagccaacagtgccagtttacttgaaccaccaacgagtatctccttcggaacaactattctcaacgtctcagccatcaatcgcttgcaacttttatacatactaaaattctgtttcaattctcttacagcatcatccacgaccatgtaattgaaccaaagggcctctttgaagtctctgtccgtgatgtcaggattgtggtctttcaacttggccttaatcaagggtaggagagtgtaaagttcatccaactcttctttggtcaagtcttcttctataaactcgtcatcgtcataaggctcgttctcatagtcattgaggtcgtcgtcagagtattgcattccttgaaggtagagcagaaacccaactcagagatatcctagttagtgatgaatcataatgttctggtacactacccaattattagagatgtcaaatagtatactgagatgttaagagcaaacggtcattaagatttaatcaagtatttactatttaggcggttggaacgttcaatctggttctgacagccttaacctgggtgtagttgtcaaaagcttccagacccatctcacgaccaataccggaggtcttgtaaccaccgaatggaacactctggtgtaagtcgttgtatgtgttgatccagacggatccggcttccaattggtcagcgacaccgaaagctttgtttaagtcctgagtgtggataccagcagccaaaccgtactcggagttgttggccttctcaaccaattcagcgacgtccttgaatttaccaatagatgcaacaggaccaaagatctcatccttaacaatctctaagtcttcatcacagtcgtagaagacagttggctcaacgaaataacccttggttccgattctgttaccaccggtcagcaacttagcaccggccttctttgctctctcaatgtagcccaagacacactcgaactggtctggggtagcctgagcaccttggtaggtaccctcttcgaatggattaccaaccttcagcttggagatctcttccttgaatttactaagaacctgctcgtaaataccctcttgcacgtagattctggaaccagcacaacacacctcacctccattgaagaagataccggtgatcaggttctgaatggtgctctccaattcacaatcgtcaaagacgatgtttggggatttaccacccaactccaatgtaaccttcttcaagttgaaggtagcagcggcaaccatgacgtcaataccaacagcagtagatccagtgaaggcaatcttcttgatctttgggtgctgcaagatagcgttaccacatcctctaccagaacctgggacaatgttgacaagaccagctggaattccggcctccttgacaagctttgtagcatataaagcggtcaatggagtggcggaagctggtttcaagacaacagcattaccagtggcaagagctggaccaatcttccaagcccacatcaaaattgggaagttccatggaatgatttgaccgcaaacaccgagtggctctctcttagtgaagttcaagtgatctttgccagtgttgatagttctaccatcaaccttgtcagcgtaaccagcgcagcttcttaagtactcaacaaccaagttcagatcgaattgagcacagtgtaaagctttaccgttgtccaaagactcaagtttagcaattgtatccttgtgctcctcaaaaagctcagccaacttatacaaccatcttcctctgacggaaggctcaacaaacttgtgcttgtagaaagccttgtaagcaaagtcggtggcgatatcaacatcatcagccccggccatctgtagatcagtcaggtgagactcgtcgataggagaggtgacagcaaaagtctttccactcttagcagcaacccattcgttgttaatgaaaagaccggttggaacttcaactggctcagcgatggttggaatgttaattttagcaacaaattcagacattttcagattgttaggctatatgtataagatgaaagggactaagagaaaaaaggagaattagcaacggatttgctatttcttttatattgccacctaatgcttgaaattctgcaagaatctggggaaaggaagtttctaatcctcttcgtagaggtttaaaaacccccacttcatccctattaacggggtgccggagatttctctttaggagtgagggggtgcctattgtggaaatgagattgtattgaagtctggacaccctatataccccaacggatacctaaatgcgcaaaacatttgtcagcacaaaagtctatcacctcccactgataaaattgttacttggtgaagatggtgacacgctggcattgaagggaaaagatcgttgtggagaacacgctcagtagtgctcaacaaaccggagaatagggaatgatggtccaaagctgaaatatgcattcctttcgctgcttggtgcaccaagaaaacgattttatggtccctctcgggggtgaccgggacaaattatttcggaatcaagtcacctcctacctttattaattgctttggttaaatagtacgtccaacattacgccgataccggtgttggcaaacacagccaacacactggtcacatggtttaccggtggtggctaaattcatgccccattccccggttataatagccgtagacagattttcaagcagactcaacttcgtgaacgtgagcaggcaatgattatgataatataaatatgtaatggcagttagttacgctctagattgacgaagggtaaaccgttttccgttttggattcaattgtttaactgttttcgactatccctttttgtttctcccttcaccccaacaatattgaaagtatccccttcacccccacccccttcgcaccccatgtttcccacaaccccggacccacgataaatgaaaaatgtgggtttctctcacaccaatattctagtcattcacccccacttggttcctctaatattattcaccccctcacccccttctatcatcattcagttccgttttgttgagtggaatacggtggaggtgtgtgcacccagcacttttcaatggttatccacgattaatatatacttactctatatattaattttcatgcaccctgagttgatgttctagaatacttcgcatgagcctatgcctggtcgtccagaaactttagaagatcattgtacactttgtacctaagttcttctttttctaagagaagactatgcttaccctcttcatacaacgttatggtttgctgggcagttggctcgtttttgttgataagatctacaaacttcttagcagagtctccactgcaacagtaatctttggccccgtgaatgaccagatatggtaaatccttcttgaatttggtgtagaactcgggagtcaatagtcgtcgtccacggtaaaacgcatcacggaacagaattagagatccaatggggtctgaaagcctgtcttgcaacagaaactcagtgtaacctttatcggaggtaataaaatcaatatttaacttactgttgaacttgtggttgggtatcacataaacgagtcctcgcaccaggtattctaagatgatgtttggagatgtcttagggtgagtctcgatgagaggggcacatgccacaattccactaatctcgtccctatgtttgccaattatagcatagttactgaccattgctccgcccattgaatggccaataagaaaaagcttatggtggtattgttcggcctctttcaagttcaattcaatgatagcctccaaatcatcaaacacatacgtgctgttcgtgacacctatatttttatagtatttagccgtcaaacctgcacctctctggtcgtagaagaaacattcatatccagattggctgaagaaatccatcggttctgtgtaaaccagggcatgttctgccaatccgtgtacaaacagtattctccctttcacagtaacaccttctggaacgggccaaaaggtggttcggaaaggtatgccgtttatgattggatctgaggtaacgggagttcccttgggaaaatacccgaggtcttccagagtgctttcaggaattggtttggccattgacagttgcttaggatggagtttaggataagcattttaagtaagatcaataggataaactgcagggcagcctaatcaattgggtgaagcactacaatctagtttactactgattctaaagaattggtgtcgtgtcccaaaagagaggcctgttgtgaatttgaagcactgatagcaccaacaaacttcctcattgaagcatcaatgccggacatacctctggcaagttcaacaatgggccaaggggcagctctgatgatgggcaagaagttaccgtagaacggaattttaatttcacctctgcgacccagctcaacagctcccacgatgtagtttgcaacgtacgtgggatctaagagaggcgctactaaagaagatggggtgatcaccccgttgaacattctcgtctgcatctggcctggacatatcaacagggttttcactccgctttgattcaaagatggtgggcccagctcatatgttagtgattcatgcagtgccactaagccagacttggaagctccgtaagcacttagtcttgcaggagatatatatcctaatactgagccaatggtgataatgtaacctctttttgccttcaacatttctggaaggaacgcttttatagtgtaaaaacttgagagcaagttcacttttatagtgcgttcgatttcatcatgcgagagttccagcagactttttcctttggtgtatccggcattgttgattagaattgtgacaactccaacctgttccctaacggccttactaagcttgagcacttctcttcgatcactgacgtcacattgataatagaaaacattgtctagtttcaggtcttcctcgggatagcgtatatcccacacaacaaccgtagctcccttttctctgaatgctattgccaattctctgcctaatccagtcactccgccagtgatcaaaacaatatccttggacggctcaaacacagttcccaccagaacgtcactgactcgcctatacgacttgtttagcctgtaaagcaatagacttagagctatgattcccatgttcctgggtcaatgcgaagagtcacaaagagggaagagcatttctgtgagttgacgcgataagtctatctaccgcaagtaacatcaaacaccacattcttttggttgagcacgcaacgctcagactgagcaagtgggtcaggacaaaaccttcgcctggaaacagctggtcatctggggaaagagaacgttattggcatgtaaatgttgataacgtaatctgtcacatgaccttcatctcagaaaacagaccagacaatatgtaccacttacacactctcttacttctaatccgatgattccaagctacaaacaactgccagaagtaataagggtcaagaggagacggacggaagacccgttgcaagcgctcatttttgatagaggcatcaagaagtccaaatcaaacagatatatatttgcactggcccagtcgcaagaggtggacaatgcgggaatttcacttttgaaggacgattcggagacgaataagaacggggaaaaaatttttcggctcctatatgatacagaagaggatgagtccaaactccctgatcaattgagtgatttggtcaacgattacctgtctatggaggcagcccaggctccagaccctggacgcaaaagacgaaggaggagaagtagcgctagtgctagcatggccgctcctgttactgcattaaaccccgccactgccccagattatgtttatgatgtgtattatagaacgaaagaggtttttgacgacccttcgaataactcctacgaaagaattggatatatcaagtttgatgaggaattagagaatttgctagatgacgagtcagacggcgaagataggctgttaacggatgatgaggactccaacgctgaaagtttttatcaaaacgattacccagaagatgaggacgaggagggatatcttgtcggggactctgacgactttgaggatgaagatggaacagaagataccacatttatgacgcactaccgacctcatgtgctaagagatgacttcattgacgaaagagacgaagaaaaccacggagagctagatgaatatgatgagctttttgatcaatttgaaagacaccagttgaatccactacaagagaacgaagctgatgaggatgaggacgatttggagtctcatcgggagagaataatgaagagactggaggctcaaattggcgagttgagctaatttgagcttaggttgagatttataaattataggtatattagttattaacataatgtgaacatgaagagtacacggaacattaaactggccaacaagggaagatttttgcttttctaaacgaattgaacatatatataaaattacatccggtcaacaataactgctaccatcgttaacattgcctcaagggattcgatgtgaaattaagtcaattaatttagagattgggccggattcataaataataaaatgaaaaaagaaattgaaaataacaaactagtagttactcaagctatttaaacagatctaaagctgaaagccaatcaaactaaatattcacaacgatgctattcaccatttggctttcggacttctactccatactttaagctgtcaccccagacttaatatcagtgaaaacacgaccttacaacaataatagtttccgaaatcgctaaaccctgacatcttggctaatccgtatcacccctctgcatcatttgccaatctctcccagctaattcataggattaatgtcattgaaagggattaaaaaggccataataagaacaccatttcaattacttgaaagaaagaccgttgaagaccaaacattgaaagaatgggaccatgacctggatgtttcggtatctggactcaccttcttaactaaccaattaaccagatatcgcaagattagtacggagatactgaatgaccaaattgacatagttcatctatacaagcggattcataggccattgtcctcgcaaaagctcgagccgaaggataaccagctttccttcgatgagaagactcaggagacttttgagactgataaggagttcgacgattcataccggctgatgtacctactgcaaaagcaagttattgatagggtatcggagctagagacttcagtaaaggctcaatgcaaagaaatggctgcacacatacacggtgttcgctcgctgattaagaagagaaaccataagaaagttgattatgaaatgtccaagagtaatgtccagaaaataatatctaagaaggatcactttgcggaaaaggatatagaaaatctagaaaagaatcaggcccaaatggatgtcgctttggaaacgtttttggagtttgacgacaagattagattaattgtaccccaatgcttggaatacttgagtgaatttctaaataagataacgttgaaatgttactatgagcaattgtccattgatgaatacattcacagaaagatacatgagttttcggttgccaatggaatagtgaagacagatggcaaaagtccagacttttcgaccatgacttcagattgggaagatcaaatagtgccaattatggtaaagattgaaaatttggagcttattaaaagttatcagcatttaaccaacaaaaacttcttgcagagatctactaatgtcgttaaagaaaaaaccttagtggcctcggagaaatctgttcatacaacaggtgcaatactcacaaaactgtcgaacacaaaccagaatttcagcttcaagagcgggtccattgaaaaccccgtcaagccggcgcatccggaaggaattttttggaagcctttggacccctttgatgagggtttttttgacgctaatctgccaactgacactgctaatgaacgtgagaaaatacaccccagtcctggaatcgtcaaagtcatggatgaggccattatcactaaaaagtgaccaacctgttcctgacataaattctcctgtgtcgccagtagctaaagaggaagacgcggaagaagcagaagaaccaacacatagccctataacagaaactgagtcctctgcccacaaagcaacaaagactgaaccctacaagagtattcctaacgcaaagattgctgaagctctaaaaaaccagaatcgcagcccccaaattgtccgttgtccagttacaacgaatttaaggtcggaacctttagtgaattttaacctgagggactatgtagcgtccaggtcatccatcacgtctttcatcttttgcaagcaattagtgaagaatgcatagtatctttgtaatgcctaatggaattggaatgaaaagaatggtgataataatgatcggggaggcactaaaacctaagaaaggagaagaacagctggaaagtcagagatgtatatgagtgcaaacatatataatgtatatgtaatattaaacaataaataaactaccaaccgaaaaattcttcctctaaagatatgttcaaagaagacttcaggtcgatagaattacagagagctgctcgtgcatcgtcattaaatgatggaggaccacagacgaagagcgacagattcctcatgtctaactctttggcctgcttgatttcttcgtcaagagtactcttgagacacaatctactggtggcttggacaaagtccacattcttcaaactctccattaaagagtcaaactcagcattctcgtaatcatccatcgactttgaacctgtatgccagacttttacttcaactccatgagcagctaaccattctagctgatctgcaaaccagtaaactttagccagatcgtcaacagtccaataaagtttgagaggcatataatattcctctttctttggcttttctgaatttttgtcgtcattacttgcttgtgaatcagatgagtcttcagtggacacttggaccaatcccttttgcttgtaaatggagatcaaatgattcagatgggggaaaacagagcaaattcccattcctccggcaagtgccacaaattgagtggtcttttcatccttcaactgcttcttcaatcctaaaatgttaccataaggtccttccaaggcaaccctgatcggaatctcaacttgagcagatttcagaactagctgcttcaggtcagaggttattccatctctcgctctgaagtagaaagtaatttgttttttatcctttgatgggacgacagtgaatggatgcgactgccacagacaataggagggcaaatcttcgtgataaaagtacagaaacccataagcacctgggaaaaatggaaaaaatctcggcctctgaatggttaatcgcaagatatcgcctctatagagtcttagtgttgctttacggtacccaccagcaaaaatgattcttactaatctcatgactctgtcaaaaccccagattgcaatcattgaataaatccagcccatccagccaaaatcaatgcagtgatgccacatggacgctatgaataccatgttcaacgctttgtggataaacaaaaacgtttcgtaagccctttctctgaacacagaagagctctggaataggatgatgaatatgacaacagttcctaggattccaaccttccagtataattgatacgcaagagacatgtatcccccatcactgtttatggcataagctgtccaaacggctgaatggatcagagcctcgatggtcatcactatagcagtcgttttatgaaagaagttaaagtcagcaaagctaaacccagaaatcaaagcaaaagggttgtttcgaataccaaaaaaatagacagtcgggagcaaggcaaatgacatgatacccgatctataccctatgagatccaaagtcagaaagtacgactcgttgatgtagacattcggaagttcgacttcatagtgcagggcagtcgctaacaccgtgtagataatgaaaggaatcaaaattaaaagttgcagcctggtagggaggtggacactcaggtatttccaaaatcttacaggctcacgaaacttgttagagaacagtccaggaagctgaacatacttttgaaaaaaggtgcccataggcaaagacagaccaataaagtgtctgttaatctgattcaaaagacccaaaaatatgataaagcaccagtaataattcaatccccaggataaccattgagtgagaagaacatggtctgtgaactgtacgaaagttctcagataaatcgcaaaatcagcatcattgtagtacagggtttggttgactggaacattcagctctgttgggtctgtcatattcagaaactcgtgaggatcaactaggttatccttggtttcatcatacagttccttcaggagacttaccgggaaattcctctcacctttgaggagacaacgagatttaacatgtttcaacgcatgtttcctctgatgatttgagaaccctggaacgtcttcgacacaattggcgacgctagcgagatagtaatcactcgcacatctacaaggccatccagccatgtgacctgttcctgtgttgtcacagccccagtcaaacttattgaagtaataggtacatgctgaagccagttgagagtcaattatggtaactgccagcgatgcttgcagctgaaccaggaaaatccagagaaaacaaatacccaacttcatgtcacgaatacacgttcaggccaatgagtgctagacgaatttatattgtcatgaaggctatatatactctgtacataaatgctcttctaatgtgctcatatatttgctcactttggtttctcgaaaaatttcagaccccagcgattaatgatgaaatgaggttagatagttctgtgctttgaaggacgggagattgggccgttgacagcgatagaaggcaagggaaagggagtacgaagaacaggttaagaagtcaggacattgatgattgaattgttagggaaaccgtcgtcgagcgggactgggaaggaaaaaccatgctcttcggtactcatgctcgtaattatataatcttactaaatctctatcagtaggcccttccaacgatcttattgataagtcttggctttttcaagatagtcgtaatcgcataatgtacctttaaacggtgttcctacaactaacggaaatacgctctcttaacaccgacggctcaaactcaactatcattgtccaatgggccaaatgctgtgccattgaaaaactaatttgctcaagataagaggatatcagtggaaaaccatcgaatgtctctgctagaaaactcgctaagtagccgtgcgcataatggccgaaaaacagttactacgaaacccatctgagcttacccaggtacaccgcgagatggatgagctctctccaccactcgaccagagccctccagtcgacggaatgaaaccccttggagtagtggagcccgacagagaattagagtttgggcaaacgggaaggcattaaagacgttaggatgggcgtgctgtggctcgaaaaaaacaccttactttttacatcttcccaccctagatggatcaagacacagatatatcagagaagccagtggaaggctcgtccttaaaggtgctgccagaccagcccatatcaactggtctcgaagggattatttacaaggccgaataccacggcgttttagttgttgcaaagaaaatgactaaacctctttacttatgtaagcatgaagctggtctgatcaagaaagctggcaagaacaacgaaaacgtttgcaaggtgattgatcttctatatgaggaagacggttcgtcgacaacgttgatattacccttttatcccaacggtgaccttctatcgttcctcgtcaggatacggaagcaaaaactgagtgttccgcaggtattgcgagatctcatttttatgaaggtagtgaatataataaaccttttgcatgcccaaaatatagttcatatggacattaaaccagagaatatcctgatagacggcaacggacagttgattctgtgtgattttgggtttgctagggatgtttccttggaaaattcagaccacccaatcgtacatttgggaaccatagtgggcgaggaaccagagaatgcaaaaaatgaacacaagacgcaagtagtcgggacaaaatcgttcatggcaccggaaatattctcctcaaagaagaaaccttctccccaagcgatgaagaaatacgacgtgtggtctctgggaattctatattttgttattgctttgacctgtcaaccatggaactctgcgacaccgcaagaccctatttatgaagactactctcttttctacaccgacaatagactccactcaatcaagtcatccgatttgaacaacaactacatacggaaagctgctttgaaacctttccgacaacttccatacaatccacgtgattgcatcttgaagtgtctaaaccctgacaacgcaacacgttataccgtgaaggacatttgtcaatccacctggtttgcagatttggcgtttgaatacaagagttccagcattggctctgagatcctgaagataatcaaaacattgaacaattaggttagtcagatacaaccgggggtttcctctctaatacacggtccgccagtccaagagacactgcctcctctggctccatgaaccgatctctctccaaaagtgcagtgatttcatccaccgtcatggttggagacatgtgttttaggtataaagtttgcaatttctgtttggtattgatgatatgacgggcatatatctcgatatcagtggcctgtcccttaattccgtttgccgaagatggttgatgcaccattatggtagcgtttggcaagatcaaacgtttgccatgcgttccgcttgcaagcaagagggatgccatggagcatgcctgtcctaagcaaaccgtggaaactggcgctcggatatactggattgtgtcgtagatggccagccctgccgtgacagaacctcctggtgagttgatgtaaatgttgatttgtttcgacgttgactgcgattccagatacagcaattgagccgtgatagatgttgcttgcgcatcatcaatgcctcctgctaaatatatgatgcgttcgttcagcagtttggtgaataaatctcctgctggtggtgagttggagggcgttggaggtaatgcatgggatgagatggatcgtcttgaacagattgacctcgggatgaacctataagctgtacgacccagacctaggggataactcattagtgtaagtggagtcaaccgacgagaggagatcaagcaaaacttattgctacaacaccgtccactgaaaagggctactacctagattagttggagacatgttcaactgttgttcgagggtggctcttgaggtgtgtgttcacccaaaaaaaaaaaaaccctgaaaaataaggggctgttaatagggcctggcgcctgacctttgcttctttctccagatattaaattcttttcgaatggggcacgacgaacagaagttgctcaacggtggcttttcgcagaacattcaaaaaattaacccttctaggctacatttgaataggattcttatccgggtaacgacgtggaactcccgggtaaccagccatcttttcctaatctggtagtcatatgtgcgccactcactaagtaaaccagcttttacgtaacctttgagtcctttaacaaacaaaccatttcattcgacaaattacttgataggagactacatcgacttaaagtcttaatccaacttcaaatttccatcatactacgcttatagcttaagctcatccgattaagcaggcgtcacttggagtttctgcaagtttgcatttttttttattctcaagttattttctatctggtcaccccgaacgcgtataagtcaacataccatcatcccaagattcacaaccactaaggaagtgttcaaagaatattcaccaaacatagcatcgtttgcactgtgacctgtgttatatccatttaatcatcattgcatgatgccctcaacagaatctgaaatgggctctgacccactcaatagctcattgctcaaattgactttaggaccatctacccattcagcaccagcaccgcagtcaggatacattctacggttgactcatttgcctccagatgtcactttacgagaagcatacgctgtgtttgcgcttaccaccgaccttgttgctatagacttggttgaggacactgatacacaagctccactgattattgcccgctttaacaatttcctcactgcacaatctgttgcgcagctactcgataataaacaggttttcgggcctcattttgctcctattaagtccgaattaagacaccgtgcaaattccatcatcaactcaccattattgggctcatttaactcattgtcgccccccaatacttcttctgtgtcggcaacactgaagcgcccttcaattggtagtcagcgctccagatttttgttcagcgaccctttcagtcaagtcaataaccaatctactgggattgattctattgacttgaattccccagcccagtcctcccttgtcaatccatggactcaaccacagtcccaacatcaacctcagtcgcagcattcgggcccaccaccttctcagcatcaacaacaacactttttcaaccagtccagtactggtcaattagtcttgaacaatgtccaaggccaacctgctcctcaaggccctcaagttccatccttgaactctccattccagaatggccagcttcaacaaccaccaccacaccagcagccttcccaacaacaacatccacaaccgcagcaaacacctcaaccgccacaggctttaaaaacccagccttcacagttacaacaacagcagcagcatcaaacgtcgcaacagcaacagcagcaacagcagcaacaacaacaacaacagcaacagcagcagcagccacagaagccgccgcagcaacaacaaccctctcaaccaaaccaacaatctcaaacatttcaaccaccatctcagcagtctcaggatcagtcacagggcggaagccaaaccgcttcaccagataaaaattctagtggtgtcgatctatctctactcatgcgtattcccccacctgccaacccagcagaccaaaacccaccatgcaatacattgtatgtaggaaatctacctggtgacgctacagaagctgagttaagatctcttttcactccagtaaagggattcagacgtctttctttcaagaacaagacttcaatcagtggaagtagtggaggaggtggaggccctatgtgcttcgtcgagtttaacagcataactgaagccgcagaagctctggctaacctatatggtacctcgttaagatgttccagtaaaggtggtattcgtctaagtttttccaagaatcctctgggtgtgcgtaacagcaacaacagaaggaatacatcctacaattaccaaaccactggtcaacctcatacgtcttataaataggccaagagctttgaatgtgaagcatccaaagttttattgtaataatatgtaacctaatattaattctacttttgtccatcttgagagctattgctgacaatagagtggagattcgtcaatgtctcttcctttttgatgtgaacggaatcaacttccgaagcagtgtcgtttagttgtttttcctgttctaactgcttgagaagcaacttttctctaagctttaactcagttgctttcttttccaatgccgcagctctgagcgacagttctttggcagatctgttctctagttcctgtaacttctgttgacgactggctaatcgctcatgtttgagcacgtagggtactgtttctgataaaatacgcaactgtgaccgttgctgttgaggaatagttggagatgatgcaatggaagcaccatcgtatttagaaggagatacggatttcctaaacactgatgattgttttgatgtaggcgtggctactgtagaggctgatttatcagaaacggaatcaactggttgaccaacgctctcattactctttaacgattcgtgcattatcttgtcattttcattgttaggcgttatcgattgagatgccgttatagcagctagatttgacaacgatgggggttctctcgctctggttgaggagatgcccgagctttcgcttgtgacagatgtaagtctctcagttctgtacatctcataaaggaaatcgtgggtcaaatctttcaagtcctgtaaatgtgagcccagaagaacagatttcaaaagagcaaagtctgacaccgctggattgtaaatatctaccgaaccccatgggtacttccttccttttgtggtcactccgtcaataactacatcctcttcggaagcaactatggcgaacggttgaatggacgcaagaaacttattttccctgattgtttcctcatcatcttcatcctcgtcataggtaaactgatatacggggatgttgtacctggcaatgtcactaacaattctctgcttgaaaagtttcaactctgaaggggtgaaagagtctgctcttccaataactggaatgacattcaagtatttagaaagacgtttcattgtttccacatccaattctctcaaaccatgccctgtaggggtgatgaaataaagacaggcatgaattcttgtgtcttcgaatctgggatttcttcttattcgagtctcctctgccagcacactgtcaaactggttttcaacgtagttgctgatctcctggaaacatacttcattgtcgaaattgtcaccgaatccaggagtgtctaggatggtcagcatcaatttcgaactatcactaccatccaccaattcaatgctatgttcggtgatagcaatcccaggttcaagatgaacagattcgggatcaaacgaagcccgggcagaggatgcatcgacagccgccccttctatgttaaaaaatgaaagagtcttggggagcgagtcagacgcgttatgttcgaatcttttaggcacaagatgttgatgaactagactgttgataaaggtagatttaccggtccccattgcaccacagaccatgaaagtaaattttgttcccttcttgacatcctttttgcgccttaacagggctgattccttgttgtacatgttggttgtagagaagctgaaagtgtcagttagcatttcgacatgaattaaaatagatcgcgaagatcgttggaatgcggcagaaggaggagcagaagagaagagagaagagtggagtcatagatagagggagtgaaaaagggcgctttctgactacaatgtttgaaaaacgagttcaatgagcaagaaggataattgtgatcaaaaatcacagtattgtcagtcgtagaaatcccaatccaagggcattcacaccgaaagtactttgaaatatgttatgagtgattgtccctcgcgcatgctatgccatcaccccatactcctctactttgcctttccatagcttaatctcaacttgaagtccttaagcaaatatgtcgctaatcaagacaattgggagtaaagcagcaagtgctctagacagagagctaatgtcaccggaaggtggagggttttccatagatcaattgatggaactcgctgggttggctgttgccagtgctgtctataaagaataccctcccagcaagtaccctaaagtattatgtgcagttggagttggtaacaatgggggcgacgcactggtttgcgcccgccatttgactctttttggatacaaggttcgagtttattacccattgaggtcgaagaaaccccttttcacaggtctacagacacaactagcaacgtttggtgtgccaattattgagacagatgtacagaaagaattccagcaggctgaccaaatcgttgatggaatctttggattctcatttgttcctccagttcgtgagcctttcctggaggtgatcggtcttttgaatgaatactgcaagaagatccccatcacttctgttgatatcccttctggatgggatgtggatgaaggtccagtcaactcttcgtttgagccctcttcattggttagtttgaccgctccaaagccctgctcaaaactttttaaaggaactcattttgttggaggcaggtttgtaaataaggagctagccgagaaatgggatattgatattccgaaatacgaaggagttgaccaagtagtgaaagtccagtgatacatcttaggcgtgttactagtatgctcggaggctaggcatatacttacctgtctatagaaccgtttacgaatttcttttacctctatttttattttggtctctgtcgtccaagaatcactcatggaactttgaactcagcaagactggccattagctctttaacccaactctacttatctaaccactctagtttccgaaaatgggggagacttcccccacggtatcggtggtttgcacctctgaaccttcacatgcaaacgcgaaaaatctggggtaagtataaatactcctcttcggcatcagcatgtcgattctctaactcaccaaagaatgtcccaagttttcaaagacaacatcttttcaggaaaggtagtgtttgtcactggtggcgcaggaactatctgcaggaagcaaacggaaacgttggtgaaactgggagccaacgcctgcattattgggcgtagagttgaacccacagaagaagcagcaaaagagattgcaaaagtcagagagaatgctaaagtgatcggtgttgggggaatagacgttcggcaggttaaccaactggcaaaagctgttgaccaatgtgtcaaagaactaggaagaattgattttgtcatctgcggggcagctggaaacttcttagcagacttcaaccacctttcagccaatgcattcaaatcagttgttgacatcgatctgttgggttcatttaatacagtgaaagcgtgcttcgaacagctacggctaaacaaaggatgtgtcctattcgtgtctgcaacgcttcattaccaaggtgtcccgtttcaaagccatgtaggagccgccaaggctggtgtggacgctctgtctaatgctctggcagtagaattggggcctataggtatccgttgtaacgctatagcccctggagctatcgataacactgaaggtttcaaccgactagtgaccaatcctagtaatgtggacaagtatattcctctgcagagaaaaggctccacctctgagatagccgatgttacagcatttttgttttctgatgctgccaagtatgttacagggacggtgatcccagttgatgggggtatgtggcatcttggatttcccatgcgggatttctatccagagaagctggcaagccagctaagagacaagccaaagttataaagatttaaacacttttcttctcattagtaataaacgtgtttgcaactgcctattttgtaagctgacacttctcctttcactcttctgtccccccccccatactctctgtactatccactttccagatcttcgcgggctcctctttcaaccatccaaatcaaatcgcacacgtctagattcactctactcgcttaatcgattatcgaaacaacttgaactaaccaaatgtctacttgggctatagatccagactctcgcagaaagcttttgaaactgcaaaaggaaggagctaataaaaaatgttttgattgtaaagctcacaaccctcaatgggcgtctccaaagtttggaatcttcatatgtttggagtgtgctggggtgcacaggagtttaggtgtccacatatcatttgttcgaagtattaccatggatcagtttagggaagatgagctgcttagaatggagaagggtggtaatgaacgctgtttgcaatacttcaccgaaaatggactcgatgtaggtttgaaaccacagactaaattcgataactacgtggctgaagactacaaagaactgctgacatcagaagtcgagggacggccgtttgtcaaacctgaccattcgggacagtctcttccctccgttggagctgctgagaaatcgtcacaaccgttggtctctttggacagagaggtctctaacactccatctagtatctcttcaagaaaagagggtgccgctgatagcgggtttgctccttcaaaggaaaaaactgaacagtactttgagcgtttaggtgctatcaaccagcaaagaccagagcatttacctccctcacaaggtggaaaatacgctggatttggtaacacaccagctgaaactaaccaagcaaagggtgctaagaaaggctcattagccgagttcaccacggagtcattccagtccgatcccttgggcacgtttacgagaggttgggggcttttctcgtctactatatccaaatctgttcaagaagtcacggaaacggtaatcaaaccaggtattcaggatttgcaggagtcggagttcaccaaccaagccaaaagagccatggcccagtttgggcaaaaagttcaagaaactaatcagtatgctacggagaggctcaatcaacttcgtgagaatggcgttgctgcttccaacagcaataaccaaaacagaagcggtgagtataccagaatgtatgaggatagtaagaattccggtagatatcaagacaagccaggccagaaggatgacgacgatgaatgggataacttttagtagaggaacgttaatagagaagatgagaatgcctttttgtttttgtagacagagcttgcacttaattgcttccaagctccgcccagcctgacagaattaattttatagatgaaatacgcgcgaacaaactaaacattattttccattctcacctgtttcctttcttgacctttcataacctgtctaaacacgatcagactatcaacaaaatgaagctggatatgaatcttttcatgctatttacggtgctacagttggcctttgcagaagacccggtcgaacctgcggcagtaactactactactggacctacaactgcaaccactccgttaacaacaactacaactccagcagcaggagccgctgcagcaacgactacaacctccactcccaccactacacctgctgcaggagcagctactacaacgtcaactcccactactacccctgctgcgggagcagccactacaacaaccggaacaaccactggaacaggtaccacagccacgccaactggtgtcactactggtaccactactggcaccacgagggccaccactactggtgccacaactacaaatacggcagctacgaccacaaccactaatccgaatgcaggtatgcctcctccggaagttgtgactaactcggatggctcgctttcaaccattccagctacaactgtttgggttacacttaccgtgaacggacaacttaccacagccatgtcgttatactctcagagattttccaacctctactctgaacttgccgaaccatcatccgggagtgttggaatgggaagttttaccggggaagttggagaagtaagagattacgagacaattactgtgagtgataacgtagccgctggcggattagttgatgttgcgggagcccagggggccatggcaagatgcggaatgattggagctttgatcttggcgttgttataaaaagtcacacaacaattatagagggcgctgtacgctattctagacttggactatgtgtatattaagtataactagcactattactactaaatgctgaaagaaggtacgttcttgctaccagcaccactcttatgaggttgaaagtcaatatgatcacgggctgtcaacttcaaaactttcttgaatctctcgccaattggtctcaaaactgcctcatccttggacttggtccagagggcaatcttcaaagcggcacgacgaatgctcagaacaataccgttcacctcagtttctccgtcatcatcctgaatcgtttcaccaatcacactcaacagaccgcgagaccacaattcattgatatcaacctttctgtaggcaaactggtatgtcagttttcctccgttagcattgcgctcgtcttcccattcaggtttgattccatctctaaaaagatgatagtccgacttgactggcaaatcggaggcctttggaatggagttgaagattccccagaactcctctaccgagttgaatgaaatgataggacgtagcaaatctgaccaactttcttgttcatgaacggctggcttcgtataccatagtgtccactcagagttgagcggatgcttaacagtgaaatcaacttggtcgtcaagcagtgacttttcgtgaggagcgttttcagtctctgacattggatatgaagataatggaagagaggtggtgaagctagttggtgtttgtggaagatttttcgctggattgaggagagccaaagagcgtgatctgtcacgtgaattacatgcgctaccaaatttgattggtgcacttgtttgaattgggatggtagaacgcgtgatgtatcatgtgactatcccggagcatttcgcatgcatattttttttttgaaagccctgccatcaggggggaataaataaactccaaaagctcttcctaccaaacggctttattacttccagatgaaggcacaggttaaagatttctatattagttcactcagggtctttaggaagtactgctcctttattggaccgggtcttatgatagctgtggcctacattgaccctggtaactatgctacaggtattagtggtggtgcttctaacgaatacagtttattatgtgtcgtcctgatgagtaatattatagcaattttcctccaaagtctttgcatcaagttgggatctgctacaggatatgatctgtcgcgttgctgtcgggaacaccttccatcatggatgaatatcgtcatctatgtcttcgcagaagttgccatcattgctacagatttagcagaggtcattggttctgcaattgcattgaacatccttatcagagttcctctttgggccggtgtgttgctgacagttagtgacgttttgctggtgatgatggcctggcgtccaggagcatcgatgaaatttgtgcgagcattcgaatactgtgtggcagctttggtgctaatggtagttgtttgcttctgtattgagctgagctacttgccaccaacagctaacgcacgttccatcttcagaggattcgtcccttctaaacagattttcgaaaacaacggtattttcacagctgcgtcgattcttggtgccacggtgatgcctcactctcttttcttggggtcagggttagtgcaaccccgtctacgtgaatatgatgtgaaacataacattgtggccgcccctgctgccacggaaaagtcagagtttgaagagagctactactcatacaaaccatccgtccaggcaatcaagtatgccctccggttctctatcgtggaactgacggtaaccctgttcactttggctctttttgtgaactcagctattcttatcattgctggtgctactctttacggcactgaagaggctgttgatgcagacttgtacgacattcactctctcctctcccgaacaatcgccccagtggtgggaactatcttcatgttggctctgcttgcctcaggtcaatcagctggaatcgtttgtactatggcaggtcagattgtgtgcgagggacatttcaactggagcatgaaaccgtggcaacgtcgtatcgtcacgaggtcaatatctatcgttcctagtttggttatcgcaatcgcaatcggccgtcaaggattatctgctgcattaaacgtttcccaagtcatcttgtccattaccctgccattcctgacagccccattgatttacttcacttgctgcaaaaagttcatggttgtcacaaccggagaccaagtgctagaccttacaaacaactggctaaccgttactgtttcgttcaccctttgggtattaatttcagttatcaacgtttacgcattggtcgaattgggccgcaacggtttgtagggtgatgcgctctatgtctgcttggcccaggttctaggttatttttttttggcgcgggctgcagtttgacctgacgttggagaggagatacatattcaatgcacgaccgcccatttctagatcaccttctaggttgtgtgagagttaaaatttgatttacactagcgtcttggtcctattactgaacttcttttcttccttttttttttttattttttttcctgctcttctcctctcttgtgcatttggagactgtgagatagatggtgcaatatcaatttatcctgtaggttcctttgtgcataggcgtttatgggaaaaccccgttcggaattggaaactggggcatacgactccagggcagcctgcatgcgtcatacagagcacaaccaaatccgactgcttaagcaacagtacttttactcaaaaaaatagatgtcgagactaaaattatctgacgatcgtgagtcaacaggtgcttcaaaaacttctctcggctaaaaattgtatggctaggtgagtgttgagagattgctggcctctagacttccaagtgtgactactgtaatgtccacaagtaaactgactttttgtctcgtctgcccgtttggctacagaaactagccagcagtcgtcccatttttagaatatgtgaaaaaggagtaaggcagtttccatggtatcctgcggtgcacgaaaaaaaaaagaaccaaacaatactcagagatgttccagaacatgtagttacgtcagcctgaaaatttcggtctcgagctagcaactgaaaatgtgaactcaggttatttaacgcgcatcttcccatggatacgcatttctgttgtcgcccgccgtttacattttgctactaagcattgacttgaaggtatggatcttagggataaggttgatactgctgcggtcaggagcctgcggctagacataaaggacagtaggaactcctccaaattagctacgcccgtcggatattcacctgtttctaccaattccgaagttgacgagctggattctctcaataaggatacacagtatcagattgctacaatgcagtatttaaatgaaatatcgcccaggggctccgacataatcgtctctccattgagcctgggctcttccgtcaataactattttgagagacagcatcataggaagaagtcagagcctacggcgtgtagcgcggatcatgcggatgaacataagaagatgaaccacataattcagtggtattgctgctcgtgtggcaaatcctttggggatctaactgtagcccacgagctcaaagacaatagaacagaacttttaaaccactttcaatcagtctcaatacggtatgattgtgatagatgcaagcatatgatgtgcccttattgtttgaagggcagattgaaagatttggtataatacagaaccagcatcacgacaaacaattgcataacagatatacctcatgtaacactagattaattaataatagcctcttattagagctctttctctttcgaactgaatagtagttccagtctttctcttccaaatgcgtcgatctgttgcaactgttggtctatttcattgtaattgatcaccatgttgtcaaaggcgtacagtatccccatttgcttggcgttgaaacgttgttgtgcatccagctggaattttttgaagacgtaagatttctggaatagctctaggttctcatcgtagtttccgtcaataaacgtccagactttcttcagagaatccatatcaggcagcttgggatagcgctgcgagaaatgcgtgagaatcagcttgcgtgcggtcataagcatcgaaacatatattgcctctgaaatagtagagtgtctcttgcttagcgcatcttccattagttcatcctcaagggtcgcttcatggattagaagatcactattcttaccaatctcgaaagcaaaacggtggtttggcctggtgtcccctgagtagctgactttgaaggcgtctccgccaatatcaaatgtaaaacccactgagtaggcccattcacaatgaatggcactgcaggtctgaatgcctgtcagaccaaggtctttgaacatggtttctgtggaaatacgctgcagggggatcttcttcggtgtgattgtttgcttagcatttatcatttgttcaaagctgacctgttccaacgaagggtgcgggtttgtgtggaactgctcacagctgaatatcttcagcctactcaaatctggcaggtcatcttgattgggcagtcgggaccactcttttaggaaagtctcatattgccagggaataatgaggtataagtctgtattattgtgtttaaatcgttcttcgatcagagaaatgataccgagatgatggtcggcatgtagatgactcaaataaatgcattgtagttctttgaagaatttggggtaatccggcccatatatccttttaatagaaccaattgtattctctcctccgtccattataatggatctgtattgtagcttgccatcttgagtgtaaggaaccctcagaacagtagaaataacatttcggtacttggatggcagtgacgaccctgtacccaaagtaaccacttgaactttatcctttaacgtttctgagtccgaaagggagccactggtgactagcttattgtcgttaatatatggttcaatgctgtcaaatgatataccaaatgtgtctagtaacgactcatcgaaacgagccttccagaactggttgactgattccaaagagttttcaacgataacagcatcaggactaccaggcttcaacacaacagggcaagaccgagtattaagtatgtgaacattagatgcgaatttttcgttgaacggagtgccgtttgaaagtgatgaataaggcagttgaaaaaaatttggaaacaaagccttgagtttcagtgatactaacgatgctcctgtgaagtttataagattattggttatgtctttgtgtgaaacaacaaattggcaatgagaattggcattgaaatagttcaacagtattggatgaattcgacttaggttacacttttcattcaggaaaatgtatactattccgatatcctgggaggatgagactatcaacggattatgcaatgttggctcgagatactcgtcagaaggaatatccagcactaacagttttgggaagcttttggactcttccacaacgtcagatgattttacaactgttactccatctggtaaaaggacatcttctcctttagttagttgggcaaacgtcttacctttaggaaccccaagctcgatagctttcttgacattgaattttcctcttacgggatggaagtctataagataattagtggaaaaggagttactcaaaccatcaactgtgggcaacttgacttgggatatacgatcaaagttttttctgttttcagaataattattcaggttgatattgagcgggaatatgtgggaaattattgcatccagaagtgacgtggaaacgttgtttgtagcttttggtttcgcaggactgatattaatcacattagctttgaatgagtcagtaatcaactcttcctcctggtcttgaacaattttgacatccaggttcatgcctactctaaaaatgaagtacctccacgtggcaatcacgtatttaagcagagggttaccgtatactatgaagaaactgtccctggacttttgatcgaaaacagtcaagagaaaccctggaagaccaccgattctgttccaactcaactttcccgttagaaaaacactttccgtcttcggcagcttgattttcctctcattgaccgttctctgaataccttctgtaactgatccaatgaagaactttttggagtttatcttctcctcaaccacgatcagaggatggttaagatcgtcgtttgggtgggccacagtggtaatttcgaacatcttgggaccggtgaacgagcgtttggagctgtaataacgggctgcaagacgtgctttagatcccaggggtttaaacaagggattgtggagcttcagtatggacaagaaataataggagtgaaaaaaaatattcagaagatagatgagaaggaactctgttggagggggccattgggagggaagtcccacggggaaaaaaagacacttggaacgagaaccctggtaggaaaaaaagagaatttcttgctaagaacaacattccctatgtagcatttcaccatcgatttcgtccagaggtaaacaacgctgacgacgactgtagttcaagcgacgtaatgcaagagccatgagttaaccaaagtacaagatatcgaatgcagttttcaaatgaggtaattgattctcatgcagtgactcaacgggcaggcatcgaactaccaatcacaatcccaacttgtacaacagctttggcttgaacaatagtggttggatgttacccggtgcgacaagtgctgagttgcggtaatttacgatttcagcgtccaccagaatgggaattccgggtaacacgcataccaggggaagaatatcacaaagatcacagagattggataaaactggaccagaaactaccaaataagtagaccgtcatactcagctcctacaccaagaggtacttcagccttttaccggtttaaaaagccccccgaaatcgactaattaccgaggcattatgtttactactgatggagatttcgaaatatccttcccgattagtccaacatctcgaaattaaactgcgcagcactatgccgaaagctatataaacaatcatttccccaactggaacatcttttttctcttttcttcgtgtatcatcctttggtcttttaatctttcagaaaagttttcattaaaatgcttccagctggtgttattttagtcttttgtctacttttcattatcggggtaattatcgcagttatcctgggcatgaagtggtacaagaagagaaagaactgagcatggacgaagaaaattactagaccaaagatgtatcaccaaacaaacccccccaagaatctgtcataaacgaagttgttataggatggttatcactctcacattttaatacaggaataccctaatttttcctcagttcggtgacgaatggagttgtagttatctttctttccctcgtttctgctcttatttccccctctcgtcgcatcatttgcatcaaattggtgcaacgtgcgcgcacgctcggctttggctgcaacgactttctgtcgtgtaccgacccatattctatcgcttcgggtagtccgcaacaccctcaacttcctaattttgtgttcttacaagctgcaaaaaagtaggactcactcaataaggtaagtccccaaacatcaatcccaattgggtaatccatcaaacactaacccgcattcatttagcatgtcagacagctctttaaagcaagaatctcaaggcaaccctgtctctgctggtgctgagtcaggtgcaaaccccaacgacgacaacaacaacaacaataacaacaacagtaatgataatgccagtactcttcgaacagagaaccgtaccataaacgacgatcttgatgatgacgacgatggtgaacctggctcttctaggacgccgagggaacgccgtaagattgagatcaaattcattcaggataagagtcgtcgtcacattaccttctccaagagaaagcgtggtgtgatgaaaaaggcctacgagctttcagtactcacagggacacaggtattgctgttggtggtttcagagactggactggtctacactttcactactcccaagttgcaacctttggtgactcgtccagaggggaagaacttgattcagaactgtttgaatgcctcggacgacccgagccaacttgaccctcgagggccattgggtgattccaatgatgttccaggacaatctcaaggatcctctggcccaggccatggcgaagggtctgctacgcctaaccaaggcgatgttttagacggaggccatggtcaccagcaacatggtgcacctaactatgcccatcctgctgcggcagctgctgtagctgttgctgctggaaatcacccacatggctctggtggtgggaatgagaatgctggaggacctgtcggaggacctgtagggggacctgtggggggccctcaaggtgctggtcaatctggcggccaagttccttacttgaatcctgatgggtcggctgtataccacccatactactgattgtatagtttatattaagagtgaaggtataagaatcaacagtgttttggtagttaggttggcaagttatttgcggtacctgtcatgtacgcaagcattctttagttgggttgttcttctagaaggagatgctaggcagattggccctagaatctcgcgagcgaatgctgaatcatgttcagattgttttctcctctgaaactctttcatacaccaatcaaggtccatgtcgacatccatctatgaaatgttccctcctggctcggtggtgttagccaagctgaagggatatccagcatggccgtccatggtgatatcgcctgagaagatcccaaagccaatacttgaggcaaaacctactagattagccaacaggaaacgaacgcgtcaagcatctccgtatgaagaagacatgatctgcacaaggtttttccaggacgataactacatgtggtgttctcccgccgacattttggagctaaccaaggatgagatcgatacttttttgaataaaccacgaatcaccaataagatcttgttttgggcgtaccaattagctagcgatcctccttctctggatgatttcgtcaagtacggaagctacaagcaaggagacgatgaagacccagattttgacgtggtggaaggtggtgaagcaggaacctctgatttggttgaagttgatgatgaggatgacgatgtagaatcactcgatactgaagatgaacctccaaggagaagaagccgtgccagggcagccaccaaaactgccgcaaagccagctagaacgactagagccagatctactagggctaaatcgaaagtaacaaaaccaacatctaaacgttcaacaaaagctaagacagccaaagaaacgaaggctcggtccaagcgtcaagctccaccgcctccacctcccccaaagaagaaacctgcaaaacctcctgctcccaaatttgactctgattggggaatcgaggaaggtaacgactcgcctgatggtttggaggagtacttggaagttattgagaacgtaccttcagctccagcattggtcaaacaaacggctacacttagaccccaattactgaaaatcagagtcacactgcagaagaactttttaggcgataccccaccgcataatcaggatgtcaaagcatgcctagacaaattacaacgcctgagcgcgtcattaggaggattattaccccccaacctcattcgatctaccaacttgcacagggttgctggtgccatcgtacaccatggcctggctgataagagaaccatatcacggttgaccaagcaattggctttgtaaattagactagattctattgtaaattattagtgcatgagtatatgcttcttgagcacgtaaacttcaaacgcgacttttatcaagaaattaaattctgagccccaaaccacttactgatttaaatagccctaccagctgttttgtgacagatttcttgagccattgagccctgctttgaatttggccagacgcagagtttactacgctcaacgatgaatgtcagtgttgcattaaatgaaattccagaggctggtcctgggaagaaagtcatgtttacgtcaatagcgctcctggtcgggatgtatccgccaacgtcaccaaagtacccgggacgtatctacttaacagatttttcagagattgcacctcatattgatccatgtcctgatcaaattgctgttagaaagctgggctatgagtttgacgtcaaaaaagttttgagatgttacatcttccaggacgtcctagatagatttttcagcggagtggaccctctgttaggagatgatgacatcccagtgaatcctcccatggataccaaatattctttaaattctctgttggaagttgctgataaagcccgtatcgtggggtttaaaggtcaagtcactgtggtgagaaattctacaaccgaaactgttagaatctcgtccatgtggtacgtagatgatctgtatagtctgggagctcatgatctctttctttattcagctttcattggaagaatgagaagagactgtttaaagctatatcagttggaaaaggtccgtctggatcgcctactaaattctgaggagaagataagctggagaccaaaagcagtagaaaatgggttgggatcagacaaaaccagagatatgaagatgatgtactcatcttcaccatgctctttatcaagagaagattcccttttcatatcaaaacgatcaaggacgtcaaatgattcctttacagatgaaagatccagtacaaaggcattaccggtgtcggcgggggcatactcttcgaatcctacagtggcagaacttgccaatcgtttttctggtcttaatgacgttgttactgatgaaatgttcctcgtgacagccaaagtggttgaagttctccctctagatatggaagtggtgtacaaaacatctccctcggggtcactatttatacaccccttgaaccttcgtattgccgaccaagtgttactgtccatatcacaggaacaatacattgatattacaattggaattgactggatcctgcgattttttcagtatcctgacttggagaaactgtatattgattgggtttccgtcaaaaacaagttggagacgatcgttacgaacagacagccaattaaatttagactacgaagaaaacatgttcttgttgctcccgatgttacacaaccagcatggcatgctatggacttgactataaacgacctggtgtaggttggtgggggtgggtagaaatgttatagatatatctagtatcaataaatcaaacgagcttgcaggtgcgcgtcccctccagattacaccttcgcgagggttttcaatctcgaatgctcccgctcgatttcgtctatgcctgcgatctctcaaacacgatcttcagagaaacacgcaccacaacaagtcaacatctgtccagaatacaacacaatgagtgattacattgcgagcagtgctgctcttagaaagaaaaagaccttgaaaaaatcaatcaatttttcagtgatggttgtgggaggttccggatctggaagatccacatttatcaatagcttgtgtgaccagcaaatagttgacatttctgccaacaggctgcctgggccacaagagtttgatcctgactcacctctgggatttttattccaattgcgtcgcagtaatgtggagttggaggataacgaaggtgtgaggatctcgttgaacatcattgatactccaggctttggccgtggcgtggaaaacctatcacagtttgaagtaatactgaattatatcaaacaccagtatgacgaaattttaattgaggagagtaaactgaagcgtaatccccgctttaaggatggaagagtccactgctgtctttatttggtagaggcaactggacacggattgagagaaattgacgtggaactcatgaagcaactaagtacgttggttaatttgattccggtaatcagcaagagtgattcgttgacagaaactgagttacaattgaacaaacgtctgattagagaggacttgacattttacggaatcccagtctacgattttaacgacgaatttttccaaattgacaaagaaagcgactatgaaagttaccaaattgcacagtacctgaataacagtgttccatttgctgttatgggcagcaacaaagttattgactcggcagaccctgcaactggacaccgccgtgttcgtgagtacccatggggtctggtagatgtagatgataacgccgtttctgagctaagtgtgctgcgcaatactcttctgatttcgcacttgaatgacttcaaagaatatacccatgaagttctctatgaaaattacagagcccaggccctagggaacgacgatcgatatgaaacggatggtttgattgacagcaacagatccccaatcagttattcacgagaccagtcacagtttgatgctgtaacaaagccattggttgcggactcctatttggcaagggaggaacaaattagactagaggaagaaaggttgagagtatttgaagagagggtccagagcgatctcttgcggaagcgccaagaactcgaggagcgtgaaaaagagttggcagatattgaaaggcgtcttgcctctggagcaattgatgtttaaatgtataaagcagttgaattgactaggtttgaggttgtgacaagacagtagtttacgagaagctggatttaacatattccaggatcaggtcgtgttctaccaaatcgacacagtgcttttttttcagtgtttctctggatctcctctctcttcaactattccttcgttcttggaaggaatagatcttgttgttaacttttccatggttggagggttggtgatggaaccattaaacgtgattgccagggatgattaaccagatagggacaactgatcttacgatgagaaaagtctgaggtttgtttttagtagaactaccgtttctgaggcgtcatgagatcaaataagaccacaccaattgcccacacgacacccattgtttctgatcaagctttctcttcaagaatgccatctatttgcgaagttattcctttgtttcaaactttgcccttgcatttttttttaatccgattttttctctcgtaaaactaaaactaccttgctggactatttgtctctcaaattagatttttctcctggtttgacatcgagccggttgctcgaaacagtggttattgcatgccgaaggaaccctgcttcgcatttttacctctttgtagatcttcctaagtcacacttttaaggcgactcaagactttcgtcatgaatcaatataacggctggacatttgtcttactgtcctctctactaacgattctgggggctttgactgtttacctagacagtatctacaacgcgctcaccccaaaatggctctctaagcgttatccattacagattacgggtaacaataacttcctgacttgctctctagctttgagttctggatgcctcatgttcacatcgatgttcaagttgttgcccagctcgttagaatacttccaacagtattttaaggactccgagttgtttgcattaaggtacaccctattgttctatgttttaggaatgctgttttgtggcattcttaacatgatcatccacttcctcacaagtgacagtattgttcactgtgtccatgacactgaagctaatgatccagttgacgaccatggtgcccacgatcaccacaataatcacagccatgatcacaactcggaacaccatgaacatcaacatcgaccgatggaaatgctttcaagccggaagtcactggtagatattgccctttccaagatcaaagatcagccattagacggtaactgtcacggatataccactgttgatcaatgcaagagtgccgagctagagccgcttttatctaattcctctgctaacaacagcccaatatattctcaaactggacatgatatggaaaactcagatgtgttttccaactatgaagaacatcaccaccaccatgtgaacacccctacttcgaaacttctttcgatcggcgtgcaaacactgctggctatcacgttacacaagttccctgaaggatttatcctctactccacctccaaagttaaccccgaactgggtgtagccatcttcctatccatgttcatccacaattacatcgaaggaatgtcaatgtgcttaccactgttctttgctttggactccaggctgaaagctgtcagtattgtttcattagtcggtggactagcacagccattgggtgcctacctagggtacttatatttccagactcataccatcaacaaccgtacaaactttgtgtttgcagttctaattgctgcaacaagtgggtttttaaccattatagggttgcagatgtttgctagtagtttaagttttggtggatctcaatttaaggtacttacatgctgcaccacaggtattgcactaatttcattaggctacacaatgatatgacatcgtatacataacaactttaaaacactaattaacaagctcccgcgtgtttatgatctttgattgacgacttgaccaaattctcgctaccgtccaaagcaatacttagaagcatatcgtaaataatgtctgtatcctccaaagcatcgttattcaaagactctctaatcaacttgcatgagttagtcaaaacagttaatgtggacactatgtcactcatcagcttctgaagtagctctagggttaagttgtatctaaccaccacacgaagaatttctctctcatcatccttcactggtttagttgttcttggcagaggataattaggaatgatccaacccttgtttctcattaaagtggatatgattgattgaggaatttcaggatattgcttggaaaactcttcgttgaactggaaagaaaccactggcaaactgggatgaaaagcaaggtgatcatcagcgtgaggcgttgtgcccgcttccacaggacgatgaacgttcgataccaccttgaagtagttcgtctcttccaaaaaggatgaaagaagcctggcatttgttaagcatgtatcaaaaatagacgagtatccattctttcctaaagcgacaaaattgaaatattggtggatgacttggtgtcccggacgggagaagtttagagtaaaactgtattctagaccacccaaatagcgtaattcaaaaacaaggtctttaggaagccattccttgtctttgaaaacaatccaacctaaacctgctgtgacgagtccaaacttgtggcctgaagtgttgattgatttgacacgaggaactctaaaatcccattccaggtctggatagataaaaggggcaacaaaagccccggaggcgccgtccacatggattggaatgtcgaatcccttctccttttcaacacggtctaaaattttattgactaaagcaacgtcctcaaaagcaccagtataggtcgatccaagaataacaaaaatacctatggtattctcgtcacaagcatcatatatcaaatcatagtccagaatgtagtcattgttgtcacacgaaatgatacgagcgtctacttcaaagtatcgggcaaacttctctaacgcaacttggcaacaggaagccatgataatgttaggcttctcggtgcttttaccagcagcacgcctcttggtttgccaatttttcttcatagccagtcccccaagcataatggcttcagaagagcctgtagtggcagaaccaatgctcttcttagaatcaccgttccacaattcagtaagcatttggagacatctttcgtgtaactccagcatgactggatactcatcattgtcagccaagtttttcaccaagttctcatgaatcaatggctcactataatcgttgatgtaaccagtgttaacaaacgaggccaagttcaaagtggggtttccatcgaggttcaaactatcgtggattgattcataagcaatcttggctggtaatcctgaatcagggattgaaacaccgcagtcctccaatcgcaaactcttccatttgatggatgataggttgacattggtagaagtgtgcgttacatgctgcagtttcttctgatgatgtacattcttcttttcgaggtacttttcaataagcttctgttgatctggagtaatggaactttctcttctcttggtgttgtttgatagggtcattgggtttgagagttggggaaaactagttaagcggtgaataagaagactgaatggaattgggatatgttagattatatgtacagcacggaggtagcaacagcagctgaaatttgcctggatggcgcgacaatatgcagagtcatgtcacgaatacagaaatagttcttcttttgcctaaaatggggatggatggttttacagccgacgtttgacttcatcgtggcttctgatgtgcctctctcttggagtcgacccgaccgctgtaccagagcccccaatccttgttgagcggacattctcaccgttatctagaacactttcaagggttgaattaagcacgtccgccaaatctgcagattgggcttctttcgctcggttttgttcagctcggcgttcttcttcttctgctgcacgcagcttattgatctcatcattcatatctcttactcgaaagtcgtggctattgtctttctcatcttgcagcttgccatagtttttcggtagttcaatcctcaaactgggctctgttacaatattcagcacgggcgcaatttcttctttcaatactctttgattcaagttgtgtttaagagcgaagtcgtgaatacttgaatctccaaaagcaccactcttttcggctgaagcgttggttaacgtatgccagtcccgaatcagatcggcaagtagactgggtggtattgtagttaagcctccttcgtgcgtattcgttatctttgcttggtagttctttttcggcgccttttctgtgttttgctcgtcctccacacgatgggcctcagcatccttggcacgggccctcagtgaagtcagagcttcatgattagtgttgaaaggtaattgttctgtgctgactcttatattgtctttgttcacaagattctcagccaatttgacgaatgaatctttctgagaggtaggtgcctttgttggagttttcgttggttttgctaattttactggtttgatctgagtggcggccttcgttgccctttgaggcaatgaccttttggtggatacagagtttcccattagacgatggatgagaagtataaactcgatcctacttaaaaatggggacgagaaaaccccaaggaacatgctaattctaatggtttaaactatttcgcgacggagctgtattttctcactcgagggagttttggtactaacgacctccaagattgtttatgtcgttctgcattcgccaactccgcaacaaaaaaaactgccttctaacaacaatcagttcatcttcgaccttccacaacgctactgtcatggactataatcaggtacacttgaacaccatacagcagctcaacgagccgcaaaaatctaatacgccccctgcccaatcacatatgatcggcatgcctattgttccagtataccctactgagtatccatcagactcaatgcaacactcgccaccagatagcacttcgagatttcaacatttacttgtgcatcatcgtaatgaagatcctcagacacagaagtatatacaggagcatcacatacggcaattgcttcgtcttgaaaaggaggagcagcagcaaaaagaactacagcaacagcaacaggaacaggaacaaacagaacagggcgaaagcgaatccacagagcagccatcgattagagtaaccaaggacaagtataacattaatgatttcaggctggtacgcaccctgggaacgggctctttcggaagggtgcatttggttcgatccgtccataatgggcgttactacgcgatgaaggtattgcgtaagcgtcaagtagccaaagccaaacaaatagaacataccaacgatgaacgaaagattcttgcaatggttcaacaccccttcattacacgtatgtggggcacatttcaggactctaagagcatattcctggtgatggaatatattgagggtggggaacttttttcactccttaggaaatccaaaaccttcccaaaccaagtcgccaagttttatgcagctgaagcatttcttgcattggagtatttgcattcacataatatcatttatcgagatcttaaaccagagaacattttgttaaccaaatcaggacacatcaaactaacagatttcgggtttgctaaagaagtcaaactgaaaacttatactctttgcggaactccagattacatcgcccctgaagttattgcagtgcaaccatacaacagagctgctgattggtggtcgtttggaatcctcatatacgagatgttgagtggaactactcccttttacgaccagtcacctatgaagacgtatgagaacatcactagatgcgaattgcgatttcctcccggtgattcttttttccaagcggattcacgggaccttcttactaaacttattactaaggatgtgacgtatagactagggaaccttcaaaatggatcatatgacatcaaatcccatgcttggttccaagaagttgtatgggagaacctcttgaatggaaatatagagactccatatgagccgaacattccatcaggagtgggtgacagttctcaatttgaccattatccagaagacgaatacgattacggtgttcagggtaaagatgagtttggatatctatttccggacttttagtctttaatacataagtcttatataggttgcagattatgcatttgatgagtaagatctgctgtgcgtcttcgtagggagttaagggctctttcatcgttactacgtcgagtgatggcatccagtattgctacctgccaaggtgagtaacagtttttatgctggtggacgccagccagcagcgtcacaagttcagggaccaaatccaatggcacaacctgccacagggcaaatatgtcatcgaaacggttgtgctctgtcaagcgatctaccactctagaaagtctttctttccgtctgttttgatttgtcttgtctaatgcaaaataggtacgcatggcggtgcgtttactatattctgatagtgtgccttgctccatgtatggcagccatcttgtctcaaaaatacgagctagctcaatgtcagccaactcagcctttgtaccgttattgagttgtcgcctacatttgtacaatcgtattgacatggatacttccacgtcgttgtagtcctgacctctccatatgttacactccctttgggcttgagcgatatgcgaaatcagtgcctctatagcagacgaatttcgcaaattcttattgaacacggcagcaaaagccaaccgcttgtcttttctacctggtttcctgagccataacttgacaaactgctgaacctgttcctcgcttaactgtcttaccgattggcacctctgttgcaagctcttttgagtgccttgtgctagctcaactacactatctggtgcagtgaactgtttgattgatacaggcttactatccagtagcttatttaatcctctatcaatagtttggaagtgatgaacttctaattgcttgaatgtggaattgtcatattcatctcgcaaaactgcatcaagctcacttagaattttgaacttttccgaatcagtagctggaagggttctagctcggagaagcgccggaatgtgtgttttgtaccgttttgtcaacaactgcaggactctgccagacatgtatggtactgctagggatgagatgggattgagatttgatcagttttatctactacatgtattcgcgcatcataaacatggccagtaaggaagagatgaaagataatccaggcgtaactcaactagcttggcatccaatgtcatctttgcggatcaaaagatgatcgtaatgcgtagttttaattaatatctactcaactatgtcacactcaacatcctggtgaggctgccgtcatcagcaagaatcctctgaaactatctaacctagactgtttcaaccagttccttcacaaaactagaagcgtctttgcttctcattagggcctctcctattaaaaatgccttaacattctgcgatcgatagtgaagtgtctccttggttccaaagattccacttagggctataagaatcacaccatcgtcttcaataatcaatgtggatatctgtgaagttgtgttcaagtcaactccaaaatcgtgcaagtttctattgttcaccccaataatcttgcttccaattttcaatgctcttttcaactcagtttcattgttcacttctaccaagggttccattccaaggcttagggaaaaattatacaaagacttcaaagtctcatcacttagcattttcacaatcaaaaggacagtgtctgccccggctagcttggcttccagtatttgatagggatcaaatataaactcctttcgcaaaagtgccggtctgttgggtatgccttccatggcaatgcgagcatatcgtaagtcgtcaatatttcctttaaaccaggtgggttcagtcagcacactaatggcagcacatccagcagtggcatacttgacagcctgttctgctgcattagcgttaatatcaatatctcccttagaaggggacgctctcttgatctccgctaaaattgcagacttgccttgtgaaatagtggattgcaatctttgatagaaatcaatctgtttgggtgcaagtccccaatcaatgtatttttgcaaatgctccaaacttttaccaggcaccttcttctgagcctccacatcttgaattcgttttgcgaatatctcatccaatatagacttcttgggttcaggtattttagcctgctcagtttttgaggtgcttgtttcccaaagacctgtcgagtattccagcatgtttcttaccatcctgtgaccctcttcagtcaaaatactttctgggtgaaattgtacaccttcaatgacatattctttgtgccttatgcccataataatgccattatcagttttggcagtgacctctagtactggaggtaaacttttggactctgcagcaagtgagtgatatctcgtcacaaccactccgtccggaatatgttggaacagccctttgccgtcatgagcgatagggctggtcttcccatgaacaatctcgccagcgtactctaccacacctccgaaagctgcaatcatacattgctggcccatgcagacaccaaatataggtatcttacccttgaatgtcttgatgacgtctactgaaattccactatcagttgttggatgaccagggcctggggagatgacgacaacatcgggattcagttgagagacttgctccaatgtaatctcgtcattcctatacacatcaacatgggcaccctcctggcacagatactggtacaagttccaagtgaaggaatcgtagttatcaatcaaaaggactcgtttagtcatagtgaaaattactgaaaagaaagtcagggaacttggtgctacgtattactatttcgcgaagggttttgatagatgagtctaacagacgaagagaaaacatcagtggaagggctcgctactaagtgtcttctaaaaaattatgtctgtcgcgtattcccttcttcaaatcaattacagctaacgcgttcacaaccagaactgatatgaacgccatcagagtagatgcttccgtgctgggacggtttacaacctctccaattaaacttataggtaaagttgtacatcatgattcccgaacagcgcaagtagagtcgaatggaaaggtgactgttaacctagcaagtgagagagacgaggatcttcaaaatggctacttttacgagtttgtcggcaaggtcaaagacgatggcagtgtgcaagagttcagcagaacttccatgggtaacgcacttgatgagcgggccttgaaagtactggtgcaacaagtccatgctcacagtgagctgttttattgatattcgaaacacagcaggtacagtaccgcagaggaaacagggaaaaaaatattgtggtagagtaaaataaaatatacattgttactatggtttttaagagtgaggcagaacttctcagtaggcccatcggcgttgtagagcagtagtagcttgaatgaaaggtctgctaatacgtctgctggctgcataccatcctccgttctgtgaagggtaaggagcgggtgtggcaaagttaactgcagaagtgtatgagtaatcccaccccggagttatggtcgaatacacagctgggctagggactagtgtagagtagtaactaacagagctggtggggtatcttctagtccaaccggttgcggacacagtgccagatggttgagtttgcatgggagcataccgcgtacgaccagtttgtaaggtgtatggtacggtaaaagatttggatatctcggcattttgtgcgttgctcatggaaatgtcgtttgctggaggagaaccagaacctgaaggagtcaaagtacctgtcatgctctgcagggaaaatctatcagaatacacgatggcataaccacccgagtatttggaatatatctgtaaatagtagcttccgcttcttccaaatgttgccagtacgcttgcatcgtattcatacgtggagcccgacagaaggtcagcggggggagtggtctcaatttcggaacagctgatgtcaccatttggaccagtacataaggagataaccaagttactggcatctgcaatgctggggaagctttcatcatctttgaactcaatagggatagttacggtcgaaccactgacgctgaaggtttcaccaccttcagggctagtgaactccacgacagctaaagcttgtgagataagagacaaaaccaataaccaaaacatttgaagtgtcgaatggagaaagtaaacgaatggaatcacgttcgtgttcgatctggttgcagttgttgacaaagtgaaagacagaatagcacaggatagatttcatattcagcagcgtgaggcgatgctgcttagtacacgcccaaaacaaatggtgttaagaatagaacttggcaaagaatgttagcgaaagaagaaaagaaacctacatgaccgtggaaggagcgcggaggcacctccgcccactagtcctctccctctactgctcctccagttctaagatttcaggtatcgaatttctcattttttcattacctcactggaaaacattcacacccacaatgatataccttaagacgatgcttaaatgcatcgacaattctggtgcgcagatggttgaatgcatcaaggtgttgagaaagaacccgaagaactttgcttccattggagacaagattgtctgtgtggtgcagaaggccagaccttccacttccacgatcactggtgcttcggcttctaacagagtcaaaaggggagacatagtccgggcagttattgtgagaacaaagaaggaaactcagagaccagatggttcagtgatcagatttgatgataacgcatgtgttctgttgaacaagaatgatgaacccatagccaccagaatcagtagcgttgtagccaaggagctgcgtgacaagaactttaacaaaatagtatcgttggcgcccaaggtcgtgtaggacgttgtgatgagtatataagctgtaaataggaagtaatataggtggttctaccgttggtttactgggcggattcgctcttaggagggaaaccatcgcattgtagtcagatttcgctaccaacctcaaaacttttcatcaccgactcaaatcatcatgtcccagatgtttcccaaactgcccacgggcagattcacaaggcagtttgccagattgaacaacattgcaaactttccaaatagtgctgttagggtccctgctaccgtaaacagattggagttagttctgaaacaaaatgtccaacaaggtcacatgggactccaccagttcaagaaatggaaccttccgacgatccaatttcacaatccggaactgtgcattgtcgtcaagagagtcaaggtcgagtccaaggatgaagcactcaaagttcccgctagtttggtgataaattacactgatggaacttcgaagacgttcgactgcaagaacaaacgcagcgaagatattatgacacagtttattgaccttactggtgctgaaaaggttccagattcggagatccctgtatggggcaggaaataattatttgtatatagaatgatatgaaactgaaagataagaccataatcataccgtaaagactctcgttgagggaggccccgaccagactgacagcagtttttggtaaaggtaatcacgtcgaatctcgtgctttcttattggctacgaattttttttctgttgacggttcaatgatgcaagatgccatttagatctgatcttctcaatgtatccgggcatcgtctcttatgtggtggaaaaatcacccctaaaatgcccttcaaaaccttaagatttctctgctaagcccttatttcgtttaacagcatggctctgcctcatagtgagtttataccgactcctaatgcctcctccatggtgtctacaaccacgccactttctttaatggtccgtctcttctcgcctcgctttcgcaaagtggtctcactcgtatcgctcgtagccacgaaaagttggaaatataattttattataagacaccaataatacagcactctacaacaatcattctctagtcatatcaaacatgagtctggtccaggagttgattcaaaagataagctctttggagctcaccttggtggaaaagctttccatcctgttcgtagctcccttcttgttgaacgcgctatggcagtttatctacagtttcagaaaggacagagttcctttggtattccactgggttccatgggtaggctcagcagtcacatatggaatgcaaccatatgaattttttgcagactgtcaaagaaaatacggagacgtgtttgcctttgttttgttgggtaaagttatgacagtgtacctcggaccaaaaggccatgagtttattttaaatgctaaactaaacgacgtttgtgctgaagatgcctacaagcacctgaccactcctgtatttggtgaaggtgttatttacgattgtcccaactggaagttgatggaccagaagaagtttgttaaaggatctttaaccaaggagtccttcagatcttatgtccctaagattagagatgaagtcctggattacatcaataatgaccctaacttcatgggaggtgattctaaaaagaaaactggaaagaccaatgtcctgaactctcagtccgagcttacgatcttgaccgcttccagatctctactgggagatgatatgagaaaactactgactaagaaatgggctaaactgtttagtgacctagacaaaggatttactcctttaaacttcattttctctcatcttcctctaccaagttactggactcgtgatcatgctcaaaagaccatttctgagacttatttatctttgattaacaagagaagagctacaaacgacattggtgacagagatttgatcgattcattaatgaaatcttctacatacaaagatggtagcaagatgaccgacgaggagatttcccacttgttaatcggagttcttatgggtggccagcacacttctgcctccacttcatcgtggtttttgttgcatctcggagagaaaccagagctgcaggaggaattatttgaagaacaggaaagggtacttcaagggcgtgagttgacttatgacgatcttgctaatatgcctttacacaatcaagtcatcaaggaaactttgcgcatgcacatgcctctacactcaatctttagaaaggtcactcgtcctcttcccgttcctaactcaaagtatgtggttcctaagggtcattatgtattggtttcacctggatttgccatgaccaacgatgcgtacttcccaaacgctagtgacttccagccacacagatgggatgaaactgttgaaccagtctcagctgacgcaaaggaaactgttgactacggatttggtaaagtctccaaaggtgtttcttctccttacttaccatttggaggaggaagacatagatgtattggcgaacattttgcgtactgtcagttaggaaccatcttgaacacattcgttagaaccttcaagtggaaggccgtagtccctcagccggactatacctcaatggttactcttcctgaacctaatttgtctactattacatgggaaagacgcgataattagttatttattgatgtcttctaattaaaacatcgaatcaattgttctagcaaggttctgtatgtaatattatgcactattctctagagttcaccacttgaagttctttttgcagaggattcactctcagctcttcatccttctttatggtatctttgatatatttggtaaagtcatcaacaattatctgggcctcgttggttaatgataatatctcgtcaacttctaggttgattccaccgcttttggacatttgacacaattctttatttgagtttaaagtaagtgtgatagttccctgggtcaaagcttcttctttcaaggttgcatctactataacgaactctctaccatcacctttgacattatcctccatggatccagagctgtatatttgaaatgtaacacaaatcggaatgtggagaacagataaaggaacaggttccctttccgacatgtcgtgcaatatcactgtgccattcctaattgaaatgtctggtttcttaaaatgcagcaatccagcaataacaccaatacacactatatcagtcatattgccatcgtaatctataatatgaacatctgctcgtacgctccaacatttctgacctgctattatacataaactttccagatcaagtgcatttgatcttcttatagctttttctatgagacggctcagcatgacttcttcttcttgcctatgtgaggcttcattaaaggacgggtgtcccataccgtccagctcactgctgacttgaaatatgccttcaaagggtctatcttcatagggcgtgacaatttcactagatatgcgaacgactaccttggcatcccccaaggtgaccaacatctgaccatagtcagggccaacttcgatgttcagaggcctcatttgcatgggtttccttccgtctagacgaagcccttcctctaaggcctttaataaaaattgatgttcattggtagacataatgaaggtggtaatatttattgatacagaaagttttcaatattcgatggcaggagacatgctagaaggagagtgaaaaagtgcagtcttctagtaatcccttccagcccctcctcgcgcacaagaatcccattcactactcacaccgtttctctattcttctcgtcttctgtcatttttcacattgccacccgacaatgattgttcactcccccatcgttacgagaaggttagccacctcagcaagggttcctatcaggactctggctacatcttctaatggactcaatttttttcagaaaactcaattaccagcaaatacaattattcgctttgttccacagcaaacagcctggattgttgaaagaatgggaaagtttcaccgaatcctgcaacctggactagctattctgttaccctttcttgataagatccaatatgttcaaagtctgaaggaaaatgcgattgaagttcccagccagagtgccattacttcggataatgtcacgctggagatggatggtgtgctctatatccgagtagttgatgcatacaaggcatcctacggagtggagaatgctgaatatgctattagtcaactggctcaaactactatgcgttccgaaattggtcaacttacgttggaccatgttctgagagaacgtcagtccttgaatgtcaatatcactgctgtcttgaatgacgccgccaaagattggggtattcaatgtctccgttacgagatcagagacatccatccaccatcgaatgttttggaagctatgcacaggcaagtctctgctgaaagatccaagagagcggagatattggactctgaaggtcatagacaatctgccataaatattgccgaaggtgagagacaatcccaaatcttagcgtccgaggctactaaattcaagcagataaatttagctgaaggtgaagccagagctattttactgaaggccgaagcaacttccaaaggaattgaacaaattgccaacgctattcgtaacactccgggaggaggagacgcagtatctctgcaagtagctgaaaagtatgtggatgcgtttggaaaactggctaaggagtctaacaccattgtcatccctgctgggttaggtgatgtttcttcgtggatggcttctggcctgagtatctaccagaatcttcaaaaatccaacgctacaaaggaccaaaataagattgaggagacgaaatgattgtaaatatgaacgttctctatatacaaaataaagtttaaacgaattaattctattgagatccaatgcgatgacattcttgtaagaaccatctgatctgttctggatccatgaatggatgagtgccgtgtccaaaattaattatgtagttttgctttcctccaccaaaacccttgatcattttgtccactttcttggaaatggtttctttggagccgtacatggttccagggtcaagattaccttgcaatgcgattcttccgttagcaatctggacagcatcacttggacggaataaccaatccaacgagacaacatcataaccactgtcgcacaattgctccaaggcgtaccaagagcctttagcaaagacagttatgggaacattctctgtgattccaagttccttcaacctcaggggaagtttagaggaaatctgtctcaaataaggcaaagaaaactcatcgaattcatcaggccccaattcaccgccccaagattcaaaaacttgtaacatttgggcacctgcaacaacttgctgagctaagaattcaactgcaacgtcagtgatctgttggagtaattgatgagattccttggtaaacttgtagatccactcttttgcaaatcgaaacatcttggtaccgcctccttcagtcatataaaccagtagagtccaaggagcaccacaaaatccaagcaaaggcactcgtccattgagtttttttctggtcaatgagatagctttgaaggcccaatcgagttccttcaaaacgtcaacgtcttttttcaaatgatccaagtcagacggttttcttagcggattggggaactgtgggccaactttgtccaccatcttaacttccatgcccatagcttgaggaatcaccaagatatcactgaagataatagctgcatcgatcagaccgtcaaaatgcgtaatcggctggatagtaatttcagaagcaatctcagcatccctgcaagtttcaaagaagtccctacctcctttgacctcatggtactccggaagatatcttccggcctgtctcataatccatattgggggacgttcaactttttcaccacgagctgcccttaaaataaggtcattcttcagttctggaaatctactcatctgatagatttcagtggagactgaattttgctatgcactattgtacatacaaaagttcgctcagcgaaaaagtttaattctgctcgcgccctggccttcccttaggcatgccacatcttttgctattaccactttgggacatcctttcatttacggtaaaagaaccagcatttttaatttactggttttgggtttcttacctaatctatcccaagtactacaatcaactccttaatgagcaattcaagtcccaaagagcagaacgctgccgcagacttgcagtccttcaggaatggagagccctccttaacttatacttcaaaccatgacaatgacgatgcagatgaatctgccatcattgacgatgacgaagatgaggaggcacaccaacaagaaggaaacacccaaaaccaaggggagcagtcacccgtccgacaacaacaggacacagcatcgttagattctttctctagtcaaccaagcttatttgttcgattcataagatccacttttgggttcaggaagactaccttgacccttgcagtagtcctttcttatctcttcgttatattggtcaatgcagcatttgagaaacagagccttgtcattgagtcacccgagcccgctattctcactaaagcatggacagatttacaggtcatatccaaagacatccatccgttcgactccaaagccaacgatgaagtgcacgattacattttagagagaaccagaagtattgctgctacaaaaccttacattgaagccagaggggataatagcactgtcatgttcaaccagccagatttattcaatagctcttcatcaacgaacaggataatctattttgagagtacaaatgtattggtgcgtgtcaagggaactgacccttctctagaggcattgctaatcagtgctcactatgattcagtatctaccagctatggaactacagatgatggaatgggtattgcatccatgctgggaattttggaacatctggctgataagaaaactgaacgcccaaagagagatattatctttaattttaacaatcacgaggaaattggcctcttgggagcttctgtgttctttgaacacccatggagcgacaaggtgaaatattttgtcaaccttgaaggaactggtactggaggaagagctgtcttgttcagagctactgatactggaattattagtcactacagcaatgtgaggtccccatttgctaattctttcctgcaacaagctttcaacggtggcatgattcatagtgaaactgactatagggtgtacgcagagcatggcctgcgaggagttgatattgctttctacagaccaagaagtttgtatcacactcgtagagattcgatcaaaggtgcaaatagagagtctttatggcacatggagtcaaacgcgttggatcttgttttagatttgggatacaatagtatcgatgaggacttatcacccagcatattttttgatgtcttggggcagcaatttgtttacttctcgcttgacaatctttacattcttaatataagcctgttggtgttaattccagtcttatctattgttttgttactgattgtgaagaagagacacacatggcacatttattcgacaagagggtggcttagattccctataactactgtgttttcaataacatttgtgactcttgtcggtagattctttttgttccatgatgccatgattatatcgagaaactggttcaccccattaattgccttgacgagtctcttcctgattgttagttacatcggacttaactttgctaactgggtagtaccaatccatgatcaaaaactggcgattctactcgagttaaactcattgctttggatagctactctatgggcaacggtggagatcaagagatattcgaacgtggggaactatgctattactatttactacattttggcttcgctctcctcattatttgggctactagctttagctctgaaaccaagacaacgtattgaacttcctgaagatttggacgaagaaggagataatacgaggggtgttcaacagcgtctaaaagaggctgccttgaagtcatttagttatgactggtccatccaatttttactcctggtaccaatatggttacttgtaacttattcctttggtggactggggttggaggctattaaccaaaccattcaagagagcaacgccttaggggaaatatctttcaagtttctgggtgctgtggcagttttattgggtttgagtgtattaccgtttgttcacaagttgaatgccgctttaactgtgctgcttgctgttacttgtgccattagcagttttgcgaccttagttggcccggttttcgattatcagcatccattgaaactgcgttttgttcaacaggtcacgcgagccggagagactcaagtcaaggtatttggaaagcatggctttattgagccagttataaatgatctcccttctgtgaaacagctcaaacgcaactacacatgtacagaactttctgatggtaatggacaatgtgtttacgacggacaaagaccatggctggtagacggtagtgcagttcaaaatgagtttgagaatttgctaactgtaaaagttttgagtgacactaatactggaaagactcgttacgttccgtttgatagtgatcttgagataaaggccgttcagagtagacactgtcttcttcttttcaatacaacgacgtttcatagcggtaatggtgtcgacaaatacaagaatgcacccgtgaaacaagtgagtctctaccacaagttacaaaataacaccaggcctgaaatgaaggataattttgcgcttagttttgttccttcaggtcatagtgttgatgaaaatggaacagatatttacagattgaatcaaggtattgacgagtttctagttgacaagactgaatggaatcaagatacctttcacgttggaatcgaatggctctatgattggagtgaggaatctgatggagataaaagagatagaaatctcggggtcaccgtcaggtgttattacggagaatacgatgccgttagcgtaattgacggagaagcaaaacgcaagatcccagctttggatgaactactacagtacgcacctgtagatgtggagatttcaaacttggatcgcggactggcgtacctagaacaatatgttgaactttaatatcgtcgttttgtgggttgaagcgatcagtgacttgacccttggtggtggtgagaattttcgcgaactctatacgaaaaattagtttacagcaaacttatcaaaaccaatccacttcgacttagacatgcctccatcttttagaggctcagtactttcagagcctgagctaatggaaagcatgcagggcatgcccattcaaattccagcaagcgggctcaatacaaattcaagtagatggactaacaacactgatgaacatccgtcaccaccacttctggcctcgtctgttggtaaagatgtggagggccgtctagtacccagctcctctactattagtttactttcattgaatatacacaaccaacagaacaatagtaatgatagcacttctagtgcagtagtggacgatgaagaggaacaagttgtaaaggctatccggctaccgccacagcatctaagagctaattccagcaaccatctcatgctccaaaggcatcagcattatacggcggtgcccactcatggtcctgcaataacactggtgcaacacggctctggaagtacggtccgcacccctgactcacctggcttgatgccagtctcagtcgtcgggtcaccatcaaagatgtggctacaaactccaccccttgggttacagatacagcaacaatccgtcatacagcatatagggtcagaatctccaaacttagatcccgttggtggttctcttcccaatatgacacctctggctctttcaacgttgaaggatcgagcggaacgagaggatgaaaaaggaacgatatgaaagaagactttaaacaagagacgaagagaaagagaaataatcgaggctgtcccgaatatagagtagtaatatgttcatatgtaaactagtttctggaattaataatgtccacgaattcaggtttcagagaagctccaccaaccaagaatccatcaacatcggccttgtcacggaactcgacagcgttcttgccgttgacggatccaccgtacaagatacggactttttcagcttggtccttaccaatgacagtagcaaggaaatctctaatttgcttgtgaacgtcttgggcatcgcttggagtggcagcaagaccagtaccgatagcccagacaggctcgtaagcaacgacaatgttagtccagtcggaaacaacatcgacaacagcttgcagttgtcttttaacaacgtctagcgtgatgttggcttgcttctcctcgagtgtctcaccaatacagaggataaccttcaaaccctggtcaagagcaaatttggtcttggaagcaatgaaagcatcgtcttccttgttaatagttctacgttcggagtgacccaagataacgtaagggacacccaagtccttcaaagcctcgacagaaacttcacctgtgtaggcaccagaagctttgtcgaaactgttttgtgcggagacgtaaacagtcttctgcttgttctcggtgacagcctgctgcaagtagggagcaggaggagcaatcacaacctctacgttctctggtaacttggtgttgttcaatctctcgataatctcgtgaattgacttcttggagccattcattttgaagtttcctcctacgaaaaatgttctagcctgggaagagttagtatggtccttctgatgtgggttctgtttctccgacctcccattgcctccacctgccaggtgtgactggatggcacttatgagactcaatgcacgtaccattgtgtttgtgatagatcttgtatatcaatgaaaaaaaactgaaaattaaaaatcaattgtagtaaaggagaaacgaaaacgggccagtaaggtgttcttttaaataaaaaaatgggtgaggggggggctgctatttttgcggtggttacggaattctctagggcgctggaaggagaaatccgacgatagtgaggaaatcggtggacctgggaggatcaggaaagagagtgagggcagtaagatgaggtgatgtggatcataaaagtccgggggaatcgcgccagatttatataccttattgcacccttccaataggctatttagagggggaagataggcggtctagtatcggtagacattgtagagtgaatttgcgctgaaaaacttcgactccaggaagtgtcaagagataaggaaaagaggctcgagttttgcgcaactaaaacactaataaatattgattagagtaactgtcggactaacggtgattagcagcagtaaaaggggggatgagatgaaatgtctgacttgaagctatccacacaaatcatgtttgcaccgtgaataaagttccgaattgttgtccaagaactggctatcaatctctgggcgttctctaatggtcatcaccatcatcatacgtgatagggccttcagatcttccagcagctgcctctctctcagcagctacaatataagctaaggcctccttccctagatctccggacctaaactgtaccgcttttcttatttcttctacccggtcttcatctccttcacgccatcgtaataatggggtcgtcaaggtgtaacgttgattttcacccttaaccatctgtataaactggcaatgtggtatatttcgtaagccttcaaactcctccacagaccatctgaaccatttcatcaaaaataccctggcccaaattccatgcgttacaaggaccaacacatcggcaaacttatggttttggaactgacggaagagtgtctcgttgaatccagcgcaacgatcatagacatctgcggcactttctccatttggaattcgatagaaaaagtgaccataatgagctctctctttccaaatcctttgcattttttcaggtcctccttggaaattaccgaagtcctgctccctcatccttggttcctcgtaaaccgcataattatgatcgttgtagtcaccaagtccctctagaatgccatctaacgtttggcgggctcttaaataaggtgatgtataaaacaaaactctatcttgcttttctaaaagcctgctcaactcaattccagcattaaatgcttgctcccttcctttctgagttaacgggaccttgtgattaggagtgtgcctattgacagatttgtcacagtttccttcactctctccgtgacggataagcaatatcagctatggtgttagaaaggaattccatcaggtattggaaagaacttaagaacttactcggggtcttgccatagtttgattctagtacaaagaaagccaagacagagaagcactcgttttggtgtgtactagttcaaagtttgatagtgtgaggtgagatttgtagattcatatcagactcgcattggagaaacgagaattcggaattggagactttcccgtagttggtcggctaatgaataaaataaactaagtaatctctggactgctaatgtgtctatctataattggatatctacctacctactagttttgttccttttcttcacccttggtgagagcgtcgggtttcaaggttgggaagagcagaacctctctgatagtgttggagttggtcaagaacatagccagtctgtcgataccacatccccaacctgcggttggtggaagaccgtattccaaagcgttacagaaaatttcatcaattaactgggcttcatcatcaccctggtccttttgacgagcttgctcttcaaaacgagatctttggtcgaatggatcgttcaactctgtgtaagcattagcgatctccttggtagcaacaaacacttcaaatctttcacacagacctggaatctcacggtcgtatttggccagaggagacatcatttgagggtgaccaaaaatgaaagttgggttagtacaggtgtcttccaactctccaacaagcttgtccaacatacgggcgttggtcaaaggtggtgggcagtccattttgtgtttaatcaagatattcttgaggaactctccggtctctgcggtgtgcaattcgtctccaggagggaacttgacgtcgaaacgtttctccaactcctcgatcatgttaattcgcttccatggacggctgaaatctagggtcaaggtttctccttcaggaccgtctggctggtatgggatcttgtaatcaccagtgatctccttgaccatctcggagaaaagaagctcagtcgtctccattaaatcgtatacgtcagcataagcctgatagaactcgcaggtggtgaactcggggttgtgagtcatatcaataccttcattacggaattgacgtccgatctcgtaaacacgatccataccaccaacaaccagctctttaagaaacagttcaggagcaacacgcatgtacatgtcaatattaaggtcgttgtggtgtgtgataaatggcttagcagtagcacctccggcgattacattcatcataggagtttctacttcaatgaagtctctttcgtcaaagaagcgacggatgtaggagataattttagatctaatcttgaaacggtctctggttgcatcgttcataatcagatccaagtaacgttttctgtatctggcttcttggtccttgaaaccgaagtgatcagtaggcaacatgtgcaaacatggggtcaacagcttgaccttacgagcaaagacagaaatttcaccttcaccacctttagcaggagaagtacgacctggatatccagtaacaccaattatatcacctcttctcaggagttcatgcatcttctcgtaatcaccatcagcatcttgagcctgggccataatttgaacctgaacaccttctccgtgtagaacgtaaaacttaagtttggatccactttcacgcttagcatggattcttccagcgacactaacagtttcctctggtagagtttcacctcttttgaggtgagcgtacttggcttggaattgatccaatctcagcgtcacgtggaatttgtgaggataaggattgtttgcaccacgtaggtcagttctgagttcatcgatctgcctagaacgaatttcgaaatactggttggggttcaaatcagctagatcatccttcttcttagcgaccttgggagcagtagctgcagcgttggctgccttctgggccttcttggtctccaaagcacgaagtttctgacgcttctttagctctgatttggaaacttgctctccagttacctcgtcaaggtacgtcttttgcaactgttcggtaattttttcagtttggtcagccatcttgggttgttcaatcgcttgcaagagataaaactatgagtcttcaattttttttcctgagtaattcaagctcgttcgtgcaaaaaaaaaaggccaaataagttcgcacacgactttgatcttttgttcctactgaaaatcctgtccagaaatttttctctcgttcaacaccgttaatagaggataaatagaccaatgtcctacgaacttaatgcctcagtggctcttaaaattgccagatcaggcgccgaacattggccacaccctgcaagtggtccgctatttggatttcccgagacccctgactcagtaaagatttcccatgtattttcgtttccaaccaacaataaccaccacaatcaaaatgaagagggattctcgttccgttcaaacgtcaacttagattttcaggaaagaactttgcaagagttgaacaaggctaaaattggtgcccagttttcaggttggtatctgtgttcccaaggtggtagattcattacccaatcagtcttggaaactatgcttcaattccacaaccaaagagccaaatctcttgatagacagccagagttagtattggtcgttcatgagacctccaaggcaagacaaggactagtaagcttcaaagcttacattctaagcccccagttaatccaaacatcccaaatgcgtgaaaagttcattacaaagaatctacgtacagcagagctgacattctcaaatttgttgaaggaagttcctttgacggtccgtaacctgtctttagtaggaggtgctcttgatggactcattcctgacgacgtttctactgagagtgaaagaatattggccctcggaaactctacccagggagatttgaataccatagaacaattgttggagacagtcgaccattttaatcacaaccagggaaatttccactactatcaaagacttttgtctcgtgagcagcaaagaatcagtcaatgggtatcaaagagagaacaagagaacgcagctacgctaaaacgcaaccccaacgctaccgaatctgagctactgagaacagattcctatgaatggtgtaaacatttcaagctgccaacggaaccatccagattggaaaacttggttttaagtggacaaatagatgccttctgtgaagggcttataaactctgctgacatcgagatagctaagtcaatcggtgtccagaaccgtctttttaactagacgaggaagagaaacgacaaaattattactactactactttacatgtattttaagttgacccagcctcttgagttctaacgcttttttgtagggtggagccgtcggtgattgcactggatccagacttacagttctgaaatcttcctctagggtgtaggttgcgtctgaatcatagcttgaaagatctccgcatgcaataaaaggagcgacgtgcctttcctcttcaaaatctttggtgtttggtaaatcggagtcaaacttaatcctcttaccaagattgacatcctcaaagaacagttctggtgtaagtaaattttttccatccaaggtgcccttccaaccatctctgggtcggtaaccttgacacactatgaagctttccaacgatgtaccacgggaagatcttggcttagcgcatgttacatgttcaaataagaaacccatttgggagtacagcaagtcaatatcctttcctctaaaaattttggccacaaacgatcctccaggcttcaaaatgcaggtagttaattgtaaagcactcaaaataagttgactttgtatatattcatccaaatcatgtagaccagtaacatcgggagctccgtctgaacagacaaagtctgcaggctcacctccaaagatttccagtattttctctaacgtcttagggtgagtgatatcagcctgtaaagtggtcactccgtcgattggagacattggttgtagatctacggcgacaattttggcgggagtttcactgttgtttgactgcttttcatagagctccctgctaaggacctgagaccaagatccgggtgctgcacacagatcgaccactctgcgaacatctttgaaaaggttgaactgctcattaagctgcaagagcttgaaagcagaccttgctctccagccttcctccttggctcttctataataaagatctctcttatctttactggtttttcccattctgtagtgaaaacgtaggaggaactggaccttggaaatttcaagaatcttttttttcttttgtttttcttcctaggcccttctctttagataagcaccttccaacagaaggctcgaaatttttctagttggacccatcctccgccaatgttgtcgccaagtgacaaaatactttctcgacaaaaattcttcaatatcaactccttcaatcatgttcaaaagactggttagaccatttcaccattctgttagagcatggaatgttgtctctaccgagtcagctgctcaatacactccgaaagttctcacagaggagacggaagtcgcaggttcgaatagacctctgcctctgtctgtggagctgaaccactatgcaccactaaagatccccgtaaagcatggagaattacgtgctgaaatcactatgcgaagttttgacaatagaaacctggacttcttctgtgactttgccttacgggcaggatattatcttggtctgccactgactggtcccaaaccattggaaaccagaagggaaaggtggacagtgataagggcccctttcgttcatgctaaatctaaggagaattttgaacgtaggacgcatgcaagattgttaagagtttgggactccaatcctgaggtagtggatatctggttggctgttttgaataaatattcagtgacaggtgttggactgaaggctcacatgtacatcgaagaggcagtcgatcctgatttctctgcctctacgccgactaaagagggagatattgactccacgggactaaacattgcacagttgacgtcatccgttaaccctgaaattgcagctcgtgttgctgagttgttaaaagaccctgaatttgctgttcatgtaggcaaagatactgaaaccaagaagcctacagaaacaccagctactccaccagaaacttcataatcatgccctcagaatattcaatgttttctttttgtacatagaaatatacaatactataactcagccatacatgtcgtcaaaatcatcttcctcctcactatcagagggtagtactatctccttccttttcgtcacgtcaacacgacacaacgggcaggtcttgttcaaatgcaaccatggtcctatgcagtctaagtcaaaatagtgattcttgttgcatggcaacctcacaaccaaagggtatggatcgttgtgaaattcattagtgcaaatgggacatgtatcgtcaggagataaatgcttgacgttaactctatccaattgatctaaataggcatcatcaactcccttggcagtatctgtgtctatttgatcccccagagagttcagcaaatcaaccatagaatctaatctgtttgaatctagactggaactactctggagctggttgagaagcatggatactacggaataaggatcatcattaaaactgcttcgagactgactggtgggtctattttccaggtacgtctctaccatttgtctgagagtgggccttcgacggccattgttagcctgagatgacatccagctgtatctggttgaatgagaggcaattgattatcaagttacaatattttcgctaaagccattgcacgtttggggtaggacaagtatactattgttggttcgtcctacaacgagatgaccacttcaatttactgtcttttggctttattgatatcattgactcttgttgtcatacgtgtaattttctgtgtcccattttgtcgtcttcaggatgtcagtccagtattagacaaaccgttaagtgttttgatccttttgggatctgggggtcataccggggaaatgttgaacatcctttctcaattagaccacaagttcaaatattcattcattgttcaaagcaatgacgagtcttcggttcttaggttggaaaagagtcaggttaaaggaactgtgtataccgtcccgagggccagaaacgtaggtgatggcctactcagaagcattcaaggaacgctaaagtgttggctgggaaccatgaaggtgcttgttttcgataagaagtggaaagaaggaaacataccgtccgtccttctggtgaatggacctgggtcctgtgtgcccttagcgtacagtatagtggttctgaacattctgggactagcaagcgcacgtatcatttatatggaatcactaaccagggtcaatgaattgagcttgtcaggaaagttgctgtatttggttgccgacagatttgttgttcaatggccagaattggcccaaaagtatagacgtaccgagtaccatggaatccttgtctaaacgacatacaaaaacacaaaattgaaatagattaaaggaatgaattataatattacaaactgaagtataaatacgcgttccatttcactagtaggaggttagttgttgacaatttcttcttttatttaaaggatcatgagatgaaaaacttgggtgtcagggttaaaaagctctgttttactgaatccacataatatttcaggtgaagaaattcatgttgtaaaaatgttcatcatccaaccaggttattcagcgatccttactcctaaaaacttacccatggctgaggccaaataaaatagaagacattgctactaacaaaaccgatagctagtaaatttttcttcccagcatcccacaaggttgagaactgtgtgatacacgaccacgcggttgaacggatttttattcagggttgtcccgaaagtataaatgtgggctgtgtaattttacccttaatcacattctgcgcggaacatactgcatgattagaaatatttatgctctcaattaattgatcggcattttttatgattcagcctgtttttccggtgggggcgttttttattgttcgtttcaagttgaaaaagctaaatttcaggtagttacctttttactttaatccctaactattgagggcaaagcctccttgcaggcctattataagagctattaatactgtttaattactaatttgctcctatatcatgaactctggaattctacgtcatatagcgtcgcatgcagctgtgcctattaccccccttttgagagtgccgtccaatcattgtcggtcacacgtctcgccgaaaaagcttttttttgttgtttctcggacgttgccaagattaacgtcgcaacccttgcagagtataggccctgaaaccagaattttatcagccaggtttgccacatcaaaaatcactcaactctatttttactaccgtgttcgatttttggccagagatatatatgccctttggcccccagaatagctgttgaatcctactttgtctttgtgataacacttcgtccgttttggttatctgttatgagttttcaagtctacaacatggtgtccttgccagcaccgcaagcaacatcattctcccaacatccgaaacttccaacattggaagtgatacaacggccaccactcactggaagacatggcattcacgaagaagagatcaagctaccttcctttagatctttactggctagtgcgggcactgccgctgctcttgaatatccccccaggattcaaccccaatttgcaacaggggcacctgcacctgagcaagcattttatcagcccctaaataccgtgggagtcacgaggcccaacattcacacctccatcactccaccactggaggcgcaggacctccctcaccaacaaaagtttatggaaccatttgcgtccttccccaatacagtagtgtcttctacacccaacacagccatcagaaaatacaagtgcaagatctgcgagaggtctttcacaacgtcgggccacttagctcgtcacacacgtattcacactggtgaaaagaagcatgagtgtcctttcgaaggctgttctgctaggttcagccgtcaggataactgcatgcaacattacaagacgcatgttaataccaagtcgaaacgaaagagatctagattgagaagtaaataggtatttatttacggattggacccaagcgaggagtaagtagtatggctttaatttttactggtagatttaatgtggttacatcatattgagtagtcgaatgatttttccgtcttgtctcgaaaggtttcatgggaccctatataaactttgagttggttgtagccacacacttgaatatccccacacttagttgtttcattcacagaaagaatggccatcgactctgatatcaatctaagctctcccaatgattccatccgtcaaaggatgttcgagcttatccagcggaagcaactcgaaattgtcgctgcattggaggcaattgaaggaaacgataccaaatttcgttctgattcttgggaaagaggagccgaaggtggaggaggaagatctatgcttattcaagatggaagagtgtttgaaaaggctggtgtaaatatttccaaggttcatggcgtattgcctcctcaagctgtgagccagatgagaaatgaccactccaagctagatctgcctgcgggaacctctctgaagttctttgcctgtgggctttcgttggtcattcatccccataatccccatgctccaactacccatctgaattatcgctacttcgaaacttgggatgaaactggaaagcctcacacctaggtggtttgggggcggtgctgatttaacgccttcgtacctgtatcccgaggatgccaagcaattccatcaagcccataaggatgccctggacaaacacgatgttagcttgtacccgagattcaaaaagtggtgtgatgaatactttctgatcaaacatcgaaatgaaactagaggtattgggggtattttctttgatgattttgacgagtttgatgctgagaggtccctgaagttggttgaagattgtttcaatgctttcttggaatcttatcccgctatcactcgaaaaaggatggacaccccttcaactgatgctgagaagaactggcaacaaattagaagaggaagatatgtcgaattcaacttagtattggatagaggtactcaatttggtttgagaacgcctggatctcgtgttgaaagtattttgatgtcgttgccaagaacagctggttgggtctatgatcatcatccagagcctggctccagagaagaggagttattgcaggtactacaaaatcctattgaatgggtatgatgagtatttaaaggttgatatgtttggtctatctgtgggagaactttcactgcaagctcctaatttttgtaaatatctattaatgtcctaaaagaatgagtattttttgttttgtctgtagtttctattatctagtgcgttctaattttctctccactggtgaccacatttgcaacatttcaagaaggtagtcatgggttcgtcagcagacctaatttgaagctgaaaaaagtatgccttatcacccccacaactatcaatgggacactgagcaccagtctgatcaacattatcccaagccccagctcctccgagcacatcgtctacctgttttctagacaggtcttttctttcatacatctgcatacccactattgggaactcatatggacaagtgggacaattgaatctattgatagagtcagctgctttcgtcacctaattgtgttagtcgcattacagaacgtagactctcaaataaaccttaccgttagcatattctggcagttgggacagaacatcaacatgactacaggtcgtaacttatggctggaagttgttagttagacgtttgaagtatcagcagagcccttcgtgctcttcctgcgtagaaaaaaaaatatatcaaccttcaagtccgcgaaatatcagtgatctgaaggattcgtctttaaggttagactctcgtcacaatgacacgcattgacatttttgaatcaccttccaaaaggaaaagtggaataataaatctggaaggagcatccccaaggaaaagaagatctcctaggaaaaaaacaccccaattgcatacagaactatctacgagaggcatcatcagactagggtctccaaggtcgaacagaacaggaagaaatggtttgagatctcctatcaaaaggggggtcgatgagttgaacaggattgctttgctgaaggccttgagtacaaagagaacattgctggaagatggaaatgaagattttgacgatggccttgacggggatgaatacacagttgtggaaaagatcatcaaagcgagcaaggaggacggtattctaccagtgcacgtggaacacgaagaagaacatgaggtagagaatcatttggcagggctgaatgaaaatcttgagcaagaatttcaactcaatgctcaacagcagttgtcgaccatggatgataaggccttattcttagatggatatgaagggtactttgatcagcataaaagtcgccagaaaacaagtggtcacacaatgaatcaggcagtgtctttggaacatgacaagttcttggagagcacactcaagttgagtggaagcttagagtattctactcgatcccaaatgaaaaaatacatatcaacactccatactcaatggtacttcgagctactgcaaggatttaacatttgtctatatggagttggctccaaatatgaagtcttaatgaactttgccaaattcctaatgggcagatttcagcatgtgccctcatcgaagaaacctcaattcatagtttttaacgggtacaacccagattctacatttcaagatttactacgtttgtgtatggaacaagtccttaccaagcaacaaaggcgaagagcaatagtaccgcaacaaccgcaagatgcgattagatacctccaccgacgagctggtccttctggtggagttaccacaatccccaaactggtgattatactgcacactttagacggagagtctatacagcaagatcaatatcagcttcttctggctcaactagtcagcgtcgattccatctggctgatttgctccactgatcgggttgactcaccgttaatgtgggatgccaacagggctagtctgttcaattttgtattccatgatgctacgacctttgacccttacagcatagaagtgtctttcaaggatgtgttgcagataggcaaatccaagaaatttgttggttcaaagggtgccaaatatgtgctagcttctttaactccgaatgcgcgtggtatctacggaattcttgcagcagctcaattggaaaaaatgtcagattcgatttccaccaactcagcagcccctgtaattggttctgttcgtcaaggggttccctttaaagagctttacaccatggccatcgaggaattctttaccagtaataccttgaactttaggacaaccctagccgagttcagcgagcataagatgttagtgattactaagggagagtccggacaagaaattgtatatattccattctctgcggaagaaatagagaagttactagctgaggttctatagagcaaaatcacgcaaagagccaaaagcaaggagagataaacaataatatttcaagatagataattccttttaaaagagggtctgcgataataatctttgatagcagttacgtaatcatactcaagttcgcttagatcctctacttcgttacttcctggttttccgtacccaaaatactcctaaaacacattctatactatggataaactggcagtgctagaaaaactagagcctggaactgagctgatagttggctcacataaggtgacagtgatccaatttatttcggagggaggctttgcccacatctataaagtccgagtatccccttcagagcacaactctgatattgcatgtctgaaaagagttatcgttccagataaggatggccttcatcagttgcgatcagaagttgatgtcatgaaaagattgagtggctgtagtcaggtcgttcgttactatgactcgcacgcttcacatttgcccggttctgctcaaagctatgaggtacttgtcctgatggaactctgcgagaataagtcattgctagattatatgaacagtcacttagaaaccaagcttacagaacccaaaatcttgaaaattatgctggacatctgtctgggagttctttacatgcatcaattaaagctcatacacagggatatcaagattgaaaacgtgctcattgattccaagtataacttcaagttatgtgactttggaagcacttgcccagttctaagagccccaaagaccttccaagaattccattacttatctcacgatatactgcgtcagacaactcctcagtatcgttcgccagagatggtagatttatataaaggcttgccgatcaacgagaagagcgacatttgggcactggggatattcttgtacaagttgtgttactacaccactccttttgaaaagactggagaactggcgattttacattctgcttaccaattcccacatgagtcacgttattcttccaaactaaagaggctcatcgtgattatgctgcaggaagatcccgcattgcgacctaatagctatcaattgactagcttagtaattcaactgctgggaacttatagtgatatcaaattggatagagtgtttgatttttatcaagaaggagaatacgattttaagaagcttttggagaacttgcaaccacctatcagtcacccactgaaggaaatatatgaatcacagcttgcattccttcaggatgacgttgcccgaatcaatgttcaagaagaagtctctaaatcggtggtcaacctgacgaaccagcaacatttactgaaggcggataatttagaaaagaatatcactggccttagcgtttccagtgtagaggttgatctggataaggttgaggaacggttcccacatttggacctgacaacaaaaacaagtgaagctgacggcagtgtcgacctcagcagctcagagacaacgccagctcctgtccaggatgaaaaagccaataagtatatggtctatcaagaaaaaatcagctccaacgcaccactcacacctgcggaagcaaatgagtttcttgcattgaacgcatatatggagaagctggcattgcaaaattatgaaaccaagatcaagcctctccaactgactatggaacaattcaatgaatacaagagacttgaagccaagaaggatttgactcctgcggagcttcaaatactttcggtgcatcgttcacgtttgagccaacaggatgaactgttcaaacaactgcaatatcaacagatggtagctcaaaaattgacacaacaagtccatcaatcattgatcacccctcctgttgcggtagcttctaatgctccaactggcaccgcaacttttccaactcgtcctcttaagcaagaggtaattcctctatcatcgggagagacagggactagctcgtttacacgtgtcgccgatggcagtcttattgatttggaggatgggatggaagaatattccgataatcagaagcctacaactgccaacatgaaaccctactccttttctgcggaagatttacaaaccaaggacttggctttagatgatactggagaacctggactaaaggagggctgaaaaccccaatgtgcttttcaggggcagtgagggtgaaacttcactaacagctcttctgggcctaaactcctaaatccttctgtactacgagtccagataccggacacacgtcgcctttggtaacctgaaggaaataacaggaactttttagagagtcaacataaccctaatccgatctcatctattcctactatacatacatttaaatacaccggaaaacaaaaaaaaacacgaccatttttttattgtccagtttaccttttcttaatcactagcatcctgttattttagcggtacactcttcaccatactgcccaataggcgtggtcaaatgtagtacgatagtaagctgtatagcccgtacgaaatgaaagtgatgaatactatgacaaacgagtgaagaacgaatgcctcgtttgtggtgagcatgtaataaggtaaatgaaaaaaataccttgagtacacatgtttaatgtccgacaccataattgtatcgttagtgccgttagccttcgaagtagcagatgaagaggtggaaatctggtgtttttacgatatctcaaaaaagccgggagcgcgaataggtacttggaacgcatcttgatcaagtgttaacattgtaaagcgactatgtaatctactaactttgggttttggtggtttttgaatcgacagatttgtcctttgcggtctctctcttgactctattgtacatcagaacgttctcgtcgaagataaagtcaactataactctcacccaagaggtatgctttggtaatggctgataaaagtcatgtgctatggttctcagaagaggcagcttagaccaagcaatgaatggaaagtcgtgatgctcgttgtgatatcctacattccaagtgaacaaattcagcattccgtagtaggagtaagtctctaacgggggaacatcctggaattgggtataatgctttggaggatccaataaatagtgctcagctatgaagtgccctgccgtaggatgcaacgaacccgcaaagaaggaactcaatatcaggtaccataaactgttagctgagccgaacttgatcaggataaaatcgctaaccaagcaaaccagcacgttcaacaaatgaataaaagtcatgtcaatagacgtaaccatcatgggcctcaacgcgtaaaagaatatttggaaagtggcgaagaaggctttacccagcaatgaggacaaaacagtcgcttctagaggcgttggaagatcagtgtccagcacttcatcgcctaaaaatttgtgatggagttggtgatatggttggaatgaagcgctatatgggactccaatgggtagattgacccaaattgcgaatagtttgttgtgaagtggttttctgaatgccaggttatggctcagctcgtgaatacagaggaaacagttttggtttgcagtagcaccaacgacgtatgcaagtgccaaaaatttgaaagacagtactggtgtattctttagagcatatgcaatggagagctgtagaagaacgacagcggaagcaatatatttcgtcctccactcgggtccacataacttggctacttccggatgcttggctaaaattagcttccttcggatactgtgtggatctttttgacgggtccagtagaactcaaactgtgggcctaaatcttcttccacagaaggcggtgttacttcatactgaacgttattggatctgtgagttatcatgtgtatctaagatctgaactgagactgaaaaaggtgattattactatatagaggtgtatggagtgatgtagggatgtgtatcgtataagtgataggcatcaagacgtcgcaggagatgacgggtacgaaacaagacaagaagtacaacaaattggtggaagactgggtccctaatgcgttcttgtgtcaagcagagcaacttaaactaggatcattgattctgtgtgaaacgcagtgcttttcattcttggtgtccggtcagctaatgtgggcttagaaagttaacagcaaacgggaacatcgagaaaacatgcgattctcactctaattttcagtttactttctgagaaaatgcttagcctaataactgacatccaccatccactgacaaccctcttaccgacaggcacctgtggttcaagatatctcgatcgctttttcagcattccctcacacccttccatccgcacccctccaagttactcctagttgcctcctaaatacccgcgccaatccccgcctagtcacgagaaaaaatttatatctacgctccaacccccgaaccagtatgtttgctcaatcaaagcctccaagcatcgccatagctaagaggcgtctgtttcaattgaactcaatccttagaatgtcaactgatgtccgctttcatgtcgacaataaagctcgagtgatctctcttaacagatcagccaaactcaatgctctctccacagacatgtgccatcaaatagttcccagattattagaatattccaaatctgactccaacaatctgattgtgctacgttcagatgaacctagggcattttgttctggtggtgatgtggtccagtgtgccaaagataacctggcaggccagatcgcccgttcagttgaattcttcaccgctgagtacaacctcaactatctcctggcaaccttcaacaaaccgattgtctctttggtgaatggtattgttatgggaggtggtgttggactatcggttcacggacccttcagagttgtttgtgaaaccactcgttttgccatgcccgaaaccaacatagggttttttcctgacgtcggaacttctttctggttgtcccgtctagacggtaatttaggctactatttggcgctgactggtgacgaattgcatggttttgattccttgatcgctggatttggtactcattacgtcccctctcaccgttttgatgcgttgttgcaacgtctggccaacatagagcagttcaaagaagacaaatctccaaaggaattttacagcatggtcgaccaagctattgaagattttgttgaaccaattcctcaagattacaagttcaaattttctccagaagaactcaataccatcgaagctgcattcgaccctaaggccaacccttccgttgaatctgtgatcagtgctttggaagccgacggttcagattttgctttgaagattgtcgagactcttcaatcgaaatcgccaatctccttgaaggttgcatatgaacttctacaaagatctgcaaaatctaaaatttacgaagctatttccaacgaactggttctagcaaacaacatgatgaccggagttgaacctaacgacttcaatgagcgtatcctcaagaacctgatcaatagaaagtctactaatccagaggacaagatcatcaaacctgctttcaagactttgcaggatatcccagatgaggtagtcgataacctgctgaagggtagcgctgcatctaccttggctaaaccatcttcttctttgaaggagggagaagacggcagctccgaggccgacgttctcgccaatgctaggattaatcagttctttggtgttaactacgaccagtatccttacaaccacggacttcctacgcaattggaaattgagaactatgttactggtaatgacaactccaatagacagtacagtgttaccagagacgaggtattgaagtacttcgacatcaagtacaaggacaagctgggagtcagcttcaaagtgcagaacgttctagaccgcaagaccaagagttccgattatggagaacaatacctccaatggatctaagaggtcaacagctcaaccgttttacactgtatataagaatgggatttaataaacctatgccaccaccaaatgagagatcatctgcgtatccacggttgaaatgtttaacacgtgatgcgcgatctttctgtgtcatcatgtatctttctttttctctgaacttttttctcttctctttattgtgactcacagaactatcaaagatgccagtaagttaaaacaacagcgagactgtggatgtgttgacagcatgagatcagacatttgacgttgacttgactcagcggttgaggtttccatgattttcgaagtttcatcttgaagataatagtacctctgcgaccacgtgatttgaaagattctttttcttaatgcggagtctctctcagaaactcactccacactacataaccctcagcttttttctgccattggtcttactaactaatttaaggttcctagctctcataagatgttcattcaaaacgatcatgtcggtgacagatcccgcttagaagactggagaatacgtggatacgaccctctgacgccccccgacctgttgcaacatgagtatccacttaccccaaaagcagaggagaacattctcaagggaagaaacgaagctgttgatatcctgaaaggtaaggatgacaggctattagtcattgtcggaccttgttccatccatgatcctaaggcagctttagactactgcgagagattagccaagtttaacgagactatcaaaggtgagcttcatatcataatgagagcttatttggagaaaccaagaaccactgttggttggaaaggtctgataaatgacccagacatcgatggttcgtttcaaatcaataaaggtcttcgtatctcgagggagcttttcgttaaacttactgaacagattcctattgctggtgagatgctggacactatctcccctcaattcctgtctgatctcttctccttaggagcgattggcgccagaaccacagagtctcaactgcacagagaacttgcttccggtttgtccttccccgtgggattcaagaatggtacagacggtgggctcacagttgctatagatgccatgagagctgcttcgcatcctcaccatttcctgtctgtcacaaaaccaggagttgtggctattgtcggtaccgaaggaaatgaagacacctttgttatcctaagaggtggtaagaacggtacaaactacgacgaggcctctgttgacgctgcccacgcacagttagagaagaccggtatcctgggctctggtcctgccatcatggtggactgctctcatggaaattccaacaaagaccaccgtaaccaacctaaggtagcccaagttgttgctgaccaaatccgtaaaggatcccgaaaaatatgtggcctcatgattgagagcaatatcgttgaaggtagacaggatgttcccaaagagggaaagtcacatctacgttatggatgttccataactgatgcctgtatctcctgggaggatactgagaaggttctacgagtcttagcagattcggtcattgaacgtcgtaatctcaagaattagacatctgtattatgtaatttattatctaagcttattattcccctagatgccccaccaccgttgagcttatcgcggatgtttcgcaaccgacttttctttcaaacacatttgcttcccttcttcttcacccatcaaattataagaaccagttcaatgcttgtggttctggccctgacattggctcttcgattagtgcaggcagctaatgctatagcgagcacaaaagatgatgatgacaagtgtcctcctgttttcaattgtaacctagccaactttgaatgcaagcagttttctgcgtgtaacgagtttacaggtcaatgtgagtgtctagatggatttggtggacccgattgctcggagcctctctgtggaggcttgcaagatgggcgtaatcgtccattgagaccatcacccgaggagccatgtgattgtgaagcaggatggggtggtatcaactgcaacctgtgtttggaagattcggtttgcgattcgttcgtacctggtgacctcaaaggaacttgctatcaatctggaataattgtcaacaagttccaccaactctgtaatgtaaccaatgcaaagattttgcagatattgaatggtgacttgccccaagttacctttagttgcaacaagacagcacaagcttgtgacttccagttctggattcaggaagatgagtctttctattgtggattgtcagactgcaatttggattatgatctcgctgcaaatacaactcactatcgatgtgacgaagtttcatgtaaatgtcttgctggcaaaaccctgtgtggaaagagtggctcaattgatatctctgacttccttgtagagactattaaaggaccagcggacttttcttgtagtctggaaggacaggactgcaaattttctgaacccagcatgaacgacttgattcaaaatgtctttggtgacccatatatcacacttcattgtcaatctggagaatgcctgcacaaaagtgaaatccccggttttgacattcctcacaaaagaaggcacacttcaagagacttagaagctttggccattgccgtggttgcttcgggcataattattattgcaagcgtctatggaatttctaaatctcctctcttttcacggtctccccagagcccaactcttggggatgataatggagaggacggtactgatggagacagttttctgcaaaccaagaatccagtagtgttctcgtttgatagtgtttcttatgagattgacggaaaagaagttcttcaagattctatgggatctgtaaatcctggagaatgcctggcaataatgggaggatctggtgccggtaaaacaactctattggatatactttcgggtaagaataaaacgggttcgaaaactgccaatctctatttagacggtgaaaaattgactacgaagaaacacctcgacagcttcagtgcaatcagtggctttgttgaccaggaggattgtcttattccaaccttgacagtttacgaaacagttttgaactctgccttgttgagactccctcgtgatatgtctactgcctcaaagaaaataagagttttagaaattttatctgagttgcgtattctgcatattaaggacaaggtgattggctctgactttgaaagagggatttcaggaggtgaaaaaagaagagtgtctatagcgtgtgagttggttacatctccttcgttcttattcttagacgaaccaacgtcgggattggatgcttttaatgctcacaatgtaatcgaatgtttggttaaactggcccgtgatttcaacagaactattattttcaccattcatcagccaaggtcgaatattgtggcactcttcgataagctaatacttttagcagacggttatttggtgtactctggccaaatgggacattgcaaccaatttttccttgaccatggatacaaatgccccacagggtataacattgccgactttttggttgatatcaccaccgatgaaagagtaatatccgtattggaccattctgaggaaaacgacatccataaagtcatcgagagttccgatagtttaggtgaaaatctttccagagagtgggagcactatgctgtacatcgagaagaataccaagaatcgccttcatcctccaaaaccaagcgtaagattcataaactttttacatcatcgtcgctctatgagcaattaaagtccgaaattgagcatctgcatgagcagttctccagcaacggattcaaatcgcttgtcaaccaagaacgacccaaaggggccacttttgttcaacaactattgattttatgctcaagaacattcaagaacacatatagaaatcctagattattgttatcgcattacgtgttatcgattacaatgggattattctgttcttacctctactatgatgtcgccaatgatatcagcgggttccaaaataggttggggttgttctttttccttttgactatgtttgggttttcttccttgactggattacacatcttttccattgaacgaattgtctttattcgagagagagcaaatcagtattaccatccgttaagttactatttgagtaagatgatttgtgatgtggtgcctttaaggatctttccaccgttactattgatggtgataatatatcctctggtcggcctgaacatggacgatggtaagttccagaggtcccttctcataatggtacttttcaacctagccacttcgatagaagtcttcattatcggaattgtgtttgaggagccaggtgctgctacaatggtaggtgtattggtcatgctattttccttactctttgcgggattgtttatcaataaggagtccattccggttcaaataaactggttccagaacctttcggtattccattacggatatgaggctttgacagtcaacgaggtgaacggattgatgttgagggaacacaaatatggtttggacattcaggttccaggagctgtgatattgagcacatttggttttgatgtaggagctcttaacattgacataatatccctggccgtaatgtttggaatcttcgttattttgggatatgcagccctgcatacactagtgtacgagagaagataatctcgccgcaaagaaagtttgatcctgcaacggttctgattaggtaagcttccattatcatgtaaaacacgtaccgcgaaaaattcactagatgatatatacatactataataacctctgcgcgtacatttaccttctttaatggcacaatgaatccgaatatccctccagtccaatcgtatcacgagttcatgagtaggtccaacagatctcatcaaaccgaatgcgactctttaaagaggtcggataccgacatttcttcgtcaacaactaatgactcaagagacttccttacgcctcgtggctccccctttcagaataatacatacagtcaatcattagcgcagccccggcctgttttcgatgaacaatttcaagcatataataggaacccatatcagcagccgtatcagcgtggcgctccttgggaatattataaccggcaagcagattacccaaccaacccttctggtgaaagtcaacagttcatacccaatgtctcagccccgttaccaccgccccctatcatgaacagaaggtactctggtttacctaaaaatcctcaagaacaagattcatctcgttttggctggttcaaacgtcataattttgcatacttcactatattcattacactagttgatatttcagtattcatctacgagcttgcgaaagcaggaagctaccataatggaaacccatttcaaacacagccttacttcaatcctatgcttggtccgtcttcctacgtccaaatttcattgggatcccgataccttccgtgtatgacctctatcccaggttacaccgataatgtgaaccagttatggccgtgtcccaattctaccacatatgaaacaaacgtctgttccttggaagagttgtgctcatttggcgggtttaaacaggtggacagcgctacgggtcagccattgccagatcaatggtggaggatgattactccaatgtttctacacgctggatttattcatattattttcaatttgctactacaaatgacgctagcctacaacattgaacgagtcattggaccaatcagatatggtaccatctacttggcatctggtgtagcaggctttgtgttaggatccaacttctctccagtaggtgttagctcgacgggtgcttctggagcacttcttggtgtcatggctgtcaacatattactactgattacgacaaaaagcacagcccatttcggtggcgtgaaaggtaagcaagtacctgtcagaaacttcaaggtaattctcatagtctcaatagttgaactggtcattatcttctttcttggtttgctacctggcttagacaattttgcgcatattggaggatttgccatgggtttacttctggggcttacacttattgatgatcccttctttgtctatgacaagggatactataacaaaatatacacagaacgcacatctcaaaaggaaaaattgaagaactggagctcgcatctcaagacctctcggcacagtaccaaatttttcatatggctgcttgtccgtgtggcagccttagttacggccatcctttacttttatttcttgattcataatttccaaaagaagggtagtgagagttccgatagctgccggtggtgcaaatatatcaattgtcttccagtgaatggttggtgtgattatggcaacgtacaaactcaaggcaccagcagtagtgcaagtgatagcagcagtggaagcagcagtgactcctcttcaggcagttcagtctcatctggcatcacaatcgccctcgttggtctcactcaagcattcttttcatattaccgagatctcatcgttgcttagtgatgtccaacgtttataagtgtgtacacatctacgactctattaagaccatcatatccaggcaatgaattatactttatggtattaggtgctgctccaattaccgcctattgtaaagctgctatttatagacattgttcccatcgttaccccagatcacttgaagggagtagcttgtcagatgtaaaggcacttcgcgaagaccaaaccagtatttcgagtctggatctaactgcagaacctaatcttcacctttatactgtagacactgttggactatggcttgcacacactttaatagtgctgacaacattaaagctccgacaaagggcactccggtatttaaagatgactgcatgctgtgttttgatacagcgttcgaaccgaaaggtctcgatatttgcttgcattgctttcaatcattttccagaggcgatctgaaccatactcaactccattccgctctatttgatcacactttgtacttaaatttgaagaaagttctcaaacccaaaagagaaagaaaagagggcgaagaaagtccagaaaagattgccaaattagaaatcaaagatcaatcggaagaagatttatttaacattcaaactgcccttttttgctcttcgtgtgatgatcagtttcccttaaagcaggaagatcttccagctagtactaattcaatagttgaaactgtcttgcattcaagctccaatgaaaggaaagaagagatcaagtcttgggaacaagaaattctgccctgccatcattgttttgacatcgttcagcaacctatagaagatttagaccttacccaatgtcaatcatgcgacttgaaggagaacttgtggatatgtgttgtttgtggtagtctaggatgcggaaggcaacagtttggaggtattccgggaaattcccatgcgttgtctcactttgaaagtcatgaaaaccataatatcgctgtaaagctaggctctctatcctcagattctgcagactgttattgttataattgtaatgatgaagttaaagtgcctgaacttggcaagtacctatcaagatttggtatcaatattcatgaagtggtaaaaactgagaagaacctcactgaacttcaaattgagcagaatgtcaaatgggactttaacatggatcaaaaagatgggaagtcattggttcctgttttcggtcgagaattgactgggttcaagaacttgggaaactcctgttatctcgcaagtgttttgcaaacattgttctcccttcggtcgtacaaagaattttttctcaatagagatttcccaattgatcgattgactactcctaatactgatttaaacatacagcttataaaaatagcggatggacttctttcgggaagatattccatccctgattattcaacgactgaggaaataaagtttcaacgtgggataaagccttttggattcaagaatttaattggtcagaatcatccagaattttctaccatgaagcaacaagatgcttatgaattttggctttatatcatggacaagattgacgaattgtatgtgtctgaagagaatcctcctaactcgccgctccattttgtgctggagaacaaattgaaatgttctacttgttctagtgtcaggtttataaaggaggtcacaaacagtttagccctccccgtggaagacacagtgttggatattgatgatgatggtagagaaagatatcaacctgtaacctttgagtcttgtttcaaaaattgggctcaggaagaagaaatcgaacacaaatgttcattttgtcaaggggaaaaacttgtcaaaagtcagtcattgcaaacgttccctgatgttttgacggtgtcaacagagaggatcaagttgaagaattgggtaccaatcaagaccgacgttccaatcttgttcaaaagagcggaagaaaaaactttggaaaggatcgatctctcaaacctgagatcacaaggcttacttgaaggagaatcgttaatgcccgaagatgtttccgattccgaagaaaccggatttgaacccaacccagaagctatccaacaacttgaagcgatgggctttccaaataatcgatgtttgaaggctttatttaatactggcaacttgtctgctgaagatgctatgaattggctctttagtcatatggaagatcctgatattgactctccatttgagttgcctaaagatagcagcagcagcaaacccgcaattgaaccaagccaagaattggtagataatcttgtttctatgggctttacgtcaaaattggcaaagaaagccctgatacttaataatatcaacatagaagctgcggttgagtggttattttcgaatcccgatgatgatggagagattccagatgggccacccaaagcaaagtcgcaagaacagcagatcagcgagcttattgtgaaagaatccataaagagacctgagtacaaattattggctgttatatgccataaaggaatcactgttcattctggccattacgtggtgtttatcaagaagaagatcgatggacaaccaaggtggattttgttcaatgacgaaaaggtggtgttggcagatgaagccaacatcaaggagatggagtccaatgggtatctttacatttttgcgaaagtgggaagtaaagacgatttatgaccagattagatcggattgaaacatcgtcaacattatggtgtcaaagtattttttcaagagaatgaatgcatgcacgaatcccatctcatccctgtgaagagattgacagatgcaggacgcttcctcgaattttataataggggaatacacgagtctaccaattcaaacaagggcctgagcttccttgtaatcaaaccttcgttcctggttaattttatacttataagcctagattggataatgctgaattactacgtacgttgggcctacttgaatcgaaagaaaacggccatcagtttactaacttcgagcgaaagggtgcagattcctctgggtcattggatacagtagcctcaacaattggcagctcttctacggttgggcaaacaaaaggcaactataaggcttcattgtttccttcaaccaatactagctttcacaatgattttatgaccggagtcggccaacaacaacaaccgcagacctcgcctcttaataacagtggaatgacatttatgggagacaacaccccatacagacagtctctgaatcctggagttagtaagtttggcaacaattacacttacatgtcggtgtatcaagagccctttaactcaaatagcaacgacaatggccacaagaagcgtgaagattccgctcaacttctagctctagagctgcaatacaaaaactcccagattgaagctttagagaaagaggttgagcaattgaaccaagagaagctagaaatggagagccaaggaaaaaacgatgcaatgtccggatcgtcgcacattggtaactacgagcaattgtacacagaaatgtctactaaactgaacgatgtacaatctgagcttgaagacaccaaagaacgattagagtgcgttttaaccgcaattgcgatgaatccagtacaaggacaatatcaagcaattacgaaagatggacggtacgatgagcaggagatcgctcacaaggtgttgactaaactacgttcgttgactaaagaaaatgaagaaatggcaaaaatgctgagttacggacggtctaaacagaaagacattgagatcggtcttctgaaggaggaggtgagaagtttgaaggagaaactcaaagtacaggagcagtgaaccttatcaagatagctagaaatagaaatggttgcgtacggaagtgagtttaacaacaaacgttttatgtgctaatactataatcaatatatgagtattctataatcattccaatacaatacagaaataatcaaggagaaaacattgcgaattcataaagtcataatcattcatttacttaatatcaaattaaatacatttcaattatgcgacctttttgtcattaccataagccttggtcttgtacttaccgttcaaaagaatgacatcttgaggtctgtagtcaaacttcttggtaaggaatgagttcaagatgttcttggtaccttcggcatatctgacctgggcgtccaaagtggtacctgagtaatgaggagtcatggcgtttccgtatccgtacttgtttctcatatctctccatggatggtcctttggagctggctgagggaaccagacgtcaccaccgtaacctctcaattgaccagatgcaacggcatcagcgacatcttgagcattgcagatggcacctctggctgtgttaaccaaccaagcacccttcttgaacttggacagaagctccttgttaactaaacccttagtacctgcgtgcagtggggcattgacggtaacaacatcggcttgagcaaccagctcctcgacagtgtcgactcttctggcaccaactttttcctcggcctcttttggaagaccttggtagtcgtagtacaacaattccttagggttgaaagccacaagtctctctaagactctgtaaccaattcttccagcaccaattgttgcgatggtcttaccttcgatatcgtaggcgtccttggcgatggcagcaacgtcccagccgtggttaacaatttgctcgtgagctggaacaaagtttctcaccaagttcaatatagtcataacgacatgctcagccactgaaacaacgttggaaccagtaacctctaggaccgaaatatctaggccattttgttcaatgtagtccaagtcaatgtggtcggaaccgacaccagcaacgaccaacaacttcagcttcttggctttttggattctctccttcgtgatgtaggctggatggaatggagtggaaataatcacatcagcgtcaggaatgtgcttttctaactcagagttttcaccctctttgtctgatgtagtaaccaattcatggccgcccttctcaagccattgtctaatacccaattcattttcgatacaaccatacaactttggttcatcggcggcgtgcttaccagcggagtacaaaacgagaacgattttcattgtttaagtgggtgatgttggaggtatttgaggtaaaataggtttatagtttgataactagcggagaaaagaaggagagtctcatctggaggagaaataaacttacttaaatagtttttcggccatttaactgggttacgacatcattacgtgtaggtcagcacactgaatagaattagactaagtataagcacagggagttgggggtagccctcgaaaatcaggacatctggggtaaattttccctaaaatgcgcaccaactgcagtacaatatggcgtttgggaggagcaacatcccgacaagattgggatttctgtagcctttgccataaactggacaggagtttccacacccgtttcagccggtcccttttattggttcttcggaaggctagagtaacggcccaatgtgaagagaggaacattgtttcgttacgttccgaaacctagaatggtgttttgggaagggactactaagatgatgctgtgtagaagtttgagccgtagagtcccacttagagaacatcatcgaactatttaattagaagctggttccgcacccaatgggatttcaagtagctttcaacgagatattcctaagaagtgaatgcttgacctaccgtgacaacaaaaacctggattcatccctggttcctagagaatgtattggctatccggtgagtagcccccgacttgccattttggtacactcctctttccatagtcatctggcgctccaaaagtttttcggaatccgaaacggcacgctaaagtttcccgattgggtttatctttttaatctttatgtttttcttaggtaatggaaaacagttggacacgtacacgaatatggacgcactcaagtccttaaattgaaaatttatttcccgcagctctcttcttgcaaacttttcacctctgaagtctccttcgtctagcatcttctttacttagcagttggaactggttgcttcgtccaggctgatccttctgccatttccaccttcgcgatcaggtgcaagggccagaattcttacatcttctttcattctcctccacttgcacggcacgactatatacaaccttcgagatcaatccttacaaataccattcaagataaccatctaatgtcgcaacctacagatgaggctgataagagtaccggcaatgcccaagtaacacacgagtccatcaactttgccaacttcaaccaagattccacttgcgtatcagttggctaccagtccggatacaagatatttaacgttgaaccgttcacaaaatgcctcagccttgctgatactagcataggcatagttgagatgctcttctcctcgtccctagtggccattgttggcttaggagaactacctgactcttcaccaagaaaactcaaagtattcaacacaaaacgtagatcgatcatatgtgaactgacttttccaacaagtattctcgctgtgaagatgaacagagaacgaatggttgtgctattggaagacactatttatatttatgatattaacactatgaggattttacacactatagagaccccaagcaatccagagggcttgatcgccctctcctcctccacagaaaacaatatactagcttatccctctcctccaaaacttccaaacaggcaagaaacttccacaaaaggaaccaccaatgacaacgatagatctcatttggaaaacatccccgaaaatgtcaacgcaaactcttcaaatctgagaaatggggatgtgatcatatttaattctcacactttacaacccatatccgtcattgaagcccataaggcccaattgtcagctattgcgctaagcagtgatggtacactactagcaactgcctcaaataaaggtaccatagtcagggtgtttgatgtggaaactggtgtcaaattgtatcagttccgaagaggcacttaccccacaaagatctattgtctatctttcagtcaggacaatcggtttgtatgcgctagctctgccaccgagaccgttcatattttccgcttgggtcaggatgaagctaataataccatgccatctcggtggagtaaaaatcagaagctggctttgcaacggtacaagcaaagtatgaaacaaaaacaaggctccaaaccatccagtttggtagattcagactcagatccagatgttgatgaattggtggagaatgataactcggatgatgatgaattggaagaagacatcgatgacgaactggctgaagaaagattcaattcatcgttaacggtgcctagaagggtatcctcaaccacctctcttggctcatatggaagtcaagaaagtattggcgataagatcgagcctcatgtggatagtgccaggagaagtgttgcacggatgattagaagaacttctcaaagcctcggaagaaaagctgcagagaaaatgggtccctatcttcatcctaagttctcatctttactggaacccaatcgacactttgcgtcgctaaaagttcctgcatcgaaggatacgaagacagtagttgctattgggaacagtgtcggccaaggagagctacttcaattgggtgagcacgaagatgtcgacaattcgagtagcacgtcggattccacctttcatcaaaagcttcttcatgttatggttgttagttctgagggttttttttacaactttggtctagacactgagagagggggtgattgtacactattgagtcaatattcgttgctgactgatgtcaatgacgggtaaaaaaaataaaactagcagccggcggaactatgggatgcattgcaagcaataatcgtaaaatagtaagaatagttagtagcagattatataattaaatctgaatattccggttgtgtgtgatattccgtgataatttttggaaaagcaggacaagcaaaaaaaagctatgaatttcggaaaaatcatgccgtttcatccgcatagtaaaggtttttccgaaactggaaacgacgattcacctgacgcattctaaatttacccacctatcaattcaaagtgtggccacttaaatcaaatgaaggacagtctccagtgaacatgactcatgcttctcatacctggatctcccccatttttggactctagatcttcagtgcatctcgtagatgacccaacggacctttctttctgcaacttctttatcgcgcgcacatagccaaaccatactgtgaagtttgcatctacctcccatctcttcttatctcaagatcataattaactcaaagactataagcagattcactactgcctattttcttatcagacattaatacccaaagggcacctatttttaccaaacactcgaggacgtcctgtgtttttttagccctaggtatctttgcatccctagcccctaagccagtctacccaagttatcatcgacttgatcgtatcctctccagttgagaaatgccacggagaaaggtttccaagcaaaccactttgtttgacatacggatcaggtcttgtgaaaatgatgttattctccttaaagggtcgcatgaagatgccgcctctgctcttttgtcaggagtgatagtattgtctgtattggagcccatgccaattaaaaaactgtctctcagactagtcgccaccctcaggtttagatggaaggagacatatgcaaccgcaagtggacatgctacaaaagaaaataagtacaagaaaatcgtttttgagttctgttgggatgacctaaacataagtgagtatttcaaagacctttacgatatttacatgcacaaagacaaaagttattccgacagtgtacctgctggtcaatcgggttccgcagttagtcttacaggtttaactacgggtcgtatttcaaagtccaacaactcctcctcttcatccctgaaaagtttgtccaatacggtacgagcaaaatcaaaatcgtccactagtcttcagacattggcaaatctctcctccacaaaaactgaatctcacacacttggccagggaaactatgagattccattctctactgtgttacctggggatattcccgaatcgttggaaggggctcccggtgcttctttagtgtacgagcttgaagccaacctcgagagaagtaggtttgtttctaacatttttgctagaaaacatttgagagttataagaacgatgaattctgatgccgctgaattaacagaaacagttgctgtggacaatacttggccaaataaggttgattattgtgtcagcataccaaatcgtgccatggcaataggatccgtgaatccattggagataattttggtgccattatcgaagggtctaagactgggaaacatctcgcttactgtcattgaacaatataactacaaaactgctactggaagtcaaaccggagaacgaattgtttccgagaagcatatgaaaaagccatcaaagactgcagatggcaagaacatatggcaattggaaccagatataaatggtgtcttttttcagaacgaagaatttttgttttccaccgagaaatgggaaataaggaccactctccctctggaaaattcgttggacaaatgctctcctgattcagatattgctggaagtgtcaaaattagacacaaattgaaattcaatattggactactgaatagtgatggacacatttctgagttgagaggaacgctacctgtgattctattcattagtccatttgttccagtaattgccgcaaagattggtgatccatcagttgagggaaagaataatagaccccctgctcctgctcacactcgctcaggaagtgataccgtattattcaggtctcgtggagagtctggtgccaataccccactacatgagaatccgccagtgaaaacaaacactattgatctaatggcacccccaaattatgaaaaccacgtcttcgacgtaccagtagacaactatggtactccattagcttctcctggaacctctggtacgacaagtcccagaataatcaatgcaggggctaatggtaactcaactactccatctactcaagcacattctcgtgctagttcttactttgccctcaatatttcaccaaattcgtcatcaatcaacgccagtgatcagctagtcaggcagttgagggctttgaatacacgaaggggatcgcaagaaagtgagccaagtaacgctgaatcaaaacttaatcgaaataagcctattttcacgttaagtgacggtgaagatgaagacgacgaaaatagagatgcccgtgattcccttgtttttgactctcaaggctcaactcctcacatcaatcaattagactctttagagttttcaacaggtactctgagggttccaaaatctcccatcttggactttgcaacacctggaatattgagtcccattcagcatttatcaagagctaactcaaaggataatatctcctcaaccttggattgggatgacaatctgctttccagggttcctagttatgaaactgccgtgaagaatgaagttatggatgagccaactcctgtgtacgtcccaccttcgtcatcttcaggtattaatatggaacaactgaaccgaagactaaaaatagcacaatcgtcccaagatcggaactcaattgattccaatcagtcaagttcaagatcttatagtgcgctgaggcttcctttacgttcacctactttggaaagccatacaagcatcatggacctggcgaagtctagaggatcgagcaacggcaactctcccgcaatatcaagaaaccagtcctcactcaatctaaccaagagaaatatgggagctaacgataagctcaactggagttcgaatccactagatgagggatcagatacctcctcatcatcacagctgaaaattaatctgccaccttccgcatatatcgcccacctacccagttctaatccctctggcactgccagtcaaagtgaaactccaagtcgtccaatttcaaggccttcgttgggaaccagaacaagttccttcctacatatcgggcgaagcttcagtcatgcttccctgtctaatcactctgatcccagttcttcaactgccagcctttccttgttatcgaagaaagataaaaaggtttccaagaaataatctacaaatcaatatttatatagcagaatcaatgactaatacttgtgtttaaatggtccttcctattattatcaattgatcccgttttttgatccataccagaaaatgaaagaggcacgaagaaactcaaaaagagtagcgccggatggtttcgatccatcgactttagggttatgagccctacacgcttccactgcgtcacggcgctttacatcagcacaattaaacaaattacgagctatatcacccagaacgaaaagtttggaagattgatatataaaacgttgtctatttctatatgtatagatattacatgtctgaaagcacaacatttgtgccaaaacactcattaactaacacttactatatgcattactgttaactacttgtgattagcgtgcgtcaggagtatctcaaaacttaataaataacatttgattaaatgtacttactattattcattacaactgtttatctctctatttccgatcctaaagctcatcatgttcagtgatggattccctagcgcttgcagatgcttcgtttataatttgctgcacttgatcatcatactgggtccattctggaatttgtcttcgtgctctgtctaattttggttccttggttaaagggttgttgcaaaggtctatcgtctttgccttctttaaactctcatcgctacaccaagtttcacaccacagccactcttgagggagtgaaaaaattttgatttggtgctgaagattatttggtagatcttgatctaggtttgacaaagaatttggatcttgagaaagttgctggtagtgttgtctcaacctatcaccggcagcaatctgcctaaaagttttcaagtcaatcacgtacagggcactgatgtgatactttagagtatcacccaagagcttctgccaatatccctgtttccaaaatctaaacccttccatctcttccctgtcgttgcacattggagtatatccataaggcgcaccttcaaggtccaaatccacaagctcctttagatctgttctaactatttggtccgcgtcaacaaatatcactttatcgaggctttgagggaacaaaacatccaagaacaaaatcttatatccccagatagttcgttgtttctccctttgacccctcagccatgctggccacttatagttgaccagttcatagtcaaacccaaactctcgggcaaggaagggtaaattcttcttgaacgtgggtgacatgtagttctcaattagccaaaacttgacggtatgcttggtgtgcttcattacagagtttgtcattattgacaagaatcgctcatatagatgcccactagcaactgtgaaaatgttgatatcagcattcttcggttgttcttgttttcgccatgaagacaaaaatttgctgaggcctgtatctttttcagtagttgctgtattgccaattagagatgcattctcttggccaggtttcctgtcaaacacaggcagaataacatttccattcatatccaagacaaagattatagcagtctcgtcaataatggtgtactgaagtgtatcaccgttagacttacttgtaacgttcgccaatcgatagatatctgagcccctagtatggggcttgacaacaaatttccacaatcctgggttcgcttgcaattggaaatatccataattggccataatacttgtgtcggaatgtcccacaagctctatgggtaaagctacaggtggatattttgtgttcttctcaagtgcatacccttcaactagaagcgatttcagctcatagacacctgtcacatcacctgaattttccaatagtacattatccaaatcggtggcagcttccttaatcacaacaatccacgggttaggaacgtccaagtctaatgtaaacaaggttttttctggtaccagtgtgaaaaggcctttatcttcattatcaatagcatctcctgcggaggaaaatttcactgaattaggaaatactccacgataaaatcgtttaatgtttaactccctagcttcttgtggtttcaggataatgttaagcttaaggctttccaatttttcaaacaacgagagcaacgatattagcttttgagactcttcttgaagaggatctatgatcacggtcacatccatgatagatggcccagagtttgaaacttcaatggagactgcatcattgagaaggccagtattatatcttgggaatacccgttgatctgggtgataattgtcaccaaagaagtatgtattggagatgcccatagtgaaatactcaaacaattcaaaagtatccaaactcttgggttcagagatgttgtactcgcaaaacagttcatgagcgattctcaacttgaaatctatttcgtattcaactagcagtttgagatcagtgtctttcagtaatatgtccttatctctaatcttaatagcccttccattaagaattaagtacatatcatttggtttggagagcttgattttgaaaacattgtggacaaaatctatggtttcgtcgttcaatacggtgtctggggaatgcacattgattttttcaagttcgttatcaatgaacgctatcacatccaccaaagacttgtttatggctgtctgtaggctcgatgaaaaatcagagtttgaagaagtttcgtagactttgatcttgatagggtccaactcagatgcagcagttatcaaatgacggagctgctgcaaaaaccttttatccttgcagtttcctagtaaccaggacgtaattgggatcgaatctggttggccatctatgacaactgtggcaatccgattttggttctgtgaaattgattcgaagacttctaaatcatcataagaaacaagggatggaaggttggtttcttcacaaattgcatttatgataaggacattcctagaagtgtgagatccaaggtaaatgtagtcttgggctctcatatcttcagaaagtgcaccgctggagatcgcattgctcaggtcaagtatgtccagaaatatctctctagcggaatgatactgccagttctgcacgaaatcaaaaaacttaccattcgtaataagtagtgggtggtcaattgaaaaggaactgatgaactcgttgattttggaaagcagatttttcttatcagaaacagggaccttagtgatcgattcaacggaaattatatcccttggagtctgtcctaagacattcatggcaatatcatgcaagtattttattccctggtttatgcccttagcttgaaagatggataaaaactgcaaagtaatctcttcacttaacttatcagaaataagtggaacaaagcccactctttgtggtatcctgttagaaagcattacagatgaaaattgtagcaacgtgtaaacctgattatgatctgctagatctatgacgaacactgattcgtgaatgttctctctcacagggggaatctcacctggagcaactgatgtcgtataatattttctagagcttgaaagtccagaatattgaggatcagtttcgatatcattcaagtaaaaaacagcttctccatggcctctaatatcaaatctcttgaacatagtgttgttaactgacctatcggaaatgtgagcagcaaaacgcctcatgatatcctgtgcatgggttcctgtaactccgaacttggttatgtcatcgatgaatgcatattctctcttcaaaatattcaagatctccatataatttaacttggattggtcaactacagccccgttaatatacacaccctgaggtaaatcattaattgagttttccaaactatcctcaatgatctcctccacttcagtatccgttacctgacgatcaatgaaagatgcaaactttgggaagtcttggatcaacttagtgagaattgccaacttttcgttctcggacacttcaaggctcttgatataaagtgaaagtttgtaacccaatgccctaatgtatttctcagatacaggctcaatctctttggagtaaacatcccaaaagttatcggattcagccgcaatgggctttgtttctaatgatttgtcaagaactatatctctgtcgtcaataacaatatagtcagttctctttaaagttagatcaacaccatacccagctagagtttctttttgcaaaacggattcgtcagaaatatacctccaagctaatctcagtctaccatctttgacgaatcccgccaagttagagataaactgtgaaaaaagagggcttctataatccccataaataattgcaacaggaacttcatcatttctgacaccaatgactctatcgaatggcaggatttgtggtgggcccgtcttgccgccagttttcaatgcgaagacatcatcggagttgcagtatacttcactattgaaatagagccacgccttaggattagttccacacttgtcacctaaaattgaggaccgaacttcattgtagtgctggtaatgtgattgaacccttggagcatagtacttgtttgcaagatatatatcagttatcgacttttcaatcgatgccccagccctatgagaccatttttcgtacaattcttcatcagatttaacaaaaggaacagcttcaaattgcaaatcttcatcttctagctctaaagattcaaatgagacgtcaaacatggcgtcaagtattgtgtaaaagcctgattcattctcacttgcaactgtctccagtagtaacagtgggaaaggagttttgaaccaattggccttcaaactgatatcaacaaacttttcagatgcaaacacggacagacataagtatgtcaacaatattaagacatgattaatcatattctcaaacgatgttgatagcgtagcttggagatgaaagtgatcagtggagggtagtagaagcgttgatctggcctgaatttcgctaatcttgggtccaggggttcagctcaacctctcaactaccctgaggtcatacgcagtacattacgtggcgaaaggatgataaggatatccttgctgaaaagagcactgtttccctacgggcgactaccaatgcataatggtaggtggtattcagacataggtggcggaaattcaaggaatcggaacgaacagaaaccaaaattgcctgtaccaactagtaatgaagttaaggacaatgagtcaaacccggacttctttattaaaaacggctttagatcagctgatattgcagagacatcctttgtgaaagacaagggtgctacagtcgaagaggaacgtaatacatcggacagttcacacgaatctcctcaacttaattttaaggaaaccaacgacgaaacgaattcaacgatccaaccaccagtggcaaaattacccaccccaaagcaattgaaacaatacctggataggttcatcgtgggacaagagaagtgcaagaagataatgtcggtcgcagtttacactcattatgttcgaataaataaccaggctcagaaacggaatcagaaggtcgattcctctgaagaaaatgttgagaatgggtttccaaatgttactaaagaatttgaggacgaaaatgacccagattatgttccggatttggagaaatcaaatgttcttttgctgggaccgtctggatcaggcaagaccctgattgctaagactctcgctaaatgtctgcaggttccatttataattcaagattgtacctccttgacccaggctggttatgttggcgaggatattgagagctgtattgaaaagttgctaattgattcagactacgatattgaaaggtgtgaaaagggaattattgtgctggatgaaatagacaagttggccaagccctctgtctatacaggaaccaaagatattgcaggagagggtgttcaacaaggccttttaaaactggttgaaggtactacagttacggttcaatgcaagaggagcaatgctcctgatcataatcagttcggattgaatggcaaagctacaaatcaggacaaggaaaattatatcgttgacactacaaatatcttatttttaaccctgggagcgtttgtgaacctagataagattgttgcttataggctgaagcagaactctattggattcgatactgatgagtcgaaagatatttctgaaacagactcagtttccgacaaatctacattagaatatgttacacttccagatggatcaaaagtttcagctctggaacttgtgtcttctacggatctacagaattatgggttgattccagaactgatcggcaggcttccgattgtatcttcactttctcctttaacagttgatgatcttgtggctgtcctgactgagcccaggaactcgatactaaagcaatatgtgcatttctttgacactgtcaatgtcaaacttgctatcacttccaaggcaatcagaaggatagccgagatctcgatcaagaatggtacaggtgcaagaggtctcagagccattttggagaaactgctactcaatgccaagtatgattgccctggtagtagtatttcatttgtgttagttgatacagatgttataagtaagtctatcgatgagaataaggaaacgggggaattcgtcttcaaagatggtgagccaaagtattactcgcgtggagaattattttcctttttcaatgagttatcaaaagaagacgaaaaactcaagacatcaattgaaaagatgtgccaaataccactttccaagaatcgcatagtttactccgaagaggagcaggcaaggttggattcttctaaacctctcgccgtgaagcactatgaacctttcatttgaaaaatgatcccgcgaatatttttctatctagtatcttgtataattataatagtatagacctaagagttcattctctttagtcttcagcagttggaaatgcaatcgatcagcagcttcttgccggagcctaagaacgcacccaagagaagtattcctcataggagtcaaaataagaatcaaatattgatccccctagaagccaaagaactcagcacagtaaattaccaacaggcatcatatggggacttgataccgttaagacacacaacaaaaaatattgatcttagcagaccttccgaagaagagatagcaagctgtactgaaagaacgaaacgggctttggaaagaatcatcaacgataagctgcatgccgctaacccaagcagcattggtaagccaagtaacggcccacagtttgtaaagtatacacctgcatcattagatggtaatgcacagcaaagaaccataaagattgttgaaagacaaaaggatcctatgctcccgtccagtgtcagacacagaaaagtgccccccggtcctcctccaccaccaccaccggtattacatacgtcatccaagaaagctagcaacgaagagcagaagaagtggcatattcctcctgcggtatccaactggaaaaatcccaaggggttcacaattgctgtggacaaaaggatggctgctatggcagatgatccagatagaacgaatgtaaaccaagtgggattttccaatcttgcagaggcgctagaaaaagcagacaagtcagcaagagaaaatatcaaactgaggaatgaagtccaaaagaagataaaagagaaggagagactagagcaggaagaaaaattaagattgatggctgtcaaggccagggaagcacgattagcaaaatcccaaaggggcagggaaagcactgacgattccaagttggcaggattgtcagagagagaagccatccgggcagaaagacgtcgtagagcagagagagaactaaagttgacccgaaaccaagatgaatctcagattgcagccttcacgaaggatagagacatttctaacgaggtcgtgctaggtcagagtagcaaaggaacacagtccatggaatcacgatttgactcgagattgtttttaaaagcttcaggaacgaatgccaagtcaagtgaggatcagatctacaatgaaccgttatttgctgcccaggaagtcatctcctctatatatcggcccaaacaactagagacattacaggatgatgttaactctgacgaggaactaaggaaaataaacaaaaatgccaagtttgaagttttgggaaaggcaaaacttgggtttagtggcagtgatggtttacagccatcaactggcgggccgattaggtttgaaaaggaatctggtaagcgaccagcctcagaagacgaagttcaggataaacactctgaggaggcctacaagcgtaccaaacaataaatgaaaccaccacttatgacctatttaattactaatttctaattacaagtattctattcatcgtcgtcattatccgtatcaaaagaaggaattttttggtttcctccaaatactaaatccaacacattattgtgatctttatgcaataaggttaaagtttccttatttttcttcacagcataccgttcacaggtccttatcgttccgcttattcggactattctgatcaatatcctttggccttccaagtgagttattaaagaaagagcggcacatgtatatctaaaagagtctcttggacaacgtattattcctgtggatgttttgttgctgaaatatttggtctgggcagttgaacctgctatgcctgctatgtgatctccaaaattttgtttcagagagtttcttagtgctatgagaattgtctgtggattcacctgagaagacgttgacttgtgcatggccaccaatgctttgcttcttgaaaagtcgtctatctcttgaggatacaatatgtcaaacagaatgtatctgtttttcagacgaaccatgcttagcgggagtaattcactagatagcagagtttgaagcttctgttgagaaccttgagctgccagagaagaaaaattcgaggactactttgataacagaagtatcctagctaaatgattattccattcaagaactagtaggaacatactgtcagaacggggaacagaaatggaaagctgattacgtttatttcatgtaaaaaaactctaatctattaaatctgctctactaaaaaacaattcacgtctttcagccattgttcatggttgtccttcaaactgttggacgtagcatatcgcacgttatgagttaacatatcaccaaacccatatctttcttccccaaatgggccttcatttacggaatatatcaaatcttgaacccatcgttcctgaataattagcttttcaatcaaattgcaccaatagtggatatcttttttaagcatccctccattttgcaaggcatgaagtttgttgtagagattggtttttgctcccaattttgctttgatttctctattgttgagttttatgtatgcaaatgctaccaaaccgcagagtaggcaccaagggtttttgattttttcactaaatttgaagaaagttcccaacattggacggattgtttcactaggaatgtagaactttgcacaaaatgctgtgaattggggaattgtgacagtcatctgtttacgaggagacgaactaggcgtgcttggcgtcgaagatttccctttaattggagatcgcctttttttttctctgttaatgtgttacttttgccgggggtactcatgggcgatggaagtccaatatcctctaaaacttcggcctcctttgatttggttcttttttctggagccattgtgggattttgcctacctttttggaagggattctgatcactaatgggaacacgagttactttcagttcccgtctaaagtgattcaagacctttttcaaacctgtctttggcagaggaatcttttctaccagtggctctggaagggaaaacttctcacccagactttcaatagccaacaatgcacatatatgggttctggcaaactcttgattttgctttaggagaccggctttaagtcttgatccagtgataaaatcgtcaacttttgctatcaatggaccggggaatggctcaggttggatcggtatcagatccctgatggagttagtgatcaactccttgttcatatcaacaaaatgctaaagtttgttcagtgaataattagcttgtctcttgagattccaatctacctatttcgtgtttaagtactatttcccaattaggaaattttcacttctacttggtaaaatcacatcagaacaccagtcatcacagttccaagatgtcggatttcgcgagatcagggctattggcgtgatgaggtgttagattcggtgggtgatttacgccctagtttccttcatccttctttcatttgtcaccaatgcctaaagttttcagtgccaaggtcaagaatattctttctggagacaccctcgtgctgactcctcccaataacgccagcggttccgaaagagtcttatcattggctcatattcatgctccacgtaatggtgaaccatacgctttcgaatcgaaagaactgttaaggacattattgattggaaaagtgatcaagttttggataacctatactactagcactggaaaggaatttggtgatatttctgctccaatttttccgagcttggtggagtatgtgttggaaaagggaggtgctaaactaaacgataagtttgacgatgaagaatacgatcatctacgagaaatcgaagagaaatccgcggcagaaaaggtgggactacacgcggatgacgtaccgtccatctctgtgctttcaagtgtacctaatgattcaattggcgaaacatatgacagtattatcgaaagagtaatctcaggagacaggctcattgctcgcatcatttcgaacgataaggagcacattattttgcctatactaattgcaggtgttcgtgctcctagaactgcctcttcggaccaacctgctgaaccatttggagaagaaagcaaaatatttgtggaaacaagattattgggcaagtcattgaaagtaactcccttaggcaactcatcctctggaattccagtgtgcaaaattattcatcctgctggtaacatttctgatagacttttggaatcaggcttggccgaagtctcggattggcaatccactttggttggatctcaaggtatgtcacacttccgagaactggagagaaaagccaaaactagtggccaaggtatttggaaacaatcctccgactctgtcgtcaccgctcctagatctacttcaaactctttgaaaattggttcagtctttaatgcgactatttctcgtattatctccgctgatacccttcaactgaccctgcaagataactcagagttaacagttcagttagcttctttgcgtggtccccgtcaaatggattccccaacatttgtaccagttgcacgtgagtttgtacgtaagctggctattggcgatcattcaaaagtcaaagtagaagctatcagaccaaaaagcgagcaacttgaagaaagacctttggtctctattacgttgagtaatggaaaaaatctgtctactttaatagttgctgcaggctatgcaaaggtgatcaaacacaagagaggtgatgacgacagatcttccgactgggatcttttggttgaaaaggaggctgaagctatctccaagaaactgggattgcatggtaaaacccctgatgctgagaggatagttgacgctagtgaaaaacaaaccaaagccaaaacgttcttcaattctttgcaaaataggtcgcgtatttctggtgtcgtagaacacgtatcagggtttaacaggtttaaaatacttctcccaagggagggtctcaagttgaccttggttctaggaggcctctccaatagctctgttccaagagattcacctttgtacaaagaagcctcgagttatgtttctcaaagagctgctcaaagagatgttcactttgacgtctatggaatggatagaacgggtgcattcattggtaatttgtacctatcaaacgagtcagttccgttacagctagatttgttggaacatggatttactgaagtgcacgggggttcattagcacaaaccaagtttgaacgccaattcttggaggctgaaaaactagctcaagagcagaaggtcggtgtttgggagaactacgaagctgaagctcaacttgaagaagtcatcgctccagtagaaaacctgacaatcgataagaaatatctagatgtgattatcactgatatttctgataatggagccgtttcttatcagatcttagactctaatcaagcaaaacttcctgcatttatggaacaattccacgcttattttaggaccaacaaaccgtcattgtcaaggccacccaaggtaggtgactatgttgctgctaagttttcggagaacaacaagtattaccgtgcaattgttacctcagttgacaaaacgaaccatacttatgaagtaaaacacattgactatggaaacaccgacgtattaacatcctcttcctttttgcttgcattaccttctcagtttgatgctaacagtttaccaccccaagctcattctgcgcagttatcgttactgaagttaccgcctagccagcccaaggattatctttcgaaagcacttgattactttgctgatctgacagctggtaagaacttagttgcttgtgtgaatttccccaacccaacttccgatattgaatccgatgtaactttctacgatggagagaagattaagcaagacattgtttaccctatcaacaatgagcttgtacgaaatggacttgcaattgttaaaaagcagctcacaccaaaggagaaactcctttcaacagagttggagacgttacagaaactggaggcagatgctaaaaggaaccatttgggatgttgggaattcggtgatatcatcgaagaagacctataaccttctgtatatacaagtatatccatatcactatatacaagggatatattacctcattttttgatagatggtgcagttccttcgatgaaattcataatctcttcgattgactgattagcgatcactggatctggggtagtttcgtccgtactagtagttgcctttttcttttcagctgacttggaagacttcttattaacacgttcaccattcggcttcattttttgctgctcttgagcagtgatcacagaatatttagtcaattgtgacatcaatttgtaaatccatgctgtagtagaatcatcgataccagcattctttctgaaaattttgtaagaagttgacacatcggcaagagctcccttaaagtcttccaacagagtcttagtttgaccacgtttgaataattggagagcggtaatggtggagtcttcatcgttgactttggcactcaacttcagaacgtactctaagacggccaaacattcagcatggagccctaggttctgcaagtttgaagcgacgctttccagcgtgctgataacagtagggtgttccatcacagatatagttttccacaactgtagagcattcttgtagatcttcagagagttcaaatagtccccattctgattttcgaagtagccgctactgattagggcaagaacagtagaatatgagtcaaagcctgcagtcctctcggtcaaattcacagatcttctactgagagttgcagcttctccgaacgaggaaagttccgcatagttttgggccaataaactgtaggcgtcagcaacctctttatgaactggaccgtacacttgctcatacagagtagttgcctgattcagaagagcaactccctgttcgttctccttctttgcaataaatgttctaccactctcccagacctcttccaccagagtcgaacggaacgtggattctttaacgataggtacgatggccacaatgtcatcaaccgaaaatactccagtagtggtgatatttgtggagacttcggaagcaagttctttagtcttcctgcccttcttcgcttgtttagattctggagttacctcagcttcagtagatcgagcggcagtaaactggtagttgcgtcccttaatttggagaccaaacttggtactaatttcacgaagaaggacgatctcgttaatttctgtaaaccaagtatcaggaataatgtatctgaatcttacataggcctctttactaattaattcaacaacatcctttgaagtccattgggtgaaagaaagatctgcatcataaatggacaaattctcgtcaacgaatatcttaggttctggattgaattttgaacccaataaacagttgaaaatatgagtgatgacataaggggcaaaaggaagcggcaaagaagcgatttgttttctcaagaggtgcttcgtagatctagcaataatttcttgggtaaccacagtaagaagagacttgagagaagatttaacagggtagaagtcagctctatcagttgtttcttctttagaatcttcattcgattcctcctttggcgagtcttcggattttttcttttgttctttgagctgctttctggcctcagccttcttcttctctagtgcttcgtttattccttctattttctttctggattcgatgagctcattttcatacttattcaaacgatcgacaatcatggaagcgatcacacccaagtaacgaatgttaattccttgcgtatgcaaaagagttgacagatgggctccgtcaataggagtgattatattcgaatctgcgatattgtccaaaaactctggaatcaaaatttcggtaacaaacttagacacttcacgaactctggattcatcctcttccaattcctttaaatcttctggtgaaggagctacagctttgtttaaggaaaaagcatctggattcaacgtgcaggcatcaggatcaatagcgataacaggctttttctctccacctttttcagatgcagaatcttcagaacttttttcctctagtttttgagtttcattgtttaccaaaacgctgacttgccttctccaccattcctcaatggcttcgtgccttaaggtgacttctctatgaggataagatgaatctgcatctggattatagtgagcctcaatgaactcaatgtccaaaggactagttcggtacaagtccataatgtaagaacgaccatcgttacccttcattcctttggtttcgatggaagtgactaggctggtagactgggatccatcctttgtccagactttatgttctttcaaatgaaaagcttgtgcaattggtttgagttttggtacaaacttttcattacttgacaaccgggtattagcttctgacccaccataaagaacatctgatggagattcagattcagagtcaccgtcggtatcggatgcgaccccagtgaaaattcctggaaccggagtttgacaaagaactctctgcccacaataatccacaatggcagtgcaaagatgacaaacgttactcacatctaaccggttgagataacgaatggaagccaagtctctattagttgctgccctggcagcttcatcaccaccagttttggcaaattgtcccacaccatcaacggccaaagaataaaagataccgtttcgaaggaatatgtgctcttcaggcttgttttcagggttcaaaggcagaaattctttgttgacgattgaaatggcagtcttgattgcagcttcagtgaaatcggccgaagttttgtttagcaaccgttccctgaggttgcgttcttgaaaagttgacttgggcatctcacggatattttgatagtcatcgttccagtctctaatgagatcagcaccgtcaataccaccgtcaacatacagagattgagtctttgccaaatcaggatgaggggcatctagtggcaaatctactatccatggattagcaagagtagcattagttgccggttgataaaccgctgagtcgaatttggccaatagttctctatttgcgaccaactgcctattcaaagcgggagaaagattgtttaacaaggaaagcaatgaatgcgacttgttgactcttggctttccctgactattaggcaatgtctttgaagagccatcaaatttggcaaaagtggatttgttcacaaaaaaaccagacacatgagaagtgatatggtacacttctccttctatagtttgaacataaagatacagtaaatcaccgttcaatttttgtctcggagtgggcgggttccaagaggacagtacgatagcctcgacagctggtttcaaagacaatttgagactattggcgtgcgcagtcaaggacacctttttagtatcagtctcaaaatcaaagaatgattttacaaattcagaaattggcctcttctcctcgtctgaaagctcaggtttctttgcggattcttttttctcagtttctgcagtagtgttttcggtttcctttgcttcttcggtatcttcattgggacttttgatggaaactggatccaagttcagaagggcgaaacgagagcttccagcattcacaccaaagttggaagatccaacaggctccagatcaacaacatttctgacatgtttgatatgttctctggcgtccctttcggtgtacgccatctcttttaggacaagttctaaaacttcaatatcttccccctctaaaagctcttctaatgtgatctgcgagtcgagctcgaagccttcaagtgtggccagtttgaagcaagtaaagcagtttgtcgtggaaagagatgtgatggtgctagctacatcttcaattgaaccagatactaaggactggagttcaatcttttccttcttccccggcaaatgaatgagaagtttaattacctctaaacaataattgttaataagaaaaactcggaataattgatatctttataaccatatgatacgaacctctttttgaagtcttttcttctgtattttcagtcatttggtcgaataggagaaaccaaaaaaagagaagagtgggtgatgactttcgatttttcaaatctggagagttggggaaaaatcgctggttgggagcccagcatgtcgggttcagacggagacggaggcgggtgtggagagtctgctcgcgaggatagtatcaacttcactcaggatgaggcaatagggtagggggaactcagttaatgccttaacgttctttcatctattttcattatatacatcggactctttagttctcacagccccagcgactttctgacttgttctctgaccatagcatcaaattttggtctgtcatctctccatatcttgcacacatctatgttggcaccgctttcaacatttggttcagccagcatgctagctacactaagtagaatcttctcgacgctttgcaccggagaccagcgttcttcaggtcgttcgtatagcaatggatcatttcctggaggatgtaagattgaaatgcaaaccgttccatccgcataaatatttgggtgaatcaatggtggattgaacttgagtttgggcggtgacaatgggtaatccttaggaaatgtcaattgagcagagaataccccattctcgtatggagtatcctttggtccctctatcagacattcccaataaaacaaatcatcttcatccagagggcccgcaattatcccctcaggggcatcacgggatagctgctggtattccttgaataaccgtcgttgagcggttgatttgggaggcatctttggtcttagcgttccaattggtatgacgcttaatcgcttgattttgtctggctcctatgcacctcgctttccacccacgctcaactcgtaaacgacttacctgcatgaaaaataaattgagcaaattagataagcaaaaagaaaaattggggcagattgttcaacgtttatctttgaagggttcttgtctttaaggagggatacagggatacagtgttatgatcatagtagacggcgaaaaatatgcgtgtatacgttgtattagaggacaccgatcttccacttgtaaacacgccgagagacctctcatgaaggtgcggtcaagaggaaggccatcccccagttgtaaccacagaatagccatattgaacgagaaaacgcttaccacaacagaggtcaaagagtcctgttgcaacggagaacaccaaaccaaagttgaggactcgccggatccaccgagttgctgtgcgaatacaaacggaacggactcttcctcctcagagaacaaagcgaggaactgttgttcaggaagtgggaagaacgctgtgattatcctcacagcctctgacaagaaggtgatacagaacacagatgatcaattacaattgttagaaccggaaaagagggctcggattaacaggaaatcttccccgggaataaaaacagagaaggtttatgaagggtatctggcggatggatgtagtgtccctggaagttgtgcttgcgaccctgaatcttgtaactgtccttcatgtgaagttcataacttgaactcaacaaagaatcatgttcaaccgtttggtccagtaaaattagaatctattggtacgctattttcagaaaaggatcacaactatcaaccagagaaacaacaaactataagcaataacatcaccattgaagatttgaacgagtgctgttgcccggatgataactgtcattgctttaattgtgcaaagcatggaaacattaacggttaccataatggattaagaattgcggactttgaagacgaaatgttccgactgtcatcagagcatgagtcaacgatagacaagtttctccaagatcttaaaaagtctttcgattcaaattgcatatgtgccagtagcccctgcacctgtaaatctctgcccttgtaaatccctaaaagctaaaagccctctaattactactgtacatactctgtatttttgaaaagttacatattaatattaccagtcatcatcttgatctgattttggtatcagatccaactttcttagaacataattggcttctctttgaccgctcaaccaggccccatgaactgctccagctccatcaaaaatagtgtgctctccggcaaacctcacattatcaagacctttgcttagttgaattattggatccatggggtcatctccagcaagacaggctgaatatgatccccttgagaagggatccacactccagttagaactcacaatgttgactggatcagggatatttttttggcagacctttttccagataggtttgaagtagccccaagaaagttccggagaggactctaaatgctttgtcaatcttccttgggtaaatgccaacagtgcaggcttcccaaacattcgatgtaggttcaagaataaaactggaaattcccaggtttcaggaattgcgtttatgttcgtctctttaccaggagttgcaattgaaacaatcctgtcaggaatacttctatcccaataaagttgatcgaactcaaagataaactttcctagaaacccgaaatgaatctttttcaacgattgtgtcagcaattcaggcaggctaggctcccacaatatgctaccttcttcattgggacctaattgaaggatactttgcggaactgtaacaatgacgaaatcatactccttgacaccttcattggaatgaactttcactttccttccaccacgttctatccgattcacaacacattccaatcgaacactagactcagggatggaagaacgtagagagtcaacaatttggtcgtagccacttttattataacaatttcttccaacattgtcaactagtgcatacttactactcatctcatcccaagacactccatgccatagttccaaatctctaagcatttgtcctacgtaaagttgctgtttttctgttaagagaccttcttgcctggtcaaatacgactgaacagtgtccttcaaaggtacatcagttaggttcaaattttcaaagtatctcaactcaatatacttgcaggcttcagctttgacctgttctaatttttcataatcgtagtccagcactccttcatcttccaaaacgtacaatggtttgccatcatcataaacaagctcataatctttaccgttcttcttgtcggcgacgacctggtcgaatagctcgtttgtcaaggtgtcatggaaccaagaggctccaagatcgtatgggacaccatgaattccatctctatgcgttttgattctccctccaagcctatttcttgcttccaagatttcaatcttgagcccgtggtcattgaggacttgggcacatttcaaaccggaaatcccacctccaatgatgccaatattcatcctgttagacgaatctactagcgcattccaagtttagtatattttctgacacctcgaacgctctaattaaactacttaagaatcctctattaaaaccataaccaaaaacagttgtagcaaacataatacttcaataaagggatgcccggtataatagtatatagtaggccgagtaaatgattattattccaatcaaatactgagaaagaggcttattctgagattctacgctgctcctgtcggcggcactgaccaatccttctgaaaaagacgagataatcaaagaatctgcaactgaaattataagcattaagaagacaaatgcaaagagatgaaatatcattaaaatcccctgagctttgctaaatatttgcagttggtgataaaactttttcactgccaactgagtctcatcacggtctgattcaatgtccgtagaagtagtagtttgtccagaggtttgggatggaggcattggaacatccatgtccctagtagcctctttatctagatgaatattagtactctcatcctcggactgaacacgttggctcgcaagtctcttggaaaccgtcaacataacatgaaagaaaaataagaccaccaagcttacactaataaagttggtagtcactattctccagtaaacagctccggaataatatgcttcaactttatggtataactcattgaatgcatcatagtagacgaaatcatcaatgttggagtaagtgtcctcttcagagtgcaatgtctcaaacagaaaaaagtactgcgctagcttattgaatgtaagcttatttcccggatcattgatagtcgcatttctatcccaatgaaacctgaagggcattctatcttggtgaaagttttcaaaggtgatctcttcgatgtaataacgaggagtcttcacccgacccttgtaagaacaggccaatgtgacagaatcatcatgattgcaagatacttccaagtcaccttcttccaggaaaactggtttcatggaagattctaatttgaacagcggcgctagtccatgggttcgattcccgtagtcaatctgattgaacggagatctctcaaagaaactggcatcgcttggttccaagtcgttctttttgaaaactaaagagctcatgaaactggtgttatactgttgaatcagaaaaaggatcatcaaagccagtgcagctgatacgcagaacattgtagcgctccatagttgagcattatgtttggtgtaatggtatctaatattaaaagtcattgatagccgattgcaatgttgctagtttcatggaaaaagacgatgacaaaggtaccgttgccgtctatatctggtaacacaaacaccctcagaggcttgcatgatgacgtgagggtaaatggggccattaccagcgtattaaacgaaagaagctaatttgtccctccttctaacgttacaatccataatgataatttcgcatgctttaagtagttacctaatccttcatggtggacattagcgcaattggtaaacacatcgttacttagtacatcagtcagcataagtttcaccagctctcgcttgtcatattcgagcagtcgattcttccatctatacattagccattcctcatatttcggaccctctcacactctacctcgttttgtatctgctgttagctttgcaattaccattggattatggaattggacccatggaaggcactaaaacaggcctcttccttggtatcgtcaactgacatcaattactctaagatactagctgccaagaagtcattagagctaataggcggaaagggtgatcccatatcgacgttatgtctgttagcctctaatggcgacttggcgaaattagcgtcttttgtcaaggaaaatagacatcggcttaacgatttggacaaatctggtttgtctccgcttgtttttgcaatttgtttcaatcaccaagactgcatgaatttgttaatttcttctggagctgacgtaaaccaagaggatttactcctgggttggaccccagttatgtgggctacttatttgagtcatcagcccttagtgacagatctgctctctgcaggcgccgatcctctgaagaagtcaagcaagggcacaagttgtgcagtggatttggcgacccccggaagtgaaatgttcaattactatcagacacacggcttgctgtccaatactcatgcatccgatttagttccatcagataataattctttgcacagcttgtcaaatgatttggaagatacatccttcagtcgtgaaaatacactttacaaatcctctaacttcaatcccgctgacgaaaatctggacgtgttggtgagtggtaaagatcaactatttgactttagcgtcatacttccgggacagtacgttcaattttttgatgagaatataccacagttgattgactatatcttctcattacctgagaagtattctcacaataccgtgtaccctgcagccatagtatatcaatgtcttcgatatgccagttcgaaattagaaagtccaggcctagtactgaatttccttcgcctctttctaaccagagttagaactttcagcaactccactggtggtatcaccacgctcgaggacgcaaacaatttggatattttacagataagttactggctttcggtgctgaattttgtttactactatctattgaaggacggtgcatgccaattttttgttaaatacccaaagttgttacaggaactagttgattgcatacaagcagtgcaaagtcaattggctttcagcattaactataaattaaatctgctggttgacgagtgcatgcttaattatcatagtgtcccggatctggacaatgttgtattcaaaagtgattggaaactgttcaaaaacagaaaaaatatacacaaatcaacctatgaagagatcatagaaatgttatatccaccttcggccaaagagcagatgaagccatcaccgataaaggtgatacagactttaggtgctttaatgtacgtgctagatttgcataatgtcaatgaattgatgaaacagcaaacattgtcacaagtgctttattggttaggctcaacaatgttcaacaaagttttgtctacaaagaaatatcacaccagacttgtagcgatgcagatcagattgaacatctccacagtggaagactggctaagaacgaataatcttaagcctcacaagctacagagtatgacttttcaagacgagggatttcctgaatcgattgttgacaatcaaatatcccttcgaaacgtcacaaggtttaagagtgaacccaacaactcaaatgactccagcttctactacagtaatttattcagcatcggcaaacacatgcttttacccttaatagaactcctgcagtttattcaagtagccagctcattaggagatgaagatatgcttaggaaaacattagacagtttcaagactctaaccccagttcaattactgaaaatatcaaagagctacaaatatgagatcgaagagcaaagaattgacaagaaattgaacatctttctaaaatcgattttagattctaccaactatccccgagacaaaaacgttcatttcaagggtaatgaagagaaacttctgttgaatgagaattacatctccggagtggtgctcccaaatcttctagaacttaccagactgtacagttgtgatgatcatggaaatttcaatgatggcatctttagtagattccaacccacgctccctctcgaaattgaagacgatcttttcaacattgcagagcaagagcgagatatggacaatgaaacaaaaaatgagggtgagtatgacactgagggtaacaatgttcaagtcaatgaagtattctccgatttacaagtccctacctctgctgtccataagacttgggaagaggataatccctgggcaagttgagagatgataaggtttcgcgaatatctacgtaaatactatatacgtcttctaaacatgatttgattcatttcacctgtgtatttatccatctatgccaattcccatagaaggtggtggcatttcggccaactcccatgaggccaaggaggcgggtggacatcaggaatcacttccagattctaaagtccgtaatgaccctcaattgatccctacggaaaacagtggcctcttatcatttccccaagacctagaggctgacattgaagctcaagagcccacaaaaaaaccagagcaattctgatatcagcaccattagaataaaatctagatccatatcaaaaaactcagtgctgaatgatgagaatcctatcgataatattcccactgatgtagctcccgtgcgaccacctccagttttgatgaaccccgagttagaggaggaggacgcagagttttccaaagtggtgccaatctcacacgcagacgaagatacagaatacaacgagaaggagaaaagttcgtacgatgccacgttaacatcaaagaaaagcttgaccaattcccctctaattccttcactagtcaaaccgaagggaaacgtggctgaaccagtaatcgactcctcaatcaaggtgaatcactcgcaccacaatcctttactagctaagcaattttccaagagaagccttcgaagaattcctagtgttgctcaatcccttaaaagccaagatcatcattatgctccaagtgagacagattcgacatacagtgaaatagcgttatccttttcaagaaagtttcttttcaacataaacatgtcagaaaatgttctggggagtggtattaccaaagaatattggttggagaacagttcagccaagaaatgttgtctttgtgagaaacgtttcacaacattcagaagaaaacatcactgcagaatctgtggtaagattttctgtagcggttgtaccttattcatatctggcgaaaagtttcacatcaatgcgaggattagagtatgccaactctgtgtgaacgtagctgacagactagaagatgatatgtcaactgatgacgacagcattcctgaagagtctttgaggcctattagaacaaggacaagaaccaactcaacacataaatatgatatagatcagtcaccacgtgtctccttggaaggtgaacctccacagcctcctccaatgatggccattccagcgaccaggacaggggaggctgttgagatcccaaccagtcgaagacttgactccaggtcaaggaggaatacaaatgaacacagtgcctcgtttagtgtcgatgatagaaataaacccaaatcaagttttagtttcaattttaacttcaatttcaactcccagaacaatccagaaagtaccgaaaaaaatcaatcagtactcgaagatgatcaatcaaacatttcagatcttctgggtactttccatcggtctcacgtatttggaaactctgactcagaaaatgaaaatgaacgttctatgtccttatacaccgccttaaactctgatcaaggaatacaaggatcttacaagtatgatctcaattcagagaaaaatttaagaacccctattaaaatggagactactccgtcggagcgtcgggtgcagcgagttgaggggagcatggataatgacttggtatcccttcctgattcaaggattattgatactaagaactatacgtcgttaaacagagtcaaaaacagaatgcgtcccaagaaatcccgtatgaaccaaagagccaggtttagaaacaccgagaacccaggtgagccggatttgtctttagtgcctaacactgactccattttcaattttggacatggtgatgatcctgactccaaatcttccggaagcagactattttctatagttaacaaaaatttcaatcttatatgtgaggctcacggcaagaaactactgcagcaaatactcacagtgaactcagtttcgaacacagaactttgggaaaagaaattgcttgagatattgcaaagtattgaaggtatcaaccttgatatatcgaatggttacgacctgcaccgaaatttcaaagtaaaaaggatttatggtgctaaagtggaagacagtcaattactaaatggtgtcgttttttccaagattttaccgttgaaaagtatgtctagaaagataagctttccaaaaatatgtcttattatgtttccagttgcttatgcgagcgaaggatttacatctttggaacctatgattgcacaggaagaagagtatacaagaaagttagtggatagaataatagccatgaatccagatatcgttctgattggtgcttctattagcggacttgcactgaaaatgttagatgatgcctcaattacggttgcgtctgatatcaagcctcagattatagagaggctctccaagatgaccaacgctgatattgtgtcatcaattgataaactagcattgaagccaagattgggaatgtgtgggttgtttgaagaaagaacgtacctacacgattctatcgttaaaacctacttttattttactgaatgtgaatcgaatactggctgcactattctcatcaatgacgatcctaatgtgaaagcttccttgaccagtctgatttatgttttctttaaccttaatttagaaaaaaaggtacttgaacaccaatttcttcaaacttatgattctcaagatagtgaatatagtggttcagactcctttagatataacacaagtttgatcggaaacgaggcatacgaattcttacccccttcctatgaaagttttttgaataaataccgtgaaacgatattctcgtcatctccaggggtaatgagacctcttccatcgcttctaatcaatgtccgaaagttactaaagcaactgtccgagctgagcaaactgtttattgatttcaagaatgaatgttcatcaaaaggtagtagtaagctggctgtaactaagaagtatatgagtcttctcaattttaatattcatgctgatattgaaccaaatcgcttatatgagatagcagtttatcaactagaatttcaaagagaacatctaagacatttattgaactcacaacaaagacaatgggaattgttttgtgctcactccaccctaatgttggaattcaaccaccatcagagcattgtgttcctttacaacctagtctcaacaaaaaatgcaacaccgtgtgtaggtcctgaagttttagagatcaatttttatttggagaatgatattagtctgggacagtatatcgaacatgtttctcacaatgctgcaaatgcatgttctgaaggttgtggacttcaacttatggatcattttagatcatatgtacatgacagaggcaaacttgatgttgtcgtcgagccttttgcatgtaaaattccaggcttgcaaaacactttgttaatgtggagctattgtaagatttgccgaactaataccccagttgtgctgatgtcggatcaggcttggaaatactcattcggcaaatacttagagttgtctttctacagcaaaaaaacttctgtgattggaagctgtacacatgatttttacaaagatcatattaggtactttgggttgaacgatttggcagttcgcatagagtactcgacagttgatacattagatctcgttgtgcccaagtttactatgcattggaaccctgaatttgatataaatttgaagcacgatactttgcagcatacattgacaagagctagagcgttttttaactcagtccaagagcgtttggatagagtgaaggttgattcgatgacaatagacaaaatgcaagaaggtcaaaaaaaaattctacagttgaaggacaaactcttgcaacagtcaaccaaaattgagaatgaagccatggaactatacaatacaacaaaggtggacgagcatctatgcctaaatgggatcgtcagaaaagttcaagatctgtcggtgggatgggattccgagtttcagtcctttgaagccaactatctgccaagtgaaaaggatgtcagtagaatcacatcttattatttgcgcaaacttttcagtgacaaagaacctgaagaatcaagcgagaaatcaaaaaaacaagagcatgatgaaaatcctaaggagtcccaacgggagagtgataatgaagagtttgcagttgcaagtgaaaaggaagaggaggcaaggccaatagtaataccagacaggactagcatagtagcatccaacggctcgccaacttcattcaacgtctcttctaaaccttcggtcgagaagtttctaccccagagtgccccagagcaccgaaagtgggcaggtgaagaaactggttcatcaaaaatgcccataggaactctagaactggaggcggaattgaaacgaggaagatcctttagcaacaaagacactgcgtcaccaagagaagttcctggggattcacctccaggaagtaatacgccaatagggagagtgcagcgcctggcaaacatgtttaatgaattaccttttgatgaaatatctatggaatttgagaaacagagagaaagagaaaaacagaagataaagacctatcgagccatacctgtcatctcttcaaatccacgggttgcaatttacaaaaatgcgattgaagcattggaagatggtctcgtgaatccttcaagaaggatcccactagtacacagctcttcatttgaaggaaaaggcgtctctaattctagtcccaacctatcatcgaaggaaaggcccaaagcgagggaagaccttttggtcaaacttgacgaagagatcacgccaaccgagaaggttccattaatcaaaacattgagtaatttctgggcagatcgttcagcagctttatggaaacctctcgcttatcccttgaagtcttcagaacacgtttttgtagactcggatgttttggtcagagaagatgaacctagttctttgattgccttttgtctaagtacatcggattacaatgataagttgagatcggttaaggaggctaggggtgtcgtgccctcctccaatgacgatggattttcggttcatagttccgcaaaggacggaagtattctaagcaatcaagtcggaggacctgctgataaaggcaatatatccaaaactggaatatcagagctggaaagaataatgttgaaaaagacggccattcatttgaaatatcagtttcaagaagggccgtcacttctttcttgcaagattttctttgcagaacagttcgacgcgttcagaacacaatgtgggtgtgatgataagtttatacaaagtctctcaagatgtgtgaaatgggtttctacaggtggaaagagtgggtctgcgtttttgaaaactttggatgaccgatttatcatcaaacaattgactacttcagagctcgattcctttgtgaattttgctcccagttactttgagtatttttcacaagcactgtttcatgatcttcccactgtgttggccaaagtttttggcttttatacgattcaaatcaagaacaccgtaaccaacaagaatttgcagatggctgttttaatcatggaaaatttattttacggaaggaaaacctctcgcattttcgacctgaagggatcgatgaggaacagacatgtggaacagacaggtaaagagaacgaagttctcttagacgaaaacatggtggagtatatctacgaatctccattgtttattgatgaacatgcgaagaaactccttcgtgcatcgttatggaatgatacgttgttccttgccaagatgaacgttatggattattctttggtcatcgggattgactccgatagacatgaactagtggtgggtatcattgattgtattagaacattcacttgggataagaagctggagagttgggtcaaggagaaaggtttggtgggtggaggtggaggtgctccaaccaaggagcccacggtcgttacaccgaagcagtacaagaataggtttagagaggctatggagcggtacatactgatggtcccagactgctggtaccagggcacctgatccacattctcttgtttttcttttcagagaaaatttaatccgcgtctgggctaataattggcagccttggtatgcgccgaactcgtaccgcgtagcgaaggggacaaacatagttcatgtagaactagtctgccatgcatatggaacaatcgaaaattaatgattccgccattcgaggcaacctttctatactccttgctaatgttgtttatcacaaagataaatttagcaggcttttccatttctgttctctaccctcaacaacccacgcgttttggtttttttttgcccacttttattaaccaataataacagttggtaaactaatatagttactcctctgatacaaccctgcttcgtcacatgagtattcataagtttcgaagtcgtgttctgttttcacagattgtggcgtttttgcttcagctcataggcacagcattcctgattctatgttgcctaactgtcccagtcacaaacagtcttgcaatgtcggaggttggagatttcaagtttggggtgtttggttactgctcttccagcgactgctctgagaaaactacgcagtatccttatgtggctgctactttggatgatcaatacaaaaactggattatgagtgacagtgcaagagacatattgagtaagatcatagtagttgtacctgtggcagcgtttttcactctactcacggcgattgtttggggtgtgtctctgatatccggggttaagcgttctccagcgttttggaaagtgttctgctttcttcagatcattgcatttatagccactgttctggtaattgtggtatcatacttgcttttttcaccccacaccacctgggttatggctgtcatgtgtgcagctggaggatgttccctagtgagttcgcttttggttattctctgtgctagctgggtttctcgtgctcgtaagtacgaagatgaagaagacgaaaatgaaaagatgaatctgaacgatgatttaactaatatggatcccataaacactaacaatatcgggctgacggatttctactctgatagagccgacatgaagaatgatgaactggtacatcaacacactttggatactggtgactctggatccagattcggcgtcatatctgtgaatactcaaacgaagatgaatgattttgtaaatgattcaaagaagtcgagatacgtcatggacgctgttccaaaaataccgttaccacaagaaccgaacgaccagaatagtgtatcctctttgatgaatgatgctaggcaaccaatgttgcctgaaataccagatccttattcctccccaactctagatccaattattcttggtaacgctgttgatgaaagagatcaaaatttgaactacaagccggatagcaaagatcaatcttcagactatatgtttgagacaggttccaatttcacaagcgtttctcaaaaaggaataaaccctcaatattatcccggtgcaggtaattatccagtcttgcccggccgaattgaccgacagcaggaggcgcccgcccaacagatgttccctgccagtgcaaactattattctaccagcccacaaatgtttaataatgcgccccaatttcagggcccaccaccaaaccaggggccttataacagtcagtatcagacacctgttacttatcaaaatcagtctagtacaaccgatctgctactttcgaagaatccagatttctttattggcggccctcaaaagaacggtagaccgagaagaaaggtcggaataccccagaattatgttcctcagggtaattctcacgctccacaacaattcggaggtcccaagagcaggaataagaacaacattccagccgcttcgatgtcgagagacagtccttacgggcacatgtgatttcagtcgaatgttgctgtgatgattagtggccttgtttctttatatttcttctaattttgtaaattactaatagacagttaaaatagtatcaattttgcacatatgtagattaattctttgtcgtgggctcgtcgacttcaaccggagctggctcttctgctggtgttgtgtcttttgatggctctggagtgtcatgatagtaatggtctgtccgtctaggtttcatcagtactattactgcgagggtcaaggtcactacgttaaaagtggataagtttgcacttggtagaccttttctgatgcttttgacccttaagcagttctttattactctgtttcaaatcaacgacaacattttccaaattgtagtcaattctgtccaatatggtcccttggtcaataaccatagtctccaattctttaaagatggtagaaatctcaacaacaccttgagcaatcttgtaaatctccttctcccttctctgaatcaactgatcattaataccctctgtctgttcttgctcctgtaacagggcagaagactgttgcatcgcctgcttcgaatatgattcaatatttacagcatccgaatcatcccactcatccatgacattttgttttgaggtgcctggaaatcatcctgttttaagtacttgatataattattttgcaattttctaaacttctttgataagtcttgggtctttgcagccaaattcttcttaaggttgtcacaaatcaaattgtcctcgggtctcaaaacatcttgatattgaagcttaatggagtcaatattcttgatcttattgtaaaccttttgaaaggagctcgtgatgacaaagttcatttgatctattttctcatcatcttctgtcgtgtcattgaacccaggcaaaaggttctttttgtataggtagtttaaccgagttacttccttctctatctccgccaacagaaattcaatctctgaggagatatccgcaaacttggggggaagtggcttcatttctattgcatctccattttcagccgcctcatcatgatagctagaatcaattagcccatgcgcctcctcttcttcacccaaaaggtcaaaccgattgttggggttcgtcgtgtcgagctgagaattaccattgaattgacccgtgttatgagggtaggttcgccgataagatatatataagttggttctatcccggaacatctttcttgatatataaccggactagttctcaacgttttcaaatgaaccaacttcaagtgaaaccaatgggaacggagtgtcaagcaatataatataaactagtttaagatagaggatcctaggctgtgtaccaattaattaatataaagaaggttactcttagagtagtataaatttaatatagtatatcgctcgctatccagcctacaaaacaacattcttggccagctttttcttatagttggagatagtgtcgtcccatctagtacacgtcttgttctcaacaacaaagatgtccttggcaatcttgtccaacaaacggaagtcatgggaaacaaccactacaccaccactgaaggcattgatggcatcggccagagagtcaatagttggaatatccagaccattggtaggctcgtccagcagaaggatgttaggggcctccagtgccaacaaagcaaacacaactctggatctttgaccctccgataatgtggccatttgggaagtttggccctctcctgtcagaccataacgacccagctgttgtctccagtattggaaatcttgggagatatgagagaacttatcacggacaaactccagtgggttctttgtcaggtctaattgatcagcagagtgctgggaatagacacctaatttgatatgggtatgcttagagacacgaccgctttgtggctgtaactgaccagtcataagtttcaacaaagtggacttaccgacaccgtttggtccaacaagagcaattctagagtccatatcaacaccaaatgacaagttttcatacaagttgtgttctgggttttcgtcgtaactgaacgatatactgtcgaatgataaaactggtggtggcaacttctcaatttctgggaatctgaaggaaaagactctatcttgggcaacaggttgaattaaaccatcagcctccatcttatccaaaatcttttgcctggacttagcctgtctgaccaagttagcatatgtaccagcagaagcgatgaacttcttgatatgagcaatttcttcttgttgctttgcatactgcttcatttggttggtctccaattcagttctagttttgacatacgaatcgtagttaccaccaaacatcataatttgtttaagtctcatgtcgatcatgttggaacagacaccgttcaagaaatcctgggaatgggagactaacaccaaaatacggtcaaatcttttcaagtattcttccaaccacacacaagcctctagatccaagtgtgctgttgggtcatccaacaaaagaatggttggtttgacgaataatgccttggcaagggcaacacgcattctccacccaccggacatgtccttggtctttttgagaatagttttagaattgaaacccagaccgttcaaaatgatggaagctctagattcaaaggtagctgggtccatctcatcaattctctcataaagaggatctaacttcaatgattcagggccctcttcgacaataatgtcctcaacaagatgttcaagcctaaccagttcagcttgagcttctctgacaacgtaatccaatgcagagtactcggttggctcagcaggctcattcaataagtatatatccatgctcgagggaactggatattctctagcagcaagagctctcaagaaggtagatttaccgcaaccattctctcccaataaaccataacgatggccataattgagctccaaagttgaatcctggatcagaactttaccgtggaacagaagggatagagaggtgatcttgacatctcttgaagtctcaagggaggctaaaacaccagtggtgactctgtctgaaataccatctttatcttgctgcaacttcaagttggcgacctcatcgaccaactctccgtcctcgccagcctcagccttttctctagccttcttagtgagctttggcttcttaccagtggcagctctctttgcttctctcttagctttggatgcagactttgacatttttcagtggcaagcttttgtttagtgatcaaaaagagaaagaaactgaatccaatttggctgaaaagggaccagacaggaaaaaaaattttaatcgcgattacactacctcttcgtgaactccgtcaaggaaatgtacttggcaccgtttataatattcagttgataagatgataaaactctctcaaatgcacaaataagactatagattggaaaagggaagttgaattgccttagatttaatagtgaaagctataatgaatgttagtttgaaatcaagcatagggaatttacactgaagctggaattgaattttaggagttcgtcctcatgacctatttaattcccatcggtgtttgtaggtctctgcattgtgcactttgacggtcctcagcagaagtttataattatggtctcttctatatattaagaaagctcctaaattacttacaccttgatacaattgcagatcagagaatttctcattatatagaaaaaataagacatcaataatctacccaaactgagtaagaaaggtctagaataatctcgactgtaagataaactgcccgactgcaataattaaatattaagactcaattggtgcttcaccaggtcctgtcgcagtcagtctcatcttgaacgacatttcgagacctttttttgatatctcaggttcataactctttccagttgccactgactgatggtgttgcacaacaacaaatgggacaggaaagccaagtataagtacttgaagaagcacggattgaataaaaaagatgaatctggaacttccaatgaaacttcctctaatactacctctaatagcgaactagtaggggactcagaagtgaaagatgagaatgccacagaggaaactcctgagcaaagctctgagacgatagacggtgaggattcagaagatcctggttttgatccaaaatatgccagaaggccgatgatagataattcatacagatatggtttggagtctacaaacagtatcactgttcgtcaggatccagaaatcgaacgggagatggagttgaaaaggcagcaagaagaacaggaaaagatggaactgactgatatgatcaagactgctctacgagaccaggtagagcatatgcctgctgccaaaacgatcgatgttaacaaaatgacgacagaagatttgctaaactggcacctgggagatcagtccacaaaaaacagttctatccatcgtgaatttgatccatcagagcaagaagagtttaataggctagcacaaaagattgccaaagttaagataaagaacgatctgaaggaaaaatttggcaaatcaaaaccgaaaccttctggaaaagttctccaattgaacacttcaaatgacggatccaaatatcaaaaggctctacaaaaggagttggcagatctttccttcaaggagaaattcagcgtagctactgagatcaacgatgatctgagtgagttactcggcgagaacattttcgtttcagactctgtttcaagagatgatgcgaccgaagatattgacgcgttgttgaaggacagctcagctaaaaagcccgaaacaatagagagacaaagcgttgcgccgacttctcaaaagcttaattccatcgatcccgaggccgataaatttctcgatgatctactcggctaaatctcgtacctattctgctcttttcgtgtcgtcttccggttcacccctatctgcattcttatccataactaatttatttcatgtatattgccaattacaattgcgcgcaccagcctcgcgtttcattccacagctgtgcaaccattagggaaacgtttttccatcgcgctttcctcctaatcctactgaaaaactaaaaaaaaacaagttgcttcagtactttttctcttttgtggacgtgttctaatacttatcatcaaagcaagacatcatggctgacaaaggatcggtagcggctaaatcgcttaccaactctgcacccttatccatcttttcttactgtgctgcatcaattctgatgacagttaccaataagtatgccgtgtccggtgtcgatttcaactttaacttctttttgcttgccgttcagggaatcgtttgtattaccttgattagctcgttgaagcaattgaatgttatcacctttagagagttcaacaaggttgaagcaaagaaatggttcccaatcgccgtgctgttagttgtcatgatttatacctcctccaaggctctacagtatctgagcattccaatttacacgatattcaaaaacttgaccattatccttattgcttatggtgaagtcatctggttcggaggccgtgtgaccaacttggctctgggctcgtttgtattgatggtgctctcctctgcagtggcttcttatggtgattctaatgttgacactggtaaactcaattttaacattggctatttctggatgttcaccaactgtttctcctctgccgcatttgtgttgttcatgagaaagagaataaagttgaccaacttcaaagactttgacaccatgtattacaacaaccttctctccattccaattttgctctttgcatctttgactactgaagactggtccgctaaaaacatagctcagaacttccctgaagacaccaaatacgctgtcatcgcttccatgattatttcaggaatgtctgccgtgggtatctcatacacatctgcatggtgtgtccgtgtgacatcttccacgacatactcgatggttggtgctttgaacaagcttccaattgccctgtctggtttgctatttttcaaggctcctatcaacttctattctatcagctctatctttattggttttgccgctggtctagtctatgccattgccaagcagaagcaaaagaaggaagacgagttgcagttaccaactgacaagagctagattataaggaaaagaaacactctatatatggtttatttattgattttcagactgaagtccactataccgactccctgatggatcgaagaagtactatagatatcaatttcattgcacagataatcctttatattatccaaagtcaaacctccactgcactccaaatagaatttcttgtttgtgttagcccacttgttcttcaaattgatggctgcgactttcagcccctcaccggtgaaattgtccaacatgataatatcggctcctgctgctatggcctcattggcttcagcttcgtcttgcacttccacctcaatcttagtgctaaatccaatcactttttgagcactttcaatggccttggtgatcgaaccagttgaccagatatggttgtctttcagcataatcatagaacttagatcataacggtgactgtcgcatccaccaacgagcattgagtatttttccaacaatcgtaatcctggagtagtctttctggttcccgcaatgattcctttgtatccagcttctctagccctttttatagtaatatagctttgagtagcgaccccagagcatcttgctagaatattcagcgataaccgttcagcgaggaggatgtttcgaacagggcccttaacgagtgcaactttcactttaccctcgtctccaccacaaatgtaatccccttcctttagaaaccactcgacctccaaaccgcattgtttgtaaacctcttgtgcaaacggtactccactaatgactccgttggactttatccatagagtagcactctgcaggttttcacccaccacatatcctccgtaatcaaaagaaggggtatcctcgtctagccagctggtgatatctttcttccattttccgtccacaggtaaaagatgggcaaattcggggttggggttggagaaactcatagtcgtctacaaatgtgaaggaaatggatgatattgttaggccattctccgcgagtcattccggggttgacatttttgagatacatctggtgtatggaagtacagaggtgcagaaactgtcgaaactgtactatcgaccgtgtctcgttaatggtactcacttccgtgcgggcaaacaaatctaaatcggtcacaaagcctgtccatacggtgaagaaagttcagtctcatcttagaaccagcttgccgcagcaggagatatgtcctgtgtgtaaaatggcgtatgtgccatatttggcacaagacatcaagcttcatgatgcgtaccaccagaaggttcagctgggcaggccctggactgaatcttggggaaacgtgttagacgtgtcaacacttgcgattccacagaaaattcaaagaaattcaacactgattccctgcaagtatgtggaggttaatatcgacaataaagttgaggttaatgcagcgcaacaagtcataggaatcgcaaataaatgtttgaatgctcctccagagtgtaattactggatgtccgataaaagcaggggcaaggtttttctttgcattgccgaaaacagagccattggagtagtggttacggagtctttgaatgatcccaaagttaaacctcattggttcatagtggaaaagggcagagttgttgagaaccagacagttaaagatgttcttgtaggtatttctcggatctatgtgtctcccgaatggagacgatctggtattgcattgcaactactgaaagttgtttgtcatttttcctttttcggaataactttgaaaccacttcaaatagcgtggagtcagccaagtgaatatgggggcaaattggcctccaagttttctggagtcaagcataaatcaggcaagatactaatccctgtctacaacgaacattcgccctaaaacccaaccgtgtttatggatctattcgcatagcattcgtctacaatcgcataattagcatagcttgagtcatcaagcacgtacataagcatcctagatgtcggatagagacaaattaatagaacaattgaacgttggaaacaactttcatgccaatcgtcttgccccaactccccaaataattcacaataacacacgaacctaaattaaatcgcgtctcagatatcgatttctcccaccaaactacaacaaataaacactctggtgatactggcgatcatgaacaacgatgcccaggagttgtataatgccgtcatagatagtaacatatcttacacagaaatgctcatcaacaagtttaagactcacgtgaaaaaagactttgtcaatttggcaaacgtcccaaagtattttgagtgtttgactatcgccattaacaaacaagaaaacgaaaatacttcaatacccatactggcgtttagcacactttgtcacttggtgaagagagttagcatgcaagatgccaatgtactaaaaatcatagactactttgcattgccagtcttaatagggaaactcgaccatcccaaaactgcagtgaagaactctgccaagaaggccattaaagtgtattgggaatcctgccctatggaagtcgaaactgctattagagatcacggtcttatgagtaatgaaagtggcgtcgttttggaatcattgttattactactagacatggtgtcgactaatgttcagagctttacttttaaaccattcaccagcaaagttgtccgaatactaaagtcacccaaattagaactacagaatgcttcaaagcaactactgatagagttttttaccaattgccccaataaagcagctgcaattgatcttgcaaaggaattggtcaaagaagacgtgagagaagatgtgtccaaagacctactggaaagcatagaacccaggttagttgacgaatacaagctattgaagcaagagagtgtggaaaacaattttgtttccgctgggtccgtagcaatcaagtcttcattaccaccctcttctttgaagaccaataccgtacgccgaatcaaatctaagccgtcaatcgccaaacttagaaatcccccagttgcggcaccaccaaaatccactttgcatcactcttctttcacgctaacgtcccagtcttcgtcattatctgcctttttaaatacactggagggctatgccttggaacccaacgttgcaatacataatatatctgatttggaatcttttactcgagaattatcaacgtacgattccaagtttgaaggtaaggagacagagcttaactggagaggcagagaacaggcaatgatttttttgcgatctactttacgaggaaatgcaccccaagattaccctcatgagcttagtcaatgtattcgactcatgctagaatcaattagcaaagcaataatgtctctacgcacgactttgtgttctaatgggtgccagcttgtgaaagaagcgtccataatattgaatacacacttagattcctttacaattgatcacatttctactacactttttagacaatgcagtgcaacaaaaaggatcacatcaatgacatccatggcatcaataagtggtatactatccaattgcatcttgacttcgaagctaattaccttaatacagaatgcttcgactgagaaaaatcctcagccaagattgtattcagcgatatgggccaccattcttctctaccgatatactgataacgaatccgctgtttttgagtccaacggattagtggaattcatttcaaagattctattgcgcaatcttccagatcaatcggccgaagtcagagagaatatgcgagaattgttttggcgattgcatgctttatatcctgaagcttcagatgttgtcttcaatcgacttgataacaatgttaaaaaggcccttcaaagaatgaaggtcaagtctcaggatgagttcaaacttaaacattcttcacaatctgtaaagtctgtcgatcaccgtcaattcagcaaagagtcggaaagtgcaaaggctgaatctttactggaattgggaaaaccatccagagtgtctacatcaaataaattgcaacttctttcgagtcaaaagcctcattcgtccttgggcgttaggcacagttctggtaatgaatctcaaagaagctcaaccgaggtcaccactactaaagttcctcaatctgcagagccggtttcaactgtatttcaaggtttgaccactgagtctagtatgggaagtcaaaagaagacggcaattgaacctaacactccttcaccacaaacttttgaaaatatctttaatcttttaagttcatcatctgtattagcacaaaaagagggtatttctttacttcgtttttctttgttgatgaacgaaacattaccggcaaagttggaaactctggtaaactcgatatccataaatgaccccacggtcctaatacctttacttgccaaagacacgattgcccgattatgcaaatttactagtctgagaagtgtcctacgaatggcagtgattgcacttgaatccaacgccaatttcaaagaaaattttttgatggaatcgtttgtggaacaattatccaacttcgtcgataacaatgaagtttgttctgaagtcattcatacactccaaacgtgtaacgatatacggtacgaatcaaatgcccgtatatctatgcaaataatcaagttcaaacaaccacttatactttttcatgcacagttccttttgctatttcttgagagacatgatattagtgataattatttgaccactttagtggagacattgctacaaaattttgacacgataaaagatgttgaagatcagagttcgttatctgccatcattcttctaataaaattgctaaaaagtataaatatcgaagtattcaattcctgtgttggtcgactgccatcttattctcaatcagaactcaatcaagcaatatcttcaggtagaggcaaacaaaggtccttatcggctgaagatgatgaacaaatgctcgattatggttacgatgtggagcaactggagagatctttggagatgactatgatcaaccctcaaaaagccaatatgcctcctctagagaacgttgatatcaagggcgatatgactatgattgtacccaatatgaacagtcgagatgataccaaagtcattgaaggtactaaggagttaacatcgcagttgaattttagtgcggctacagttgcaacctcttctaattctcatggagattctgtgggtggtacttccaaaacatcagtttcaaatgaaggacttcaaaatattatagagaaatctgatccttttcataaacaaagtaatgaagtcattgaaatatatgaggatgctggacatcacttagagaataagatccaacaagtttccatgttagataccatggattcgtggtttgactttgaactgcaaaagttctcagttgtgtatgctaaatctcaaatagagcaagttgaagattttgtcaaggatactgatctgacagctatctcaaatcttgacttgttaaacttgacaccacagtccttttatgagaccatatatcatctgagaactactcctattgctcaaatggaaccagtcgaaaagatagtcgacaaaattttactgttcttggagcaagccaatagaaatgaaattggtaaagagtctatcatgatggttgtatctctactgaaacagtgttgtgtactgggttttgtgaaagatttagtccggctgtggacagtaatcttatccttattcaacgaagtcgaggactttttggatgagttgtattttgcatcacaaagtttggctaaccacatcaatgatccttctgtgatgattgagtctctaaatgagaaagaaaacccggtcaaattgtgtttcattctaagtacattgatgagggtagagttgaaggacgatgttgagtctgaccaggctttactaatgattagacatttaggcccgttattaagtcatacggatgtgagcgtccgaaagtatgcaactcagctctatgcctccatcaatttcacacacagcaccaaattgaagtcatttcttgaagagctaacaccaactcagcggcagttggttgaatactataaagataacattaaatagacaaaaaaaaagtaatgagctcgtaatattttattgtatttacatggactttgggttgtgaggaatacacagggatagaattagataaaataacacgctccaaactttaaacaaaagcttcaccacctttgtctatgaatgcaggtttgaagttgttctccacacttgggaccacagcttccaacggtgagtaaaggtagtactgtttcaaagagttgatacaagcgtcagtcttcgctttgagaatggaaggaccctgaccttcacctagcttatcattgccagagaagattcccactatgaatattgggttacttgataatctaccgttttcggcaatgagtctggatgttggtgcgggtagattctctctttgcaacaatctactcaactgtctgataggttgggtaaactcgaacatggaggctatatcgagctttcttgaaagtatatgactgttaataaatttctttgtttctgattcgccatcatgagcataaattccagcaatgatggatctaacagcggaggcataagcggaagctttgtccatcttcaaagcagactcctttgatatggcaacaattccgtcttccttttcttcaacggaactatcatatcttagtttaccaaatgcatattctttaggctcattattcaagtacttggtaagatcacttttagtgtcttcctcgataccccaaatattcttaccgagatccaataatgcgtacttgccaatataagaatccactgctgcattcaaaatcgatagtggcagtcttggatactttacaatcaaatactctgtagcatagtaagttaaaagattcttaccaaacagggaaagaccaaagttgtcagccaatccattctctttgttcgtgttggatctacatgtgagccctctagctaaggtagaatattcaaacttgtcactgagtcctaatcttgcgtgtaaagcgattagcaccgatgatctcgcagcctcttcgttggtgattttgtgttggaaagaggtcctttggtagtttccaaagtcggctttgttttctggaatcgaatagacattgttcttgtatgaggaattggtagcaggtctataaacctctgagacagatccatacagtcttcgtgataggcccaacggacggaccatacgagaggaaatcatgtgtgtcctattatggatgcagcctaatgttactagattgaagatgttcctaggtccctctcccttggtgaaaaatcggtttgaaaaaacctatcgcctagttagaacggactttgatttacacacacataggcgtaattttctgtactaaacctttatagcactcgcgagcgccaatcaagtagcgacataatcctaattatcagtattccagcccagagaccagtgaccaggtagagacttaccccccaacaaagagaatgtcaggtcatcacatacatacaccaagttatattaagccacctacgggaggttggaattttactcccgccaactggaagcagaatacggttcttgttttggtgggattcacagcctgttgtgtgggtctctataagttgggagaggcaggttcttacaacccaaagctgaaatataaagaagaggagctttccagatggaaccaatcggcaaagaaaaactagagcagagatatcatcagaaatgggtagtccccaagactccatagcatagagagttcaaatacgagtccacgtcccacattcaacgattcactgtttcattatttatttatttattataatatacaaggatgaaaactttcaatacaggtatactttcagtgatttgttttttttgaggaggtccttgatgacctcaatgtttttgtaatcgtcccaataggaaatcttcttcgaatcaaggtaggaagaatcaaccacgatcgctgagatgctgtctggagtgagggtgcattcttcttcttctagtagacgaatcaatctgccggtagtggaagacaacagatgactcttggccctctttatgagttcaatgtcgtttttcatcttgtttttcttgattaattttagagatgagcccggtaggtctctggtagccctatgaatatcacagcacctgattgccgattgagacaataccagcacatatttagaggtgtttctgcgtgacttaccgaaaactcttggaaatgtagtcttgaggaacttgctgaatcctggcaagtttctcttatgtggataatctccagtgtagacaaaatcgtccttagaaaaatacaattcactgagctccaaagaactcagatccttgttatgctgtctgatctttttagccagctcttcaacaatcacatccggctgctctttactgaaattaagcttatgttcaatgtcatattgcatcttgatctttttcttttcctttaacttttccttgcttgagccttggtctctttttctttttccttttccgtcaatcttctcttcctctggctccgacaccaccacaccctcatctacctcgttatcagaagggttgtaagcgtattccaaaccgtcatccaaatcgtctgccaatgttgacattatgcacagatattgaagatcgatgtttattccatcaggaattttttctttcccttctgcatgaaaaatatatttatcttcgcgagaaatgtccttcgtttgttttactacatctaagttgttgtttacgatatctctgaaacataagtgatggatgaactacccgaagaacaaaagacacctgtggcgcgtcaatcctcaccagttagatcgtcacagaatttggtgtcatctcgggttaggtccaggtcacggtattctctgcctcccaagactccagtgcgaacgcccagtcgcactagatcaggttcaactcaacgactacgaagagtttcagctggagagacacccaaattgaaaaggcattcaaacgatgggcggacgactccaaccataaaaggagcacatggtaattcgccgcgcagaaattcaatcaggagggtccctactactccctacgctctaagagcccttaagacattgaccccaagaggagccagaagacaatctgcagctagagacactcccaatagagagaattcacagtacaccccgactaaagatcttaggtcattgagtcgccttttgttaaaggaaagaaaccaaggaaacacagaaagtcataatttgtcaaccattgaaaataaatctacaaccgtccacgagactcttcctcttcccgacctaagcgagttcactgatatagcaatgcctgaaggagtggttcaaaggggaatatttagtccggcaaagcctgatgaccaggaactatttgagggaatcaaccaagatttcaatcaagacgtggagtcttatcaaggtgttaacgagaataatgagaatggcacattcagtgatgaagaaccgctttttggcatggatttatcattgttggagccggcagtaggagcatcaccaccaaaaaaatcttccaaaccttccaaatcaacaaactcgcttctccccaaatccatgatcctgaagatggtcaaattcaaaactggacgaaccacaattggccctaatttataccccaccttacaatccataagtgacgatttcttcacccaggtatcggaagacctgtgccgttatgccgaacatgggcgtcgatcgatggtcaactttaccgatatccaacttttaacacaacgcattaacaaaaacttggcatcagtagataacagcacagaacatagcgatattatgaccttagcaagagaatcattagatctcgaacagcttatggaacttgagaatatgatgcatctcaaccaaatgcaaaaatcaacgaaaaaaaaaactgtaaactagtgtaatattatatgtacatttatagctccacatccctctgagctcgcatagccctttggcttgagctcgatctaatcaaacgataaagttcaaagaatgccgctggcgtaactccctgaatccttctagcttggcctattgtttccggttgtatagtgttcaaaagatttacaacttcagaactcaatgctggtacatctctgtagtcaaatccagttggaagcaacaaattttcatcagattggaatgccttgatatatccaatctcttttttcaggtgacctgcatataacccctctactgtcaacttgtgcagtattctatccgaaagatctgccttatgtgggaaattaagcaaagggaaaagttccttcattccaaccttttggtatttgagtatgtcaaaggcagtttttggtttagaatcgtcactaatgttgattcccaaagactgcctccacttggcactagattgtttgaattttgtcaaataatcacgggtggtattcagaagctctttctctttcaaaaaatgatcccatcgttcgtctccaacacagccaacatctcgtccctttggagttagtctcaggtcagcattatcggaacgtacactgactctgaattcggaacgagaagtaaacatacgatagggttcttgaacacctttcgttatcaaatcatctatcaagactccaatgtatccgtcgcacctggataactttagtggaggtttattctgttggctcaaggccgcatttactccagcaatcacaccctgagaagcagcttcttcgtaacctgttgttccatttatctgtccagctagatataaaccctctatcagtttcgtttctagggtaggtttaagttctcttgggtcaacataatcatactcaacaccgtaaccaggttgaagcatgttaaccttttctaggccttttatcattcgtaccatttgcaactggatatcttcaggcatagtacagctgataccattagggtatacaacatcgttatcgatgccttcaggctccagccaaacggtgtgctttgttttgtctgcaaagcgaataactttcgattcgattgaaggacaatagcgaggtcctttaacggtttctctgatatggatggatttatctaagttagaacgaattaaatcgtgcatctctggagtggtttctgttgcgtggcatcgtagttgttcgtttatccgtacggtgtcgttcatataagacattggttgaggtgggtcgtccccgtgctgtacctccaggtttgaataatcaatagttttggaagataatctaggaggagtccctgtcttcagtcttccaaggcgaaatcccgcctcattcaaagttttgctgagtccaaatgtggcatcttcaccaattctaccagcaggataacaatttaggccaatatgaatttctccacctaagaatgttcctgtagttataattactttatcagctctaattaagtcacctgaatccaatacaaggcctctaattctgccgaagcttcttccttcgacatctgtactggtcttggtttgggctggtggttcaatcagtagatcttcgactttaccttcgacgatgttcaagtttggatatccctctagttccttttgcatctcttctaaatagatctttctgtctatctgtgcccgtgggccccaaactgctgggcctcttgacctgtttaaaattttgaactggataccagctttatctacgatcttcggggcgacaccatctagagcgtcaacttctctaagaagcgtcccctttccaactcctcccatagaagggttgcacgaacatgtacctatttttgataaatctggagtaattaacgaagtcaataccccagtccttgctgatccagtggcagcttcgataccagcatggcctgctccaataaccacaacaggatgtaacggtttggtcagtagagtcgactccaactccgtcgtcatagtaacattccttttacacaccctattaaagcttttaagagctaataacttggtgttacgggaaagcattctatgtacaatcttatcttcgactgtgagaaaaaaaaattactaacaaagaattcaaaagtttggtagccttatgacgagattaaagagagggagacgagacgtgcaaagacctacataattttggtgtgactgcaacaggacagagctcctagcaataaggttttcctcttacaactagctactatggtatagtgttaatagtcatcttgaaaaatccttcaagtttgaataactaaaatctgcttaaaatacagcaatctcatggaacatcttttcattcctttccttctctaataaataaataacattgagctcataaatactacatcagttctgataaaagaagacaacaaataaaatacaacatttatgcaaaatggatcgtataaacattcatcaacttcagtgctcctcagatggaccggatactagctgagctcttttttgtgcatctacttgtttgaaagtctcccatttggatgcttgtgtcgggaatcctaaaattgtctgtttgaagttgtgaatattgtctctgataccaaagttgaaatgtctgtcagcttgccaaaacaagaatccgcctgccaatagtccagcaccaataggttgtctaatgaagaaaaataccagcacagctggtctgaatgcaactaagtatggcattttgtattgtaagatgtgtctctcaataaggagttggtttagtacagtggttgagaaagatactattggtcgataattgagtggtaaacgactcagatttgtatgtaagtatagatccaataggtagccttcagcaaaccaattgaggtccaattaatactttctacttgtttaacctatttcctgatttaccgcaacaagtaattctccatccaggcattaacaatcattcgacacttctttggcacagcgcaaagcaagaaacgcacccaaattagctttcgattatgtaatctcgggcgagaatcctaaagctgtaatcgatccctactaagcaactcaactattttcacctgttgtaatcctaacaatgtttagacaattcattcgtgtccctgctattagcgctcgtgccttgactcgttccattactttttctgccgctaaccaaccaaggatcagaattggatcaattgctccgaattttgagactgaaaccactcaaggcaaaatcaacttccacgacttcattggagattcatggacgattttattctcacatcccgcagatttcacccctgtctgtactactgaattaggagctttctcagctctaaagccagaatttgacagtagaaatgttaagctgattggactgtctgctgagccagttgctaagcacaaggaatggatcaaagacattgaagaggttgctacgggcggaaaagagttccagttcccaattattggtgacgaatcgagagaggtctcctatttgtacgatatggtcgatgaagaaggtttcaagaacctgtctggtggattagtgcttaccatcaggtcagtttacatcatacacccctctaagaaagtgagattgatcatgacttacccagcttccaccggtagaaactccgcagaagttctcagagtcattgatgctttgcaattggctgataaacgtggagttgctactccaattgactggactgagggtcaagatgtcatcattccacctactgtatccaacgaggatgccaaaaagaagttcggagacttcaaggaggtcaagccctacttgagatacacatcccttaaatagttgtagtagcttagtttgaaacccattcacggccacccaggcattatgagtgactttttgaggccatcttgccctgctttctcctcactttttcttgcagattcccgctccttttttttcactcattcttaaccgatcgcgcatgaaaacatttaccctcaaacggatcttgacttctccataaactaccccagagctatgaagggcgttccgatcttacccctggacaagtctttgaaaaggaaaggagatcaattcctggaggatcatgatcgcctcgacaaaaagcagaaagattcgttgcctatctcacaaagtcctgggcatcgtcctgtgacgtcttgcactcattgcagacagcacaaaattaaatgtaatgcaagtgagaggtatcctcaaccttgccaaagatgtgaaaagatgaacttgaattgtgagatagatccacagtttagacccaagaaggggtctcaaattcaaagtttaaaaaatgatgttgacgaattaaagagtaagatagagttcctcactaggaatgaaagcttgatcgctaaggctttggcaaagaaagacccaagtggatcttcttccgccaaatatatgttacctaagacggaacatgacccggctttgacagcccttggctctgtctcttcttcctctgcgaatcctgtgttgttgaaggatgaactgttaagcaataatctaaccaacacgaattcaccagaaatgaaaaacactaaagtccccgaggttccagagacggaaatgaaggagtttgtacttggaaatgtcaaacttcctctggacaaagccaacgaattgcatcacagattcgttacccagtatttaccttacttgcccattctgcaaacatcgaactgcgttgaactatatgagcaatcacaattgttgttttggacagtcatactcaccgcatgtctttctgattccgaaccttctttgtatatcagtttggcctctctgatcaaacagttggctatcgaaacttcatggattcgaactccaagatctacccatattattcaagctttgttaatcctgggtacgtggccactgccaaatcaaaaggtcttagacgactgttcttatcgatttgttggtctgtcgaagaatctctcccttcagttgggtttacacagaggaaagtttatcagcgagttttcccgtactcaagtggctctggctaatgcagagaaatggagaacgagaacatggctggcagtctttttttgtgaacaattttggagtttctgtttgggccttccaccgtccatgcagacagattttcttttagagcaggcccggatagacaatactcttcccaagaatttccgatgcctcatcagtctctcaattttccaagctaagctggtcaacgtcatgggattatctgttacttctccagatgggcttttagagcccaaaaatagagccggagcgttgtctattttggaaagagagctggaaaggctggccttcaagctccaaattgatgatatttcagtcgagatttattacctctatgtgcaattgatgatatgttgctttgccttcctacctgagactcccaccgaggatcagacaaaatacgtcacactggcctacctagcagctaccagaatagtcacgataatatccaaaatgaacgaacgaagacaattgattgagtatccaatttacgttcggcaatctgtctcgttggctgtgttggtactattcagattgcatctaacaccttatttattacccaggtacgttgacagtgcgaggcaaagtattgtcacagtccacagactcttcagaaacatgctttcagcgtggaaagatgtagagaatgatattagtcgaactgcaacagttttggagaagctaaacctagtgataatcacacatccagaattatttgtcaaatctgaaggaataatttcccggatgaggtcacatttgacaggatctttattctacgacctcgtttggtgtattcatgaagctcgcagaagaactttgaacgaaactcagactaaaagcaaagataaatctaaggataagctcgctagtagacctcctccattaccattttacaatcaaattacgaaagaggactttaccacgatcacctcaacgacgccgaatggtaccacaattacaacattggttcctacggatcaggccttattaaatgccacagctacagctacagcagcgggcttagcaaaacctacaatgattaatggaattcccatggcgatgcttgaagccacaggttcattggcctccagcaaccaaaaggaaaagagaaacaaacctagcaaggatgtttccaaagctgtttccaactctcaagcccatgtgaacacacctagaagagtttctcaaaacagtaaagagcctgttgtacctaaaattgaaaaacttccagtaacggagagtccgttcaactcgtcattgttcaactcgcaattagacgtcaatgatgtctacagcactgcgtctactacaagttcgaataacaatcctcaatcgttcttgtcggccaacgaagagttcaatatgaatgatctgaataatgatcaaagttttatcgattcaatcttccaacaacagaacaactggtccgataaaggagatgatttcctaggatggctggatacaaatatggctccggagttttgaattctctcacaatattaattagggtgtaaatagcaatcatatttagtcatcatcctctctagggtccccaattccatcttcgtagatagcaaatacacattcactctcgggaagacatggggagtcataaatcttacaaattctttgctcagccttacccttcttgaatgataaacgggttgttgacgagtgagcaacgatgtttccaccaattggtttctttggatctggattgaatacagcggaggcatcaacttgtgctacaacttgattagtgatcagcactgcaattccaaactcatcagctaatcgttgtagagttctcatgtatttggctacatgcatctgtcttgcagatagttcacctcttccactgaaatcggttctgtataaagccattatggagtccacgataagaagggaaaatcttgattcagacatcattgcagctgcctggttcagcagttgaagttgatgatcagcattataagctctagcataggcaacgttgtccaaggtatcatcttcattcagaccataacgttttgcaatcgaaaccaaacgaattggacgaaaagtgccctctgtgtcaatataaaggcatttaccctctcctcctcccatatcaataggcagttgacaagtgactgctagtgtgtggcatagttgagattttcctgttctgaattcaccaaacacttccgttatcgaacctgtctctatacccccaccaagaagagtatctagtttcttggagcctgtggtaatgcaaatcaactcagatcttctgtgatgaaattctgaggctgtggtgaaacccatgggaacaaactttgaggcctctgctagcaacttgtcagcctttatctcagaaattcccttaacagtaagcagagctcttttaggagtatatgcgattgcttcaactgtattataccctgcttccataagtttcctaatatctccgggactgatcccgttgccttccaatttggatataggcattgggccgaacatttcatcatcctcctcttgttcttgctctacatgaccatttccagaattaacctgatgctcctcttctagattcatcacccgctgcgagtcctctatgacttcatggttcgacatctttcgttcagagtaacttacgtgttgtgggtaaataaatactttatgtttacgcgactgacttttgaaatattacatgatcatcgatcttctctcctctctttttgtattgcctctgaatacgaagtgattgaggtttgacatgacaagaagagtctttaaagctgaattaagcccatttatgggcggtcctttcttattgtatttagaaacgccatcattggaagaaatcaaaacgagctcgagatgtcgaatccccatgactcttcacctcagtgagaatggaaccgatgacaatttaggatgttacgtattaggaatcccagatgtaagtagttgttttttgatgcaaagtgttgcaaataactaacttcgcctttagagaacaggaaatgtccatcagacgttactcaacggaaatcaagagctattagatgtgacgaaacgcctatcctatctgctcaccaagaaataccaagtggttacatatgtctccatctccggaaactttacagacgaaagtattagggatgttattttagaggtggacaagttattgaaagatggtagaggtacccagaacccattgtcatcaacagtgaatgaagcataaagaagcagactttactatcagtctaaccccacctcaagtagagaagatctgtcttgtctcaaaactttgtcggctgaacctgagcagggccaatttgaactcctgtacactatatttccccattagctgttatcacatcaagcttgatgatctaatcgctgtttttctttttcgcacctgaatttttttatcttaaaaaaatttcagacttgaaaataactatgagtgaagcaggtactttcaagaagaatcattcttcaaggaaaggaaagagagcttggagaaaaaacattgacttggaggatgttgagaaaggtctagaagagtccagagaaaatgatatacaatacggtggtaatcctgaggagatggatctcttcactgtggacactagtggttcagaacaaatccgcaagaagaggaacatcccccccttgaaatctagacaaattcttgagcagcgttcaaaggttcctgctttggattctggaaagagaaatagaaagccggttccacagcaacaagtccgtcggttgatgtcacttgctggaagaacagttggcaagtcaaagacagtcgccctgatcgaaagagatggagtcatcaagacaggtaagagcctggaattgtggggatctgaacccgaggaagaagtaaagaaaccatatcttcctgaggccgatcctccgacaaggcctgaaacactaaaccttcctccagtcagagtagctacgctggaagatgttcctcatgcgggcaagtcatacaacccagcggtcgatagttggaaagacttgatagaaaaagagttcttcagagagaagaaggtagaagatcagttaattgctcttgacgagcataagacactgatcaagaacatgatggtagctctcgaggaggaggaagaaccagatcaagttgaccaagaagaagatgaagattctgagggagaaaagtcaaacagatccgatgtgccagagaagattgtgcacaagaagaagaccagagttcaaagaaacagtatcaagagagaaaaggcgatgttacagctagaggaggaattgcaacagatacagaaaaaaatggatcaaatagatcaattggataagatagagaaagagcttttgttagaaaagtccaaaccaaaggctactaaagcaaggaaaacaaaatcaaaacatgatgctgtacttccagagcgtgtcgaggtaaagctatcatctgagctgactgattccttgaggaaactgaagcctgaagggaatttggcgtatgatcaaatgagagcacttcaagctactggtgtaatagaaactgctcaaaagaagaaggaagggaaagagccatgggttaaagtaattgaaaaggcatcatatgctgagtttaaatagtagttttattagttaatggtgtatttgactttaacattgacgatgtgaaagaaacataatatgtagcaggagatttgaaatttattgagcgaaaggatctccgttttctgatccggacctgcttccctaatgttctctaggatatttgataccttcaagctatcatcgacgatcaccaacgaagatgtgatattatatccaagtgacactataaaaggcatattagatgttgacgtcgtcaacaaggcaaaagtgaaacgaatagagggttcattaaagggagagctgttccttcagtatttcagtgtgtcatccaacaaaatggagacaagaaccgttacgtttctagctcgtcctttggcattcaatgaggaagatgaatcggaaaaatcattgaatattgatgaagtttggtacaaggattctttccatcaagtaacctttagcgtcaaaattccggattacataattttagacgaaggagaaggctcttggtggagtcattttggatatcccaaaagctctgaggggacaacttgctgtttgcctccatctataaactactatggaagtcatgaagagcaatacaagatcaattattcgatcgacatataccttgtgacggacaacatggtgttctcaaggcattaccacgaaatcaaactagtcatcgagagtaggcttaccaaacgacaattgaacataataaaagaggcaaacagcgacatggatgaggctcaactaatagaggcaaacgccaaatggtcaagccatccaagaaaactgataaaggctgacgaagaccacatggaagatgaggttgatcacatagttagttccaacctaactggaagctacaaatattcaaagtacattcggcagttttacgatgataagtttatcccctccaattacaaacagctcgtttgtgatgtgcacatgaaagttcagttaacaatgagttccaagcattgctatatcggaggtccgttaccacgtttgggcgttaggatcaaggtagccaatccgagctcagattttctcataccgggaacccaacagtcgtcacttctgggagaattttttgtcaagaaagttacactggatttggttgaaaagtccaccattttgtacaatagaagatcccttacaaagagaaggactttatttcagaatgtttattacggcttcaagtttgacttggcgacagttggtgacgactacctgattccgtatgatcagatatttggatccgaagatgatataatattgaatccgaacacaccactgggggaacaatttaaaaagggaacttctaaaaatcaagggctacgattaaccaacgatctagaagtatttcagctgctacagaagagacatatactggaatttacactcatactgtcaaatttggagacaggaggaagaactcgaacagtttatttgaaatcagacttgatcgtacttcgaaggtgacgaaaatgccgaagaacagatcctctgcaacttcaaccaatggaatctaaactgcaatgtagaggacttcacttttgaatgctgtgagaactatggtctgaaacatgtatcggtttgattttcgcgttctcctacaatcagaactgcacctcctcattcggtttctggtttcagtcaaccttactcaaagattggttattcactcacaaggctgaataatcaactaaaatgggtttgtttggtctgtttgagttggaattcaacccagagtttcccgatgatcatgtttacactggagagaatatcaagggctccttgacatttaccactcgaagacagattgatgtaactaaaattgtgctatcattgaacggtgttgcggtattaacttacattgaaggtagcggagaaagtagcacccgatacgaacaagaacttgatttgtttagtcctagagaagtgcttgtttttcctaatccagatgccacttccagcagtggtaattacacattaccaaagaaattcaccacatcctttgactacgacttgacttttcccaagttcattgaccccgaattagtttcttgtagcagacctttttttgatatcacgccaagtactaactcattcaatgcctccgggacccaacgttgtgagataaggtacttcttgaagttagatgtaaactacaaatcgttcagttccaagcagtcaaagatatgggagttccaatatcaaaacaacgttgggattgactacattaatcgaatcctaagaactaaagaggatgacatgcatggcgagttttttagccaaagcgatgttgacgatgatgatgaagacatatctatcccggaaacagaggacacagagcaccccatgttgaaatattggagaaagggttaccgggatcataaagattttaaaaataaaaagaaaatattgattgacagcatagccggttcgaaatctaaagaaccggtaccaaatgaggccagtttatccaagttggacaagctcttccggagaaagaaggcggaccatggggtcaattttttcaatatcttactaacaattgcaataaccaatagcagtcgatttaatcgccccttcatattgattggagagtcattgaggaataaatttgacattgagttctcggtaccgttcaacgatcattatcagctgtcccaaaatcagagctcgaagctatcggcattctacctcaaaaatatagcagtctttgtccgtacaacggtgggagtcagaataagagaccggaggtttaatagtggatctattactcctcggctgatatactacaaacgatggagtaccagtgatgcagatgggctttttgagattgatcttttagaaaaaggcaagttcagccccgaggacaataccctgtcatataagctttctctggacaaatttttagaaggagggttaagggacccaattgtatcccctcatttaccgctgcggacgtgggttcataaatataacgaagacattttaaagtcacttatgaaaaatatggagaaatttcctgatctacatcgagtatacccagattatcaactgaggaagcatgccaacatctgctctgagttatatttcaggattcaagttgcagctactaaggacggtgacgacgtacacacttttaagatcttcagacccgtcatgttgttggagcatcaagaagattcgaaaatagtagacatggtgaacaatccggaactaccaggctatgaagacatccttccacattacactgaggtagatcacaacgggaaggaagaaaaggtagcaaaggtggttagttgctaaatagtaattgattaactttacattttgtctagggcctcttttattgtattcgagccactgattgacaccgatctgccacacctagaatggcacgactgaggcgcctaagaattttccttctgatagcaaaatcaatgtccttgataattgttcctggacactcaatttggaaatactttgaaggctatgattccgaagcacctgggaccagttcttcagaatgggaactagcgtcgttccagaaagaggctgatgatcatctagcattcatagagcatgtaaagataggagtagatcagctgataagaacagaaaattcaattctgatattcagtggaggacaaactaaagaatcttgcggacctatcagtgaagctcaaagctactggttcctagcaaaagctttgggtttatacgaaaaccaatcagttgcaagtcgtattcacaccgaagaatatgccagagactcctttgagaacgtgctgttttccatccttagatacaaggaaatcgttggcgactatcctaaatctttgacaattgttggactgggattcaagaaggcaaggtttgttcaccagcattttccagcccttagttgggaaggagagtatgaatatatatcggtcggacctacgttactggattcatttttcagcgactgcgtcactgaagcacaacgaaaggagaaagaggaagcctacttctctgatctggaatcttctgagatgaagtatgccgtgtctgaattctccagagatccttttggcaagggtccagtgttatccgcaaaaagacgactaagagatcctttcaaaaggggatgcccttatagagatgaaaaatactttgacatgctagactctaattgaaacacttctcatattccagaaactcccaggcaattacgaacgagtcggccagcccatcaccatgaatgcttaaaacgccaactccttccatctcattttcgtaccagattatgactcttaggcggggagaatcccgtccagcatagcgaacatttcttttttttttttttacgtttcgcatctctctatcgcattcagaaaaaaatacatataattcttccagtttccgtcattcattacgtttaaaactacgaaagttttagctctcttttgtttttgtttcctagattcgaaatattttctttattgagtttaatttgtgtggcagacaatggttagatctttcaccatcaaagtgcctgcttcctcagcaaatataggaccggggtttgacgttctgggaattggtctcaacctttacttggaactacaagtcaccattgatcccaaaattgatacctcaagcgatccagaaaatgtgttattgtcgtatgaaggtgagggggctgatgaggtgtcattgaaaagtgacgaaaacttgattacgcgcacagctctctatgttctacgttgtgacgacgtcaggactttccctaagggaaccaagattcacgtcattaaccctattcctctaggaagaggcttgggatcttcgggtgctgcagttgtcgccggtgcattgctcggaaattccatcggacagcttggatactccaaacaacgtttactggattactgtttgatgatagaacgtcatccagataacatcaccgcagctatggtgggtggtttcgttggatcttatcttagagatctttcaccagaagacacccagagaaaagagattccattagcagaagtcctgccagaacctcaaggtggtattaacaccggtctcaacccaccagtgcctccaaaaaacattgggcaccacatcaaatacggctgggcaaaagagatcaaatgtattgccattattccagactttgaagtatcaaccgcttcatctagaggcgttcttccaaccacttacgagagacatgacattattttcaacctgcaaaggatagccgttcttaccactgccctgacacaatctccaccagatccaagcttgatatacccagctatgcaggacaggattcaccaaccttacaggaaaactttgatccacggactgactgaaatactgtcttcattcaccccagaattacacaaaggtttgttgggaatctgtctttccggtgctgggcccacaatattagccctcgcaactgaaaacttcgatcagattgctaaggacatcattgccagatttgctgtcgaagacatcacctgtagttggaaactcttgaccccagctcttgaaggttctgttgttgaggagcttgcttaatagaaattagaacatcctctttagattatgataatacgtttttaacttttcccctaactgtagtgatggtatctgaccctcttagaccttaggttggaccttctcgaatttcctgcctctatcaaaaatccgaccctcgacatcgtttacgtactttgcaaccaattaactagtaccggcagacgttcagtgatcatggctctctatacaaataccctgataacgtttgcattcctgacagtcggaggatgtacgtgcttattttcttgctagtcccaaatgttttgagattgctccaatcgttttttcaacaatactaactgccaacaaatagatcttttattcaacggaaatggggaacaattcaacgtgggtgactttttggagactacatctccctatatgtgggcaaatctgggtatagcaagttgcattggattctcggtcattggtgctgcatggggaattttcataacaggttcttcgatcatcggtgcaggtgtcaaagctcccagaatcacaacaaaaaatttaatctccatcattttctgtgaggtggtggctatttatgggcttattatggccattgtttttagttccaagctgaacccagtcgatgccgtgaatttactttccaaatccaatcagtatacaggttattcattattctgggctggtcttactgttggtgtatccaacctcatttgtggccttgccgttggtgtaacaggatctacggctgcgattgctgatgctgctgactctgctttgtttgtgaaaattctggttatcgaaatttttggttctgttctgggtctgtttggtctgattgtcggacttctgatggcaggtaaagctgcagagttcagctgatgatccaatggttaacttctacaacaaacaatacatccccagaagtatacttcatacattccgagcttacatagtcactagtatctagagatattgaaaaaaattatcatttcatgcaccacttcctcccgctcccactttatctatcttaaggagtatctaatcttcttctacaaagtcaggattcttacgcagtatcacgataccttctagagcagtggccaaactgagatattcatcagtttccaactcagctctctctccgtgtcccaacaagaccggagtcgaatgtgtcacccaaccagtaattgtcttgggtctaccggcttgtcccacaacatcaacagcttgtccaacccttacgttgacctttatagggttcaactcttcgtcaacagtgactaacattcttggtttgatcgacggagccaagtagtacaatagcgcggaattgttgtcgagaataaacgatttgggatccaacaaagtcactgcaaccgttaagatgcttgccaaagaaaccttggacaaaatggctctatcagtattgaatggactgatggtcatagtacctttacccaaacttaccaaaccttgggctattctcacaataaacaaagagtctctgtccttagagtagtaggaagcaagctgtcttaaaagttgagccaatcttgcattgttggtaccagcaccaaccaatcccatgctgaaaatggagttaatagcaacatccagatcctggtcatgtgagtatcttgataaagtatcaaacaccttcatttgagggttagacgagctgaccaaacccatagccaaaggaactgctctgcggatcatagagttaccataatgcattaaatggccgaagtggcgaagagacatttcttgtccgatttcttcacccattgcaattaaagccaaacctagaacagcgtatgcttgataggattcgttttccggtgtggtggtattatctatgtcttccttatctttatcgttttccgattcttttcctttctcgccatctttctcctcatcttcttctgcttcatcttggtgtggcttaacagtgcacatttgtaaaagtgcttgaatttgtaaaacattaccagttccagcatacgaacaaaccgtcacaatcactttcaaggtttttacaattggatgctcgatagcttcaatggtctccaaaacatcgtccgcttggtcatatttactcatgtatagtaaacctagacccagtgacatgaatcgaatccattttgaagtcaattcactagattcacgttctaaaagagtctgcaatatggttgaagagatatcgccattacaagttcccacaaatacgtgtccaagagctaaagcagcaagagaactgacctctaacgaaatgtcagtgtcactgattaatggcaagagtagattaagcacagtttcatcctcactgccagcaaaactgattcccaacccggtgataacactggtgataatggagacgttcttttcggttccacttagataatcttgaagaatcagcaaagcactttcaacctcatcgtgcacacttgtcgaagaaagagccatacctaacagtgctccagcttttatttcagactgttcattgtaaagatactcatccaatttctgaagtccttcggtattgtcccaaaggttgatcagaccaagagatgcggtagtagaaagcatgcctgtacctttagtcttgtagatccattgatcttcttgtaccactttttcagaaccgtaaccggcattgacaaatgagttaacgaatgcagatgccaaattctgatgagcgctttccattgaagagttcattatagatgttggcgaagactctaagtgacttctgtagatgtcttctggaactttgggagtcaacaagttcagctccttagtcaaatatttgaaatattcacttattttgacgttggatatacattgctgtaccttctcattatcaattttgaagcatgaattttgacgtccaaggataaatcctaactgctgctgaacaatttcatcgtcggttgcctcaaaaacattcctaatcaattcctcgtcatctaatctaatggctaaagacaatgcgttggttaattggttttgtaagaggtagatggaaaaagcagtattcaagaaactcaaatcgtctggaggtgccaacaaaggaacacagctgacgagatataaacaaacacgttcgaaagtatccttgtcaacgaactgtggcaatttatctattgattccaactctaacaagagatcaacagcctctgtctcggcattgtgcttgaggaactctggcacaatctccaaagccaaactaaacagtttttcatctttttccttactgaattctaagtcctcttggtattgctcaccaatctccagcgacaaatgacgcaggtactcatgaccccattcattgaggctcttgagatttcctaataatctccatttcaaagattcccttttatatgtttcaacgccatccttattgccactttcattgtaggtcataccaatcatggagagaacgtcagcaagttcagccttcaacgtcttatcctcccacttgtcataaactgatatcagagcgtcgtagtgtgatcgcaaaaacttcagaggttttggaacagcagtcattgaggaagtactttctttgatgaacttcttcaaagaatctatactgggttgatatagctctatcttgtcttcttgaagacgttctaccagcatttccagttcacccttcaaagcggcatcctcttcactcaattcgtcctcaggaagctctatattctttttactgttactttccttctgctccacatctttctccttcggaagcttaagtgtttctttttctttaggtgacattaggagtgtcgattgttggttagagaattaattacttggagttttacgatggcaaatagacgtgtcgtgtgcgaacgaactcaggttggctcgagattttgttgtccccagttagcattctctgcgcggaagctggtaggagaaagatacacttcctgtaaggtagaacgtttttaatggtgacaaattgtcactgcaatacttaaaaataatacagatttgcacaaaataatagaaacaatgtgagagcgaacagtgattgacgttgaatggaacctgttttacaactgaatcagtgtagcctgctgtcaatgttgatcaaatgttcgtcaatcttagtctcatctgcttctaaatcttgtttggttgcattcatgacagctgcagcttgggcagccgcaacctcagcttctctcttggccgcttcctgagcataagcggcaagtttgacattagtctccaaatcgtggtggtcaggagagatgccagaccaagtgttgagattctggtgatgcgacatgagatcagggttactgagcacagaagtctcatcagactggattttccttgattttatttcggctgatgaaggaactagcttccgcttcttgagaatacgaatctcattgtagatgtcctcacgcttcagaaaaagatccgggaatatctcgcgtaatttttgatgaatggttgaaggtttgtcaccatttgcataaagatctttgatagtctggttcacttgtgtggatcttttcctcaacatagggaaggacgtaagagggtcaagtttaggatgattatgtttagcttggtttattttgagagtccatttgttatgctttttggagtaattggcgaccatcgagaaagggcacttgattttcttggaccccactttcttggtaggaatatccttgttggaagagtcttttcttggcttcttctctcgataggagccacccaattcacaagtgaagtagatagctttgttgttggagtgagcgatggcaataccaaactcgttacgtttagcaaactctttcacaaactggcgcaattcagtaacgtcatcgaattccttctcttggatccatggcgtcacaaaaactgcttcatcgtcctcaggtagaattggaatatccttaggtcctcctggggtggcaggaataacatagtgttgcacgtgactgggaactctcatagtgtttacatggctatgaccgtgaaggacatgctgatggcttgccgcagtcggttgatggtgatactcgatgtttaagtgtgacaaatcgttactggcagctgctgtgtacttcggtataagatgctggatctttgcctcggcactttcatcctgaggatcttggtcctgaccgggctggtggtggtcaatgtgaacctgggcctgttgctgctggtactgctgttggaactgttggtattgttgctgatctaaggccgcctgttccacaccgtgtgtatcgaatgcttgggcaaaatcatcgcctgccggaggccccactaccgcttgttcctcctgctcttgtttgttttgctcattgatgatatcggcgtcaatgaattgatcctcaatcgtgtggtggtggtgtcgtgattcctcttctttcttgagtgccttatccatattcctatcttagtgtaccaataattttgttaaacacacgctgttgtttatgaaaagtcgtcaaaaggttaaaaattctacttggtgtgtgtcagagaaagtagtgcagacccccagtttgttgactagttgagaaggcggctcactattgcgcgaatagcatgagaaatttgcaaacatctggcaaagtggtcaatacctgccaacctgccaatcttcgcgacggaggctgttaagcgggttgggttcccaaagtgaatggatattacgggcaggaaaaacagccccttccacactagtctttgctactgacatcttccctctcatgtatcccgaacacaagtatcgggagtatcaacggagggtgcccttatggcagtactccctgttggtgattgtactgctatacgggtctcatttgcttatcagcaccatcaacttgatacactataaccacaaaaattatcatgcacacccagtcaatagtggtatcgttcttaatgagtttgctgatgacgattcattctctttgaatggcactctgaacttggagaactggagaaatggtaccttttcccctaaatttcattccattcagtggaccgaaataggtcaggaagatgaccagggatattacattctctcttccaattcctcttacatagtaaagtctttatccgacccagactttgaatctgttctattcaacgagtctacaatcacttacaacggtgaagaacatcatgtggaagacgtcatagtgtccaataatcttcaatatgcattggtagttacggataagagacataattggcgccattctttttttgcgaattactggctgtataaagtcaacaatcctgaacaggttcagcctttgtttgatacagatctatcgttgaatggtcttattagccttgtccattggtctccggattcttcccaagttgcatttgtgttggaaaataacatatatttgaagcatcttaacaacttttctgattcaaggattgatcaactaacttatgatggaggcgaaaacatattttatggcaaaccagattgggtttatgaagaagaagtgtttgaaagcaactctgctatgtggtggtctccaaatggaaagtttttatcaatattgcgaactaatgacacccaagtgcctgtctatcctattccatattttgttcagtctgatgctgaaacagctatcgatgaataccctcttctgaaacacataaaatacccaaaggcaggatttcccaatccagttgttgatgtgattgtatacgatgttcaacgccagcacatatctaggttacctgctggtgatcctttctacaacgatgagaacattaccaatgaggacagacttatcactgagatcatctgggttggtgattcacggttcctgaccaagattacgaacagggaaagtgacttgttagcattttatctggtagacgctgaggctaacaatagtaagctggtaagattccaagatgctaagagcaccaagtcttggtttgaaattgaacacaacacattgtatattcctaaggatacttcagtgggaagggcacaagatggctacatcgacaccatagatgttaacggctacaaccatttagcctatttctcaccaccagacaacccagaccccaaggtcattcttacgcgtggtgattgggaagtcgttgacagtccatctgcatttgacttcaaaagaaatttggtttactttacagcaaccaagaaatcctcaatagaaagacatgtttattgtgttgggatagacgggaaacaattcaacaatgtaactgatgtttcatcagatggatactacagtacaagcttttcccctggagcaagatatgtattgctatcacaccaaggtccccgtgtaccttatcaaaagatgatagatcttgtcaaaggcaccgaagaaataatcgaatctaacgaagatttgaaagactccgttgctttatttgatttacctgatgtcaagtacggcgaaatcgagcttgaaaaaggtgtcaagtcaaactacgttgagatcaggcctaagaacttcgatgaaagcaaaaagtatccggttttattttttgtgtatggggggccaggttcccaattggtaacaaagacattttctaagagtttccagcatgttgtatcctctgagcttgacgtcattgttgtcacggtggatggaagagggactggatttaaaggtagaaaatatagatccatagtgcgggacaacttgggtcattatgaatccctggaccaaatcacggcaggaaaaatttgggcagcaaagccttacgttgatgagaatagactggccatttggggttggtcttatggaggttacatgacgctaaaggttttagaacaggataaaggtgaaacattcaaatatggaatgtctgttgcccctgtgacgaattggaaattctatgattctatctacacagaaagatacatgcacactcctcaggacaatccaaactattataattcgtcaatccatgagattgataatttgaagggagtgaagaggttcttgctaatgcacggaactggtgacgacaatgttcacttccaaaatacactcaaagttctagatttatttgatttacatggtcttgaaaactatgatatccacgtgttccctgatagtgatcacagtattagatatcacaacggtaatgttatagtgtatgataagctattccattggattaggcgtgcattcaaggctggcaaataaataggtgcaaaaatattattagactttttttttcgttcgcaagttattactgtgtaccataccgatccaatccgtattgtaattcatgttctagatccaaaatttgggactctaattcatgaggtctaggaagatgatcatctctatagttttcagcggggggctcgatttgcggttggtcaaagctaacatcaaaatgtttgtcaggttcagtgaatggtaactgctgctcttgaattggtcgtctgacaaattctctaagtgatagcacttcatctacaatcatttgcttcatcgtttctatatcgtccacgacctcaaacgagaaatcgaatttggaagaacagacgggctcatcgttaggatcatgccaaaccttgagatatggatgctctaaagcctcagtaactgtaattctgtgagtgggatctaccgtgagcattcgatccagtaagtctatcgcttcagggttggcaccgggaaataactggctgaatgggatcttgggcatgaatggcagggagcgaacataatcctgggcacgctctgatctgatagactgaagtgtctcttccgaaacagtacccagcgtactcaaaatcaagttcaattgatccacatagtctcttcctctaaaaatgggtcggccacctaagagttcggccaatatacatccaactgaccagatatcaattgctttggtatatgtctgaaaactaagaattatctccggtgcccgataccacctggtagcaacatattccgtaagaaagccagcattcttctctgcatcactactataacctcttgcaagtccaaagtcacaaatcttaagttcgcaatctgagttcaccaatagattgacgggtttaagatctctatgcagcacatctgctgaatggatatactttaagcccccgagaatttggtagataaagctctgatagtggctgtcagtcaaaggttgttttgatttgattatatgatgcaagtcacattccatcaattcttcgtaaaggtagatctcgttgaaattattattttggtccggaatgacatccaagtcatacaggcaagtgatatacttgtggcctcggaaatggcgcagcagtttgatctctcttaaagccctcttggctaggatctttttgctgaaaatgttggtcacctttttgatggccacttttcctccatcttcgttacccttatactgtgcactgcacaccactccatatgcaccttgccccaaggccttgatcaattcaaagtctcggtcaatgataaactcctggttaaaaaccgtaaagctcttatggtcaccactcattatttatcgtcttcagcttagtatacttataatattcacggcaagatggcagctgctgtaacggtatatatatttttcaggtggagaggtttatcaaaattacgttgttgaaatgatccctatcagttttttcgagcatcacggaaatgctaggattctaaaaaaagaatactatggcatagaactaggaaaaacttttcaattaagcgcatgattctgtatgattgggctacgcgtaaatatgcagacaaaaatagaagtttcagactcaataatgctagacgtggtagatagtacgtatgcagtagaacaggcttacatagatgtaaacttgaaacggcagtgggaagcggaaccaccttccaagacctggaagaagaaagctacaaaagccggatttgtgccgagtttcagctgtatgcaataacgagccaattttggacaatagcgaatagtgtattcatgtaaccatgaacggctaagcctgaaaacgaacaaaatttctagaaagacaaaaaatgaaatttggacgagttgggaatcgaacccaagacctctcccttgcaaggggagcgcgctaccaactacgccacacgcccgttagctaagtataagtatgtgaatacggttttgctgaatactctggacttttaatattactgtatactggctatgctagagggctttatgtatttttgaaacaaaattgcttctccatgaagtctctattgtttcgcactttcctcaagtttggaactgattcttactttcagttggctcgactagtactagtacaaagttgttttaatttcaagtttgattcttgagacgtccttatagaattacaatcttattatagaaaagcttaattagctgcattatttatatataaatttgtctgcaatttcctttaccttctttcccctcttcaggcctgttgacagagttctattgttctcatctcgtgtgcgtgatatccccagagtttgcgttttctcgaaagaacccaagaagttgaaaaatcgcagtggctcaagtcaacctccccaatgtcctcagatctgtcagaagatattcaggttttgtctctgaatgacaaagaagaagaagccaaaccacaagatgaagcaatagtccctcatgtgaggcaaatggttcaagcggtcatcgatctatggaaggaggaccccgatactgaggatgcactcattggagagctttactacttggtgaagaagaagaaccctaattgggactttacggaacagcaattagagaaaactttgaaagagcatggatttattgtagaccagacgctgtttacctttgcagagcaaatcacttcgactttgaccccgaacctgtcgaagatctttaatgaagaagaggcctcctttaaagttgactttagcgagaagtcgggcaaagggttatatgccaaaagagacatttccaagggtgaagttttgtggaaagaggagccatttattatggtgccgcccattgaactgttgaggctggtaaaacatggcaaagcatgtacttattgtggtaagcccatggtatcgatgacaacagaccgtctgcttaaaggattggattgcaatgtatgcaatgagctctggtgctccattggatgcaagagaaaggatttgttacatcctcaggcaaaacatggtgtatatggtattcgtacgaaaggtatcaattctaaagcttggttggctttggaagatttctgcattgagaatgattggagctctgtatacgctgctgctattatttatgccagagaacttctcgataaatctaagaatgtatatgatcagtttcattccatggctaagataagtcaaactgtgagagatcaagctagttctttgagtgaatttgaagcttcgattcacgagggaaaactggctgagtgccaccagcttttcaataaatgttttcctaaaaaaccgatttcttatgaaacgttgatggaatatgtgggaacatataacatcaacaatgtggacaattgcctgttcttggtgtatgcccacttaaaccattcgtgcgatagaaatgtttccattgatcttcaaccgaaaagggccgacggattgcaagttactgcattgagagatattgctgccggtgagcagctgactacaacctatgtttcccccacaatgtccctgcaagatagacaaagggaactgcgactgaactggggatttatctgtgaatgttcacgatgtgtattggagtccaagcaaagggaaaaaagaagatcctcaagaaatagcaccgctgaggcagataacaggacggagattagagaaatgttgaaagaagaaagcgtcgaatttgacatggaagaacagaaattggaacagggaaagagaagacgatcagttagatttaatgagacggttattgcacacagcaacaaataattgttcaccaagctttacctggtgaatatatttgagtttgtttgagactataatagtatacatgccagtttggttttttatcacttaaatccgctgccttttggaagggggaattacaaggtcctcacttagtagattaggatctggagtaatcgcattggagtctttgggcacttttgtgtcgtctccattcgtatacgtagcttctaggggatctatcattttttgcttgatcaaatgtttttcaagcatcatgtagagatcatcctttgtgaaaggctttgctagaatatcagtcattccatgttccagatatgtcagtaaatcctgatcttcaatgtttcccgtcatagcaataatgggtgtttgtgagtcaaagtttcggattattgctgtagctgatgcaccgtcaagattaggcatgacaatgtccatcaatactagatcaaactttactttaccgaccacatcaactgccgaaaggccatcagttaccacctgaacagtgcatccatatttcattaaaaatttctgacaaagctttatgcacacattgtcatcttcaactaagagcacatggaaaggagaaccttcgggtctttctagatgacctctctgcgtatcaccattagtctcgacaggcgcgttcaacggggttgcagcacttatctgtgaggcatcaacgtgtggaacggagggctttttcacaatgttcgccgtagagttgagtaaggatgggttgggatgtttctcagggttacgtaaattgggaagggagctataacttgaatctgcggaggaagaaattgatttaaggggatgttgggcttgggccgggaatgtctgggaggcgaaattgatatgttgctgttgttgttgttgttgtggttgctgaatttgttgctgttgttgttgtggttgtggttgttgttgctgtggctgtggttgatgcatttggtgatgtggttgttgtccagggtgaaattttgggcctagagaagggggaagaactccaccaggcataggtgctattatctccaaaggaggtattttgatgcctgcattgtgtaagcatttcaccagagtgtctaaaactttcattgtaccatcattgagcttcctcatatggagcacactctccacaattgtattatactttgagttgacaataccaagctcattctccaaatcgtcagcctttctggttaaaaactcaaccttttctgcaagctcactggcatcgtcccccggtttcttctgaatgggcccctttcttttgatattttctaaagcttcaagttcgtttcgtttgaacaatgggtgtttgaactcccaaaatatctctccgttttctaacatttgcatcctttgcttatcctcattgctcaatttgaccttgtggaaatcatatttgttcagttgacgtacaaaactcgcaaaattactgtgtttgaaatgtttaggtaggatgtctttggtgaattcattggtactcaacactacgaatgagtctcctgaatctgtccacctcacaatgtcccgataagactcatcctctagcatttgatagagcttcttcacgaagtctgtggacccatggcccacagaagttggatcttctttcacctttatcattgatggcttactgcagtgttgacactgaatagactctgattttgagggagggagttgctaaggttgatacccgattaggcaggacttacttttctgggaaataccgctgtatatatttttataagaattctgctattgtgtgaaatgcaaaaatcataagatttattgttcataatctcgttatattaatttctagaagtattgcggacttgcctcatttttaccgacatgtcatgtatgagctttatcgtcccggcttttaggaattatttaggtcactgccagatatcattcttgaatgctcgaataaaattatacattgggggtgggtggggtgctattaatatttatatccctcaattgtgtgaaatcgaacgattatagctttgacacaactaaataagggattgatgcaacttcatctgcagttcttttgattttttgttttgttttgtttctatagttaatattctcgtgaaatgtaatcacaaatcaaattgtccattcacaaaatcatcgtccatgtgatgatcgccatcaatatccatgtcgttatcatcatcttcctcttccccttcttcaatcacatcttcatcaggattgttgggatttcctagtattaccgggttggtaccccggtatgagttttgtagtttgtacttgtttgcatatgaaaagttatcgaacatggcactctcgtccacgtacgtaaatcctttgaaattggcctgaatggctggcgacaggggcgtagagcccataaatacttgcttattgattatcgaagtagaagcgttggtgaattctgggtcaaagttagacgtatctgtctctgacgttaaatgcggtttgaaaggtggagggatctttttcaccttcaaaagagcccaatcaatatcgttgaagaacggatggtctctcagctcgcgggcatcgttgattgccccgagtctgtgccttgggttcctgtttaataacccttttacaaaagaacgtccctcagaggagagaacgtctttcggaaatttaaccttgccaaaagcaatatttttgtacatctgttgagtgttttcggcatagaatggggaccatccacagcacatttcaaaaattaacacacccaaagaccaaaaatcaaccattttggtgtatccggactcatctaataaaacttctggagcaaggtactcagtggtaccacagaaagtgttggttgtaccattggatgctaaattagccttggaaagcccaaagtcacacagtgcaatatgtccattggcatccagaaggatgttctccggcttcaagtctctgtagacaatgtcgttgtcatgtaggtgttcaagagataaaaccagttcagcaatatagaacttggcacgctcctcagagaacctgccctccttctgcaaatgccaaaatagctctccaccagacatgtaatctgtaacaaggtacaaatctgaaggagtttggaatgaaaatttcaatccgacgatgaacggtgatgcagtagaggcagtggtaactaaaatgtcacgctcaccaattgtatgcgcaatttctttctttctgacaatgacctttttactcaaaaccttcatcgcatagatgcgtttggtatccttctttctgacttgatagacctggccaaaggtaccctttcctaacagtcgtaacacctcaaaatcttctggaccgtactgtcttttagtgacgtcaaaatattcaagtttaactttaattttgcccgtgacggtctcaccaacaacccgtggatgcagatctagccatttttcggacgtggtattgtgcacaattgttttggggagaattctgacgtggcccagaaataagccatctctgtactcgtcgtagacactaatatcaagttcagaactagcaccaattacatcaaacgtggcctgatgatgccagatgggattgcagttgtcctcggtggaagtgtcgagatgacttgaggagttcaacttggccaaagaagtcagtttggaagatgattgccgatggtagacaggtttagcggtattggcattaccgttactaatactttcgggtccatgagtaatgaactcagtactttcaaaagtgcacaccacgtatggcaacgaaggactagtgggggagatattcaggcattgagcctcctcgatgctaactcgtagcttgcctctaggaatatcggtggcggttcccgcagaagtttcttttgcttctaaggatacggggggtttgcaaggttttgccttctccagagattccttagtaattggtgcgggtgatggagaagcattgctcttcacttcgccgtatttcttgcataggtcggtgttcaaagttgtggtggtcccgtaaatgctttcacctttgctgaccgctgtggtaggaattggagtctgcagaatattaggaaattgtgttatcggattgccattcgattccactttggagccttggtcatatttctgcgcaggcagtttaccgaatccgaatagattctttgcaaagtctgacattcaagtgatgatgttctcagggaaggaaaaagacctttgtatgacttgactgtatttattaatcaggaaaagaaaaaggaaaagcgttgatgtagtagtatttctttttttttttcctgcgcttctggtttggtgtagggagggtttacagataagataaaggaaggtagactaggtactggcggaaaaaatgccaccgattcgattggaggaaatggtttttgggccacttgtggaaaaaaaaacttcccacagttacaatttcagttgtggttcacaatcggcgattcgggtctcaagatgggctactactgatttggattctaagatgggacggacttagattggcgcctaacagaaacgtgatgcggcgtttccaaataattttcagattttacgaatcgagtaatcccttcccttgcccatccaggttttcgatacaactaagatcttgtcacggaacattattctcctattattgtctattacttttctttttttactttcttatttttttcactctcattcattttccattttcagggtaatcttttcagactacggatgataccccgaagtcttggtcgagatctgtgtagactattaggttaatgacaggattgttgtcaaaagtaaaataacccttggtcgaaatgcgaatctgatccgatttgattagtgagggggaaactttgacgcagtaaacattgctgttagtggggatgtcgaccccattgatgctgacaagtttggtcacatagtccaggtgtctattgtcgaaaagcggactaaaggcgtctattgcggcattgtctaatagtcctagagaacttgtctcaaatggtttgattatctcaaatgatagtctcaaatctctgatggttggaatgacaaaatcaagtccaaagtccatcaaagtgttctggcccccgaaaaaagggtctattctataagtaacaacctctgtttctagtatgggtgtactggttaagctgtctttgttcgcaccgccgtagttatggtagaaattgtcttggaattcaatggcggtagttgaattcatatatggtggtgtgattagagacttttcaaatattttgtcgatatggcatattgtaggatcctgcagtaagtgtgacgataaaaatgtgtcggtattcctggctacgaactcgcacgatgaatgaggtaaagacagcgacggcaacgtggggcggtcgttggttgttttctcgggatagagtctgttccataaggtacccagtaaaggtatgcggtcgaggaatttatgttctgtcagcaacggcgatgtggtaaagtactgtgctgggtcgttaagagaccgattatgcgttgccaaccagaacggatgtccctctgtggagaaaatcatattgttctgtttttctaagacattatgaatgtaattgttttcatcaaacaataggtagagatatttcaatgtctcgctgaggacaaagctctccattcgatcttgtctgatcccgcttcgtatatcttgaaatccacagagaccacagggacacaggaacatggatcgaagtttcatgagaagatcctgaccgatggcgaggtatattggatctctagtgcttctgtaaagatgatatgtgctttcaataaactctggtctcaagggataccattccaaagccatagaaccctcgatggtaaagtctccattaatgctccaacgctctggtatactctggaaacagttccaaattttaagatatactagatgacttttgactgctggcttgatgtggccagctaacacctgcaatcctggccaaaatgcactcagagagtcgatccagtaggccctattcttaccgctggtaacgtcgacgtttacggtgaggtaatcattaaatgtcttcatgttgctttgcacagaattgtaggcaatattccaaacgttgaaaagatcttcatcatcgaaaagaatagcccctttcaatgcatactcgtaaaacgaatcaatgcttgcaccgatcccactcacattatctagccatttagattccaaaggatcgatcgtcattgggagaagatttatagaagaccttgagttccaaatttggtagaaacttctctttgatactttttcataaatcggattatttgtcaatctgcttagcagggagaactctaacagaggtgtagtggctcatgcagtgcacgtatcatgtggaagattggagttaaccggattgccttttaagttgactcttggtagggggactccagttggcgtatcgaaagctggtagcagcctgtcagccaaatcgacagctaattcaagtaaccttctgcctttcttgggctcaaacatgacatgcctttcatctgtaaggtacaagtgagctgagagtagtccaccaagaacacgaatatcggtttcaaagagactgacgtcgctgtctatgtcaaaatcgacaaagttaatatcttcaaggtattggagggtctcattgaattgatcccaaagtcccaacaccaacaaggagtccaagttgtcgaaaagagtcaagtggtagtttcctagtacatcattttgtaagtcaagactatctttccgtcttttattaggcgtacaactcagaggtttgacttcatcgtaaggaagaccgtactctttgtaactattccaagaaaactggaataagcccctcgtctcattcttgagcagctcaagatgacttgaggtaaatgacgactgtagaatctcctcatcagagtacctagagacatacccacatctaattggtagcataaacagccatattagacagacatatatcatttaaggtgcatagattagagttcatgaaatcatccgcgaagagcccttggaccctacgggatcgcttacgcgagaaccaaaactgccctgccaatataaaggaataaatccgttgaagatttctaactatgtaaattatagatgacacgtatatcaaaatagcacaaaaaaacaattgaaaaggaggcaaaagctctgtaggtaattagcttagaccaatgcagttgatgcatataatacaaggaagtaaatgatgagaacactaaagaagggtcgctagtaacggtagtgatcaaccttgaaaggtccctcaactgggatacctaagtactcagattgaacactggacaacttggtcagcttagcacctaagtgagccaaatggcatctggcaacagtttcatccaagatttttggtaaaacgtggacaccaacatcgaatggaccagacttttcgaactcaacgaattgctttctgaactcactgtcgttagacttgaacagagcaatttgagccaggacctggttagagaaagaacaggacatgacgaaagaagagtgaccagtggcacaacccaagttgaccaatctaccgtcagccaaaagaataacgtgacgaccattcttcattaagtatctgtcaacttgaggcttgatgttgctgacgtcctgagcgttggccttcaaccaagcaacgtcaatctcaatgtcgaagtgaccaatgttggagacaatggcatcttctggcatttgctcgaagtgcttaccggtgatgatgtctctgcaaccagtggtggtaacaaagatttgaccaatggagacaacgtcatcaagaggggcaacttggtaaccttcaacagcagcttgcagagcgttgatagggtcaatctcactgatgataactctggcacccatacctctaagagccatggcacaacctttaccaacgtcaccgaaaccagcgacaacggcaaccttacctgcgatcataacatcggtggcacgcttgataccgtcgatcaaagattcacgacaaccgtacaagttgtcaaacttggacttggtgacggagtcgttgacgttgatggcaggaaccttcaaggtagcatccttgaccatcttgtacaagtggtggacaccagtggtggtctcctcggacagaccgaaacagtcatccaacatttcagggtacttctcgtggaccaaagaagtcaaatcaccaccgtcgtccaaaatcaagttcagcttcttgttgtccttgaaggcaaataattgttgctcgatacaccacaagtactcctcctcggtctctcccttccaggcaaagactggaacaccggtagcagcaatagcagcggcagcgtggtcctgggtggagaaaatgttacatgaggaccaggtgacctcagcacccaaggcgaccaaagtctcaatgaggacggcggtttgaatagtcatgtgcagacatccggcgattctggcacctttcaaaggttgggcaggtccgtacttctctctgatgtaaatgagacctggcatctcattctcactgagttcaatgtcctttctaccgaaggcagcaagtgaaatgtcggcgactttgtagttagacatggtattatttggtttagtgtagtagagaggaaaatggaggatagtttttcacgatatttataggtgtgaaaatcttttgaggttccttaaaaaaataaacgagggttacgagttttttgttgagcgcatgtgagaacgtggtaattagggatatgggttggggtgtctggatgttgtatgatcctgctacatgcgagaaataataccagctcgattgccaattgtaataagtgcaagctcaggccgttgaaaccacccccaggaagaacgtatctcttgtcgtggactaggacgtcaggtgccaaagatctgagaattgcttttgaaaaattggcaagatgctggatgtcccttacacggagattccctctaaggatcggataacacatagtacacagggtcccttttgaaggaaacccgacacaagaacaaccgggctacgttttagaagaaataatcaggggattctttgcatatcgtcatgagttcctgcgttattatcgttcgttctccgttggaaacaacccgctttgcttacatccctatcaaatctgaaaactcttatcaaatcggcatcccgaatctggcagacagcaacaattcacgtacttcaaaaatcctattttatagattgtttcccctcaactttggtttgtttatagcaacattgaaactgaaaaatgcatttcgacacccaagctcaagttacacccacgctgggcttcaacatattagtgatctgcttaggttcattcctgtttggctatcatctgagtgagttgaacgcaccccagagaattatatcttgtaggctgcatcaggaaggccccatgtcttggtgggcccagcatccggagttgtttgaacaatgtatcccgatgaaatctagtcaacgggctatgattaccaccatgttgtcctttgggggtctgctgggctccctgtatagtggatgggtagcaaccaaaataggtagaaagaagatcagtatacttgtctctctgggatatgtcctctcttcggttctgttaacaattgctaactcctatgggatgctgaatctgggaagatttatagctggattgagttcgggagcatgtttggctgtgactccaatgttgatctttgagatcaccccagttgttcatagggggttcatgggaacaatgatgcaactctctatctgctgtgggatcactacatctcaagtcatgggctactactatgctaatgacacgcaatggaggaacattttccttttcaacgtcttgatttctttgacctacacgttgctacttcccttcacaatggaatccccgaaatggcttattacagtgaagaaagatgtgaagagagcaacagcgctacttaagaaagtcagaggtacgcataaagaagttgagggtgaagtgtatcattggagaggccttagtgttaatcagagacacagtaaaacttatgggtctgtgaccgatacgaacgcgtctgaattcaattcactccccgctattgaagaagagcttgctccctcaaagtcccgtcgttactcagtggacattaacgttgataatataacggtttggcaactgttaacaattccaagattccacaaagatgtgattgctattataggtttgatgctctcaattcagctcactggtcagaattccatcactttttacggtgtggatgtgctcagcggcatatttccccaaaacacaagtctgatcaacatttttttgtctgttatcaacatatttataacactggtgtcctcattgttaattgataaaacaggaagaaaacctatgcttttgatgtccgattttctgatgattgtgggctcatttgtgttggccttgagtatgaggaatgattggaattgggcagtggtgatatctgttgcagtatttgttattggattctctactggtatatcttcagtgccgtatttgatgatccctgagatgttagaacacgatgtcatcccagctgctcaagcgttaggtgccaccgtaaactggaccacgggaatcattatatcttattttttccctattgtgaacgaacgtttgcccaccggggaagtttactttatcttcaccttcatatgcataatgttcttcatttttgtcgttagaagagtccctgaaacaaaggggaaagtcaactacaatgaggtttggaaagattatcacttttacacctaacaatcagatcgaatatagttacagtttatataaatgcatcattaccctgttctattgcgtattttgtatgaggcacgatgtcagtactctcccaagggtaagcgatccaacaatctgggactgttcttgcagcaatatatctgttttccgactccaagatctccttaggcagctgtgctttcttttgtttgatcttatcgtgaagaacaaagatagcaaactcggtgttactcttttccagcccccttttcaaagcttgctcttcagcatccttttggagttcattgagagcataatgaagtgttgttcttgtgtcatccacctcatccacaaccaaaattctcttatttaccagctcaatttttgaacgttcataatcgatccactggatcctttcgaccttcacaccaggcttctcagaagtatcaccctttgttccgagatcctcatacaatgacagtatgattgcaacaattctcaaacttggttggtcagcctctttgaggaaggttctcagaattctggcagggatgaaacctccacctccgatggctatgatgaaatcagggttgaatttcttgatctttgcagccgactcctgacatagttgatgtacattgttgtacgaaatgtacatcttggactcttcagccattttcgcaattaggtggaggttgtccgtatcagaatagaaattatccagcgaaagaattaattttgggctccgaggtgagagatacagttgccgtggaaaagtacacgcatttcccaatcaggttaatctaaagacaacattcgcatatgacgtacgcttattgtttcgtctggtcttcctcttaggagcaggtttacctctagtccttttctggttcaatgtcatgtaatgaaatctgtacaggttcacatttacgagggaatcattgctagatagagcctgacttactacggactcgttgtcgtcgttgtcgtcgttagttactccagggatttctccaggtcgatttattcctgcgttttcaggacgggtgttgtgagcatgtgactggtcctcttccccagatgaggatttaccgtaactaaaattcaggtccaatgacgaataatcgtctaaaaagttgtagttggcgtaaaacgcctttagatagctatcttccgtagattttgtagtccaatcatctatcaaagatttcacaattgctttgtgccatgatagcgatctctccatagttttatagcaattgtagaggtagagaagaggctagagatttagaagcaggaggaataacaatggagaaagaaggtaagccagagcagaagtttgtgatagacagccgcacgggacactgccaacgaagaacgttttactactgtgcatgatggatgtgtcaattggtccccttttgaaaatggaatgctaatgaaatgaatgaaatagaaatgaatttgactatcaatgagttagctacaatgcaaatgtttagaagtcgtcgtcgtcactttctgaatagccattctctgcgaccatttcctcgtcttcagattcacttgcctcaacaagaataccatcttcaacctcttcgacatattcgacgacatcttcgtctaaatccgaatcgtcgtcagattcgcctgtttctttatcctgaagaatgctttttctcatatctattgtgttcaataccatattcacacgcccttgcagttgcaataatttgggtaacgttttcgatctgttggagagaatcacgtacaaggtcgataagcttgagaaaagattaggctgctgcattaggtagttgccatgaatgatcatcacccatttgatccatacaattaacgctgtctgtttgttggcgttcctgagaatcctttcactcaatctgtccaggaagttcacaacatatatagaatctaatctggatatggtcttcttgatgacgttctcgtccctattattaagaacagactccagcagagaatgatcgttactctttaaagcttgtgtcaaaacagttgccagagaatctgtagttagcttcttttttcgtgcagccttgataggagcttgttttagctgatcaccgaatgtctctaaatcctcttgatctacctccaaatctttaaagttgtctcccattgttaccacggcattcttttcggtatacaattttggtgcagctgaatcatgtaattcaagtccctggtctttatgagatgccactcggtccttcaccaaatgcgtatctgtaattatttgcaacgttgcaaaatcatctaccgtctttacccagcttaaggtgtcaaaaacaggtaccaagccctccatccacgacacaattatgctggaacctttaataaacaaatcaatgaacttcatgttttcatttgcggcatttctgtcctcaggacggttgatgtcgatgataactccggtatttatcgattctacctgtcttcttctcttggaagatttttgcatggtgttggtagcaagaggatcgttgaatagttcaatgtttccatcttctgtgacaccaataagaacaccatggccttgagattcaccatatctgaacgttaccactggggattgaaagacaacaacctttagaatcttcttggtggtgagggagtaacaattgacgaaacgatcaccttctgcaccggagaaaatggtagaatctttgatgactatgttggaaatggtggctacgtgtcctggaaagctgagagctatggagctagtcttcaaatcgtagatatatatcgaattagagctcagcacgagatgtagggaaccctcgtacaccaaactgctaacctttctgataccagtgtcttccagggtaaacgatctcaacaagttgtgactctttagatcgaactcatgtattttaccgtttagatcaacagcatagccacgaaagttttgttcacagaagtggaaatccgtaattccaacacctgaaggtgattccaatgtagcaataaggtcattgttagccggtgaatataataagaccttccctgtgttcaaaccgatagcaacggtttttgtctcgagactttgttgatgtgactttgatcttttacctgtggcaaaaatatcactggaagcaaaagctgtactaagaatctcttctcccttctctagttcgtataactgtgaaataatggtttttgttgccaaaaattcaatggaggatacacgtagtttacaacggtccagatctttcgacacaagggcaaaaagctctccatcactgtcgaaacaacttgacattgttgaacactgtaattctattagaagacttaacttacagagagaagtaaaaaaaaattatttttcacaagcgttggttaacacactcctattgttattgatatcttcaatataaatataggacagaaattcccataaaaaaatgagaagaccgcgtattacataaagatcctcagggactaggagactacgaaagccaaaaaaaaggcattaaacatctgaacaagcaccccaagcttagatcttgcacggaagaaaatgtcagaattcacacagacggaagagctttcccttcccaaggctactgtgcaaaaaataatctcagagattctcccatcagaattctctttcacgaaagatgctagggaatcattgatcgactgttgtgtggagttcattatgattctttcctctgaatctaatgaaattgctgagaaagagctaaaaaaaacaatttcatctgatcatgtattgaaggcggtagaagacctgggattccttgaatatttgaaccctatcaggaaactactggaagaacacaaagagttgaccaaaagtaaggataagagaaataacaagtttcaaaatagtggcctcacagaagaagaactattgaaacagcaagaagagctatttagagccagtaggaatcggttgcaacagaaccaacacaaaccagaataatccatccgcattaatgtaacaaaagtgagctgaaattgaaggaatatgtatgaactcatgagagaatgtaatataatgtatactattaattgattttctttattactctttaggttcgatgggttgctactatgttgtgtacatagtctattattggaggtttcgcaaccgctcctgtggaacggtgattcgtccggtggagttgaactgtttgaatttagataagacatcaacattgtccaaaattgtttcccttaaaaggtcgtcttcctcgtcctcttcatattcaaagtcatcttcttgagcgttctccaaagaatctagcaactcttgtcgttttctcatggtctcgggtaaagtctccaaaagttggacaagttttagtgtaagctcatctttgacttgttctattacggagagtccatcaagaccaagtaatgaaatgagggccaatatttgtaacttgacgtcaaacactgtggggctcttcttttgattattcatccaaagaggaagaaattgagttaaatcaatgttgctaactgttaattggggattggtaactaaacaacttagaacgatttcgatatgaatgcagggttcacttgtatttgaaagtttgagaatatctggaattactggtccaacatcgcaggctaagattatttgactcagtaattcatattgcacctttggatagtcttcgaagagttcagcgttggaaataatttcaatggccttttggacctgagggctcttaaagttcaaatctttaaatccataaataatgcaagcttcccaaaatggctgacacacatctggtataaagtaataagatgcggaatcaaatagttccatgtacacatcccataaggcctgagacacctgtttcgtcttgctgacaatagtttcacagatggacaaaacttcaactaaaaacatgtccagggtattctgaatggtgcacagcactgtaggccttaatatatcggcgagtcgggtgacatgatcgacattgtcggaactgtttacaatcgacaacatggtatccaaaactccaatgccctggtattccttgtcagtgtcgtttctgttgtctatcatttctttcatgatcctttggaaattctcgttgagatcagtaaatagttgcaaagcaaacggctgaacttctgcactgaattcagacacaaatgcttggatgatgtcgctaactgcttcaaactcatactcatttgacagttttagtagtttgctgatgatagagttgatgtgaggcctaagagaatcagaaacctctggtctggaaatcaacacagttatcgcctcagcacctaacaatatcaacaacggatcatcatcttgttggaaattcttcaatagtccttggaagacttctgacaagagattaagatccctgatgcctgctccataacaagtaatcaaatcacaagccctggtttgcaagaatggatactcctttgcgtttaggtaaggcaatgtgactttaacaattccttcaacatcccaatcggactgattcaattgcaaagagaaacaagccaagactcttagacttgcttctacttgaaatgggttgtttttctcattggtaaaacagctaaccaccaaatcttcagtatttgagtaaatttgtttaagtttgtcttcagaaatacctgccaataaattgacagcagcatcattggcagtagttgtgctgtttccaaaatcaatgtaacgtttataatactcgtcaggatcagactcgtataattccacaacgtcgtcagttggtaataggttgggtaataccaaatgagcaatgatctctcttatatgaggctgcactagtttccaattgtagggcccgttgacaaattggtgaatagtgaaaattaaataataaaggctcttctgggagagccaatgagactcggggttttgagaccaattggaggcgatcttgaatacctgagttaaaatctctggggcaaagtttgatgtaaccaattcacagaactgattcaaatgagcttctctactcatcgattttccaccgccatatcttccgattaatctacatagattggcaaaagcccatttttgcgattttgacctaggatcaactgttcttctatccacgtctaatgccattaatgatgaagagctctctgatgaagcaatcgttagttgataagaaacccatttttccagtttcccaatatctcttatgaaatactgaggcattgaagtgaaggtagcatacttgaatattttaaggatttggtaaataaggttacttgcagaagtatcatcaagaccattagagaccaaatcatccattagactttccaataattcgaacgaattttcgacaataagatccagccttctacggtcatctcccaagctccaacgttgggttctcataaatgtcttgaggatcagtaacccactgtaaacgtattcgtacttgtccttggaatgcagcaattgtagagtgtcatttgtcagttgatcccactgatcaatttcttgttgtaatatcaaatacaatgtatcacacaacagttggcttactttgttatcctgacaattggccaggaacacctgtacaaatttggacttgatagatgctttttcttccggagaaatctgtttttgttgtagttcccatgagtcgtttccattgatgttccaatgcttcttcactttgttcttgaagtatacggcaacaaacagtttgacgggagcctttaaggaattatcgcccacgaggtcaaagaaaaactccgcaacccctggtttatgctctataccatccaaataatgagacaaatcatgattcctactggcatcattggataatgacgcctctattagcaatagaagattttgtttatccatgcttggaataatagctaacaaattatatttttccgagagtagtaacggtaggagactctcgattacgcagtgggaggagcgtgcgccataggcgagaggttgttgccggggaacgacgtacctacttctgcggcaccgtgtacctgtcctcgtgaagctcatgaattggaggtcaatataccttctgtcgattcctttccgtatatggttggtgtttgagctgtcttatattcacccggacgaacattttcaaagtctggaagttctatgcaactactttttgggctactctactaatctaccttgggaattcagccctgagaccccaagcagatcattcggtcctttacttttgttatatggtccgtctataatagcgggcaaatggtttagcctgccccctctatccatatacttcatatgcaagttacaattatgtctcttgacagaattggcgacgcattggtgtctctacaaattgatgccaacgaaaaaggaaagaataaaggctgtttatttaaactcgttgtcatatatcacattagtttaccaatcacacacattttcaaacagtgtggagacgttgattgtcttgctctgtttggccatcatcaatgaactcaaaatagagcaccacatgtcctaccctacaatcatttggcttgcatttttgatcacgtttggagttttcaacaggataacgtttttggcttggctattaataccaagttatcaccttttgccgtatttcacttccaacttcaaggcactgatactgttcacactttttggcctgcttttctcatatggtttcattgcaacagacacgctgttgttcaacagttctcaatggttattgaccccaattaacaatcttctctataacttgaaccatgataatttggctgttcacgggcttgatagtcgtctcaaacatgttttagtcaacattcctactatgttgggcccagggttgctgttattctccagaaagcatgtctatagtttaccatttttctctttggtctccggagtctgtcttctgagtgtttttccccatcaagaattaagatttcttatgccagctataccccttttatcttgctgctttgatgttcaaccaaggttctccaagtatcttctaaaggccttcatagcatttaacgtcattatgagcatcgtcatgggtgtgtttcaccaaggaggtgttgttcctgctttgaatgagttgcacaatatcgggtattgtccatctactacagtccaagtttggtggaggacctacaaacctccatcttattttttagaattatctaaccagacggtaaggttcaccaacaaagatcaagattccaaggacgaactcttaaaaggtgatataatagacgcgatgggaatgcccttggaggatttatcagttcttttatcgaaaattgatcggccaatcaagttagttactccagtaggttcatctttactattagaaggtatgttaaatgagacatggacttatttttatcatatcgatttggatcatctagaaaattttgcatttgggatcggtatctacgatgttatcaactgagcccagtttttagttgtctcttgacttaatcttttgttcatttgacatttgattaatgttgtttacttgtaaaactcgaacttgtcgacgtcggaaccagtcttaacttgtgaagagtaagcttcctctagatcactttgaatgatgacatatctgttctttctaacagctctcagaccagcctcctgcataatcgcagcaataacggcaccactcaatgggtcatttcgaataatcaacgaatctaaatcaacttctggggaaattgacattctcgaagcaattgtcgaaaatatcaaacgacgttctctcctgtctctaagattggggaattcaatctttctgtccaatcttcccggtctcaatagtgcagggtctaaagtgtctgctctgttcgtagccatgataacctttacggtcgaggtttgatcgaaaccatccatttgatttaacaattccaacaaaattctttgaacttcacgatcagcaccagtttgggcatcaaatctctttgtagcaatggcatcaatctcatctataaagataatagccggtgagttttctctggctaaacggaaaacatccctcaccattctgggaccttcacccaagtatttctgtacgaattctgatcccacaacacgaatgaaggaagcggtggatgagttggctactgctttgaccaacattgtctttcctgtcccaggaggaccgtacaacagtacaccccttggtggatcaatacctatctgtttgtaaagatccgactgggtcaatggtagctcaacagcttctctaatttcttgtttctgtatgtccagcccaccaatatcattataagtgacatctggtttttcgttctctcctacgattgagatcgaagagtctgcttccggaggtagaatatctaccagtgcattggaatgacgatgtaacgctaccgacgatgatggtttgagcaattcacgatccaaggtactgagaattcgtaccacatagttactgcctgtggtggaactaactatacctgtatgttcgtcaataggctccaagaactgtccaatcaccaatggaacactctgaattcgtttgacctcttcttgagccctgatgagttctcttttcagatgacgttgttcgtccttgatgtactcctcttgaagcaaaatcaattccaattgcttctgtaattgtttgagtctaagatatacatcgtggtccttggggagatcgctctctatggtcaacttcttgaagttagaggtcaggggaatttttgtctgtatgcctaattcttccatctctgagaccttagttgttagtagtagatgtagaaaattggccaccgaaggatgtttcgaggtgctcaatgatggagggctcgtttgaaggcgaaaaaaatgagggtgctacaacggattgggatcgaggctaccctgttacggttatattacagtaattattcaagctatcaacattccaacaattactcccgatagacagtatactgctatgcttggatcccaaatgtttagtgcggacgtctggggagatccccagtcaaatttagttccaaaaagatagtttataatcgttctagctttgaggagcacaatttcctttaattgaatcagcttcgatctgaaagtgggtgtttcctcagattcggatgagatttcaacaaattggtcaagctccgcttctggctctgtgtcagccaaaacccgggtttctagattaccttcgtctagtatttctgctggcaaactgtggtcagtctgtaacgtatctttattcccaataacttcttccttcaacgtagccagttgctcattgacactgtcactgaatttttgtaacattctccgccgtttccagggctctaaaagcaattgtacaatcaccaacattagaaggttcacggccataatggtaactgtaccccaggtggaaagctttcgtatcttatccgaccatatctgctcttcatggtatctattcaatatggagttgatgagattattgtgatactcatcttctttcgattccagctcttgtagttttagttttgtctcattttctttggtctgaaggttatgatcattcttgtacagatttgtgaactgctccagttcttgaaggttccagtcattcttacgttgaagcaacttattgatttctacttggctattgtttctattattgatggcatcttggtatcgagttttggcttcagtgatgttgctcttcaactcgttcaacttgatctcgttggctagaatttcctttttcaatgtttcgatccgattgtatcccgttatctcattaactatcctactggtaatgcttatgcttgagttgaggtctgtgtacattgtgttcaacttttcacttaaggagccgttgatacttcggaagtcataaccatgaagctctttcttcagagatttgacattgtcactgtctctgagtttattgaaaaactgcttgaactgggccactccttgggcaaaccttttactcatggcacgcagcgatggtgtatatataggttgaactttagtaaaagtactgatcaagtgaggtaaagataggagaagctgaaaagtaaataaataaggaagcgtggaggaacagaaaaacggattggtaaaagattagaaggactcagtcgttacatcaactgaaagggcaccctatgtttatttagagcaaactgaacccctttggggtttcctgaagacagtctgagggatctacatctggcctctagagctcttctcgccagatctcctattcttaatggatgtcccttcgcgatctgaatctctgtcacctacaattcattatggtcaaacttacactaaaaaagaagataaccaagcctttgcggcgaaaccaaactttgaatgttttcgaaaaaaacgaagaggcagctgaaaaggaaatacaaatatcgaccgtggactccacttcatccaacaaacataatgacacgaacctaagagtaatccacccccctagagacacttggtcgatccataccaaaaaactcataccctcggaatctgaaatcgagacaccggatgttgctgacgattccgaccctaccgccgactcctaccaatctgtcccagtaaaagattttggtatcgcgatgcttcgaggtatgggattccaggaaaagggaaaggaaaaaaaataaaaaaatttcaggactgataataatcattaatatggcagcaccgacagccagaagcaaatccacagagaaagcggaggtggtacgtcctcaagctgaagacgaagacgtcatgattgacatggacgtcaccaatcaggactcacaacaacaggaagaaacccagacagaggaaactgctgagaagactaatgcaaacccagaggccatggtcctcgatgagagtggaaaaccaagatttgtatccgccaaagaatccggaatgaaagttaagctagaatccagaaaagttgccgtacctccacatagaatgggtcctttgaagactgcatggcccaagatttatcctccattggttgaccatctacacctacaggttaggatgaacttgaggacaaaaactgttgaaatgagaacttgtgcaaagaccgttgacccaggagcattacagaaaggtgccgactttgtaaaggctttcactctgggatttgacattgacgatgcaatcgctttgctgagactggatgacttatacattgatacatttgaaatcaaggatatcaaaacgctgcatggagatcatctctcccgtgctattggtcgtattgctggtaaggatggaagaaccaaatttgccatcgagaacgccaccagaacccgtattgtgctggctgattccaagattcatattttgggtggcttcactcatataaagatagctagaaaggctgtggtttctttgattttaggttctcctccaggaaagatttatggtaacttgagaacagtttcttccagaatgaaagagcgtagttgagtgcgggattgctgtgttttgcataattatatttttgtacaataataggagaccctcaaagggttaattagacgatttggtaagaactgtagtggcagatttaaggttcgctaggatccttcccagcaactttgaaaactccctctagatgcttccgccgctccctccttctaaaatcatatgttttgcaacttatcgagcaactgctgatcgcacccaaaattttcccctactaatcaaatgaaggagttatctacagcagagataagaccttactacgacccagataacttccagagtgaatatccatatgtattcaagcacaattatggagttatcaatcaagaattggggaaacccatttccatgacacttcccacaacaatcaaacacaataaccagaagccttacaacatgagcagaaataacctggggatctcagctgttccagtaaataaaacccgaaccgctaagatacaggaagatatgtttgattataactcggtgaaagaacttttgacctctgtattgaagaatttcatcaagaagtatctaagaaacctaatatcacagccttttgaagttgctagactgttgctacaagttggagtttttacaaagcatgatgtttccaacaaagagcacaaggtggtgactactgattttcaaagctcggatgatgaggatattgagtacttgattcccgctgacacttcacaatcttcccttgaaagcagcaacaacctgcaaggctccatttcagtcaaacctaaaagtcgttcccatagaagattctccagtatcgagacagctccaccaacgattgaggttgtttctgttgatgaggaatgttccaagtacaagttaaatcccttttctctcaacacgcttgatgtgatatcttccttgtttacccaagatggggtcaagggtatgttcagagctctaaacacaacttttatttacaatacgttatttgctactatcgaagcgtggatttctgggtttatttcgccattactgagtatcccagacccatactttgtggatgttattcactcctcagacccctcaaaggctttggtcctgatactggctgcgagtgtcgttactgccgtgatacttcaaccaattgagttgatcaatgtgagatttatggttacgcctactaataagcctgagactaataggtctttcagatcccaaattagccagtattctccgagagatttcctttgcccttggagcttgctcctgccaaccattaaccacagtttagcatccaatggtttgaagagatatattccttacttgcttttcactcaattcaatatggatatttacaattcacctgtcatgtatccattgattactcttgtgacaaattccatcgaactgttcattagacttcccgtggaaaccttactgcgcagggctcaactgaactatcttctaaacaatccaaattgcaacaagacactaagactgcaacacaatgagctctccgtgccatttggaggatactatggatacttcagcactctctactacgtctacactggatccaaaccttccttcgacaaagtatcggtcaccgaactgaacaacattaatagaggtctggaaagcatctttcgtggttggaaagtcggtcttcttcacgttctcagtaattggagatttcaaatgttaaacaactacactaacgttagtgaagaacagttctaaatattatgtacatataatgagtatacgatgtgatcaatctttattttcaagtgcgttctccttacgttctttacttctcgttagaaggtactgtccgagccattccagacaatcctgcggtctttctttggccatttgctttattccttctataagctcaaaagtgagctctttatttagccatttcctgacatcgcttcccccaattatatctgaagcctccaagcctgctggaatttcaacctttctcttcttgactgagccctgctctgctgtcaattgctgtgtatcgggagatttcgatttttcttccttaatcatgacattttccagatcaggtgttgctcccgatgaaatgggggtctcctgcttgacctgaggtatcaagggttcattgttgtccattttcgtcaagatctcttcttgaactcgttcccaccaaaaaagaaaaataaaagtttccacatattacataagcagacaaagtgataagtattattaaattagtggcgctagtacccaattaaactgttaactacaaaatacaaatattaaggaaatagtatggttcagtgacctagatttccgtgatgaaggttgcctcgttataaccattaccctcttcggacacaatctcttctccatcttttgcgagggtgaaagtgaatgggttgttgaactggtaaatgaagggcttggtgccagcaataccactgacaatgtttttgacaaactggggaatctcagccatcacatccactctctcgctcaacttttcaagctttcccttgacaaccactctcaattgcgaatcgccttcgtatccagagaggtcaaactcgatagatgtaggaatgctccatccggtaacgtcatcaacaaccctgtcaatgtattttgtctcattatttatcgagctaagcaccactttctcgttgttggaaacgataccaacggttactttggtagttgcataagaagggggagtagtgaactccatgataacaacagagtaatctggggacacataattcaagaagttccaagtagctgctgcatggtgaggtttcattccttgtaatgccatgacgtacatggaaataccctctatgggccgttcaataaactcatctgactcgcttgatttatcttcagatttattttcaagcaggatcttaccctttacatgacatctgggccaaaaaatatgtctcatagatccccatgggttttctgggtcttcaccgtaataagtagtaccatctttaccaaattttacgccgtcagtcaaacgagtgatagtaagatcgacaatggattcggggttgaccaaactcttcaagtgatacgtcttgtcatctataagcttaatactcaaatggtcagcaaaaaagtttggaccctcaactctaaaattctccaatccggtgcttgtccaaacaaagtcttcgggtgtgtccttgtggaagatcttaaaagtgaattgtgcgttggtgtgcaatcctacaacgttactatggatgacttgggcaaatccaaggtatccagtgtctgcagagttgaagtagaacgtctgagtctcaacatgagtatgctctggatattgccactttaggtcatcttcagtaagaggagtccaaggtttcttgaggtctaagtccttggtaactggttgaatcgcgtctggtccgtactctggctctgccgtaccagcgacggctgatagtcctgattgaacccacttaaacatggtcttaagagggtatggtgtgatacaagtgtgttgaaaacagaggtaagaaaaaaaaaaaaaagcaaatctcaaaaggggaaaaaggtccttgggcagccgagggtgccgcggccaaaaagagaaaccagaagggaacaagctatccccaaaagggcgaaggttaccatacgctgttactgttatcgtagcagattgtaccatgttactgagttaccactaaaaaatgaggaaacatttgatcagggatcttttaacgaacggaatctcaatttagcggaaatcttcatcatgacgtcgtgaataaatcaaactctaaactctcctctgtccatagtagctagtgtcattttgaaccaattctgaggctttatagatcactgacgcactcggaaggcagcagtaatatcattatcatcttcttcattctcgtcatcgtcctcatcttctgtgtcaccggatatatcttcttcttcgacttcttcggagtcgttctcgctgtcatagatcaaactggcatcaaagtatagggatggatccaaagcgctaatgtcacacgtgtgggcctccccatccaagatcaattcactcattaatagaccggtagcaggggcgttattaatcccccaacatgaatggccggaagcaaggtataagttgggaacgttggtctctccaatgagaggaccagacgaagatggaatatcaaccactggcaagtagcatgcttgggttttcagaatcttaccgtttctgatattggaactaatacaggaaacatagtttaagagttcgtcacatttctccgaaacgatctccacatcatccgtggtttcgggaatgggtaccgtagtgtcaccttccccacatacatatatttcatctttacgggcgtacatttctggtgacgcaaattttctggggccggtcttcagttctgagaaaattgcaaatggcgcaatttcgggttccttcggtttgatggtgatagaatgagctcttaagccagaaatggggcaatctggaaggatttttgttgtccacggtccaatcgacatgataaccttatcaccttctaattcgtacttcttaccaattgattgatcataaaccgccttagtggacgagggcgagtaaaacacaccattgcaatgtccagtctcttcatcgaagagaatgtcgtcgaccttaccaatgagtaattcgacagcttcggatttcaagcactccttgagaatataagtagtgaacttgtaagggtgtacttgagctgtggtctgttcgttacctaattggttccactccgtaataaattctttgtctatccaattgagcgattctggaagagttgaaggctccgtttccaggtctgacttaacctggatagagttcttcgtgactgcactcttacgctgttgagtgtttgcagatttttctttgcctttgatcccctgaccgctgatatctccttggacgctcaatgtggtcaatcttctgtaaccccattcatcttcaccgccaaattcttcactcagatcactatgtaattgaaaggacaacgggacaatctgctgaggaaatgcccacaatgcaagcagccctccggccttaccactggcgcctccagcgactcttttactttccaggatagtaatatggtacttctcagggtcgaatttggaatgtctagtcaagtaaaacgccgtgcacactccaataatccctgcacccacaatgatgatgtgcgtctttcccttgtgcctaccagagggtatcgaggaataactcacgttttccggcctagagtcaaccatgattctgcttagtaaatgatgacagttgtaacaaaatttgagcctggaaatgagtgcgcgaaggatgtcaccaagtctattaagcaaagatattgcgaacgcatcgatggtgccacttccgcggcggcgcccggaaaaaaagcgaaaaacaaagaaaggaacatttccccgcgcattaccagtattacgtaacaacaaaatagggtaggcccctaattgcaacttctttacttctgttgaagaacctttattagtctatgtatatatggatcaggtacaacgacaacatgatgctaaactaaaacccccgttttaaatcaacccattaacgtctaaaaacaaaaagttgagaaagaataaagaaaaaatacaattaacatgtccaaacagttgagctttggatatatttcaataatgtgagaagcaacggctacaccaagccagaaggagagaacgagcctgcgaccttaacaaattcttttgagctttgacaaaatatattcttattgtgttttcgcttaaagcttaagaacctttggctgctcccatgggttttcttggttggtgaagtgaccgtaggaagcagtcttgaagtagattggtctggcaaggtctagctccttcacgataacaccaggtctcaggtcgaagttcttgttgataatcttgaccaattcgtcagatgagtaggtagaggtaccgtatgtgtcaacgtagatggaaagaggctctggaacaccaatagcgtaagagaattggaccaaacatcttctggccagcttggcgtgtacaagagacttggcaacccatctggcagcgtaagcagcggaacggtcgaccttggagaaatccttaccggagaaggctcctcctccgtgagcaccccatccaccgtaagtgtcgacaataatctttctaccagtcaaaccagcgtcaccggcgataccaccaatgataaacttgccagatggttgaatgtggtactttgtcttctcatccagcaggtggcttggaataaccttcttgatcacgtgctcagtcaattgcactctaatgtcagcagtggtgatctcttcggagtgttgggcggagatgacgacagtgtcaactctcagaggaataacagcaccgttgtcgtatttgtactcaatagtaacttgggtcttggtgtctggtctcaaccatggaagagatccagatcttctgcaagaagccagctcgtggttcagttgatgagccaaaagcaaggtcaaaggcaacttctcatcagtttcatcagtagcataaccaaacatgataccttggtcaccggctcccaactcctccaaagccttctcgtagtgaagaccttgagcgatatcaggagattggtgctcgatggcgacaagaacgctcatggtcttgtagtccagacccttgtcagagtggtcgtaaccaatgtgcttgacagtgtctctgataattttttggaagtccagttgagctttggtggtaatttcaccgaaaaccatgaccataccggtcttagcagcggtttcacaggcgaccttacttagagggtcgacggtcaaacaagcatccaaaacagcatcggagacctgatcacaaagcttgtctggatgaccttcaccgacggattcagaagtgaaaaagaatgtttcgtttttagacattgtataaacagtgttttgaggttgaggtaaaggaaacggtgggttgtaatgatgaaggagcagacatggagtatttatgtaagtcttgaaaaatttgttggacatcacgtgccacatattaattcctccaacgtgtttttgagccaaactttagctagagggtcaattaaaagggcaatcgtggatgattcggcgtcaaaccaccaatggtggtattgccaggacagacacgctgagtctgatggtttatgttggcacaattcgcccaattgccgtgcttgtacgctgagccgtcgtcgcatgtgaaactttgcttaatgaaaaattcgtataggatcgtttaaaggcaattgcgacgactcacgtgatctcaatatcttggttttcttcatgcatctctggatttaaaggaaagtaccaagggcgagtgttcggacatattttttttggagagggtcatgcaagcgggtccagaaggaatgaaagtagagcgcttaattggtctctggcggtgataacagctgcgtttgaggctgtaaggtttgcctaaagtgcgattatcccacgattcaacaacgaatttttcccagccttggatgaaaactcctcgtgccagtcaccaacttctatgcgcctcttcgaaagaacgtggtcatcttctcttttggacgtgtcgtagtttacttgatcattctggttgttggaatctttgaggcagcctttggagtttaatctggatttctgaggaagtgcctgtattaccccggtcaactgattactgtagctgtagtctactgcttccaattctgcagggaaaacgagcttgtgcgataccaagcgtcgtatatagagctaaagtcacgagcggcccatattaactcctgacggtgtaatcagctcaacattgcccaacaaagacaggaagaagagaaacatgctcagcgtggtccatcagggtgcgcccagaaacgcaaaccaacatcggccatgttgcatactgtaataatattcagaaatgacgatatagagtaactaatttacaacaacgaggaggccttctccctcccacgattggcaacctgattgccaaacactactcgtatcagtttgtcaaccgttctaaaaatccatttggcaacgaccattataccaccacaaatggtcaccaaccgaactaggaaacgcacaaatgatatcctcttttcttcaatggacaagatgattggctcaaactggtagttgaaaaagagtcctggtggcctgctcaaaccaggaagttcagtgacggtcatggaatactgggtggtgtcaatcacgattcccagtttcttgtactctgtagggactacgtccaaataataattgaatgtgtgaatgtgatcattggtggttcttgcggtaaaatctaagggattgttcatgtatgggtagaactcaccaaatgagaattcactgatgacatgcgtaaaattcaatgcttccttgggtactattgatctatctctgtagccatagcctttccccgttatgtgaaagaatccatggaccttgttaacggggatagatccgaagatatgacaggccggggcatctccgtgagtaaaagatttcttctctcgaaactcagctagagctgactctctcattacttcatccaaatccaacgtgcttccttgtgattcatcgccattgacacggaacgaatctgggatgaaaaaattcacaccttcaaagttcagttgctcctgcgccaaaaacctatcttgtgtgatgtctttgacgttagtatgcagataattgcaaggggtggcaacaaacatgtcaaggttgatattgagaacacgctggatgtttctgtccaacatgaactggcgatcaatgtatccatccacgtatcctccgatctcaacccatataaggaacaagatgaaaaaccccattaagatggtggaataggagcctttagtgctcctcacggtattgacaggttccgttttagggaacgcatcaaatactctgatcgtgcggtgataatccatgtgaagatgaaaaatatctgccagatatattgacaaaggtaaacgcatctacaacggaaaaccgcgaatccagatgaaaagtatctcctgtggggggctatctatactgtgtgggggactgttttcactcaggaactggcctagcatatctgaagcattcccttacccatcgcctacgacgaaattggttattcaaatcatagcaccactcgtcgttcttgaaaacaacaccgtcaatcaagtttcgatcgtagcaccatttcttcggatcagtatctaaagtccaaccttcaattgagaatgtccattcttttggtgcctgcacctcattaagtaagatagatcccttcggtttcttttgatgtcgtcgaagattgcttctttggtggaagattgttgttgtgaaacatatagggacatactgagagggagttaatccgttttgttgtagttcaaatacttcaaccgtcctgatttctggttcttcatctaagatcagcgatttatattcagctttattactttcagaatccggtacaggcttggctttacccgaatcccaattttcgggaagcaaaagaaataaaacacccagtttgtggaaactggggtgacaacgacaaacagcaacccatcctgaaacgataaaaatagctttccagggaatataacgtccgaaacaaaataagaggatcatccacagccagaactttaaaaatagtgatgtggacagcttttcatcttgaaaagaaaaattctcgtgacaatactgttcaataaactcgatctgtgtagtaagatgagaaagcaaattctgaaggtctctcatgttgataaggatattcatttctttgttgaaggtctttccgctctcagtttcttcaacaacctcttctacgctctctgaaatagagacaatactctccgcatcactgtgatcctcctgttcctgtgataacacctcttcccgaattgactcgtagagttctccgctcatcggatcagtgaattctgagggtgccagaaagtccagcaatgatcctgaaatgcgattcggtgtgtccactaggttcagaggctcaattgggtgtctttccaagtatttctgcaccacaacaccgtaagttagaaacaccagcatgtataccaagaacatatatggtgatattaccgcccatgtatagagcaataaatatgtgatggtcattgaaggacaatgccatttgatcacccttgaaattccatgctgaattgtgaaaacaagttccaggtgtgcacttaatgtccttagattttccatcatgaccttgatcgataaccgtggttgatccttcctcactggatcctgcatcttactcttcaatagctgcctttcacgtttggtgacagtatggcgcaacagtttatcaaccagtttatccacaaaatgctcagcatcatcgtctaactctgtattcacagtagaacttgcgggcaacttgcggctactggatcccccttcccatttgtctaagcccaactccatcaacgaggccgcagtaccagctgccaatcctcgtttgcttccctttactaaagagtctgctgcatactcggaagtgtactcaagggtagaggccaagacggccttggttttactcttaagtagttctctcttgctaaccattgtccgtaagaagtgggcagtgaaattgatcagtaattatcaaaaaaatctggggagctcttctcacgcgaaatcaatctatgaatagcaacggtatataagcctggactaaggatgattattaatacatatatacctatataaacctgtgatctcttagttggcgtgcactggctcgttctcttgggtcccagtggaaacattggtcaagaaagtccaaaaatggcatgaatagcatcggagacttggagaattgttgatgcctgagtaacatgttatctacgctagtgcctctgattttcacattgggcttcaatgagcggacgtgatccaaacggagattgtaagacaaagagtcaaaacacgtccatagaatagttgatttattaatgctttttgaggtgtcaggtttgtcgctctggtttattatgggtccacatgcatttagttcgaactgccaatgttgaattgtgtctcgtttaggtactccaaagtactccagagccttggtgaacagctcaaactcatccttgcaaacaatcaatggtttcccggtgtacaattcgacgagaatagttgccattgaccaaatgtcgattttgctatcgtatctagcaccaacaaacacttcgggtgctctgtagtaccgtgattgtaagtatgagtacgataattgtccttctttgcacgaggatccaaaatcaatgaccttgatgttgatttttccagtggctatatccggagtcagcataatgttttcaggcttgagatcacaatggataatgcctctagaatgtatgaagtctagactttgaatgaattgtcgggcaataatttgaatcaagtttagatctaaacctctgaagctagtggactgtatgacttggtataaatccgtcagtagtagctcggagactatgcaaacatgccctctgaagtgaaagttgtccagatacctaacaatgtggttattaatatgaggatgtcgagattgtagactcttgagcattttgatctcactaatggcttgaagtgaccagcacatttcatttttgataatctttattgcaacaacactttggtttttatgatccaggcaggaaattacatttccgaacgatcctttgcccatataattcaaaatctcgtatctatagttcaaatgatccccaatgttggcgatatatgacttgtcagcattatcaaacccaaaattgttggaagggttattcatgcttatctgcgtcttgcaatccttagatttgcctacaaaatagacttccttcgtctgtaatatctctcccttttcatacatgctcaatgctgattgtgaattcgataaagagacatgtgccttttttatgttggtgtagtttgatacgatatcatgtgtgctcttgtgattccttaggcattcgaataaaagttcgatagtgtcaattttgaagtttcgactgtcctgtagggtagaccttctcgtagatctcgctcgaggtcttgtgtatgatgacttctgagagtttctggttcttggaaccttgacagggaacgaagcaatggaagaagaaggtgcagtcgcagttttaggaggatccttacgggtcaatgagctggctgttgggttcaaatatcttggtacattattctctctgtcaatatgtgctttaggaggtccatgcaaggaaaattttctgatattcttgggagcgttcttggaaggtgaaatttcactaaagactcttcgttgtttatctataaatgggtgcgggttgagttttatggcgggagatatgcgatctttgggtgatttcggagttcttgggtttagtttcgaccgtaacctatcgctggattttgttgtttctctggcaatgctccgatccaatacaggcaaccgagaaccgggtggtgttttctttggagtctggtactgttttctgttcaaactgggactttctaacgtaggaatacgtgaaaccttttgacttcttttgactacttcatcgttatcaccgtgaataccgatcttcgcaagttgtttggcaatatagcttagatcaaggtcctggtacaaatctcgcttcttaggtgtgtaataacggaagctttcctcgtttttggaggtatccgacaggtccataatcagcaatgtaacatgaatataaaatatgtctactgtagctttgggaacaacttgtaggaaggggaatgcaccggttgcaatatgtgtagttctatttggtttgatgttatttatgtttggatttcaaacttcgagatttttttgtgggatttatatctgatctgtaagaaacctttccttgtataaaacctccgaaatgacaggtaacattggcagagacgtagccaatatcatagtggatccccagatttacacaacccaatttctgttgttactctgccaaagcattcatttgacgttacaagaggtggacggagagagtgttgatgaagatgcgatgtcccaaataattgaaaaactcaaccatcattctctgatagctagggacaacccagctgtaaacaaaattcgtctcaagccgtcagaggccttggaattgtactacaatttactcaagcaacacaatatcaaccaagaggaagggttagagggaaataaagaaatttgtgaattgttatatgctactcggatcaaggaattggaggacaatttgagatcacaggagagcatattcaaagaacaagttaaatatctacaaggatgatttttctccctcagcatttcctcccttcaacgggatacaaaccagttcgacctgctaagctggtgagatagtgcatagttctagcgcgacaggtggtacgatgcttctttatttgcaagtttcacccgaaccctcaatctctttcttacatgaataaagggccggggagtaaaggcacaagaagtcgctttggatgccgcaattgtaaacgtcgcaaaatcaaatgtgatgaacagaaaccaagatgcggaaagtgtgtaagtggaaacctcccggaatgtgactattccattcaattgcaatggggacggggcagaccttataaaactcagaaagtgctgaaaatggatcccataccagatctattcaattcaagagaagcaatttactctacctctatgaactcagaaggctcttcttccacagttaatacaatccctgacacaccgacggtgactattaaaaccgaaccgtttcaactgcaaatcgatgatgctatccaaaaagcatctgatcaactggtgaaaaaacatgatttacctatcgatctcaatcacctagggattgtatcagagttgatccaagaggacagcgaccatctctctatgtcgacgtcagactctgtcaacatccctagtaatcaatctgagttgccattcaaccccaattccgaagagagtgtcgtcgaattcatggaagattttgattcctatgcacaagaccttaccagcagtaacaaactcaacaagtcgcacaattattttcatgaaattcctttgcttcacaacaaccataattcattgcacctaccaagtgatgagcacagcgacgcaataaactcgtttgtggaggacgatgatgagttttggaattttcttagtaacacatttattcaaaactctgcctataatgacaatagcaattctcagtcaaatttactccaaccattagacgctaaaccaccagaaagcgctatcaagttgtacaaaaagtcacttcagaacgagttttctcgtttaacctcaatgtacaatgtttatcacaaacaaattcccaacgggatattgccattacctgatatgttgctgagtgtcccgtattactatgaaagcttcatatttttcaaggaggtcacttcgtcagtattggttcctatgcctcatcatttgtacagggaaaacccagtagaaatcttacttcctcgacttgccatgggtaacagcactgttatggctattttaatatcgtttgcaatcactcacaaatgttacatgaccaatacagaagaacctcgggaagttgttgatcagttgatggctagaatcctaaatgacttgcttactttcctccagcatccagaaacggcaacgtccgatttaaccctagctgtaatattgcttcttagctcttacgatatcttttcttctaaacaacagaaatggagactgcatatgaaaggggccaagcaaatcttattaagccgaggtgtcatcaagacgctgcctaacactgaaagcagcgatcagcaacctagtgtcaatggggttttggcaagttcatcaaaaatgatcaaagaatccaacatattagcattcataattagatggtttgcatatattgatactcttggttcattatgctcacccttgaaaccttcaccagaagagatgaactctcatttgcagtcaatcgggaacacaaacacggagttaggaaaccatatcaattacgacgatccaaggctgcattcgtatattgatgctccggaggggagcaatataaactctatcgatcttttcttgggatttgatgtcaagcttttagcaatatccactgaattgtgcgttttgataaagcgagtcaattgtatattgcacagcaaccaaggaaaggaggtgtccctccctattagtttaattacaaaggcaatggatgttgagtacagactttgggagaattacgaaacttcgttggataaagtcgacagaaatgcaggagctgattcgagtcatttagcgttggctacgaataagctgttctactatgctggtttgatcaatctttatcggcgtgtactgttattgccacgacagtcctctatggtgcagaaatgctgcagaatgattagagagacattggagaaacatgttgaacctggatcttcggcagagatttgctcaattttctgcgtattcatttgtggatgtgaagttattgatgaggcagatcagaagtttttcgatgcgaagatgatcaacctggataagaagggtgttccttgtgcaccaaaggcgcttcaaatcatgcgaatggcatggaagactagcaagacacacagatgggggcggaattgggacgacattatggaggagacaggcatggatctggtatttttgtagaacttgtcaggtcagtatagattccctaataataaatagaagagcatcgcactataaacacgcgcgaattgtggagatcctggtttgttaagaaaacttttcagaaaggaataccttctcttccacatatttgtttaccaagaatgaaacgctttggcgtgtcacgcaacttgtggtagttcttactgcatgtgtgagatgctgagtttacgcagttgataactgattcatttccttttggagatgtttccttttcctattgattgcaggtgttctgttcgagattaaattcccggtttatcgtattataatttaactaccattatggtacttcatgcccgggttacatttctttgatgatgaaaattcatgaatgtattgtatataaacactagaataattgattgtctcgtagctctggctgctctggaaatcacccattattgtaacttcttactgcatatgattgcacaaagttaagaattgacagctaaaaccgcatagagaagtaactcttataaatctcatctgacaattctttgttattttcaatcttggtaaactggagctttagtttcagagtatcagtccatgcctcgcgcagtttatgttccacttctcccagcttaatgttgatgtctcttttagattctgacattttgtaaccaaggggttgcttcaaaaaagcggggctctcacagacattcttgaactcctctaaagaataaatgcgacttttgacctcgtttgtttctgagaactgcgacttgagagctgaaagctggtcgagtgtttcctgttcgacggatttgagatcagccaggtctttctctaattgttccgacaagtcctccacatatcctttgatcgtctcagcttcattcaaacgccaataagattcataatcaagagataattcagtgtgagtcaattcttgactttggtggtcttcaatgaactttccaatgttgtctgaattagttttcaaaatggcaaactcagattccacttggtgacacacctgctcaatttgattcatgataggatcactatctaactgtggcataattattttacctagagtgacataattaggaactttcatgggtatattcttttgactcagtgtcaactcatcatccgtttgagtgctacttgcatgtaatgtagaattgtcatcaccaacagcaacatttttcataggtatattagcagtttctgtacctatactttgtaggcccatttgagtagactcatttcggaaggaaatccgttgtctactatgttcatttgtttcttcttttgcatcttcaacttttaccatttcaaaagagctgctatctccttccgaattatccgacttgtttggcgttgaatcttcattgaatggtgtcaccgcagtggttgacgtttgggattttcttttttcgatgtcagaagtaacagagtcatcctgagcaggttcagaaacacggtttccttctgcaaaagaaacactggaatcattagaaattctatgttcgccagattttgatatatcagcaacctctgtttcttttgaaatgtactccaactgttcattatcatcggagggattttccgagcttgaggcttctctagatacattttgctcgccatgtggggaatgactgccgtccctcaatgaagtcggaggatgtttgttatctgaggtgtgaccaaactcttgttctgagctatttacggaaacagatagctcagcactctctgatgatttatcaggatctgactcaccatgtggtatatcatattcttcttcggaattctgttcatccactgatagtgtgtctttactgctgttgttttcttgtgtgtatttctggggatccgaagtgattgctatcttgtgactgaagacatcattcaaagagtccgattctgctgccgagtttatctcttttgccttaatgtttaaactggaaaaagggttatcgttggaagctgtatttccaaaaagatcttcaggcttcacacctgcaatgcttttttgtttaaatacaaaaggtggcattctgctattaaggtcattatctggctcgccgttttgtttagtaagagatgatgaggatgagttgagatccctaagaaaagttggacttctcaactgataaagtttacttccaagttcattatccgtatcgctctctgattttggtttcgtatcagcattcttcagttgtcctacgtttgttgatgctagctcaaaaatacttttctttgtaccctgcgagtcttctttttggaaaatacttgcagatttgcttgaagtatcaaaaatcgaacctttggatttttctgcactaaatatgctttcattattattcttattagaagcaatcgatgcgaacggagatgattgagaattgttggaggtagcaaactttgagaaaggtgaggaagtagatgcagagcctgaacctaaaactttattgccttgttgagaaagtttggcaaatggagatgaagacgatgggttattcccaaaaccagtggaaccaaaagctggtgcgttctttccaaaaggttcggatgccgttgacccatttttaaagcttccaaaagctccagtatccttggaaaaagcatttccttgggtacttgagaagttagagcttctaaagggtgacgtaccaaatccagaggaaccgaagccagaagagctgaatccatgtgaattgaagccacttggctcagcaggttttgaagtaaagcctgaggagctaaaaaatgttgcttctttcttctcagaaggaggagaaagttgctcactggcaggaagaggtttgttgtcttctggctgcgttgatgatgtgaggtcagcatctgacctgaaatcttgttggctttcagatgaagtttgcttttctgcggcatttgtatccttaaaagacactgccggtaattcctttgcagtttcgtaatatgaacgaagactttgtaacgcactttcgttgcttaaagaatcactcttgatgccgtgagcatcaaataacgcccaagaaagtaaattaccctggttcgtcaacacccaaactcttggcaaagatttgcaattatcaatcccattacaaggttctagcacttcctgggtagaggtcaagtcgatagcaagtcctaatggtgtgtcatcttctcctgagtcttcgtctaagggcagctgggccctgtctgtgtcgttaagctggttcactagtttttccggagtaaaagcttgaatatctgtggatggtgacgaagctaccacgacgacatctggccagtttggagaccatgatttaagttggcttaggtagtatgtggccagccttggaagagagccataggggggacaaacatctagcatcttttgttcactactccccccaataatgtagtgtttgtaatcatgctcatcttgattgatgctctctccatatacagcgaataacagttcctcatcatttttcagtattgaggtgacttgtaggggcctaaaggaattctcgatgtcatctggttgagaaatctctgattcggtaccatcaaaagtccttcgttgaatagtattatcaataattgtataaaatgtggatttatccgctttagaccaagaaaacgaggacacattaggtaattccaatctgttggttacattgtcaatgtctagaatgaccaaacgatcttctagcaaaacggcacaaactgatgagtaaaatggagatgcatagatatccctgacgggagagtcaaatgattcgatgttcgtgatctcagaactggatggttcaacccttttcaaatcattggtgatggaagcaagaagcgaagtctcagtggcattgaaaaccagctgtgacacatcagaaacctcagttctatggccaccctcaaataccggcgcttgcttctcttcgtcttcagtcgttgagaggttgatgtaagagtctaattctgatgtatcaccaatgagtaatgtgttacctattgagagggcaaactttttagtgatgtttccccacgctaggaggttcaactccttcaatggaaccgtatctaaagcaggggcaactttgatccctgtggtgattgacctgaatccaaagtcctcagtaactgtttcctctatgtccacggtcattttttggtttaacctaaacagtggttcatcagctaagaaatgtaatacctataaatattggtatcggtgcactacttcatcagagactatttcagaccaggtcaacgagcggagtatataagagatctaagaactgggtattttgttggcattacttgctacctaatttacatgataatctgtggagtgtcaacgttggcgctaatagacttgtgaggaagaactttaccaccgttgacgtagatctcgtccttgacagtaacatcttctcccaagacagtaacaccctcaagtctagcccatttaccaacagtagagttccatccgacaatagtggacttaacccaggcgtggtctttgatattggagttcttgagaataacagatctctgaattctgacaccgtctccaattacacagtttggtccaatcacgacattaggacctatcttacagtccttaccaaccttggcagtagggtcgattaagacgtttccaccgttgatgaaaggctcagaagtgggagtgagtgcactacgttccttcttagctagggatgagagataaagacaggttcctgacaggaaatcctttggctgcccaacgtccatccagtatccttcaagatcgtaagagtacagttgcttcttctcaaccaaaagagggaaggtctccttctcgatagaggtgggtctcatctcgatcaaactgatgactgatgggttgatgatgtagataccagcattaattctgtttccgacgaattcaactggtttctcgacgaatcggtcaattaagtttggaatgtctctgtcatgaacaataacaccatacttggatggttcgtcgaccttagtggccacaatggtggcttcagcaccgtgggccttgtggaaagcagcaagatctttgaaagggtaatcacagatcacgtccgagttcagaacaaaaataggttcgtcattcttggtcagaacactctcagcaagcttcagaggaccagcagttcccaaaggttcctcttcgacagagaaagtgatgtttaccccacactccttctcgtactctctcagagcaccgaccatcacctcaggcttgtaattaacggccaaaacaatgtccgtgacaccagcttcggcgagagccttgacttggtgaaaaatcatgggcttgttggcaaactcaacgagtggcttgggaacagacaaggtcaaaggtctcagacgagtaccgtaacctcctactagaataagtgctttcatttgtggttttattggggaatcaaagtggaaaaatcaaaagagaataggacgaacgttaacgtgtctttaaataaactgctggctggtgttttttttttcgctccaacgtgcgactgcaatagacaacaaactcgaaaataggtaggtgtcaggacttttcctctgcatttcccactttcgccgcgagtaatgcggctttgggcgtttctcgcccgctattcgtgttctgcaagaagaaaactgcagaaaggttggtctcaggggagctataatttgctatttttgaattacttacaggttcccatcagaacccatgaccgagtccgttcaaaaaagctttaccaaaatggctggcgtgggccaaagggctggaactttatgaagtttcctctgagaatacctcgcgaagagacttattctgtatggacgggctgtttccccttagtgagtcaagaacgaaacacacacaactgggccgtccatccttatagcgccatacaaaaccgcatgagagaaacagagaaaaaaaaatgatacaagatcgattatgtaatcaaccacagctcactgtatggtggaagattgcaagattcagttcattactatagatatgcattagtaataatgggacagaactagctttgcttggcagctgtctgtctatgcctcgagtccctgtttttattcgccgtcttctttgatgatgatttgttgtgaacgttccatgtgtttgaatctttggacggccggtaaaaaccgactgtttttaatgattgctggttagccttgtcgacaaatgatttgtatgaagctctgaccactgaaaggatttcagatcggttgaaatgatcgacttttgctgtttgagtgttggtattaggagttgtagtggcaccagtcggggtgctacttcgtgatgagctgggattctttgcgttcacagccttcgaagtggcatgcttgtcatttcttatcttatccttaccagcagccaggttcgcccactcaccttgaactggtacaaggatatttctctgtttttgctcggtggttcccattgctcaaacgagtggagagggaaatcgattcagcagttaaatcaatgctggaaaatattcgagattacctaatcggatctggaacttacttcgacctgacattttcttgcctggggagccacgatcgattatgtaatcaagaatatggacagagggaaacagatttagctgtcaaaagcccaagagaagctaccgatcaatggatgcggatagataaagaaaagcctttttttttcattagccatccgagttgtccaatcaaatgtctgcctgctacgctggagaggaatcacgcgtgtttaacattcggattgtcgcctaaaataagcctattacctacacagtaaaacccggggggtgctttggtatcaatgaccccgggattttatccaccagtttttttctttctggcaagagtgcattgcatccccgtacaaatagtagcaacctccacaagaggaatcccctatgagcgagaagtccatagtaatacccccgcggaaaagagatattttgtttccgtgttgcccttgaacttcagtttcccccatcagtttatatagtagccgggttcccaatctctagcccttctttcctcctatttcattcctctcttcttacgttatcttacattagcatgtccaataacaccacccaaaacttggctgaacagaagggtattcagaccgacttggtcactctgactcgtttcatcttggacgagcagaagaaatctgccccaaacgctaccggtgagctgactttgcttctgaactccctgcaatttgccttcaaattcattgctcacaccatcagaagatccgaattggtcaacttaattggattggccggtgtgaccaacgccactggtgacgatcagaaaaagctggatgttattggagatgagatcttcatcaatgccatgaagggatccggtaacgttaagttacttgtttccgaagagcaagaagaccttattgtgtttgagtcctccaagggaaactatgctgttgtctgcgacccaattgacggttcatccaacttggacgctggtgtctcagttggtaccatttttggtgtatacaaactgttgccaggctcagctggttctattaaggatgttttgagatcaggaacagagatggtggctgccggttacaccatgtacggtgcatcttctcacttgatgcttactaccggaaatggagtcaacggtttcaccttggacaccgacttgggagagttcattctcacgtatccatccttaaaaattccgcacaccagggctatctactctatcaatgaaggtaactcgcactactggaccgatggagtcaatgagtacattgcttctttgaagaaaccccaagcaaacggaaaaccatacagtgcccgttatatcggatcaatggttgctgatgtccacagaactctgttatatggaggtatctttggctatccagcagactccaagtctaagtccggtaaactgagagtcttgtacgagtgtttcccaatggccctcctgttggagcaggctggtggtgaggcagtcaacgataagggtgagagaattctaaacttggagccaaaacaagtgcatgagagatctggtatctggttgggttccaagggagaagtagagagattactaccctatctaacaaaaaaaattaagatccaatctgtgaatctctagtgcgttcgattggcactgtttccgagatttgatactttgtacacgatgttatatgaggttatatacttgataagagggtttttacgtttgcaattagcacaatttcggagtagcactggcgggagtgaaccttgagtagtctggatcaatgtaatcttcgtataggctagacaccccggattgggagtgctgacgaaatgatgttgggatgtgatgacatcatagggataatagaaaagtaaggttccgcgtgagccgttgaacgcgcactggaatggatggtctgtgacgtagccagactgaacttgaaattccttccaagaaagtacatttttatttcattcattcattcgaaagggaggcttgtgggggaacccccaatcaaatacctaactactacttacaatatccaaacctaacaacgagctcctcattcccgatcactccttctttctaccaaataatcctctcttcttcttgcccttaccaccacttcccgttggtgaattaacatcctgttcaaaagtattctgatctcctgaaaacgagatcacggggttttgaccagcaatggggggacgaggtctcattctgtcgtgatattcgtagtttctgccggactcataacctggaaaatcaggacgtaccctccaacctaaagtcggggtctccagtagttgtttataagtagtatctccagtgatggcatattcaaaggaacggatcgtatctaaaggcctctcgtctctcgatctggcaggattggaaacgtcggggttattgattggttgtccaaaaatgtcacggatgtactctccatcgcccgacttattactaaacgattgttgtctggcatgagtgtagtccgttgattgttcgaacggctgagcctcgttgacagccatcaagatggggtcgtgaatgttgtttgatctgtacttgagtctgtccgtgtcgtctttggtgacgtgaacttttggtactttaccaacatcagttttctctgatttctttgaaaaaagtcccattttcctcttgaatcgggtttgatctgttctatttcagataggctggttataaagagcgaaggttggctatgttaacaggagtctgatcagtaaatttgcgatctgaaggtccacggtggtgtgtttatgcagaaaacaaaaagacgagagatgagatgggctgtgttttgtgggactacatcagggtgagtgtcccctgctaaacttagaatttttttttcttctagtcccccatttgtggcttacgtaataaaggcttagtttcagctgtgaatcaaaacaacaattgaaggggtgagttgtggggtgtgacgttttcggcctgcattaaaggaattacgagcgtggtgtcaaacgggacgcccgcccgcttggcgaaggctcaaagatacgaaccttggcggagcggaacccattttgacccaataaatcaaaagcatgctgaattctggttctgctcaccccaactcaatatcggaactctcggtaaactctcgggtcggtgagagcataccgagggtaaggtgttctatctcgcgattctttcccttatcagcaaatttatttacgcagaggtgcctaaggcctattgttcgcggcggttaactccctggctattgtcgcagtagagatcttacaattctaatcttgcaaccaccacccttttatgaacccaccaagatacattgaaacggtttcagcgacttcgtcgagttcgccagagatcatagacaaccagaatgtcagcgtccaaatcaacggcgcaaagcagagcaaaatagttatcactaacgtcaatattaataaggttcacccacaatcacaacaaaatagaaacacagagctttcgaactataccattttgccagctttcgatcacgtagagttcgacgctaaagtggatctggacaatatggaccaatacaaccccaaaatctacaaagttgtcactttgaacgccttggaacaacatgaggatctcccttcgtacgatgaactgacaaccactgtgaccacaatccaaaacatttctgataaggcttccatgacccaggattctagccttccagcacctgcgactcatccaaacaacaagcaacgaaagtctagacggctagctccgttcctggcatctttcacggttatcatgtgcctgctcttcatttctcataggtcatgttaacctcgtttgacttaaagcctatataacttacatagttctagtttaaccccaaatactttgcatggtgagcagcatgaacgtctgtgaatgaagagataaagtagtaagaatggtcatagccatctaccaagttcaagtccacttttcccttgaacacagagttctctgaagccttcaagaagttctcaggtagcagctggtggtccttgaagtagaacgaatcactctttccaacgtgaatcaaaatgctggaatctgaggggccttggtattttccaatcaattcggttgggtcgtactgagtccaagtggacttgtcctgtcccaggtatccagagaagcacttctcaccccatggggctttagtggggttggagattggagaaaatgcggaaaccgacttgaattttcccgggtttctcaagaataactgtaaagctccgtaacctcccatggagtggcccgtgattgaaatattgtcaaagtttagaattgggaagtcagcctgcaatttgggtagcaattccgagttaacataactgtacattctataattatccttccatttctcagtagtggcatccacgtagaacccggcaccggatccaaaatcataagagtcgtgctctccttcgatgttgagccctctgggtgaagtatccgggaaaaccacagcaaaaccgtacttatttgcatatggttgccaaaatgccttctctgaggcattgttgggagtgcaagtcagaccactcaaataaagtagaactggtaatgattttcccttggctccattggcaaagaattgagctggaaggtagacgttcacatccatgtcagtcttcgtctcatcggacttgtgttgaagtttgactagctttcccccaaaactttggatttcagctgttaccttgaagattgaagtagtaattgatgacattagaaagatggaatgaacgctacagcgaggaagagcaattgctatatataaccccagagtattgcttaggctaagttgtcaagattgggtaaacaattcgagaatcaaagattaagtaagaagtgttatgttgtaggcttgaagcttcacgcaaggaagactgggagaagtagttgattcctgtggtgattgtcctgaaatgactgtgagcgggtccgcctagagtgttggatccctttcagtgtttccactaatggggtctacattgcgtcccagatcgatagaccaggagatcaattaaaccctacgcaaactatagggcatgaatcaagagtatcaattggcatactcggatcattttctaccgtttcataccaagagaagatggcaaaatgggacttctgcgttatcatgagttggctccatcggaattttccacacttcaggtttttcagatgtattacccttttgagccattcacaatgatatcttggtatttcaaacagttgtagcttttactataaaagtcacaccgatcacaacgtttcatcaatgaagatatgttagttgctgttgccctagtgttgttactgtctacaggctatgctggaatcgtcgccattgataccgaatatgagttcaccattggttttcttagtacgatagaaatagggtttcccccacaaagcataacggctcaatgggatacaggatcgtctgacctcttggtcaattccgtgacaaattcacagtgtgctcaggacggatgtagctttggtgcgttcgccttcaacaaatccaccacttattccaatataacaaaccctaacaaccttcatgttcagttctcctttgcaagcggcagcgtggttgatgacaaacttgtgagtgacactatttttgtagattccaaggtaatcccacggttcaactttgcactggtatcgaagggagacctgtatggtgataatatttttggtattggaccgagagggaaccagggaacattcgattccaatggaactccagctttctatgatagctttccttatcacttgaaggccctcggtttaatcaaacgactggcttactcattttacactgggcccacccagggaaaggtagtatttggaggggtggatcatggaaagtacgatgggtgcctggagaaactcgagattgtccatgacagtgctttttacacactgcttgaggcaattgatgctgatgatacttccgtcttggatgagcaaattcatgttttgtttgatactggtaccgccttgacactttttcccagctttattgctgaacaactggctgattttttgaaagctacatattcggacgaatacaatacgtttgtagttccctgcgaccaagattttgattttgaataccttcattttggttttcgaaacattaagttgtcggtgcgctttaaggatctgtttttagtcattgacgatagtgtttgtgctgtggggtttgatcaaggggcagatgcaaacaagataacctttgggtcttcacttttaagaaactactacacgctttatgatctagattccaaagaaattttgattgctgacgtcaagcctgatggtccagacgatattgaaatattatcgggtccagttcaacgaatttgtgatgaaaagggtgtcagtagcacttcattatggagtagtctgagtatagagtccacgatagaaccagacacttttaccactaagccttctatttcccagacacggtattcgactagctccattggacctcaaaacatttctaactctttaggtgaatatccttcagtttccgtcactctttctgaacaccataacactacttccatagcctcaaattcctcattagaagggaaaccagcaactccaactgttacagaccagtcgtaccagaataataagactacctctaccgtaattgctgtgaatttgattacccattcaaccactcattcaaccactcattcacccacctattcaaccactcattctagtaatggatcacgctcaactttagagtacacttcaaccaaggaatcctcggtgaaaatgccctgtgcgttgatcatctccgacacaattccgtacaatgcttccggtgggaatagtagttatggatcgttaatttcaacatctacggttaacaatgttgaagagaataattcaaacactgttagaccaagaaaaagacagaccttcgtttcgggaaccacttccacgatactactctattcctcaactacgacccaagcatatcagatgttgtcctcaacttcaatcccccgaccatccataaaagccagttcaaatgctggtagccgcaaaacttcaaagacattattaacatttatcatattgtatattttttagttcgtaaatcaataaatcaaaacgcattgttcattctatatatcaacaaagattaaatcactctaattctaagcagagccggaatacgtccccgcaacaagggtctttaactcatggactggtttccattctccactagagacattatcggaagaagaaaacggatcattggtaacctcttggtattgcaaagtaaatcctgaatcaaccaacctggttccaaaatcatcattaatcacaaacttcaccaaacatccagtgtctgcctcttgagccaatcctgaagtcataaatcttgctatcagtcgctcttcgttagtagctgtcagcgttatagggttggggaaagtccaagcaattctgttcttttccttattgaaagagccttgtggtttagtggctgctgaagttgcttgcgcacccttgattgaaacggataacgagaagttactaagggtgagccctttgaagtcttctggcaacgtggccaacaattctggggagagtctgactgagattatgacacttgcctgatgttcctcaaacttccacgtaggaataacaacaattggagcagcaacgtcattcagcagatacttcacagcacctaaagtctggaattgaatctgttgcacatcggttagtgtaaacgagttctctgcatgttgtctcagaatgtcattgtttagtaagtatttgtcagcctgctttttgctattttgtaacgtaaagttgatattcgaaggcaaggtattatttgcaggatccgttatatatgagaacgcaacttcaccaactatactggaacgagtcttaacaccatctttgaatgaagcgttgattacttcagcaatacttgcattcaatccaggtgcccttagcgaaggatgttggaaaggagaacctgcagaagtacctgtcaagttaggtttaatactggaagaacctgtgttttgtacagcaattccagcgccaccaatacgtacactgctaacatcttcgttgtttgttgccacggtagacgcaaaacttggttgtctagcctgtggaaggtcatggaacagatgggattgcactctttggttatttctaggcacaggaggtggtggaacagcaccatgacttgaacgaggaggattcaacgcagattcgctggtataagtgtgcctcgatgttggaggagctggtggttgagcaactccatacgacagctgagcggcattttctttctgttgttgttgttgctcttgttgtggtggttgtgcattctgttgttgtttttttggttgtaagggttcgaaagaataaagagaagaaggtttttcatactgtggcgatgattgttggagtttgataggggaaccaggcgaagaagtctccacagaagacacataattatcttgagcagtctttggtatctgtggttgaatgcccagctgcttaatttcggatttcggagcagcaacattattctccaaagaattttgaatactggaaggcctttcttgcttagcttcaaaggattgctcaccggcacctttatcattcagcgtgacttcacgagaaagatgagtttgttccctggttgcagttcgtcttcctacgtttaccgaagattctgacctattgtttgaaacgaacgaagaagaagtgctttcggcaatggttcccatatcagggtttgggttcttagattttttcttcctgccgaatatagatcccactttagaccgcaatttgtggtttttggacgatggttcctttgcacttttggaagtaaatttgccattaaaaccaagaggttctgcagatggcactggggcagtttgcggagcagaagtagcttcacgacctgaagagatggagtggtgatcttggttatgagaaccaagctttcctagtagctttgaggaacgtgaagtcttgtgggttccttgagactcaacatcagtgtggtcaacagcagtcttcgagtcctttctcttcttggaagacaagagaatctctttggaacaagcatcagtgctgaaacgagatatttcatcatctggattgaagttcaaagtcagttgaagaccctgttcattttgtttttggtaaagttggatattgtcctgaacattggtttcaaagttggtgaaggcatccttcagcattatcaatctgttgtagtcatagctctcaaaaatctcaaacaaatatggtgctttggaagaccattcatcgttcaactcgttcagtctctctttctcgctttctttgagttttttggaggagttcaattcatcgatatttgaagccaagtcctctaaagtgttcaaactgtccaaacttgagtcaaagtcttgattaaaagtacgaattggcttaacaatctcagatagcaagcgcctgcaaccgccctcagcagccttatactccatgccgacctcactataaactgacatccacaacgggtgaagcaaacccatagcattgaccaggtcattgtgataaacatcgttccgcttttcaaacaatccatttccacgagctaacaaactgttcagggaattagcaaattgttttttaattttatggtaatcagatagccattgagccaaatctttattgatattcgtgacttgggtatgtctcaaaaccaaacattcgatggcctcttttgggggcttgctcactaaaatagtagaagagtaattggttctttcttccgacattgtgaagaggtgggctggttcggatattggggaagggaagggagtgtgaaattaatggaggctggtgagaaaaagagccacgagcgcgaaataatacgatgcccaagggtaataaacatttccccacacaattaaagagggagtgaaaactagattaagatgtttttgtcatactattaaaggtcttccacgatggactaaaactagtggcagctgaaagtttgccattacttattttgcattttcaatttgtaatcctctaacagggtctgttgaatgtgtctagatactccttggtagaaaagaggatttctgggtttcagtgccacgaggaacttcctgggttcaatggcagaagaagtcgggaatttgttagatttattgggatccaactctgccagcatttcttctgctttcggtggtccgatttcaaacaacaacagcattttgcaaataatgacatacatttccttaagggctagtttcgatccagaacacatcctggctccagctccgaatgaaaaatggaataaccccttttcgtttgatatgagtttgccttcttgatccaagtatctttctggatcaaattccattggatgggagaatttcttatcgtcgtggttgccgttccaagcgttcatgaaaagggtggtgccttgggggatgacgacgctgttattcaatacaatgtcccgtgtagtatatcggggtaaggatgtcggtagaacggtgaaatatctcagtgtttcatgaatcagtgccatgatataattacagttcgactcttcttcggagtgacaccaagcttcccaatagtcgttaccatgacatttcagtaattcattcacagccttagtttgcaatgaaggtcctttaatcggatgtgaaaattgacccatcaggtaatttagatttaaagccgtgttgtccagcccagcagataccatggttaagcagatactttgcagctctgaaaaggacagtttggcattggtcaaattgtgagccacaagactggtatccatgttcctatcatagaacgactgttgatttctcatgttagttccgcacttcatttgacgcttctcgttgaactttttttgttccatttggtttattgtgaacctcatgaacttgtccatgtaaacttgtcttctttctctaaggaggttagctttcttgtacttattttgagagttgatgtatcttaggatcgggaaataatcctgcaagttggaagaggtatgtgaccttatcttgatgatactattctcaacttcaattatctcgtcagcaagctccttttccgaatgatccaagtctaactgatagccatacgtcatgtaaacactgagttgaagatggaagtactggaaaaactttagcaaatcagtttcgttacaatggttggaggccagatctttcatcaaacggtacattgccaagtctgactccctttgaattagctcattataaccatacaagtttttgtagttcagatggcttgcgatcgtcttcttctttcgcttgaacgactggccaaatggggttgtcccgattgtatacagtgcatttttggaaagtaccttatggaaagtgtaaagaactggtctagagttatttgaactgcaattttcagtccagagtttctggatggagtcataagaattaacaataactatccgcttggtaccaatgcgaacttgaaagatgtcgtatccgtacctttggcaccactcctggtatttcagatgtggatttgagagagtatcaaaagtattgccgaagaaaggaaggcctggtatgctaggaatgtttttgatttcagagtcctgattgaacacgagaccgatagatgacaaaaaatgccatagcatgattaccaggatacagctgaagacaactgtgatccaaaccatggtcactatagcagaacagagtagagttggagttactccgcagttttgtatttcccagatgatctcatgcggctgatcttatacacatagtattgtcgtgcgaacggagtgtgaagtataaatattattaaatggttggctaattagtattacagtctataaaatctcctgtttgagctttgaattgcttgaaagggtcaggattgaactattgacgcttttgagatcgttgtcccaaaaatgttctttctctgacgtctctgggtgttgatggcttccgttgctgtcttcataaagcaggttcttcaggaatagaggaagatacttctctaaattcgggttattgagcagggacccagatgtggactgggaattgggtgtctgttgactattgttcttggtgaggtaattggagtagtaacttatgaaagaagggttctgactgtttgaggaaggggcctgcttgagggtgttatggtagttgggaagaggtgaggaaggtttgtcgtgtttcactttgtccagatcatcacggagctgagcaacgatttgctttatgattttcaggtcttccatagagtactttgaaagtaaatcctgtccataaaagctagcccgtttactttttctctgtctctttttagctctgggcttggtattcagcttttcattttctattccccaactttgaataaggtctattttgtctctgttaagaacaggatccaggtcgtcgtcatgattcagctcattgagcaactcagaaacttgttttttcctccagttgtcgatccttgtggttaaatcctgtttatcatcttcctcttcatagtcgtagtcgtccacaacatgggtcaagtcgttgatgatactatcgtcgtcttcttcgtcctccacctgaacgtgattgttcactggttgctcagtatattcttgctcggcatcgtacacatcctcactgcttctccttgaagacgacaaaatgtcgtcctcgttgtaattgtaatagtaatgatttgagtttgttcgccgtatcccgtcagatgacgttatcacgtattcaccttcagcgttctcgggagaaaacaggatccattcactattgtcggttaaaatagacgacgtgcgaggcctcaactggcccggtgacgctacattgtcgctgcgattattgccacgggcattgacaccaacggtaccctttgctgtctcttcgttcttgtggatccggtttaagctgttggatgaattagagcaatgcaacgagctgagctcgttgttgcgtttttgtacttgctttctggaaaacatgatcaaaaatcccaagcaaactgaatctgacaataaggtttagttgtgacttggttttgataactgatacgatgcctgatttctctttctttgaagttgcagagaaaaataaacaatcactggatggcagcctgctctatcttatatgtgaattctaaatcttttcttttgctggtgctgttgtgcggcgtaataaacaaaataaggtttggcctctatggcttttgggcggatgcagcaagcgaccgactattaaacttttgatggaagagagaattgcgggtaagctaggttctttctgccctgatgatgatcaaatctcagctgtctgcgtccgcgtcgtcaaattttatactcaagagtcgtctttagggactgcttgtaggatccaataatgttccgatgggagacgggaaggctatatataccttcccactgatccgatttgactgaatcagggagctaaatggcaatggatcacgtgaatgattgagaatattttatcttatcttgcgaacaacagacccttttcttagtcatctcggaaaaatagaatccatagtgccggttggtgttcgggaggaatagcgtggaattcatttgaatggctagatgaatttcatggtggggatattttagcagggtgtgaaaacgtgtaaccaggaagagttagaccctccattgaggagtcggctcaggtaccaaaatccaccttgatccctgttcttggcccgggcggaagccaaggggaatgaaccattagcagtaagtcacgtggacaccagaattcagtgcttcattcatgtcatgtgaccagacggtattctcaagcctgagttgaatgtttcgacttggtgttcatctgttgagaatggagaggaggccctaaatggagatgtcaggaaacaggactgatattggctagcacatttgaatgtgaattgaaagttgtgtggaaaagatgaggtagcaggcatttttcctgaactgtcatctttaatatacaaacgtaccctgtaactgcttcaatgccctacgatatgcgatgtcatatactacttcaaaatctcccctttaaataccctctaaagtttccagttttctacacagaaacttcaaacttcattcaacccgtctggtccgggttatactactgaagcgcgtttgatagatggcgcgcgtttcgtccataatatttgtctttctcataccttatcaactataatgcttcctctcatcgccaaacgttcattccacgtcacagccgctgccaagctggctaaaatgagtataattggaaccatcggtaccgacttagttccccaggaaacctcaaatggaaaaaaatttgtaaagtactcagttgctgttaacaacaagaataagaatggagaacaggtaacctcctggttcaacgttgctgtgttcaacgacaagcaaattgactacatgaccaaatacttgggaaaaggtgtcaaggtctacgttgaagctgacgctaccaacaccccatacgaaaaagaaggaatcaagacttactcgtttatgttattccagaataacatcgaagctctgaagtacccaaagagccaagatgagtcctcgtaaatagacagtggagtcgtgtaactattttatttcttccgtaattgtagtatgtagtgactaaaaaaattgaaaaacttgtatagtgctatccgcgtcacactttatcatctggggacctcaggatgtagttcatgttgatagaaccaagactcttttcatcatcttcaaagtgagacgatccacatattaaattggacttcccggtgtcttcgtactttgtaaagtgtgaacttgctatttctgttcgttcttgatctgagaattgttctttgtactcctcttcaagattctttctgacgactttcctgtaaaggccatggattcctaggaaaacaagtacccgtttgtacatcgatacggcttcagttcccagcccaaaaataaggaaagtcgcaaacgtcaacagtggatagatccatcgatcgtatattggtttcacagagtcatccggtatcaccagcccaatccaaaggtctggatcatgaatctccgaccagctaaaatggggaagcgcatatcgcacgtccacaacaaaagtgtaaatggaaacgggcagcattatcagtatcaccatgatgcaaaacaccaataaacgacagaaccgtcgaagagttaatcctgagtttgagcacttcattaaatcagaggcatctttcctcctcatgaaaaactggtacaacgtcaaccctgcaaaaacagaggcaaataaagaagctatgactaaccacacggagtatatcaatatggtaacgtacgactgggcaacaactgcaacacaacctgagtacttaagcacaaaaaacctaaatacctgaacaatgtagctcagaccgatcaagactactggcagagtccagcagctgaccaagtcaatggctatcttcttctttgttgacatggacatccacctggaagtgaactcagatccactcaagacgacccataaattaaaacaaatggcagcaacacaggataaaattcccggaacagcacctgtgtgtagttttatcatcacatcacaccatccatagccatcaaaaacagtcataaaattaccccacgaccatatggaagcactgactaaaatttccaaattcataagaaataaccacacaatcaaacttaaggcaggaatgtttctactcattccgtgccatacgaacaatggaacggttagcaccagtcctaaggaggacaatactatcaaaggtactccaaatcccattctctgctactttgaaacgtcattatccggtttcttgggctgtaatataaagactttggcccatgttttaagtcctccctttgaagtcccaaaagggaaataaatcagaaatttcagtagtttgattgacatagaacaagataaaggccaatcccaaacacaagatagatgctcaaccccagagacgacatgtagccgtaccgagaaatgtgcttgtagatctcatcatggtacgtgtgtgatgaatcatctctgtgcttcactgttctcagataagtgtaatcgaggacctcagtttttataatcgcttccaaatcaacactttccctgagaggttgaaacatctcattatcccgttcccgctcagagtaacaggcttcctcagagtactgagccgcttgtttgtattgggtcatcatggtcaacatgatagctacattgaagagccaaagtagtggaagaaacaggccaaacatgaagaactttgggtcgttagtaagctggttccgcacagaattagactttagtactaacatggaacactaggcggtggcactgggtgccaattcgacatcgtctacaagaacaaagatagttggagtggtagatagtgccattgatcttgattgtctcagaaaacatcattggtttcgccacgttgaagtgcaaagacgaactagagatcaggagctggatccattgtttttataaggaccacattgatctgtttaagagtagaatcaagttctacctggatgtaagacattgagtaaaggggttacctgtttgggtatctaacaatggtacaggtttgggcagtgcgaacgaaaattacatgaggcgtaaggtgttggctggggaagagctgacctgtcgctaacgagagatcattttgggccagaagtgatcttaggttactctagagtggctcacatatccgttcatcttaaggaaaactatacttttcaatcataacaaacactacaaactctttttcttcttttgttctctctccgcttcccgtttggcataaatctttgctgtgaatggctcctcaaatttcagtgcaatctggtacatcagataaactaccagagaggcaaaaactccagcaggcttcccgtaatataacccagttccaaggaaacaaagagtggatccattgtacatcgggttgtcgtcaatgttgaatgggaacgaggtcactctgtcctccatcaatataccgaagtagtctcccagataagtaccagtaatccccagcttccacattgaggataaaacgagaacatttccaaacaagaaggatgcaattcctaggtatctgaacactggatcagccaataacacggaactggcttggtttttcagtgccttttcatacagataatctctgaatagacccagggagaaaatggttaatgcgagtaaatagcagccgaatttgggtttattgaaggccaatttggtcagaaggtgagtcttgtactcggttctggcggcaatgttccaaaaagttggattgaagagaattgaggcaatggcaactaaaccgttagtagtggaaatgaagggtctattgctctattgagcagaattcaacttactttggaaatccctgtcctggagattgacctccgatgccaattgcttaaagttagaaacaagtcgatcagccatgttgagttgggtggttatttctttcgatgcccaagatgtttttatatttcagagtgctttccccaacaaagaaggttctcgctcatcagcgggtgattcgggtgataagcatgtgaaagaaatcgagggttggaaacagcgacatctggcatctcagtacggctttatctgtggaaccaattctacattgttaaagtccgaattgggaaatcatcgcatcttgacacatttcaaagaagcatataagatgggttccaagagggtcaattccctcagagtcgtttcattgcagggatggaaaagaaacgtgatgaagcagttgtgctttccttggacgcatcggcccgtgaggatttgaggatcaatgtggaaaatgtcacactcgtgagcaagaacatttacatgttcatggagctgaaaaatgattggtttttactgtttttgggcactttctcatcaattgttttggctgctgcaccttctggaatgactgtgttaatgggattaattttcactcagttacagaactattttagaggagattactcgtcattgggagcatatctagctgatgcaaggttgagctgtttctccctagtgttggtaggattaggctcgtttatcttcagtttcctctcgtttgcatgttatatgcaattgggtgaaagacagcagtcgagagtcaggaaaagaatatttgagtctctattgttcaacagtatttcctggcatgaggccaataaagaacttaatggggaactggtgcaaataaacagatgcatcgaggaactgcgtattggcgttagtatatgtacaggtctggcaattcaagggattctttcggttctagcattgttgatcactagcttcatttattcatggtcactaacatttgtcataattagtactcttcctgtaatgtttattgtagtgatgtttatgtcaagaacattgaccaagcatactaccagagaaaacgatgaatctagttatgctgctaagatcgtggattgggttgttagatcccctatcattccaaaaatctgcaatgctcagacaattgaatatgaaaaattcaaagacagagcgtctcgtagtatgaatgcctccaataaagccctggttacaaatgcattgaaccttggagctctcaagtttttgaccctaatgatgttcgtccaaggattctggtatggatctacaatggttagaaatggaaggctgtccgcaggcgacgttgtaacatgctttggttcaagcttgatgttggcacaaactatcagtggactgagtgagcagattattgttttccaggaagctatcgtagcattgaacaaggtggtagcagttttagctaaaccttgtcaatcgttcagtagtaatgaacatttgatcattcctccctattgcaagggagacattttcttcaagaacgtatcatttgaatatcccacaagaaagggtagagttttggacgaagtctctattgaaatacctgccggaaaacattgtttcattgtgggcaagtcaggatctggaaagtctacactgtcaaatttgctggtcaaattttacagcgccagccagggaaaagtctttgtagatggctacgatattgagcgtgtgagtaatgattggttaaccaaaaacatcacattagttcagcaaagttcctcttttttcaatgatacccttagggccaacattttgcttggttcagggggtaaaccagtctcagaaagagatttgagaagtgctattgatactgttcttttatctcaatttattgatgacctcccagaaggcttggaaacggtaatgatgtaccaaggcatcagcctgagtggaggtcaggaacagagactggccatagctcgggcactcattagagatacaccaatattgattttggatgaatgtgtaagcgcattggaggagtcattcaagtcaattattctaaattcaatcaaagaatggagacagggaaaaacaactatattcatggaacatgattaccagcaaatccaaaacgaagacaatatcatatttatggagaatggagaggtgaaagaaacaggaacaaaagaacaactgctaaagaacccagacagtaagttttcacgtttagtgcagatccaacgaaatatgataaaagataccttcagtgatgaatatgagtcgtctatacgattggagacgaacccaacagatagaatttcaaacgtctatcttaacagagtaacgagagttttttcgaatttctttggccaaccagttggtcatattgctgaaaaggatccattcgatgagaaaaaggtttcatctgacactgttgagatagtcaccatggaagaaagaccagaggatctgatgtcaatcatccaaattttcagatttatgaacagctacctctgtcataagtcgttgatcgtagtcggtattctactggcagttttgaatggctcttgcaatccagttttttcttggtgttttgctaaactattggctggcatagtaccagtcgattcctatgttgggagtgcaagataccttcttaagtgggcattactagtgattctggtgatctcaatggatactctaactttagttaccaaaaagattgcccttggttatgcctcggaaaaatggatttatttgattcgaactagagctttaaagaatcttttactgcaagatatgaactggttctcaaataagttgaataaaccagcagaaatatcagcactcttagtgaacgactctagagatctcaagatcttggtatctagtctattggaagttatgttcactggcattgttgttcttgtgcttggttcagtctggtcaataacaattggctggaaactatctttagtggccatatccgttgttcctttgttcttacttagtgcaacactgtatgcccgccttttggagacagcagagaatgggtacaaaaatgaggtggcccttacagagaatcaagttcatgaggcaactacaggaatcaagacgatcagatgtctgaagctggagtcacattttgtcagtaaattttcagcaaaggtggaagcactacaaggtaaaggaacgaaacgagcaatctatattggatttgggaatgcgttatctcttttcctagtatatgttgctcaagcagttattctttactatgggatgaaacttgtttctgaagaacagtacacagtatcgcaattaatggaagtcatgagtttgatgatattcgcattaatgggggtctcagatttgatgcaacagataccagacatcagcagagggcaaagagcaggaacatatcttataaggttactaggactcaaaagttcccctgtggaggtcaaaggaaatctcaaaccccagtgcagaagtttagtaccagtaattgagtttgtggctgttgacttccagtacccacatgtttcggcaacagctttaaacaacatatcatttagagtcagcaaaggtgaagtgcttggaatcgttggaccgtccggatctggaaaatctaccatcgccatgctaataaataggctcttctttgccaaaaaagggtgcattaggtacaatggcgtcaacataaaagacattgaagttccatggttcagagaacaagtcaccctaatccaacaaaaaccaacattcttcgatggttccatcagggaaaacctggcttatggaatggaaggaattactgatcgttcgatattacgggccttgaaactgacaatgatggacgattacgttagaagcttgcccgagggattagacacttttatcggcagtttgaattcagtgatctcaggtgggcagtctcaaaggttgtctgtagcaagggcaatattgagggagccaagagtgattgtaatggatgaaccaacatcgtctttagatcctgaaaatacccaggggatcaaggatctcgtggataagcaattgagggcgagtggctacactgtgataattgtgacacattctcaggagctgatgaggatttgcgatcggattttaaccatagaacatggtaaattggtaggttagcttatgttgttagcggccattgaaatagttataataataaataatactgagaaatagtcgcgataatactagtatcctggaacaccagaagttggtagagaagtcccgtcaacacttgaggaatgaatacagatgagatactatcattctaccgcttaaagtcaaccaaccctcaaagctggaatagagatgttgttgatctagaattcaattacccagagagtgaaaaaatcgctgataatcttgatctgctgaagcgtttaattgaccatgaaacctccaccaagacgatacaagaccccaaaaacaacaacaaactgaacactgaagatcctttgggatttcgtgcatcggtcttagatgaattgattgataatgaggtcattgatgacaccagggatgacaagaagtttgactatttgattagtagccataggttcaagccggatttgtttttgaggaacgtccatccaagtctgtccgcctctgatctgaagcaaggtctatcgtatctggaacacgatgtaaaatcaaagaacaaagatcttcagttacaaattgagtctgagtttcttgtttatatcaaatccaagaactctctggatagaatttttaaacaattcgataacatgaagctgataggcaaaggggatgccaatggaggaaaagaggcagcagttgattatttgaaaaatctcatcgaagaaacaatggctcgctccaacgagcttttaaaaccagttctagaagaagccagaactgaaactgcattgaagcacactctagaatatattcaaaagaatagcattatttttgatctaccaaaatctttgcaaaactccattcaaaaaaatgattacagctcgttcatctctgattacattaccgcaaaggaatcaaaggagcggttgatggatgatggggaagtttctggtattcttctccgagtctgggatcaagtggaacttttggtttccaattttcgggaacttttgtgggatcagctagtcggcgtacatctggatgaaattgatgagaaaagtatcaactataccaactacaatcacgagcagtcggtgttccttaatctgattaataaattactagaaataggagttgaggatagtccaataatgggatttctagaatgtcaatttgcaaatctttcaagggatatattatttgaagcaaactcaagtcatttgaccgtgttaattagatcccaaaaacggctgaaacagaactatacccaaactgaagagttgttgtctgaagttttggctaacaatggtttgaactttttaaccagccagctcaaacatgaatcaattacctacaaccattatgatattgatctcaagcgactagatttgcccttggtcaatagcatgtgggaacaaattgaagaatacattgggttcctgaccaatttcttgaaccatgaactattactctttgtctccatttgtcagtattttaagaatggtaattaccagaaacagattgcaaagactcatcttgttgatagaattcctcaaaactcgaaagctcatgtccaattaactgaatcggacatgttaagaataaatatgatgattgagaaactcatttacgatgtttgtagttgtctgaatctcttttttaaaagcaatgacgacacattgattgagctgacagaccaaacatcgagagagcaattggccgataaagaccttcagtacacgggaattacatctgattttgggttcattccctgcttcagtaatgccgtttcggccctgaaatatctaaacagatttcaaaataacttgctagatgttttcgccaggttgtaccagcagagtgaatcttggggattgagacctgacgttctggatcagttgaacttgacaaacctgaaaataaatggcagaataatcagtggtgtgcttgcctatttgataaacgatgtaaaagaattctacaaattggagaattggcaaacttccaccatgcgccaaggttgtacactgatgccacttatggtccacttttattacaacaacattatacgagatttaaaaaacatcgtctttgctgtgaccccccatgaaaataccttccaagtcattgaacgtcaattactcaattctttccaacttttagtggagaatttgcttaagaaagggttatacgattcccaaacaaattcttctgagcaagacttttttcagaagtcaaacgagtacaagcttataactttaacaaatcttatcaagttgaagagttccgtttttgtcgacgctataaaactatacgactcattatttgacaggcaactatatgacgacaatttggagatatttgttaagctggacaatctggagctgactcttttccagaattacactcttttggggaacccaatcattacaaaaattgttaacaaaggcattgacaggaaagattggcagacagagcaacctccaaaagatgtgagtagctatgcccatcatctgctgaatttcttaacgctagtgaagaccaagctattgcgactagatattcccgaacaactggccaacagaattcttgactactttcacgattacagtaccaaaaagatactggactcatttaatcgcattcacgatttttcaacgtatggattgtatcaatgttgttgtgatttggattatcttcaaagacaaatgggcgcccatctgagctcagaaggtgtttctcgattcaaagtcatttatgatacaatcatctcgcctaaaatcgatgtggcacatgtcaaacacagtgtttcggaaatagtgaatagatatagctgattgctttagatagaacataataacacaatgcgagaagaacatgtagatgggccatactgagtcaacagaacgctaaaataaaaaaaactcatttgtgccctttgacgggatcgaaccatcggtcttctcattacgagtgagacgccttaccacttggccaaaagggcaaatgcgcttttttttaaaacatatgcataccatacactacctgtgattgttaatgtccaactaaagttttctggtttgatcaaattcatcgtaaatactactaaaatatgttgtatgatgaaattatcaattacatttataaagcgtcagaaaaggtaatatacataaatcgctagctttgaagttcctatgttctaaagttccaaagttgaaattatataaaatcgatggttatgtttataaatgcaatctataaatgctaataactaataattattccatgattaatatattaatggatccatttttgagataattcagctgtttatgattagcctatccagccaataggatatacgtgatatgcagttttgtcggttatgtcccctaaatggtatcagctaatccttctaatcttctgcgagcagcctcccttgacctgtgttggtcttcggtaagcacgaaatacctcctcttcccttctatacctcccccaacattaatgagttcgtcaaaaatatctaaattttcatcaaagttcaggaaataaaagtctttcgagtctccatattggtcaactctgtcattgtaccatttttgttgctcctccttggaaggaagctcacccttcccgctcaagaatctagcagctgttatagcttgatattcaaatgccctgtacgataaactcgatacgtagagtccaatcgagatcaagaggggatctggtgtataaaatgtgtgcagatataagttgttgattcgatttcctgtggtgaaatcaggatcaaatttcttcaagaatgggaaagataattgatatcccgtggcaaacacaatatagtcaaaaacaacttctgtgtcatccttgaactgaacgcttaccttgccatcatccctctgctcaacctttgaaatatctggctttttccagacgttagaaagattctgactcttaattgtggatggggtggatctgtgtgaaatataaagctcctttgccacgggtgaaatcagtttgaccatgtcgacaccggaaactcttgacccgacgacaagaacagtcttgtttgtgaattgcttgttattcttatagaatcttgaatgaaacaaaacatctttattcacgtcaaggattccaggatacttggttggaataaatggaacgttgaagtttcccggtgctatgatcacagcatcgaattgctgtttataccatctttctttgccatctgacagatcttttttgagtactaattggaatttatccccagctttggtgacttcttcgacactagtttgcaattcgatcttgtagttggccttactcttgactttctcaaaatacttcaatagataagcatgaaccgcttcagcatttgtaaacccagcttcttcaggcggaatcaaccgcggccattttgtatcatcggagaaggtcattaaatcctcagtaacattggtcctcataccggggtaacctgcagttccgtagaacttttgatggggcgaatcatgtccttctctgatcaattcattactctcaaaaacgggtatgttaggggaataatctttgacaccttcagcggtcagattaagagcagagtcagatttactatcgttgagattccatataccccctaactgatctcttctctcgaacaggacaatctcttcaaactctccctcttccaggagtgtattcagggcaatggcaccggaaggtccacctccgataatggcaattgttttcaccggtctatctaacctcattatacagtgtttactagttttgaatgccgaagtcgaaccgttctttatatggagatgggctctggaaaaagaaatattccgtgatgaaaatgccacagttatatgacagatttcttgctcatcgcaacaaaaaaacccctatcgggtaatcagcgccatcacagggaatcgaacggtatgcacatcgaacggtgattgtgaagtgaaggtcatctaacggcacacctttttaggaacatgctctttctaaaaaggcctggaatccgatttattgtgactcatcttacgggataagttagacaggccggaaaatgaaagtccgcattaccttggaagttcaaagagtgttcaacatgtctgatcttgcgatagaccttagttatcacgggttgtaaccatgaccaattgcgtcaccaggcacttctgggagttctaactggatttcgtgtgaaatcaatgtagatgactcactaatgtcattttctgtcgttggaagcttcaactttaagttataaccactagctccaactagttaggtttttcaggaactgttaacttatcccattccagccccagagatcagggatttacagctgactgtttgaagactactttgcatagagaagagattagcagaaaatccctatttgcgtccagatcatgtctctagaaggctcatcagagatactggatatctagccactctacctctatcaagaaacgtggttaatgattctctaaactactccttcaagaacttttccaattgtataatctactgacaacaagccaaacactttaccaactatcgggccaaccttcaaaggtaaaccaaaaacttaattcactacaaaactacaacatatactaaaccaaccctgagacaatacgttccaaacatattgcaatccttccagattaaccaaacaatccccagttgtcgacatgaaaagtttcaagtatcttcaaaacaacggcctccgcaattttgatcctttgaaaagccaagttgtcatcatcagcatggtggtatctatgttccacgagcttatgcaaaccttcaacctccttctcatcatcgccaattggaacattggctgttatgacaacatcagtagatacttccttcaatcttataagtccaatgaccatgaccaagacatcgcctttactatccttaccccatttcttagcttcttctaagacaatagctattttcttggcatcagggaccgtctctgaaaaagccaaaaaccagttggctcctactccgttggcctccgaaatgtcctgaatatgtgtcttcaatgcaacatcaatatcttcctcggctctctctagcaaatcgatgatgattgagtcgtttttgttcaattcttggtaattggtggtattggttcccccattgacgaaaacctcctggctatcaggaacttccctaaatttggaagcatccagcagtgtcgtgggcaattgaatggtaattgctcctccgtaaagttttcttagtgaatattccataacggcagattgataagcgctgacgatctgagaattttgaacctttactgcccctagttgagagtctcagaccacacaacccacattttgagatgcttaaacacagtcgtgtattacataaacataaatcgcttacttaatataacaagtttggttaatctaagtgcaaacagatgtatggaacttcaacatcttcaccttctttgtcatcggcacagatttcgaaaatcagcttggactcgtgagcgggaatagccttcttagacacagtcttgatcagctcggtcaacttcaatggtaatctatccttcagctttttcggtggatggaaagaagcatacagaagagatactccataggataacatattgatagctagaccttcatccttctcaaatttgtctagcaattcttgtagagtaaggtctttgtcaatatcaaacctatcccagatttggtcaaaagatttatcattatacttggattgaggagatgcaattggttctgaaaaaccaaagaatggcaatgcaaggtttacaaatccattcttgtaatcctcgatcttctcctttccaaatacaactttgtataactccaaagtaatcaaaccagtcaccagagctgtagttgtggcaatagctggaacaattcggcctgcaatgaatttagtcttctgcttgtcggcagtctcgatggagtagttcaaggccctacagttggaggcagcagcaatgaactgaatgtgatgattagtgtcgtcatccttctcaaattcagcaggagttaatcgataaccagccaacgaagaaggtggtggtagagagtctgaaagtttctgaataacatcgtcgttcagatcgttaccattagcgtttggatctggatcattatcatcagcctgtatcttaacatcgcttctgggcttgaatggctcaatcttcaaagtgtccaaaactgccttatagtgggccttatcaggctcaccctgatcccccttcaaaccatatataaaagccaaaaggtttgcgccgccaacgacgaagttgaagtgatcctcattgtcaatatcaaactccaatggtgtgggagcacgctttggaccagaccaaaatggtgcaccagtggaggttacggagtctttgggaaagttgtaaagcaactgctgaatttcgtggttgaacttggtctcaaattgtaatcttgcccatttgatacagtcttcgaaggtgtaaggcctctcgtttaaatattgggaaatagtttctaacgtgcccttggcatcaccactttgcttcaaaatgttttcaacatagttgggttgtgataaatacaagttgacattctctggagcttcagaaaagtacccctgaaatagagatttggcccaagcaattgtatgatcaatcttattaggaaacgatctcaaggtacaaagcggaatagacttttcgggaggatcttgtgaggaggagtatgactcggtcaatctagggatgacaacctgagtatttcccttggtacccaaagttccagattctaatagaggcttcttgaaaaagacacaacgacgatcaacgtatgctcttgcttcaatattgtctaaagcattagtgaccacatccagcccttgccagaaactgttatcaaatatgttttctgtttcaggtccaaccttgtcaacctttgcctcaattttaccagctaaatcaggattcatctccacaacagctctagctgcgacttctgatttgttttgaccaacatcttttggtctgaaaagaaactgtctattcagattcgatttctcaatggagtcattgtcagtcaagacaatctttccgttgggaccggaacccaatcccatcattgcccagtttttgagcatttcacacccaatagcaccagcaccaaccaagaacaccttcaagttggcaatcttttgaatatgtgagagaccaaaaacggcaatctgattgtcatatcttgaattgatagaagcgcatgtctcctcagttcgatcagaatctggtaatgattccagagagtcgtagtataaccactgtttaattggattaaactttcctgaacaggctttcaagacctcttgggcaaccagtccaccaaagaaggcgttaactgcaggcaaatcacctcttgcttggtaagataactctttgatcagtttggagtcaacttctgtgccttctcctaggatagatgggacctgttcggctagattttcagtaagttttagaagctggttagcgtcttcttcatggtgtggctttggaagttgaccttcatgagcattctggaattggtggagagcctggaatcccaaatgcaattgtggcggtctgtctagctttgcaaaatcagaataaagatactctggatcattcaactgatcagaaagcttcttgaacgagacagtctgtggaactttgacttctgtaaaaattccacccttttcgtatgttccccaagaattgtcaaagtcaattttgaaagcatacggacctaagactttgatcttgaacaattgaccatcattaagacgctcgataccttgtacctccgaaaacttgacgtatcttccatcttccaagtcatgacggctgtcatctagcattgtcacggttccatctggttcgatatcagatactattccttgctttggttcttctccagtttggtcaagaacggtaaaagagtctccaaagtcgataaacgcttgaccaaataaacccctggttgctgctgaaataaacttgatattgttggcatgagtaaattcattgatctgcacttgtttctctaaggatgtctcggtggtaacaatcacctgaaacgacttcaaacttgattctgatagctctgtgatgatagaaataggcacatagtggttcaattcagaaagcttactggaagtcgcaaatgctctctgttcaccaatgtccttctccgaaaggaagaactgtgaggacaagtcttgcaaggtcactggctctggatcgtacagagacagggatttgacacctgccaaagcgacattctttgcaatctcaacacccaatcctttcaatccaatgatcaaaacgttggagttttgcatcttaagcatggcttctttccctagcacatataattgacgagagtacaaatcttcatcaattttgccctcttcgggcttatcaatttgcattttgttttcctgaacctcgttagtgtgtcgaattgccatttttttgtgagaaagaacacttacactcatccctttgctttgaatgtgggttactaagacggaaaggtggtggcaatgggaaggtgaaatgattaactaatttaggtagaacactaccaaaggaacttttattaaaaacaagaaattggcggaatatatttacgtttacggattgagataacttatccttaccggttagactcgttcgtaggtgacagtgcaggcttttgaatacagattcacgggatctgaagcctttttatttgccaatgggctaacagcatcagggaagcgttttctgcctgtttgcgagaaccagattaccgttttcgcgaataggttatctagaccattctctacgatctttttcttctctcaggctatcatcttactaatcaccattttaataaccagatcatgttgagttctatcgcaaggggtgttactagaactggcctgaagaggctcaatagctcatttgtgcctgttacaagaacttccactctccccaacggtatcactgttgcaacagagtccatccccaacgttcaaacggcaacggttggagtttggatcgatgctggttcaagggctgatgtcagtgactccacgagtggaacagcacatttcttggaacacttggcattcaagggaacgtccaacagatcacaattgaaactggaattggaagtggaagactgtggatcccacttgaatgcttacacctccagagagaacacggtttattacgccaaagctgtcaaagacgatatcccaagggcagtagatatcctaagtgatatccttacaagatcaaagctagaaaagttagctattgaaaaggaaagacctgtcatcctcagagaaagtgaagaagttgataagatgtacgatgaggttgtttttgacagattacacgaagtaaccttcaaagggcagcctttggggagaactattttaggacctttagaaaatatcagaagtttgacccagggagacttgaaaaactacattaagactaactacaaaggtgaccgaatggtgctagttggtgcaggagctgttgaccacgaagagcttgtaaaattagcccaaaaatcttttggtcatgtccccttgagtgaagaacccgttccgctagggtctcccagaggcgatttgcccattttctacggcggagaagctagagttgaagatcgttccttacccaacacttatatggcaatctccattgaaggtgtgtcttggaatgccattgattatttcacagctttggtggcccaagctattgtcggaaactgggaaagatctactggtattaactccccttctccgctagctgttgctgtatcgactggaaacggacaaggacaaccgctagccaactcgtatatgtcattttcaacctcctactcagatattgggctgtggggaatgtatttgaccgcagataaagatgcggatctgaaacctcttgtcgatgaagtcctcaaagaatggactagactcaagaatggccacatttcggacaaggaagttgaaacggccaaggatcagctgaaagggtctttactgttatcactggacggatctacacctattgcagaagatattggaagacagatcgttacaaccggaacaagactatccccagaggaggttttcgataaagtaaacagaattacaaaagacgatgtcattcaatgggccagatggagaatacatgataaacccatagcagttgctgctttaggccatctggacacgctgccctcttacaaatacatgaccaaggaacttgccaaatagacaatttatatatagtatcacaattataattattaacgatctcggagttgagaatgtcggggctttccgggcgtttgggtcaggggaaagggaatcttagtatgccgagggttctaccccagaccgaaactaatccagttacttctcctttctcccactaatggctccaattgtagataggacaaccagaaccattgggggagttaaggtctacctttatggacttggacaattgccctccccagacataagttctccgcccagcgtggccgtgtgctatttgtttcacggaaggggccagaacaaggagtacattgagaagattggactccaaatcttggagatttactcctccaattgcaatggaaggtctctgcctctcataatggtcaattttgatatgcgtaaccacggggagcgcttgattgaaaccgaaagaaatgatgagtggaagcaaggcaatatcacgcatgcgattgacatgatatcaaacattgatggctccgttgatgacgcgtgtctgatatcgaacatgctccccggattgtatcccgggtacgtattcaggaacttagccttgggcatatcaatgggtggccatgcctgttatagaatggctgttcgaattcctgataatattgaatgtatcatccctatcattgggtgtccagacgtcagtagccttttgctaaatcgtctgaaggaatccagagagctgacactgaattttcgaagactctcgtacgaagatctgaagttgaactcgggcgacagtgaaaaatggcctgaaagtttccacaattacgtcaccaaacaggactaccaaatctcggagaacttcccaaaccatgtcaaagtgctggcattatgtggagagctggataagctggttcccaaggagtatacagaggaatgggtggaggagatggagaatgcaagagccggaggagattcggtgacactgtatatagataaagaggccggacaccaaacaacggacaaaatggtgaaggtcatcggacagtggttaagtgattttttacgggtttactaggaaggaactttatagacagtaaggaggaggcggtggggagttcagatgttagatgttaaaattcataacctataaaagtaatcgctgaatatcgaaaaacagattgctactctctgttttgatgtttcgtttggccaaaagtgcatgcactgttcagccatgtttcggcctgaggacgtctaggaggttcatccaatctcccggagcctttccaaaaaccagcattaagtttttcaccaaggagaattgccaactgtgtgaagaggctaaactggtgcttcaagatgttcttcaagaaccccaagtcatggaaagaggcgtcgacctacaatatatcgacattttggcaaatgaaaagtactttgaaatgtacaggtacgatgttcccgtaatacacatagaaagagaagacatgccaatcgtgaaatacatgcatagattagacaaacaggaaatcatcggagaattaatagattagccttcataatgactttccggtgaacccacactaaatacttaatcaataggccccagtcccatgagagcaaagttgtttctgttttcttcatccaccagtcccatatacgtctcaatacgatttttcaacaattgactatcaagaatatccatgctgctctcatccaaagtcccgagatcgataggtccatctcgacgtccatccaattcaatcaacttgccatcactatttttcacaaaagttatgaaatgaagggtgatatcctcttcagctgacggtgcttcggtttctccctgcacggcgtactggttgtatatatgtttagagacatcctgaatgagtaggtcaatactttcctggttcttttcgtaacggtctagaatgttacttcgatcttgctgtaaatggtctttggaagcattagtcagaatatgcaatagcgcatacaatccacaggcattcttgaccttctgcttataccaatgtatattcacgtcttcagaaggagtttccttggccttgaactcttcgtactctttggttacggggaacaacagaattacgccatcatttggacgagggtataaactgagcatttcagcatctagagagaatatgtcatagaaagcgtatcgggggagtaaacccagttgcgtaccaaaactggaaaatatctcaggattagactccaaaggaatgacggcagaggacatggtttgtagatggagttgataggaagattacatacccgacatagagtttcgtggggaaggatctaccgattcttgctccacgcagctcgcgactgtgagtcgtcccacgagggagacacccttccacaatcagtttgccagatagacaggttcttccccaaattatttatttgcctcttccttcctttcccttgaaagcccccaaattgatgccaaatgaatagagctacactgaatcttgagaacgtgccatactataatttcctccgtaaatggaaggtccccgacctgattatgattgccgtactttttggtgtcaacatcatcctctggaattcggccccatatgaaagacagttttcaatcaatgatctgaccatatcgcatccttttgctgagcacgagagagtcacaacccaccagctgttcaacatctcctttggattgccattggtggctattttcttctttgggttgcttttgacagactcaccacacaagatatacgtgacttatctgtccctggttggcttcttggtgtcattttacacaaaccttaccatcaccgatattttgaaaaattggattggaagatgccgtcccgatttccttgcaagatgtatcccttctccagatgcccttcctgatgttttgtactttgcgaaagatatctgcacgaacgacaactgggaactaatccaagagggattcagaaccactccttccggccattccagtattgcattctcaacattgttctacctgacgctgtttttaagtggccagttctttattggccacaaggatgttggaacatggagacattacattgccggacttccaacactaggagctgcctacattgccatttccagaaccgctgattacagacaccattttattgatgtcattctgggctccttgcttggtaccctggtagcttggtggtcatacagaagatattacccttctatctactctgagaaaagctacattccttacaacttggaggacgaggatccctgttacgagcctgccgacggcggctgccaggtgtaacaatttgcgtggtagcttattgcggacattattgactactcatgctgttatatatatataaacgaacactgcatcttactaagtacagaaataaactgcagcggacattttcatatgcaaggctgagcacccataccactatctattactcacgtgacagatccagcgatttcttatttttcttgattagagcagattgaacaaccattcagtttcaccctcctttttcttcttccttatcgaagaccccagctttttgtatgacttcttctgtgtactgtctggtctcctccaagggtctggaaatgatccaggcggagcaaagcctgcaactgcaggcttctgcactttatttacccaatatcatgatctcttttcagcacgagattaaaactgaatctgataaacaatttttgaacctgctggaacgagttttccccgagtggaaaaagtcaaagattgagctccagcagctcaccggtggaatcaccaatatgctgttgctggcgtcttgcacttcgcgtctcaagaaggaacatgtcttgatcagaacgtatggtaagggcacagacatgatcatagacagagatagagagtttgtgtcccagttgctcctgaataatctgggtttggccccccaaatttttagtcgatttggtaacgggttggtctacggatatctggaaggtcgctcgttgaccccagaggaactgtctgaccccaccttataccctttgattgcacaacgcctaggacagtggcataacattattgacaaagacgaaatagaaaacgcccttgtgaagttgaaatcgttcactaatgcccaaggtgcttcacagaagttttcggcagacatctggcagcttttggaggcttggatcaatattctgcctcctataaaagagcttgaaaaatcatgccttgaaaataaagacattttgcaggacacccacgataaattagatctacaagccattttcaggaaagagctggaatggataaaaagccaaatctcaaacaaatctccaactgttacctgtcattgtgatttactaagtggaaatgtgattctgagaggaaccccaactagtagcaagttgcccactattgaaaataaccctattctttttattgattacgaatacgttctgccaggaccaagggcatttgatatcgcaaaccatctggttgaatggcagggttttgaatgcgatcaatccagaattctcgatatatcccaggataacccaattctaagaagctgggtaagatcttacgtctctgcctctgtggacaagcaagttgacgaggctgacgttagtcaacttatcgatgaaatttctttgttttttgggcttccagggttttactggggaatctgggctggtatccagagtaaaatatcattgatagagtttgactattcagagtattgtgctcttcgactgcaagaatattggacttggaaaagagagtatctaacgaatttatagatttttatcatcatatatgtatattaattggaagtttgtcttcgtcaacgtctacttaggttgccaatcaaagatcccagagtctctcccgtttctttgggcttggcagtttttggtttcggttttggttttggttttggttttgtttttggtttgggcgtggcccttggtttagctatgggcgcagtcttagcttttgctctggtttgtctagttttctttggcggaggaacatcaatgaaatcgtcaatatctgactcggaattcgaattgatatccatgtcctcatcaatatcatcatctatgaaatcatctaattcttcggacaggatctctgactctgaagaaactatcgattgaatgctaggcttggaaacgcgtttctttgtgacagatggcgatattttgcggtttgtaagtttaggctgcgcatcctctgagtctctgtccggtccagtaattgatcttaagaatgctggtctttctggcaaactttccgggatgtgtttaatggagtccgtacaaattttgctcatcaatgcctgagacttttcctttttgatatccttcaatatcttattgaaggatttcttttgggaaattgactcatcttctatgtgttctccatggcttaaacccatcaacagtttgaggtctttggataattcttcatctatgaatgttttcaaggccgccttgtcatctttctcaacgaaggctttgacaacagatcccacgtccttcttatttagtagattcaactgattatcatccacaaacgtgtcaacaagtttagaaatattcaactcatctaactctaaatgttcctcgccgttcttcaaattaggtttagttcgggttgcccccgttgtatgctccttcttcctatggaaaatgactatgtcgttgacattggcaactttaccaacaaaccgattcgaaaaccttctggggttttccacttcaaagccgcctgaatattccacccttagacgaactaaaggtaatggggtatctacctcgctatcatctacgcttgaagagttttcagcttgtttatccaaccatgacttctgagcttcttcaataagcccattaatctcgtcaatcataaaatcaagaacttcctttttattcctggaatttgggtttagtcccagttgagttagactgatatctttcataacaaacggtctaactgtcttcagaggaatcttctccaaagaatagtcttttccttttatatttagaatgaacacatttttctccagcgtctccccattggacaaagacgtagccactgaggagcccggttgtagcgtgtcgaatccagtctcagggttggggacagggtaaggtatgcaatcatgttcgtgaccccacacaacaaggtccaagaaagtaggcaaaaagttctctggcaaatatgcagttctagcaccatgctggacatggttctgatgcacacacattagattgaaccatgaatcagtctgaatacctggggtagagaatgtaacccttccatctctaaatgtcttgaacattctttcatccctgatattggacatcccataaagagccagtttggttctgcctttttgaaacaacaagggctttacattaatattgtcattgtccaccactcttccaaaatagttcatcaacccactcacgcttagaacgtccaagggagacaagttgtcgtcacctgtagcatcgtcatgattgcccgaaatggcaaaaaacggaacagaaacatttatattggggtcttcatagttagggtagttgaaacccctgttatctagacagagagaaggatctgagagtagctcaaactctatgggtttctctccgtaacaattggacctcaggatcctcatcacatggtacattgatttctttgtcggtttgttaacgtgaaacagatctcccgattgaagcaccatgtcaacatccctgtctttggctagcagcattatctcttcaaaggtcttccaactgtcatccccaacaatcggatccaactcattgtatccgacatgattgtctgtcgtcaacagaagccgcaacgtgtcctttcccgggagtattctgtcaacgtgtggcatttactgtaagttcctgagaggctgggctagctgttctgtaggctggtgtgatcctttgtcctctgtcccctcctgacaatctcgatttgtagttggcctcgatcagaatctcttaaaaaaatacctggcttcctgcttacgctcatacatcaacacaccttctaaccttggagcagagtagttttttcactaaaacggcttctggatctacaggcaaggtatattgactaccatgacatctactttaaaggaaaatcatgatctccaagttcaggagctggaggctctcaaggcgatctatatggatgatctcatcgacctgacagagacatcaacagcctggcacaaggatccttatcccaaatttgaggtacatcttcattcagacgatacaaaagaacccgtcttgtctttatcaatccagtttgagatgaccttgacctatcccaagacaatgcctatcataaagttcgtcaaatctaagaatgtgcttacttctcagatagataagctcaacgatatgattaagcatactttcaaagatttgaaaggtcaagaaatgtgctacgaaatcataactcagatccaggagaaacttgatgagtggcaatcaagtgccagaaatgaatcattggaggaagagagagtgcacagacttcagagaagacaagaagaactggatgcaattgaaagggcaaggctggcaaaggagaacgaggaccgtgcaaaggaagaagaaatgctgaatgatctcatccagagggagctcacacgaagaacgaatacgtctgacaattacgataatgatggcaatgagactaaccaatttgatgattcatcgtcttcaactacagaccgcagtaagaattcgaaaacgagtagcgacggtagtaacaagaaaaagaggagaagtctggggttgaacacctatgaaattgaagagaaatatttagttccacctcactgtgagctaaactcaaaagacttctatgtgtttgacaaagaaataatgacgaaaccaaattctgagcatgtttctttcaattttagaactgttaccggctttgttgcagttccaaaagttggtgtcttgaaaaatgtcagtaggcaattcttagtgaagccgtacgttcatccccaatcggagctttacacacatgacggaaaaaaatcaaccccaatctacaaacagaatgaagagctctcgtcgttactcctcttaacagagatagagttgaacaatccacattggaacacaagtgacggcaaagcagcacttcacagccttgatagagagctacaaagttcttgcgaactgaagcatgaaaacattgccagactctatgcttcgcaaattgacaagattgtacaacaaccctccactgagaaccccatagaaagaggtattggtgggaaacggagaagagaacccgaacaatttttgtggaagataaggattttgactgagtatccttcaaatggaacgttggacactttgttgagtacggtaaaatatatcagtttacccactgcaagagagtggattattcaattgcttgaaggattagaatatattcacaaacaaggtcttgttcaccgaagtattagtctgggatcgctccaggttatacaaagctacgacaacactccatcgactttaaagctgaccagcaattgctatggttacacaattttagacatgctgaaaaacttccctaatgtagagtcaaataagacaccacttttgcaaaactcatggccggctccagaactccagcgatcgaaaccatcaagaaaaacagatatttgggatcttggagtcacttttgttcaaatgattgctggccaaaacattactagagaatacagttctccagaggacttcttggagaactacaccaatttagagccatcggtaaaagaatttttgggttacacgtttgtcaccaagccaaggaatagatttggaccactggagctgcttccaacagctttcctccgaaatactattgtggaagagcccactgataatagttcatcaaagctaggttccttgaattacctcgatgcgtccaagacaacccatagaaggagttttaataatactggaaacaggcggtactcctttcataacaataatggaagtgcatattcaagatacaataatgattttgaggaagtgggaattcttggtaagggggcctacggtgaggttgtgaaggcaagaaataaactagacggtagatcttatgccattaagaaaatcaggcacaaagaggacaaattgtctagcatcttaaatgaggtactgcttttagccagattaaaccaccaatacgttgtgagatactacgctgcttggttagaagatgattacattttaaacccacgagagaacgacaacccatttgactcttctgcctcagaaagtgagacagaagctgaatcagatactcgttcagagcctcaaaactctctctctcatagccacagtgccgtggatttcatatccaattctatgagttatccagatatagagtttggtttttcggacgaagatcaatctgatggcactgaagatgctgccactggcactgctactgatatggataacatttctgtggatttcacttttggttctgaagacgaaaaaactgatcacattactccacgtaataagaagttgaacaagaagagtactttgtttattcaaatggagtattgtgaaaaccgcacattacacgatttaatacgacaaggtcttccaagcaatcccggtgagtattggagaatcttccgccagattttagaggcacttgaacatattcattcacaaggtatcatccatagggaccttaaacccatgaacatattcattgatgaacagcagaatgttaagattggagattttggtttagctaagaacgtccatagcctgttacaagtgacttctcaagtgggctctttgcaactcaatgaagatttgacatcagatattggcaccacattatatgttgctaacgaagtagaatctggagatggaaattacaacaacaaggttgatatgtactctcttggtataatcttttttgaaatgatttatacgcttaacacaggaatggaaagatataccgttctttgtgctttgaggtcaccggaaattcgattccctgacgatttcagttctgctaaacaaggcgaagaaaagaaaattatcaagatgttactgaatcatgatttcgtaaagagaccctctgctagagaattattgcaatcaggactactgaaggtcgaacagcaggatcaattgatgaaggaggcgatgaagtctttagtcaatccttcatctccttggcaccaccaggcaaggaatgttttgttttctcaaccgtacagtttagctcgtgatttattgtttgataaaaggattcaagactattcttcttcagactatctactccacgctaagatttcagaggaaatctttaatattttcaaacggcatggagcagtggaatgtataagccaatctgaccttttccccaagtcaccgctatacaacgttgataatcaagtctacgaattgttggatcattcaggatcggtattgcagttatcttatgatttgactttgccgttagcacggctgattggaagaagtattttgcctattcaaaagatttaccgttgtgggtatgtataccgttcaaacgatagtgatcccgcatcaggccccatacgtttcaaagaaattgactttgatattgtttcgattgattccaaagacatggtactgtatgatgctgaatgtatcaaagtaattgatgatgttatttctattttcccgtttttcaagagttccaacctattttttatactaaaccattgtacattggcggagtatatctttgatttttgtgggatcgaaagagcacagtatatcaaggtggcatcaatattgagtgaagttgggtatagtaaaacgttgaaggaggcaaagcatattctgagggatgagttgaacatcccttcgacagttttgaacgatatagagctatttgactttcagttagagttaaaggatgccagatcgaaatttcagaaactcatgttggattctccgtatgctactaagtctgagaatattttgaactatttgtccaacataatttctttattgaagcattttggagtcacgaagaaagtgtatatagctcccctatcagcttatacatcctcattctaccaaggcggtttagtcttccaagctgtttaccaggagaaattcaaatctattgtcgcagctggtggaaggtacgactccttggtttccagtgtttcaaggcattcccatgaaattgtgcccagagctgtaggattccgcctagcctgggatttattttttacatacatgcagcggtatgaatcaatgtttgtcaagaagcattcctcttccagaagaaaatcccaatttttgaaacaaagtgcttccaagattaaatggagtgctagtcgagttgacgttctggtatgcagctttaccagctctctgttgcgttctatcggtatagatcttttgcagcagttgtggagctgtgagatcagagctgatttgctgaagaactgtctcacaactgatgatgttattaacagagctcaattggatggtgcaacatgggtcattcttataaagcagcaacaacaggaacccaatcaatatggcaccattaacacaaagaaaaggtataagcctctgcgcttgaaaaattttgaaaagcaaacagatactgatcttgactttgaggaagtgattccttacataaaaaatgaaatgagggaaagaaacgaagtcgaggagactacaattgctccagccactcttcctttgagatctctttctgaagaatctcaacttagagatttaagtactgccgaaaacgatagtgggcaacaaaaggtgattctagtgccgaacgatgcaacaagagccaacaggaaatcaaaccggaaagatcgatgggccatggaggatgcttctcgcaatgcagctatacaggtaactaatgagatatcaaactgtcccattttccccattgacgctagggatgaagtattagacatgctttctataacgtccctagaccaaccagaagaatggaagcgaaaagtgggtggtgcgtccaatgccacacctcgaagttatgtggtgaacctgtacaatgctctttccaaggagtcggctaagggtactagatgggccattgtgcactctaccaagacgggtaagatttgtatttgcgacttgcaaaaataataagataatgagtaaattaatgattgtaatttgtggatgtctgatgtctgttgatcgtgtcacgcctatatcatcaacctggatcgtctcccccgtccttcaccaatactacgctttcattggaactccttctaggatcgaactgtcctttgattgtaccttccttattttactacttctgtgattgatctaattgagcattatttgctgcattaagctgtttcattatctaaaaaaatggcaaccgcaactcctcccttcaaggtgaaggcgttgtatcaatactccacagattacgaggaagacttgaacttcgacgttggtcagttgatcactgtttctgaaattgaggatgaagaatggttcagcggatattatgatgaggacggagttagaaaagagggcatttttccaaaaacttttgttgcggtagtagctgctcccagtgaggcagtgcagaaggtggaggagcagccagatccagcagaagaattggagctggagacgaaagagaaaaaggatgtccaagcggagcaagaagccaaacaaccacatttatcacaaaaacaggaatctcaacaagagcaaccgcaagagccagggccacagttaggccaaacggaagaggaagaagactcagcaaagcaacagagaagtccaattgatctttccaaaccaaaggtttccgctacccgtactgtctctcaccaggaagcagagaccacagagaatacaagtaccagcccagttcgtggtcatcacggcacttctcagaatgaaatgcttaacaggatatccacattcaaccatgggacagtggctccaatgcctacgaaagggccggtgaatgaagcacctgtaaagaagtctttcgtagctgccccttcaagttacgttccgcagggatttggtgataaaccaaaaccaaaatctatctctcaagaaactcatcctgcaaacatagtttcagagcattctcagagagaagaggaagaggaagggccaaaaatgagcctgaaggaaagaattgctttattacagaaacgtcagcaagaagaagccgaacgagctcaggctatattaaagaggaaggaacagaagaagaagaagaaagagcagcagtatactcaagctgctgagaatcaggaaactgagcttgaacctaccgagactaacttagataggtctaaaactgctgatagcaccgcggcttctcaacagggcgaggtactagatactgccttacccgcagcgcaggaacagagtcccactgaaaaacaccaggaaactaccggtgtagagaaacaacagattgcacattctgttgccatcgaaagtgatgataatcgaagcgataacgaggatatagaatcaaaccagggcaatacaattgaagatgaactagtgaatgaagatgaagatgatgcaagttcacaaaacgaaattgaggaagtcagggatgacaacaaccaggatgatgataaagaagaggaggacgaagaagaagaggaagatgaagaagaagtaaaaagacgcaaccttagagaacgtatggctaaattatctggtggtgttggtatgtttggtatgatgggcgtacctacccccttcggcgctcctgctggaggtaaaccagcttccaaaaatgaaaagaaagttgaaaagactgaaaaagaacatctggatgtcgctgaatctaacacgggttctttgccaaatgttgcagttgcacagactgttggtgcaactcattttcagccccctgatgatggaagtggtccatctgatgaatctgaactagtagatgaatcagatgaagttacatcgcaagctgatgctacagctcttgacttaaaagaggcacctattccggttcctagtcacccttcaattcctctatcagctcgaccagttcctatcccaactcctagggtacccgtttcagagacagaacctcataccgcttctggaactacaaaccttcctccactgcatacgcgaagtagttcaaaagaggaacatgaagttggagaccccatttctccatcagtggtatcacctaaagttccatccattcccaaacgcacaccagtttcacctggtactcatagggctccacctattcctgcccctgcggttcccatttctcctcaaaatatttccccctctgcccaaagaagattttcagaggagttgggacgtagtattcctaaggtcccccctccaggtgctcccccaatccctacaagggatttcagggattccaatgcaggagtatctgagactgctgtatctcctgatgttccaaaacagactatcagtgatgcttcagaagccccacctctgctagaatttgatcctgaggctatgaatcaaaatttcaatcatgagcatcacagcccagaagactctgataataacgtaactgggtatgaggcagacgaggacacagatgtaaacaggtctccctctcatattgccacaaaaccatcagttcccataccagaagttagaaaggttcagacagaggtcaatcagataagggacccaaaagttggtcggagccaaacactcccacctgcagctcctgctccaccaattcccggatttgcgccaaatgttccatcaccaattgtaccttctagagtgagaaaggaggcaccacctcctcctcctgttccagcccctactaccgatcttaacgcagcccaacagcttcctccagcactgaaaaagacgccaactggatccaattcaattgagaggaagaattccgtattgtctgccactcagtcaaacaagttcactgaccaaacttggtatgtcaagggtcgtgctcctcctgggttcagtgcaaggatacatgatgacgttttgcttgaaattgacagcaacaccattaagagaaggggcaacagacacaccatctatagggatttctatgtgctgtcatttgacttatcgcaagatgtcttcgaagtcgaatgggacgaaagccttcccgaagaggccgagacaaagcaccatagaattgatgctcctgtttttactgttgatacgttggtgtggaactctcaagaatatggatccaaggtgttccagcttgctcattcgtttattggtaaacaacttgacggaagtttggtcgaaacaatatattctcagattgaaggaatactaccgcctattggcgtcaaaggttacggtgccaccatctacaagaacaacagcaacagctcagtgaatcagcaggatgagtttagaccaggagatgtgctatgcatgctcaagtcaaaatttgttgctcataaactcaaaccggcatttgaagtcggcaacaagactgaaccgtacagtggaatcatctctgagtacgactctcagaaaaataagctaagagtaatcgaacaggatagccgtggaaaggtcaaggcaaacagttaccggttgaatgacttcaagagcggaaaaatcagagttttcagacctattggtagagatgcgatcggttggtagataagtaatcctacttttttatttagttgaacattgtgtattttgataaggaaagaaatatttttagcatctattgaaggtatctccctaagtaatttacaaatctctgaaagaagaacctttgaaactgtcgaagtcaattaaagcttgcatgcatccccactcctttatcttattggccagccaaaccaagttgacgggttttgttaggaaatcattacaaccagcagccagtgcctttcgtttatcaatatctgaagtcgaggctgttagggccacaattatcaccggagagcggaaaatattcgtatctagcttatcttcttcatctagtgtcgtgtgttcttgatcctcgttcctcacaaatactccaacttgattcaatttctcaagtcttcggatttccctggtgcaatcaatacccgatattactggtaactgaatatccatgagaacgagatgaaatccgccttgtctccaactttggatggcctcttcaccgttcttagctacagaataacgaacgtgattctttcttaggaaagcacttaagattgctgcattaattttattatcttcaacaattaagacgttgacactaggcaggactttgtctagcgcagatttgggcttcttctttatggacgattcatttgagctgctcttacctttggtggcttctgtctgagaaggtgatacaactgaggcagcccccggatgcacctcagtctgagtcttatcttgattttgctgtgaagaatttccatcaggcttcacgtcttgctcagaagttgaatcatgtatatgcctccttcttctctcgttggatttggccaatgcattgcttctgggaagaagtaaaacggtagaggtcggtgaatgtgggtttgaatgagatttgcgttggatcgatgaaagattgggtgaggtggaggctgagcgacaatgcggttcggctggctcttcatagggtaagctccggattgcctctggttttgtttcttgtccggtctccggcgagctttttgcttcagggctttcaatgataaatgcatcatgcatagtcattccatggggaaaatacaagtctagtaacttccaaacagactggtctgctccaagaaggacattatgagtggtggtacttggtaaactacccgataagtgttcattgtggaagtcgcttgtggaaagttgtcgattcaaaatggagccagatgatcgcaggggaatgggaataggagaaatgggtgagagcggagcgtcatacgctctcttaggaattgaaccgttggcaggagaaagtcttgcagactcggatttcgaagacctggtagaatccatggacgagttgatactcattctcaactgaatatcggcaggatcaaagtgcctacccaaagtggttggatacttctgcgcaaccaacgtcttcacgtcgtcaacgatatcaaatgagctcacatacagggttgtgggaggtctattggcccgacggacccagatccgccgtttattatcggggaacatcctgactaacggtgtatgtgacaaagacgagaatgtaaaggtaagcaaatttgaaagggtcccgtctcaggcatcaaagtaatactcgcgaacccaccatttactgatccgagaataagcggaaagttctttcacagaagagtgatgtaatgtaacgtatgattatttgtatgttgtgtttacttaattatgtctaataatacattggatgggaaagcgggaaggggaaggagagtgggaggggaggaggggataagtgacctggaggaagcagtctaaaagacccaagccataattctgcggaacagagtgtcatcgcgctggttattagcttccaggtttgcatagtattcataaatgtgttcgtcaatctcctccatacccgtaaccaagtcaacttctgcgggcttgcggaaactggttctcttgagaatcttccagaagaggaaaattgcaaggttgacaaagatcataacgtaggagaacaaaaacgtctcaatactccaattcccaggcaagaacactgagtaacccaagatgaagaccatcgtccatatgaatgctcctgcgatgatgatggagtaaggctggaaccaggatctgtaaatgaacatctttctgtccatacgatcgagtccctgggcgttgactgctctgtagaaacaataatatgtcacgcacatgaaggcgtagttcagcatctgggcaccggtgaccaggttcacaatccattccaggactacggcactgtcgttacccagttgcaacaacgaaagcaaagcgaaacaagtggtgacagccatacatgtgataggaatacccttcttggtaaccatctggaaacaagatggcgcatatcctctcttggcaagagcataaagctgtcttgaagcggcatagaagtaagagttaccagcggaagcggcagacatgatgatagtgacattaataacatggggaagaccggaaattcccatgttgttcatggcaaccacgtatggagaggccgaggcgtcttcttgtcctgtgtgtgcgactaaggtggggtcattgtaggctactaagatacctaccgacagagcacctccaatgtaaaatagggccaatctgtaaatgacagttctgaaagccccagacatggtcttctttgggtttctggcctcagctgcgaccatggagagatattctgggccaaccacaaagaaacatgccgttgtcaaagcagaaacaaatccctggaatcgacccaaaggtccatctctgtaataggtagcaaaagcacctgggtcattccaatatctgaatccaaaagcatcgtgttgaggattaccaccgaccatggtaatgaaagtgaaaaatagcaaaccaatacacaaaatcaacttcgtaatggacatccaaaactcagactcaccaaaccatttgacagtgaagacgttgaagagcacatacaagagggtctgaaccacaaaggtgatagcgggagagtagtcggatctccagtagtgaatcatggtattacaggcagttatctcgaacggaatgtaacaggcttccatgaggaaaaagttgtaaccggcgcagacttcaaatgcctcatcaacacaacgacctgccatttcaatgaagggagaagctactgggaggtaacaaaccatttctccaatagcagtggtaagcattaaaatgatcagagtccagaaagttgtagcaataaacagagaacctggaccaccgtttatcagaccgttggagatggtaacgaataatcctgttccgatggaaccaccaatggcaatcatctggatgtgtctactcttcaaatgacgttgcatcttgaattccttgttcatttgaaggaatccagagctgaacaaccccttctctgtggtagatgatgcgtcctcctctgagaacactgcgaagttggagtccttcgactttgaagtttcgaattccttctcggacaatctacttgagttggacatttttgttctttacaagattgatttagtaagactgaaatgctgaggaccctatgacttataaagtgatgtgttcaaaaaaaaagaaacagacggcattgcattcaaatggatttttccgttttctgctcggtattctttatgacgcacatgccatgcaatgagaaaataattccgtttttctcctgttaagaggggtataagtttcaaatgaggaaaggtgtacctaatttcatatcgggattccgtaaaatggggggaggggcaaaattagcttagacaagattttgtttctagtgccttaataaaagtatagtatttaattggacatttttggagagccatgttctaagaagttaatgttgccttctctgcagaccataaaagtttggcctgtcaagacttgcgagaattccagaaatgcgcgcctgtgcagtactggaatatttctcctggggaaattcctattagggctagtccatgcgattcagtaatccccttagtaaaggggtcatcaaaaaagtcgtgtgatatccatttgggtcaccacttccagaggaaattataaataattgtattgtttcagagtgaaggattgattgtctcgtgcccaggagaagagactggttccccaccaaagagattcattaatcaattgaaagagaaaagaaaaagaaaaaaaaaaaaaagaaacactattgtaagttgcgccaatttcgaagaaaaatttggtctcgtgtatagcgtctctattttttctaagctttgtcctcgttcttcgcatgaccaaaatcgtagaacaaagtatcaatctcttggctgctctgcaccaatcagcaagatgcctaggggaatttctcgtttcttttttttagacccatcaactggcattacccacttgtgggtacctacctgcacactacgtcatagactcaatccaccatcccagtttgaaacggttaggtgggatgaagagtgccacctgcttagctatacatgaagtctgcgtttttgtaaaactctaacatgggattctctccagtttgagtcgttgtagcccggatatctgcccattggcttaaaaactctcgatgcgatgagacatcggctaattttccaacaacttgccgatacagatcggaggccaactggaaatcggtagggaacatgatatcaaagtaaccttgcagaaccatgtatgagtcggtcgtgaccattctgttgtttagcattgtctgcacaacaggagccatgtagcctggaatagtttcgttgagtttggaaaaatcggacgctaatagctgatgttggggaaacttatacttgagaatgtggaagaatttcaaaagtctcgtggggatgtattctggatcgcttaagtttgcacgcactgggtagatagagtctttgaaacctcgataaaaggcatttttggccaaaggatgttctccccacaaactcttttgattaagtcgtgggtattttccattttctcttagccctaagaatgcattggcccaatcatccagatctttggtgaaaaattccttgaagtcaccatgttcatcaatcactacatacccttgataaggctccctggtggtgttgtcatatcgaataacatcatgtgcaaagttatcgaaaacctctaatgctataaagaaacatggattaggctccacttccttccaatcaaagatggatttgttaatgatctgaactttcccatgatgatcatggtctttggctttcaattgtaatgcagtttcctcttgtttagtggacagattatgggagatttcaatgattttgtactgggttctctcgtagacgtcaggttgtttctcccttatatagttgaggatgttcaacataagcgtaccattaccaccacccatttcgtatattacaagatcgttgtacggatactggttcagcatgtaattgaccaacaaatatctagccagtgcttcgccatagaaaggttgaaatagctccgtcggcgtgtgccagagttgtatgtcttttgcgttcgttttttgatcctttggattctttgggtcggaatttgttttcttgtcctcgtacctagtgtattggctttgccaatctttcatgaattggtcttgcgactccattttggcgtactcgaatggcgttgaaggctgaaagatttcaacttgtttagaaaagtagccataatggcggttgtacaatgagtcttcgataaagtcacttgctagcattttgactcctttcggcctcttcggattccttgattgcctgttgaaagttgtagttggatgttttatgaagagttgttcattttctctttcgttccatgcgtcatggccacttgctttcaagacctgtctcataaatgacccttcatatggctgtttgcccagcctaaagctgaatgtgttgggattgacagtgtagtcatgaaggaactttttcatcttcactgccagatccgtggaggtttattgtagagcaccgaattggttggagagtattctcgcgcaagatattggagtagtaccaaatggagacccaaagagatggggtgaatttagcggtggctgagtgactgttggggcactatccatagaaatgataattgtccaagcttatacgatcatgaacggtccctttcctggtatatccttctctacgcttctttttgggcccatgctttccaccctctagcctgcttttttctttcccttctagctcgattcgtgaaacaaacttttccaccctcctactatactatcataaaacaccgatttcaccatgggtgttccagcattgttcagatggttgtctagaaagtacccgaagatcatctcgcctgtgatacaagacgaagatgtggatattgatggcgaatcccgtcccactaggtacgaggaccccaatcccaacggagagctagacaatctctacctagatatgaatggtatcgtgcacccgtgttcgcatccagaacacaaaccagtcccagagactgaggacgagatgatgctggatgtttttgcctacacagagaatgtgatcatgatggctaggccgagaaaggtgatctacatcgccgttgatggtgttgctcccagggccaagatgaaccagcaacgttccagaaggttcaggtctgcacaggatgctaaagatgctaatgaaaaaaaggcggcagagctaaaggagatggaaaagaaaggtgaaatcattgatgacgccatcaagaacaaaaagacatgggattccaacgcaattacaccaggtacaccctttatgcatcgattggccgactctttacgctactgggcggcctataagctgactactgatccagggtggagtggaattgaggtcatcattagcgatgcctctgtacccggtgagggtgaacacaagattatgtcctatgtaagatcactacgctcttctcccaaacacgatccaaataccacccactgtatctatggattggacgcagacttgattttcctgggcttggctactcatgaaccccattttaagattttgagagaggacgtgtttgctcaagacaaaaagagttactcccttcaagatcagctacgtatgactgacattgagagacaagaacttaaagataagaaaacacctttcttatggttacatctgaatattttgagagaatacctgcaaattgagttgaatgtgccgggactttcgtttccttttgacttggaaaaatctatagatgattgggtgtttatctgtttcttttgtggtaacgattttttgccgcatttaccatcgttggatgttagagacaacagtattaccacattggtaacaatctggaagcaaattttgccaactatgaaaggatacttgaccacagatgggtatttaaacttgcccgctgtggagagactgttggcagaactggcaaagaaggaggattatattttcagaaaaaggtatgaggacgaaaagagatcactagagaaccaaaagagaagaaaacttgctcaagagcaaagttcggctagatctcaaaatgctcccaatatttcaactggaaaggacaaagctccgttaacgcctaatcagaatattccactttataccactagcggagaaagcgttggaattaaaatgaccgactctgagatggttaacaactcggcattaattactaaagcaaatgaagccaataagagcatcgctgaattattgaaacagaacctgcaaaatgagattaataaaaagagaaaaattagcaacgaagagcaagaagtagttaaagaatcagttgaagaagtcgttgaagaagaagacgatgtgcttgtcacatctgatcctgaagactcgtccactgagattttgattcccaagaatgaagagattagattatgggagccaggatatagaaagcgatattacgaaacgaagtttcacactaaggaccctcagaaggttaagaaaattgccaggaatatggttcaaaagtacattgaaggtgtatcatgggttcttttatactattatcaaggctgtccatcttggaattggtactatccataccattacgctccttttgcagctgactttgtaaatttatctgaactcaagattgagttcgttgagggaacaccgttcagaccgtatgagcagctgatgagtgttttaccagccgcttcaagccataatctaccggatgtttttagaagcttgatgtctgatgctaattcggagatcattgatttttatccagaggagtttcccttggacatgaatggtaagaaggtaatttggcaagccataccattgctgcctttcattgatgaaaacaggctgttgaaagcggtacaatcaaagtatgatcaacttaccgaagacgaaaagtttagaaataccaacaggtcagaaattctggttctaggaagaagccattcacattatcccacgttagtcaaggaattgtacgaagagggaaaagatagttacgaatttcaagttgacagttcgggagtatcaggagtagcaattaaactgcagtcctttgataggtctggagttcttcgcctacctgtcaaacaactcgaaggatatcgtcactaccctgacatttcaaatagagatttcctgatggtggaattcaagcaattacctaagtcacatgcaaaatctatgattctgtcaggtttaattcctcatttgcggagactaactcaagaagataaagacagcattttgtatggaggaaccaatttctacggccgaaacagattcagtcctgaagagaacgctgacttcaagcaatacattggcccacatggaaagtcacagtacttaccaagacagggaggatataaggctttcattcaaatccacagtgatgaggccaagggacatagacatggcatctaccacggaggaagtcatactgagactgagttccgaagaggcggaggatatcatcaacatggaaaccgtggaggtagaggtggataccaaggaaatcagggatatcaagctaattcgggtgggtaccagaatagttatcaaggatcgtatcaaggcggataccgtggtgggtatcagggaggctcccagggtagatatcaagctggctatcagtctggctaccaaggcggttatcagggtgaatacaaaaatggataccaaggaggataccagggcaatcaaggtaccagggctataatcggcaaacttacaatgcttcaaaatcaggaactttgcctatgaaaagaaggcacaactaactatatactgtacaataaacgtttcacatctaactaaccagttgttgccatgtgcatgagtagatttgtttgcggtgttgaatgatgtattactggaggaagtagtgagatacggcatttgatgactttagtttgaagtgaaccagtttacctctaacaaaaagtttacgagattttatttcatagactcaaaaacttttgtagctttatttcgatttgattgtgtggctaactgctactgctcagtgcaaggggtatgttaggctggttgaacaggtattgggttattgccaattatgtgcttcagatttggagggctgtcatatccaaggaaaatgtttttaatggaatatttattcatctttctagaaagcaccatattattactatagtactcatctacttatctctttgtaaagtggtcagaaagtagtaatatcacttgaacgaaatgacctccgtccgccgcataataaaaccagtatgcagggagctgcaagtgactgcagtatatacgttgttaccagatctgaaaaattaagattcctgagttgactactatcattaagctcaaaattgattatagactataaccttgagcagttgtcaacaaatgctgttggctgttgttcatgtgagcacatttcagctgctttagtgttgatcttgccttcagcaattattcactttgctactcaaaagagttccatggtcacaaagagccaatgatttttaattctcatagagttcaaactaacaacattcaggtgtgtgccgttttagtgtgttagacagtatagaaacactataaatagggcacgcttttagtgaattccccatggaagttatagtggctacagattcaaacggaggaagaattatagagatcattgattttaaagacattgagctaagacaaagtttcaacctgaaaaagtctttgaaaaaaagctgctcaaatctctaattttcaagttgtagacagtaaacgaaaggtggcattccacggagcccatttccatggagtaagcctatttcaccgggaggctttactcaaccaggacccatgatagaacgcaacaaagaaattttatatcagatatgtaagttctgaggtgaccaccactaagcaagttcacattctagctctagaataggattgaaacattattgaacttgttcattcttagtcaaacatgaatagctttcacagattaaacttacaaaactcaattcatagttcatcctttttgtctactcttcattaataccccatagattcctgggttgtctagagattggagggtgataaaacaaaaatcatagaagtactcagagtgcggttatgttcttgggctggagatgatgaaccgaccattgtaagcaaacaactctattgtgtttatctgagctggctcataaacacagaggtgagctctggactcgcctaagaaatgcagcatcaatagctcattagaaatacttacctgcagcacgttccttccgcaccatgcacttgatgaccccagcccatggtacgcgaatgtcaaaacttttaaaaattgcccttcatctcttcctaagttaattcacttccccagcattactgaccgatgtcttttcctgctgtgctggaaagaggagatgatttcctttcagagtacccaagaagatccaaagcttgggctttcatctcacacgcagcttgtgtcctcgttgtgggtggtagtaagctcgtcttgaacattgcctaccgtccagaagttacaggcctggaaaagttagacgctgctctggagagatctaagagggaaaatagaggtataatcaccgtcatgaaccacatgtctgttgttgatgacccatttctttggggctgccttccttggaaatatttcagagatgtcgatgttattcgatggggtttagctgcgtccaatgtgtgttttaaaggaacgtttttgagttatttcttttcggcaggtaagattctctccacggaaaggttcggcagaggtccatttcagccttcattggatgctaccgtcagattactaagccctgacgatacgatggacccagggtttatgtttgttccctccccaaaagcaagcttattgcactggataaaaagtccacttactcagaaaataaaagagattgactccaagccttatcacccacctgtgatgagacactgtccttcttggattcatgtttttccagaaggatttgtatgccaattacaaccaccgcattcaaactcaatgagatacttcagatggggagcctctcgtttagtgttggagccgactgtgcctcccatagtagttcctattttttcaactggttttgaaatgattcaaccagagtctggagctgagaatatctttgaaagatatcttccccagaactacggccaagagataaaggttgtcattggagacccggtagacgataaagtgattgaagattttagaaaggaatggaaaaatctgtgtgagaaggaatatgatagaaataaccctagggacctttcgcatgagttgaagtttggtaagcaggcgaaggacctacggagcagagttgctgcggaactgcgacagaatgtcttgaatattcgtaaccagctggggttcaatccggaagacccaagattgaaggatcccaagttttggaaaagatacaccaactctaaaggtttgagtgatcccgatatcaagtttatcggaaagaactgggctgtgaaggagtaccaggcaaaggtaaaaagttacgatgagttcggaaatgaaataaaagatgatcaaagatgaaaagcatttatttatatgtacatagaaaccccgataatattaaaagaaaaatcattcatcttctgacctgagatcgtattcactcaatccaacagttcctcccagtttttcaaagtttttcatgtaatttttcattttcttttccccaatggccagcatctcaggccagtatttctcgtggtcgtacttgaagttgacttctccaccatgaatgaaatccaactgctcttcagggataaacttggcaaatggttcgtcaaatgcacatttttgcttcgtatatggatccacaaacggataacaaattttcaagaaagcccacgcataccatggaatattgacgaacaatgctcttcccaatctctcaggataatgatactgtaaaatgtgtaagacctgttttccaacagatacggaggggaaagattttgctgaaagttcagggtagttcttaaagtcgacgcagagagctagtttatcctgccctctaggcataaaccaaatggtcatttccagcatgaagatcaaatgttgaatttggcggaagcttggtttcgtgttctgtttaccagagaagaggaagagacatggtctgcactccctatcaaaaccaaaaataagctgtttccccgtctcattttctggtgctaccaactgctgtttcaaagtctggaacttccctccagagataccgaattcccttctccaagaaatcgaattttccagacgtgtaatggtatcagtaacgttccaattacaagctctacaataccggagtatgcattctttagtaagccacgccttttcttccgtggttagacttcttgtttcatccccttctttatatttttctgtaatagggagtttgagatcttcatttttaaagtgatccaagacctgttggtactttggaaagttttcctcagagggttcttccaaccctgagggagtcagccctttcaaagggtattcatatggttcttccacaatttctcccttgggctgatcctccgtagcagatttcttttcctttttgaaaagcattgcagtgggaactctggcttagcttcaacggaatctgactatgcaatccatccaagagaagaaatacgagaggaattcgcgagaagaggatgccttaagacccctacaatctcggctgcaggaaagcaggatgcaactgttctagccgaagaaatcgttttactcattgacactataaaacccgtcctaaataaagatctcttcaacttcagctggatagcggccattctcggaagactcgagtttcgtgtagaacgtcttatcagggttgggtccaagcaggatcttatgtccaactttggactcttgggtcctaaacccgtacagatcgtccaaaaagttgctcatgaatgatcccggtctgggaccagaatcgctgattccgtttggcgtagtggaacgacgtgcagccacagctccaacgtatttataatggtggacagctgcaatcgtagcttccaaaggagttgcggggaatgtagtgatgtaagctgcaatggctgatcccagagaacatccggttcctgtgacgtctcccatgatggaacttcccccttgaaccttgaaaaccctttgagtgggctgcgactcgtaatagttggccccgtccaagattccatctacaatataatcgacggcacccgtaaccacaacaatgcaacggttgtttagcgcagctctcttggctgctgccacgatagcctcctctgtcaagttactgaggtctcctgtgtcaactcctctcatctggttcgcttcaccagcaactgtgagaatctctgaaacgtttcccttgataactgtgtaataccctgcatccaaaaacagtctggttctgtgcttacgcatttcagaagctccgcatcccacaggatcaaatacaatggggtttcccgtagcgttgtaggcttttgcagcagctatgaccatctgtacaaagttttcagcactctgggttccagtgttgagcaccagcccggtggttggaagtctagcaaactcttcaaactcttgataagattctgacataatgggagacgctcctactgccaaagtcacattggcactgaaatttttcacaaccgcattggtgatatgatgaatcattggattagtgtcagcaaccttctttgctttctctgtcacattgttgaagaaatcattgtcagctctgtgatcatcgctcaaccacggagcgtggctgtggaatttctccactaggactctggtagcttctgcggcatcttcttgagccatgatacaggaaacaatagcaacaccgtccagttttttgccaggtatagagccttgatacaaaaccttttgcacgttcgtctggttcactcctccaatggcacaagtcttgataccagcgccaccttcgttgagcaacaccgtcaaaatctctctaatacccaaagtgccaaaggggatcttcttatgatctttggtcttggtgtcgtatacgatcccaatccccacgtagtcagcaccatccttaattgcttgacgggcctcctcgacttttccggtagatacacctatgatcttatcctccccaaccagtttacgaaccagaggaactggcatatctgtttgaccaacatggactccctcggcatccacagcaagagctacgtcaactctgtcattgatgatcaaaggaatacctgctgctttggtcaattcgtggacctggctggctctttcgataaaatctctggtctcgatgttcttttctctcaattggatagtggtgacaccgttatcgatggccttcctgacttggtccaagaaagacaatccctcagggaccatctccgcattggtgacaagatagatagaaaggtcaaagtcagttcgattcatgtttgactggtggataaatcaactcgcagaggattctgatgatatttttcggctaggtgtgagtcgtcggtcctcattagtttcctatttagcctaagaaatgagccaactgagtcgcgtgataaccgctcagtgactacatcattacgtaatcttacttaatctcatagatcttgttctggtagttccattggcgaagtccagaagttcacctccaattgacagacatctgcaaagatcttgactagctctgctaactggacgggagaaacagcttgcatatggctttctagcgactgtctggcctcgtcaacagcatctttgtaccaatcaccggtatacgtattgatccaattcaagaattcttcgtccacgtcagcttcatccttgataaacgaccgagcataaatggcagcgtaatagtagccaaagatgcatggtgctaaggcgatttttatggccacccagtctgatgtcttcgcaatgtttaggaggtagtcggaatactgtttgcaggccttggagggtcttaattcatccagtttcacaattccacgagagttcaatacgtctttatgtctatgcatttcttccatgatggagtcgattatatgggcttctgcctttatgctttcaatatcaggtgcaactccggcagctaagccgtggacacgggcataagaagctagatacacgtaatcttgacaaatgtagtggatgaatctgttcttagccagcttatttgttgctacgttttctaaaaatgggtggttgatgtagttcttccagatgggactcaccaaaggatgctccagtaagtaatctaagaagtgacctggatagaacggaagaaagttattctcagcacttgtgccgttaatgggaggagaaatatgaaacacatgattcaaagggccttttccttgtcctagcgtctcatctgctccaaaaattgcctgatgaacgtatctaatcgaagaaattacagcatcctcaatcttcaacgaacgggcaatgtttgcagcaattgaggcagcaatcgtacacccagaaccatgagttccagaacttgtcaagtaatctgtcttgattaccgtgaatttatccaaatgaccctgataaagaatatcagtaatgtatgctggatctcctcccttttttttaaccaactgctcgtttctattccagggaatatggccacctttaagaagaacagagttgcaatgtgtagtttgctggatgaacttggccattcctttcaaatcctctaaagtttctatttcacccaactcatctacagtcttcagctttttcaagtaagagtagatcacacatgcctcttcgaaatttggagtaatgatagtagctttcttaaaatgagaatcaatggtgaaccctaattcgtgttgatctgcaagcattgaaccagacgtagccactaagaccggatccaggacaaatggctttcctttgtggtatttatctaaaaatttcagcaataaacgagatgactcagggtttaacagtccagttttcaccacatcgatttcaatgtcctcaaaatttgcctctaaaatctcttcgaaaaactttgggtcggtgttttctatactggtgacacctttggtattctgggcagttaaagatgtaattgctgttagcgcatagcacccaaaagccgtgatggatttgatatctgcttcgatccctgcaccaccggaagaatctgaccctgagcacgctaggactgtgggcaacttgactggtttgccaacaactctcttggatgaaaggcgtaaatccaccactgttgattggttggtcatgtaaggatagagaccagcgttgtccgagatgagcctctcgcaattcgggatcttacaacttaaataagaaaacgtattcgctgagtcacgactaaacagacttcctaatggggaaatgactacctaccgaccgatagtcttccatgaactgactctttacgtctgtaatacatcctaacctctgaaatattgattgcattgttatggggttattcgttgttagggtacagtcacaaaaggagtaggtttactgtagtccaagtgcatttgaccccaatgattcggtgagggtcacctccagaagagatgaaacaggtatttctatggtctacttgctaagagaccacatgaaaattattagtgctctcaattgtcagttaacttgctagacaagtttgactgtatagatcacaagtcacacttacaatttgatcaactttcagaaccgtgcttatcattaaatgtttataaaaactagatatggccgttagccgtaagtaatcattagaggtactcctcaacgttactcattcataacttgctcttgggattggattgctacaacttggtttcagatttgaagtatgcatcagtaattcctgaaatcaaagcggcaagaccaatagcaccaggatcaggtagtccaccttcactttcgaattgtttgaactcttcttcggcaacataagatgctcttccaaacttggcttcgagctttcttgtggcttcagcaccatcatgggcagctttgtttgcaagtttcagatccttagacttggcgaattcctttacaaatggctccaaagcgtcaataagagttctgtctccagtacgtgctcttgtgtatttgaatagagactgaagtgctgcctgtaaggatccagagatcgtttcaagggtcagtgtgtaggcaccctcggaaagttccttctctttcaaagactttgctaaagcgctgatgaaaatggagtacagacctccagatgttccacccatggcagtttccacgatgtctgtaatttgcaccagtgatttaacaccgtctttgagatcaagctttccttcagccagagcctttaaaatggcattggaaccattcgccaacgtttcaccacaatcaccatctcctgcaacagtgtcatacaatgtgatctttggctcttttgaaatgaccttcttcacaccagactccagaaggtcagcatacagcttagcatcaacagataccttagatgaactgtctccttcgtctatttctggggcagccacaataaaattgtcaaccctgccagaccagtctgatatgttggagttccagccaggggcactagtcttgtggtctaaaaactttaggatatctttatctcctgtcttggtagcattcaataaagtgatagaaaaaccgggcccatccagtgatgtggtgaaagtgccagtgaaaatgcggactggtttaatggaatatttggaggccagttggtcgacaacaatgttctgaatagcgtacaattccaacactgaggttcctcccaagttattgatcagtagcacaacttcatcattcttgtcaaattggacgtaatttcggtccttatcggtagtcgaaagaaggtactccagtagctcagccaccaattcgtctactgttggaattggcgacgacttcttgatacctggttcgttgtgaatacccattccgatttcaaattcatcgtgctttagcacttcgtagccgtgctcgtcatctgaatcatcttcctcctgtttgtttgctctggctggaatggtgacatggtccaaggaagcaccaattgtaaccaggttggcaacgaccttctcaccgaaagtgaccagctgatgcaattccaggttgtccttttgtaaataagctttggcacccaaaatcttgtgcactaaagaagttccagccaaacctctacgccctaccaggccattcttggctttaccaacagagacatcgtcctgaacaatcagcagttctgcgttgagaccttcggccttggccttttcggcggcaagaccgaagtgaagaatgtctcctgtatagttcttgacgatgatcaaagttcccttcttcgaaggtttggctttgattgcgctaaatatctgtttagtagatggcgaggcaaagatgaacccggccacagcggcatccaaaagaccgtccttggtgacaaagccagcatgtagaggctcgtgtcctgaacctccaccagagatcaaggtaatcttgtcctcctggttctcggcggagatgacgactctttcggactcaattagccttacatgggggttggactgacataatccagccagatggctgagtaccagatctttcttgtaatcccaatgtttactagacatttaaagtgtataaattcctttgtttcctgttataaaagaagaagcaacaagcaaaggatcgggaaaggagtcgaaggttgagcaagcgggttctttatatagtgagccattatgacatattagacatccttacccctcgattagagagctcaaacagccgactagctagccgctctagtatgacccacgcgaaaatgagccgagcgatgccctctatggaacgtattggaataggaaatggtaagctttaatgggctgggggggaagggaattgtccttctggtgtgatttttttttggcattggcgctaccagatgtctctttcgtaagggttcaacctcggaggccgatctttgtggtttatgtttacacatcgtatttttcaggactaagaaaatcactggatggcagatgtcggtctggagacttgaaacgggcttacttagtagctttgaaacttatcagataatccgaatgtgttgcatattgttgcatggtcacttttccacaactttgaaacgctaatctttgatctgaaacaaacatgctttgcctataaaccatgtatcacccctacttctttctccctcacagcatcagcagatgacaatggcaaatgaacagtctatcgggttcaattctaaagagatcaagtatttctttagcctgttgatcttgtctctccaattggaagctggagacccaagtgaatcgggattgtttggcatattcaaactccaactccataacaacctctattgtttcaaggcatctcatgcaatagtcaagttgaatggattgtctttgaacataaagtccgtttataagaacctctgtatttcatgttctatggatttggactcctgtctagcactgctgaacatgttcctgagagctaggctaattcattgtccaagagaaagaacactgatttccctggacgaaaaacacctaaatacccttttacaacctactccaaaaggtttggatatcatgttcatgttctgcattaagctgggaatcaccatagaccaaatgccctcagtgttgagatctccgctcaattcgatgcaattgttctactttgagaggaatagcactacgaaccggctgctggtgtccaagagtctcattaggctgatcttcataaagctgatgggtccagaacccaacatctgggatcctatgactacactagaaccgtccgtctcctacgaagataaactgagaagggcaaaactgctgctgggaaatcgccctttagatacgacattgggcgataacaaagtctctggtaaatcaggaaaaaagtctaataagcctggcattgagttgcaagcaaattcttgggatgattttgaatacatgtttgaaaatacaaagtccaaagagagccagacgcatcactctcctttagcacatcgatttttcaataacccaaacagtgattccaactctcaatattacgtttcatcaaaaggaatcagacttttcaagaaccataaagtcgtatattcaggccacaaaaaattggttgaatattgttttctaggaaaaactatggttcaatggctgatagattgtactgacattctattcaaggaagaagcccaatcgatttgtgaatatttcatacaggaagggcttatccagcatgtcaatatcctgtttgggtcggtctctagttataacagagactattccaaatttcatatggatattgacgacttgtacattttaacctctgaaggttatagaatcttggactggtgctttcaggagcctatagaaccaaatatccccctcgttgacattcaaaaagttttaaacgacccagcgtttttttacctgctcaaggtccatcttaccgaagaactgtgcctagaaatcctaatggtttacattgaaattgaaggggtcttggagaaactgcaacggctctcacagacccaagatcaaccgacatcacataaatcggtcaatcaatgttcggccatgatattgaatatctacttgaagtatctagcacctgacgcagttcacaacatcaatattgatcatgctactaggaatagagtgacgcaactcatacatgagctgatccgcaatcacaccacagaaagtttcaaatatgtaaccaataccaacgttctaatcaattcagttgagatctccctcaaagaaatcaaaaacaagatgagccaaaacttgaccgaagtacccagatatgaagacgagaacgaatacgaagtggagggactggaccaaaacgatagctctttggttctggatcaagtaagagaagtttttaacgaaatcaagggcaaaatgtacaccttgatgcaaaaggatgtactaattaaattggtaaactcagcccagtttcgaaagagatactgccaaatagcgacatgaatgactgtacagttaaactattacatttctacatcttcccaaccccctaaaatttaagcaatgggttccaaggtggtacccttcttgatggtagcccacccgatcaaccgccagtgcttctcgatacgtctggatagagcaatcttctcgtttatctcagtacaagctggagaagtcagttgtagacgggccatatcagccttgacggcgacgactctagcacctgtagctgtagaaccaatgttgaccatcaagacctcgttaggatccagcttacgcaccttggcttgcttctgtccatccgtcttgacacccaacaaacgacgcagcaagaaataattaatttcgatatcagtgtatatggatggaaggtgtcctttggcaccaacgacttggcctaccaacctgtcggcacgacagagcgttgggtccaccttggtaccaacaccaatcagaccacctggaacggcaaacttcaggtcattgtgctctgcaaatagcgacactatgctagagaagataggtttgcattggatctttccactgtcatccttggtaacaataccaggacgtacttcgatttcgtcaccaatcttgaagacaccggtcaaaatggaaccaccagcaacaccacccttgagttcatcgatttcagcacctggtttgttaacgtcgaaagaacgaatgacaattagtcgtggcgatgctgtgaagtctcttggagggacggggatggtcttgacaattagctcattgacagcgtcaatgttgtatttcaattgggcggatataggcacaatgggggcaccatcagcaatggtaccacggatgaatttgagaatcgacttgtggtgttccagagctgtctcctctctcataagatctactttgttctgcaaaatgataacatggttcagcttcataatctcaatggcggccaaatgctcagaagtctgaggttgaggacatgattcgttaccggccactagtaggagagcagcgtccatgactgctgcaccagacaacatcgtactcatcagaatgtcgtgaccagggcaatccacgaatgagacatgtcttaccaagttgtaacggccagtacatcctggacgctggcatttggggtgtatttctctgtcagacttaaaagagcggtaacaatctggctctggacactcgtcgttgtcacacttgtagattttggcgttggcgtatcccagtttgatggtaatattacgttccagctcgtctttgaaacgaacggtttgaactcctgaaatggccctgacaacagtggacttaccgtgggcgacgtgaccgatcgtaccaatgttaatagtagcttgtctgttgatgatctctggagataaaggtgtcagtttttcgaattctggattgtcgggctgagcgggcaatcctccaccttcttcaaactccttctttctcaattcttcttcatctacttcgtctaattcggcaaaactgacggttttcttggacttagactcatcgagatcttgagtctggtcttcctcaatttcctcctcagttgcatactgctcatacccatcgtcaatcgttgatccgatgattatgtccggagtttgactctgtagatcgtctgccatctttttcgttctgttttggcggttacctagtgtgaataatatcagtcggttcacctgctcaaaaaatttgcttggaggacgatcgcgcgtaattgtgggactgagcaatggtattagtaggtacacgaaatgagttcactggtaggttatgatcaactacatgcggtaatgaggttggtttcagtgctctggtggattgtctgaagggaagacatgatttctggagacgtttacttgttggccttctctttgttcttttgtcggcttctggcaagtcgaatcggattatccacgaatgcttatgtaatcatggattttttgagattgggggtcccccattacgaaagcttcctacctttcctccatctatctcacagactccctccacaatgtccaaccagtcaggtattgaaggtaagatcgattcaagcttataattggaacttgattgctaacaattagccggaaaggagctcattcaatctttcagcaggttctaccaatccggatctcgtgcccttacactcaagatccagaatgaacagattgtcgtagacaagcttattgagggaacatcctcattcaaccaagacttcgctttgattcgagaagcattgtctgacgtagagccaagatatgttattataaagaatgatgaaattgacaagcacacgtttatctcgtatgttcccgacaacgcaaaggtcagggacaagatgttgtatgcctccactaaaacgacattgatccgggagttgggtttagaatatttttttcccattgcatttgtcagtgacttggacgaagtttcgtacgaaggatggcaagccatcagagctcacgagtccgagcagcaaccattgacccaagaggaggagtccctcaaattggtaaaagacattgaagatctcaatttattaaagggcgggggaacctctagaaaattcaaccttgctggattttcagaagttcccagccaaagtactgaagttgcatttgaagtggaagacgaagtcaaggaggcaattttaaatttgaagaataatcaggcaatttccgcaacaatttctaatgaaagagtcgtcttactttcctctaaatctctttcgaatccgaaggaactgacggagttcatttcgtctgcacatccttcttatgccattcatcagggcgatgaaggcacatctttcatctacgcctgtccctctggttccaaggtgaaagacagaatgcttcatgctacaaacaagaaagggtttaccaactttcttaaggccaatggaatcaacctagacaaaatcatagagataaacgatgttgacgagctggatctttattacactgattccaaaccagaagcttcaaccattgtccatgagaagacacgctttacaaaacctaggggtcctcgtagaagataaataggtaacgaacaatgaaatgctgatttgaatgccatgaaaaatgtaaaaaacaatggtccctagcaggatcgaactgctgatccccgcgttattagcacgatgccttgaccaactgggccaagggaccatttatacacttcctatgaaaggatgcatgtactacgggttattggactggtagggaaaaatataattagatcattagtctgttcctgcagccttggtgtttaaagttatattgttgggaaagaattaataatataatatatttatatttataaataaaaacctttcctaccaactccctaacatataacagttctagttccacagtaactcattacaatttttatctaccatccctgggcatatcactccttcatcctccggtctttgcggcttttttcaagcgtgtttccaccgttagtagcctctgaccgttatcatccagttacccgtgtgttgcatttttcctctcgatacaattcgtccgaacaactacgtgtcctgcatatatatgcagccggaaaaaacaccataatttcgtcacaaatctccataagtctctatctgcgatctacaggggacataatgtcaaagcatgccctctccttagaacagctccagttagttgtctagcacaatatgtcaaccaattcgtcctgctccgcggcttagtaataaataaacctcttctgcaccgaagattatgtaggcgcgcgctcaagctttgccgttcgttactcctattcacaatttcgtataaatactgcgtaatccctccgacgtttattcttcctgtttcccgcaaactataaatcataatggcccttttcgactctatctcaaacgttgtcaaagatcaactcaaagacaaggaagcttcatccaaggatacctcagctaccgaagcctcaactaagggggaagagcccaagaaaactgaggaggccaagaagcaggagatcgagggatacacccaagacctgaaagacattgccgctgctgtccagaagggtgacttcaagggaattcaaaaggaagtctctgaacttgccggcaacaagcagtttcaagccgatgccaaggagtacgcctccaaggcatttagcaagaaggagggaggttcaagtgcctaaatgtgtattacccctgactacaatacagagtttatagtaatactcatttcatttttagaactctatcaagactctctcagattcttcgtactcaatataagatattttatgaaaaaagaacatagattatataatgtcataaaggggtcgtaaaggtttggtttggttggttggatatgtaatggtgattgtgatttctattcttcaacattccagtagtcaattaactccttgcccttccagttcataggccagcctgttgcacactcaaggttgttcaacagtttcagcaactgtgtatgttcagacttggaactaattagctttccagcgtgccacaatggttgcaatgagttcactttggctgctagattgctgttgtggttgttgttgatagaaatcccacagatctgcttggcatgccagagcgtagagcggaacttgttacctgcaccgtttgcattaggcggagggctcaacgttgtcgaaagagagggctctacacttcttggagacaaatgatcaccagaagcgtggtggtctgaagcaggtgtgctggaagcagacatcccagctttgttgtccgatggagatgacattgaagcagaaactgtagtaaaggggattttgtataatcgtggtttattctgcactaagatgatgtagctcatatgatacagctggttactgtaacagcttcgagagttggagaatagaacagttggaaaagttgatccgccctgcgattcgtcattggccttgaactgaacaatactttgaaaggtcaagggtttgttcaattcccattcattgagttcattccacaaaaactcccacttgggctcaaaattgagcttcgcatctctgcagttcaacaggttaatgattctaccactaatgtacagcatgtagatggcatacatatcgtccaagtcatcgtcagttgtcgtgctagtcttcttggtgaaaaatggcttcacatcttgaatggtcttgtagtcagttgtctctttaacccagtagctaaaaggaatgaccattgactcttcaccgattgcacaagtagccaaatccaaattgacatagttccagaaaatactcttttccagtttgtcattagatgtaaatccgtttatgttgcatgcttgaatgtattttgccaatgacacaatgatgtccctctgggttgaaggttcactagacatgatgtggaacacactcaggagaatacatgtgataatgtactcaatattatttgagctttgaacagtagggatgagctgttgtagtgagtattggtagcattgcaatgttttttcattgtgctctttctttatcctttctctttgacgagaagatatagccagaatggcatagtacaatgaagaacattttttggccagaactggaatttttgttccaaactgtttggtattgtcaaaagtgtcaaaccatggcgagatgttgtcaatgaagtttctcatcaatgaaaacttttcggcgtcagtgattgttggtggactcaatgagaacttgtcagagaaagagaaggagttcaaacttaagctcaagttgttggaaacggtgctagaatagttaccgttagtgccatttgccaaagtgtcggagtgttgactattcagatgagacgaactaagggtcatgtactctttcaaagtttccggcagattgtactttgaagaagagggtgactctgccttcaacgattccaaaaaagaatcgtagttgaactcaatctctggtcctttggagaatgggcccatccttccaatatcgtctcctgagttgctagaagctgcactagaacgtgaactgaaaatcgatgagttcgaagactggtccttaggaatggctgtgttgttcttagaagcatcatctccctgttggacagcattttctccattggctgtgagggcctgtttttggaactcattgaaccaaaggtcctccggcccagatgggtatgaaaagtgtctactggaatttccatgctttttttgagatgcttcttgaactgtagaaaataagcatgacatcggagacaaacctatattgtggttgctgttgttggtagaatcgttaactgtgagggggttgaagcttggtgagttgaacatcaagccacttagttcatcgtcattagtcccagacggtgaagagaaagagtgtgactttccattggacattccattgaaaccgttcaaatgggaagttgcattgctgaccggcagcaaacctagtttctgtctcttacgactgttcttgttggaaatgtcgagtttttgggcctcgtcagcgtctactgaaaatgtcggatctgaactgccagagtttgaacctatcaagtcttggaagttaaactcgtttttgataccagagccgtaaccaaaactttccaatccaattgaggaaagcgattgattggcaattgtgtttgaactctgctgttgttgcagattcacggccaaattgagactatcagctccatccaccgttttcttgcctaagaaatccttcatggagttgttaacgaagatattcttcttattgttctctggccagacacattccaagcctttcaaagtgcaaaagtcacattttgggtttctgttctcgtcacatttcttgtgcttctttcggcaggtcaaacagcccgtgcggactctttttttcacaggtgcagcgttgttgttgccagatccaccagcagatttggagcccgtcttagcaggggccgctgaaactttcgactttgcctgttttgcgttcgaaggtatatccttgttcattagggtcaaatgggcaaattggctttcttccttgattggggctgcggtactcattggctgttatatagaatctttgagaggagggaaagagggggtggtgcgtgagtgtctgctgcgacgtaatctatgtttataaagcaactcagagtagaaatagttacagagggaagaagagggaagccaacaggagggcttgcccaattatatatattgggagggctgaaacaaaaaaaaaccccgttatgttggatgaatgactagtatgctgtttggggaaatcagggttggggcagtcctttgagtggtaccaaatgaccaatggttgaggacggacgaatgtacagtcccgggtctacgaaatatgcataagactgtctaacaacaagaggggttggggcgatcgcgctaaacaacatctgctttgttgtacattttgtacgtcattccaactaccaaccttctcggaagccaacctcttatcggatagagcggaacgggaagaacccatggacggaggataacagacattggccagcgagcgagattgaaggaggagaaaaatcgtaaacttgatacacaataacagatttggaggggtggtttttatctaattaatctgctcgctcttcctcctctcctctcctcactccacttctacgttcattccctttctgtacccccgttctgtgatgtaagacgtgacgatgattggtcaaatctacagttctgcttattcccccaccaccgcaccctcattgggagtgttcaagtggtgctggctggtgtatctctcgatgtcgtatgattctgataggagaatgtatgagttctacgtttggcattgatgccagctactgcgcgcaatccgcacccagcaccccttaattcttttgatgatgccccgcttcactgctcgggtgtgctctcgggagtatttccgattagctcaactctcacgttcaaagttaaactttattgacgaagaggaactttctaaacggctggacagaaacttagattagggaatgacggtgtttacacctccagattctgttccaacacgatatggacttgtagctcgcttcgatcaaatttttcaagtgtgaacgtctcctgcagcagtctttcatcatacatatgaaaaatttttaaggagttctttaccccagttttcagatttttttttctctcttcagctgtacgcagtactagaatcagcgacctataaacacgaaactactatacaatccaacactagctgtgtatctattccactctctccaatactgtttccccaatcctaccactaacgttcggttgagccctctctattaccccatattttactatatttatcttgttgtctttttatgcacgtattatgcacatagtatgtaggtcgcagaggattcacccacattgaaaaatgtttcctataaatcaaactcctcatatctgcagtgacaggtttctcccccacaatcttcgtcccttcaatatccgggcgttgccatttctgagtgcagcagtgtttcctgcaaagccatcaagaggagctacatgctctcattttttggttttgtatgtccgacggggttcgtaaactggttcctcctttccttcctgttccatttattggtcaaaaaacaggtctttcctaaaccttatgtcaatgacctaccacatagtgttgcatctgaagattgagggggtgtacatcaccatcccaccctaggatgtcctacaggtaaacagatagccactacgatgatcatccataaacaaaaatcaaatttaatagacttacacaactactaacccgttagtggccaaatctacttatagtttgtcgtgctttggttttcccttcaaatcggtgaattcgtaaaggatttgaggactagccttaatagagttgacgtatgcagcaaccttctcaccaatcttctcaggagtgtatccgaagtatttgtagacatcctcaacaggaagagacttaccaaaggtgttcatggtgtaaccagcagtggcgtatctctcccatccgtatgcgacataggcctcaacaacgacagttggaacctctcctcttctaaggacagaacgtctgtatgccagggattgttggtcaaacagtctctgacatgggaatgacagaactctgaccttccatcccttctgttgtcttagcaaacgagcagttttgacggcaaactccaattcggaaccagcaccaattaattggacgtctggcttaccctcacagtcttcaacgacgtaaccacctcttttggctccctcagccgaagtcttacctgggtattgctcaacctcgtgtctggacagagagaacaaggtggagtgctcgagctcaacagctacttcaaacagagctgcaacctcggtagcatcggctggtctaatgtagtagaagttgggcatagctctgaataatgaagacaaagcaataggctggtgcgttggaccatcttcaccagctccgatggagtcgtgtgtagcaatgtgaattgctttcaactcttgaagtgcagccatacgcaaggcaggtgctgcatacaggtagaacatgtagaaagttgaggtaataggcaagaaagtacccttgttgtatgcagccaaaccattggcaatagcacacatagagtgttctctgataccaaactcaatatatctaccagagtagtcaccacccaatccacagaaagtttgtaacttagggttgaagaagtacttaactcctccccagttcaaaagaatggacacggacaagtcaccagaaccagcaataacctgaggaaggttttgtcccagagatctaacaatttctctagcagaggttctggtagcagttggctcggttggtttgtcctgtggaatgaaactcttccagttctttggaagttcacctctaatacgggcctttaattcctcaccttcttgaggatagttcttaacgtactcatccaaaagtttcttccagttagcaactagttgatcaccctcggctggtttttcagcaaagaaatcatagacctcctgtgggaaccagaactttctagcgacatcgaaaccgtacttggccttcaactcccggataccttcctcaccaagagcagaaccgtgagcagcgtggtggttaccgaaagcagaatcctgtccaatttcagttctaacgttgatcagagttggtctctcattctcagccttggcccattcgatggccttgacaagggtagcaacatctctagaaccattctcgacttcaatgacattccagttctgagctctaaacttagcagaaatgtcttcggtgttgttaacatcgacggaaccatcacaacaaacctggttgttgtcgtagatcacaataaggttgtccaaggccaagtgaccagctaaggaaatcgattccaaagcaggtccctcttgcaaacaagcatcaccaacaatagcatagatagtgttgtcaacgacagggaagccaggtctgttgtaagtagcggccaggttctttgaaccaatggccataccgacagcgttagagataccttgtcccaggggaccagtggtaacctcaacagcagggttctcaatttcagggtgtccaggagtcaatgagtgataatcggaagagtggtaagattgaagttgcttgacagtcatctccttcaaaccagttaagtgctggaacaagtattggaacaaacagacgtgaccgtttgacaagacaaaacgatctctgttgaagtagtctggatcatttggagcgtacttcatctggtacttccacagagcgataccaatggcgaccatacccatggcagaaccagggtgaccaccaccatactgttcgactaagtcgagaacgtaacaacggaaggttttgatgaccaagtcatggatgtcatcattgtaagaaactgctttgggaattctagccattttgttcgattattctccagataaaatcaacaatagttgtttgtaagtaaacgaatcaagatactgaaaatagtttcaaaagcagatcatctgggatttatatatcaggcatcctgctttagttcttttttgaacccaaaggctatctgatgaaaagttgatataggtatgaagaccagaatttgcctagaggctaaccgagacctgaggctaaaaaaggcaggaggaaaagtcctgccaaagataggtatttgaacttgttcgaaaaaggcggaaacatggttggagcaagcggcggaatagcggagggatgatacgcagcaaggctgggatcattcgagtttcaaggaacgttagctcaacattcattgactggtaagcgacaactggtttcatctgggtggagttagtctggtgttgggatgctagttgttccccacaattgaaggccagatgaggaggatggtgtggtgataagagatgcaaacagatggttatggccttttgagaacaaagtagacctgtcactcaattgttgtttatatcattgctctaatcatcaatgtaagcttgaaggttcagcgcttccattttcgacagaatgttatctattctagagtccaagatcttggactgataatcctctttggatagagaatcaacataaggtagtccgctctttaatgtgtcataaatgtccatgaaaatttttgactgaactttaatgaaactttcaaaaatggggtccaagtaagaaagccttagcgacatgaattcggacagctcgactttaagtttggaattcaattgtagatactcctcttctgtttccaaactttctgtaattgacttggaaactgactctaggtgacgctccgtttgagaatctagtgagttgttcctcttgtcaaattccaattgttctttttcggtggtcaattttgacaatttggattggagcatatcgtagtccaatttctttctataacgttttttattaacaagtcaaactcttcattgtactgtttaagagtctctaacggttgcaatattgtataattgaacggttccactgaattgggtaacacatcgtcttttatcctgttgacgatctccagatattttccttcaaatccatccgtagtggaggttccataatatgagttcaaagtggtagcaacggctagattagcctttagacaactatgatgattttccaataagcttgaaagtcgattgtagagctcttgagtaaattgttggataatccggaagttcttctcctggaaatcaaactcttcatccagactctcatcaagatggtttgtcttcataaggacctgcgttccagctctattgacggctttcttgaaccctgaccaggacataatgatatttgagggtgttagttacttcgtctccagagtagcttatagggagaaaaaccgagacaacgatggaactcccatgtagattccaccgccccaattactgttttgggcaatcctgttgataagacgcattctagagttgtttcatgaaagggttacgggtgttgattggtttgagatatgccagaggacagatcaatctgtggtttgctaaactggaagtctggtaaggactctagcaagtccgttactcaaaaagtcataccaagtaagattacgtaacacctgggcatgactttctaagttagcaagtcaccaagagggtcctatttaacgtttggcggtatctgaaacacaagacttgcctatcccatagtacatcatattacctgtcaagctatgctaccccacagaaataccccaaaagttgaagtgaaaaaatgaaaattactggtaacttcaccccataacaaacttaataatttctgtagccaatgaaagtaaaccccattcaatgttccgagatttagtatacttgcccctataagaaacgaaggatttcagcttccttaccccatgaacagaaatcttccatttaccccccactggagagatccgcccaaacgaacagataatagaaaaaagaaattcggacaaatagaacactttctcagccaattaaagtcattccatgcactccctttagctgccgttccatccctttgttgagcaacaccatcgttagccagtacgaaagaggaaacttaaccgataccttggagaaatctaaggcgcgaatgagtttagcctagatatccttagtgaagggttgttccgatacttctccacattcagtcatagatgggcagctttgttatcatgaagagacggaaacgggcattaagggttaaccgccaaattatataaagacaacatgtccccagtttaaagtttttctttcctattcttgtatcctgagtgaccgttgtgtttaatataacaagttcgttttaacttaagaccaaaaccagttacaacaaattataacccctctaaacactaaagttcactcttatcaaactatcaaacatcaaaaatggctagaattccaaaagcagtatcgacacaagatgacattcatgaattggtcatcaaaaccttccgttgttacgttctcgacttagtcgaacagtatggtggtggtcaccctggttctgccatgggtatggtcgccattggtatcgctctgtggaagtaccagatgaagtacgctccaaatgatccagactacttcaacagagatcgttttgtcttgtcaaacggtcacgtctgtctgttccaatacttgttccagcacttaactggtttgaaggagatgactgtcaagcaacttcaatcttaccactcttccgattatcactcattgactcctggacaccctgaaattgagaaccctgctgttgaggttaccactggtcccctgggacaaggtatctctaacgctgtcggtatggccattggttcaaagaacctggccgctacttacaacagacctggcttccctgtcgttgacaacactatctatgctattgttggtgatgcttgtttgcaagagggacctgctttggaatcgatttccttagccggtcacttggccttggacaaccttattgtgatctacgacaacaaccaggtttgttgtgatggttccgtcgatgttaacaacaccgaagacatctccgcaaagttcagagctcagaactggaatgttatcgacattgtagacggttctagagatgtcgctaccattgtcaaggctatcgattgggccaaggctgagactgagagaccaactctgatcaacgttagaactgaaattggacaggattctgctttcggtaaccaccacgctgctcacggttctgctctaggtgaggaaggtatccgggagttgaagactaagtacggttttaaccctgcccaaaagttctggttccctaaagaagtatacgacttctttgctgagaaaccagctaaaggtgacgagttagtaaagaactggaaaaagttagttgatagctatgtcaaagagtaccctcgtgagggacaagagttcctttctcgtgttagaggtgagcttccaaagaactggagaacttacattcctcaagacaagcctaccgaaccaaccgccaccagaacctctgctagagaaattgttagggcccttggaaagaaccttcctcaagttattgccggttccggtgacttatctgtctcaattcttttgaactgggacggagtgaagtacttcttcaaccctaagttacagactttctgtggattaggtggtgactactctggtagatatattgagtttggtatcagagaacactctatgtgtgctattgccaacggtttggctgcatacaacaagggtactttcttgcctattacctctaccttctacatgttctacctgtatgcagcacctgccttgcgtatggctgctcttcaagagttgaaagcgattcacattgctacacacgactctattggagctggtgaagatggtccaacccaccagcctattgctttgtcttcattattcagagctatgcccaacttctactacatgagaccagccgatgctaccgaagttgcagctctgtttgaagtggctgttgagcttgaacactccacattgctttctctgtccagacacgaggttgaccaatacccaggtaagacttctgcccaaggagccaaaagaggtggttacgttgttgaagactgcgaaggaaagccagatgtgcaactgatcggaactggttccgagttggaattcgctattaagactgctcgtttgctaagacaacagaagggatggaaggtcagagttctgtcattcccatgtcagagattgtttgacgagcagtctattacttacagacgttccgtccttagaagaggagaagttccaactgtcgttgttgaggcctatgtcgcatacggatgggagagatacgccactgctggttacaccatgaacaccttcggtaagtctcttcctgttgaggatgtctacaaatacttcggatacactcctgagaagattggtgagagagtggttcaatatgtcaactctatcaaggctagtcctcaaatcctttacgaattccacgacttgaagggaaaaccaaagcatgacaagttgtaaacgggaagtctttacagttttagttaggagcccttatatatgacagtaatgctagtacgttttgttttgtttaattaataacttagtttatgttagcctagtatagactccatcaattttttttgttattacgtaagccgcgatgataatatctgatgaaaaattcctatcagaaaataatttatcaaaagtttcatgcgatatgagactaagtagaatagggactcccaaagtgtcagtcacaagggtcattcccgttcgtaatgtggtgatagcgaggagaaaacctgtcagagcaagtaacaccgacgcaaagacatggctaatgaaagaagagcagagaagaataagacagaaggagcaggagatgaaacaaaggctagaggaactagaaaggttcaaaacaaaagtacagaaatcatatataaggaaagaggataggcatttggcacaagagatagaaaaggatcttgacataatcactgatgattacaatttggacagcgatgtagacctggtctttggagaactcatgcaagcagaagagcagcccaaatcgttgaagagtttaccaggagccagtgatgcaagtgataacacagataaatcggtggaactgttttcctttccatctccgaatctgacgctacctgaaaaggtgatacaccatattgggccactggtgaagcacatcagtaatcctgaaaacattcaatgggggagacttttactggatttggaaaaaaatcaggggtttaacggtctatctgccgtagatgttaccagactgattcaaaatatacccaaagaggaaaaatatcagcatatgtctttgattcatgaaatgatgtttaacagtgggatcagtcctgatcggtacttgacagatttgatgatgactgccttctctgaaaggagctactatgaaccattggttgaggctcttttccaagactatgacatcaatggctgggctccaacagattatacttttggagcattgatcaaagtatattccaagggaaagaagctcgataagatcaataatcttctgaatcaaatgaaactaaaataccataaggaacccaataaaaagatatataccatggtcttacaaacctgtatgaagattgatgattataaaaagacttctgaggtctttgatgccatgaagtttaattctgtcgccactaatccagatacgacggcttatggttcgatgatattaatgcatgtgctcaatgataatgtggaagcagcattggatctgtatgacaatttggaaacagaaccagacgaaaccattctgcttgctttggcaagaggttgttcttcaagaaaagttttgatcaaccggggatgggatttcattattgaatactacaagagaaagtttccattgaatgaaaaattaatgaccgtgatgatgtaccttactagcagagacggagatctatcccttaccagagctatctacaataccattcacgagtcaaggttcaagatgactgaatcgttcagtatgaataagaatgatggaatagctctgaatgtattgttgcgtggatatttcaagtatccggacaaccatactgtgcaatccaaaaccaacgatgcagtggtggcattgagacgcagcacattggcattgaatcattttggctaccatcctaaagctacacctttccttcctgtgaacgagcttgaagagaagcacatattaccagaagtccaggcaatctggtcatatatcattctgcattaccctgatattgtcacatccgaactggtaggaacttacttgatgatattggcgactcgaggttcaatggctgactttaacaaagcttttgaagaattgacgttgaaacctgtgtttgaacaggtcgacaatgcagtagcagtggaagaagaatctgagcaatcttccgagctgtcagaccttcgtttaactcctctggccatcaggttatcctccaatatccagatcaaataccccagaaatcatgacatctaccatatagctcttcaggcctgtatcaacaacaaagacatagaacttggccagaggatttggcaggaaagagggaggtttagaagaacgcccgaattttcaatgcaacccagaaacgtcaaacacaaccaggattttgagtttgctagagacatgttgaaactcttagtcaattgcaatgaactaaatgacgcttgcaggttgcttctttcaacagagactcaatttaattgggaatggacatacgtgaaaccagtgtacataatggcagaacaacttggagatgagtatgccaaaaaagtggtaagacgagtagtccgaaacaaaaagtccaagtggagagaagagtatctccaaggtatgtaaataggactcttccagaggtctttctattcgtgttacacataatgattatgatattatatatatatgatcttctaaattagatttttgttaacgaagtcatcgtacaacagtttacctagtcttcctggagatggggaaacaatgacacctgcagactccagagcagcaatcttagacttagcatcacccttaccaccagaaatgatggctccagcgtgacccattcttctgcccggaggagcggtgacaccagcgatgaaagagacaaacggctttggaacggagacggtgctgttgtgttgtttgatcagttcagcggcttcaatctcagcggttccaccaatttcaccaatcataataataccttcaacttccgggtcgttcaaatagagattgacgacctccaacaggttagtacctggaatcgaatcaccaccgacaccaatgaccaagttttgacctagaccaacgtttgtggtttgagagacggcctcgtaagtcaatgtaccagatttggagacaattccaatcttacccttcttgtggatgaaacctggcatgataccaatcttgcactgttccggagcgatgattccaggacagttaggtcccacaagtctagttttcgactgagatttaagtatgtcagccactctcaacatgtcatgttgaggaataccttccgtgatacaaacagccagggggatctcagcttctacggcctcctcaattgctgcagcagcgatagaagggggcacaaagattccagaagcagtagcaccagcctgtctgacggcatcagcaacattcttgaagacagggagtcccaagtgcaattggccggccttcttggggttagtacctccgaccacttgggtgccatagtcaatagcttgttgcgcgtggaaagtaccctgtttaccggtgaaaccctggaaaatcaccttcgtcgaggagttgacctggaggttcttgatggtggaggcgtagttgcgggtgacctgggatgtgctgaaacagcggatacgttgcatggtgggcgcaaatgggtttagtgggagtgtaagaggaagaggaagaagagaaaagagaaattaggccgaactttgagcaaaaactcgtttaggaggggagggacaacaaagtctcaatactgcgcgacgttgaccccagctgctagtatttgcgagttagttgcacgaaattaaagatccagagaggggcattgaaatgatgtaagaaaaactccggatccggaggccgaaaattgggtactctacggagaaaagtataggactggcaacccggagaaagtgaaagacttagggcagatttgagaacgacatcaagtcgttatatgataggcgtggctttaaccagtcaatttggttgcaaggcagcagcagcgtggaaagatctggcaggtgaggtaagggggaaattggagacaggtggcatttttcaggcatccgaagatttcaccgaggaagtggagggggagatttgtaaggtccagttgacagagagaagtagtgggaggacttctgaaatcaacgcagaaggagtgtaaactctgcagtgcctaagaacttccacagaatagttgctcttcctttccaccctaatggatgctggatgttccaccctcatctcggttgtctggatcttacccccgctctttgtaaacatacttcaaacggttcaacggggaacatctgatctgccatgattaccttcgttatagcgtttctgatacccagtatcatgactctacggacgttccaattggtcaattcaaacgagtttatcgtttactcttccaatccttttactgtaagcgcagttcaggtcgaggatctggtggatcatcggtatcatctttcactggttttgccatggttcagatattggttcgtctctttcctgaaactcaaactagagcaatatctcagcctgtcaacagttccattctactggatactgtcccttgcgatccagatctggctgtttcacccgtattctaaagggtcctggttgatctgctatcaactatgtcatggtcccatctctgaaaagttaaccttatcacctctagaattcttccaaggtaacctacaagctttcttatatcatgccattcatactctaaacaaagtctactttaatcctcttttagacctaatttccagccctaacgtggactacgtcctactattcctgtcgcaaatgtcggagaacgaagttccagtaaatactttccacaacaacgcattgatactgtccagcatctgccgtatctgggacagatactccagattcctcaggcgttagtggtcatgcctaaacacctctggcacgtttagccaccaacctttactgtcagcactgcccagacttccggcaaccagagactcttgcatttcatccgtcattttccaccatttgagatttgcgtcttcttctaccatcttggcacaatctgcttcatagtcgtcgcccagatatttcattgtagcaatcaataaattatactgctccagatagaaaatggagtaatcttcaatgtgatatttggagagtaattccaggactgaaggccaaacagctgcgtgaactttgacgtactcgtcgtagaattcaggtttaagtttgacaacctgacagatacgtttccctgggtgcaagtctatgggcattgtgatagttctcaagggaaagatctgtgctgttatgtatggtacatcaggagcgatgaggtaggtgttcggttgaaaaatcaaccgagtaaagtgggggatgagatgcgtttgatcccacaagatcagttgttcaaaacttttcaacaataggaccaacgtttgctatcatgtagaccactcaaagccaaagtcttctacaatgaacgcaaccaagcatactcatgtgattaccattcactgttttcgtttttttttttttttaggttcactgagctggttatggtagcacacaggacagccagttcaccaacacttagaagggatcattgatttctgactgtctgaaatatttctttcagtgaaataaatttgtggatagcaaatagaaaaccttttcttctaagcttcaccaaattaaggtagaccccctgaacaatgtccggccccgacattcgacttacacattcatagttgtcacttccaaagcatggaccatggaccatggaccattgagcttggaatgaagcgacagggctctgtttgggtgagtgccgagctagttcccttttctgtcttcaaagacttttcctcacagttcctcaacgccaaccataacacacccagaatcccttatgatgccacgagcagtcccagcataatctataagacaaaatttttgggagttcactccacgagtgcttcaactgtctccatactgacttatgccttggcttaccttcatccgaccttcattggttcacattactattacataatcaattatatatcatttcctgcacaaattcgtgtggaaaaaaaaaatcaatcccatctacactctcatggctctaatcaaccacttgatactggttagtgccctggtttgctaccttgcaactggaggaaggattagcattgtttgcttagcagcggtcttgtactgtttgttgcaaagctcctccactcaaccttctacatctcggtctactacttcggcttgtggccataccaaatcacccgaaagaactatcccatctccggctaaggatgaagcctcatacgaaattttagcaaatggagctgtcaaactgaatagaactttcaataagaataagcaatcatcaactttcaagaggaaagatgacactaaacagaggaagaaaagagtcccaaaaattttcaaagctaataaacccagctccccaaagttcaaagagggattgactgccactagtcatagtctgttagactctaattttatcattttttactcttctttaactggatcttcagccaaagcggccactactttacacggaaaattatctgagattgccacaaataaaccacagcttttaaacatggacgaagatgtgaacgatttagaagactattttgtgaacacaccagatttgaagaatctggtttacattttagtccttccctcttatgacacagattctcctttggactactttttggaatctttggaggaaacttccaacgacttcagaattgacaaattcccattgaagaaactagcagggttcacagttctaggtcttggtgattcggagtcttgggctgagaagttttgctaccaggcaaaactggttgacaaatggctcagtaagttgggagcccgaagaattttccccttaggaactatatgcatcaaaactggaggtgaaccaaagataaacgaatggatagatatttttgatgaaactctgaaggatgacgaccctatgttaacggagaatgaaccagaagcgactatccgtgattcaaataacgattacgacgatgatgacgctgatgtatcggacgatacgttggtagatgttgaagacatgggaagaatgatcgccaaaacgaaggaagagaatgaaattgcccaggtcactgagaaaaaagaaatggtagcaaaagactctccaactttcaaatcattaaccaaacagggttacactgttgttggctcgcattcaggggtcaagatctgtaggtggactaaatcagccttgcgaggaaggggatcgtgttacaagtttgccttctacggaattaggtctcatctgtgcatggaaacgactccgtcattatcttgttccaacaaatgtgttttttgttggagacatggttctaaccctgtcgggacgacctggagatggcaagttgatcagccagaagacattctgaatggagctcttgaaggtcattacaagaaaatcaaacaaatgagaggtgttccaggcatagttagtgatcgattcaatgaagccttcactgtgcgtcattgtgctttgtctcttgtcggagagcccattttttatccctacattaatgagttcttacaaatgctgcatgcaaagcatatttcctcatttttggtgtgcaatgcccagcaccctgaccaacttagaactctgaacaaagtcacgcaactgtacgtttccattgatgcatctagtaaggatgaactgaaaaggatcgaccgtccattgttcagaaactattgggaaaggcttcatgagtgtttgaacatcattagaactgtgcaatcccaccaaagaactgtctttaggttgactcttgtgaaaggatttaatatgggtgatttcaagggatatgctgacatggtggagagcgcattgccctcattgattgaaatcaaaggtgcaaccttctgcggatcatcctctggaaatggaaatcctttgacaatgcaaaacatccccttctatgaggaatgtcaaaattttgtaagatctttgaatgatgagcttaattccagaggtttggagtacggaattgctgccgaacatgctcattcatgctgtattttgattgcctcgaagagatattacatcaacgaccaatggtacactcatattgactataaaaagtttttcctgttacttgaatccggtgaaaagttcacacatatggattacctagctccaactccggagtgggcatactggggctcatcggagggaggattcaaccctgaggatgtcaagtacaaccggaaggaagaaaaggagaaaaagagacttgctagggagcaaagtaagcaattggaggcatagtagattataggatttgtactcatcaattatttattataagagcagaaggatttgggttggtagatttcgtctggtaagagggaatatcaatgacaaaaaaaactccgcgacggggaattgaaccccggtctaccgcgcgacaagcggtggttctaccactaaactatcacggacttttcgtgaatttcttcttcttagttgtttattacttgcaaaacaactctattatataaacgaaattcaatatcagttgttccacaaagcaatatggtcaatgtatggtattctgaaataactcaaaaagtactttttttttatcatttggtggttattcattgaagtaactaggtgaatttcctcacaataattcagccaatatgacctaaaatccccaagatgtgttgtgttgtcttctattaaaatcaccccttattcacaccaacaataacactatgaacagttaatatattcaccttattacttactaagaaacctatttcttttggccttgagcagcaaccttcttggctccctcctcagcagcctttggatccaagtagtaagcttccttggtcttgttcaaacgctcgtccaactcgtagaccaatggaataccggttgggatgttcaaaccagcaatatcagcatcagaaatcttgtccaaatgcttaaccaaagctctaagggagttaccgtgggcagcgatcatgacgtccttaccctccagaagagacttggcaatggtatcttgccagtatggcaacaatctgtcaatgacaagggccaatgactcagtctttggcaaaacgtttggatcaacgtcgttgtatctctcatcgttggcttgggagaactcagaatcatcctcaatctcaggtggaggaatgtcaaaagaacgtctccaggtctggaacttctcagctccgtacttctccaaggtctcagccttgtcctttccttgaagagcaccgtagtgtctctcgttcaatctccaggatctcacgacgggaatggacaatctgtcggccttgtccaaagcgatgttggcggtttggatggctctgctcagcttggatgtgtacagaatgtcagggtgaatgttcttctccttcaacaattcaccggctctggctgcctccttctctccagttggagacaatctgacatcgacccatccggtgaagaggttcttttcattccagtcactctgaccgtgacgcaccaaaattaacttaaccattgtttgtttgtgtaattgaaagttgttactgacaaaatagaggcacttaagctagggggcagaagtatccttatatatggaggttgtgcccactaggaatagtgaaatccgtctgagtcctgtccgggattcgcggcatggatgtacgattcccggggtaacgccagaagcatgagagggagccagggtatggtgtgcgcgcagcagggcaagagtcaatcgaaaactgagaactgaaagctcagactgacggatgtgatgagatgaggtcgagaaaacaggatgcctgatggcacttaaaggtcgtgtagcactggttcttttgtttccctcctcccaaaaaatctggcaaaatcgtaacctaaacagaaaaataacggacactactaataacccaaggtattgataatgtctggatcagggttcagtttctcaggctctggccaaggaaatacagggttctcatttggtaactcccagaacgcctccaagccctcattgtttggaaatcagcctgccaatactagtaatgccaacaacacgcaaacgtcgtctggaggcccctttggacaagcaaacgctcctgctgacggagctaaggccaattcatctttatttggtacacagagctcaaaccaaggatcaatttttggctccgcagctcaagggaatgccgcaggtggatctaacactggatcaacaggtgctttttcctttgggaacaaccagccagcttctaacaacgcaacagcccctacaaacaatacatcaaaagcgtttagttttggtcaagcgcctgcggcctcaacagcatcaaacacgaccgcgtcttttggaggaaacaataatcccagtggtgctttttcgtttggttcaggcgctaccaagaccgatggaggcagtaacagtctctttggcaacaagccggccactgaaagttctgcagctaaacccgcttttggtttcggtggtgcgcaacagtcagataaaccttctttcgggtttggtgccactgccacccaaactacagataaacctgcagctactgggttttccttcaattccaacccggttggcaattcggatgcaaaaccggcatttagctttggcaacaaacctgaagaaaagaatgataagccagccttctctttggggtctaattctgggggtgctactgccagtaagcccgcactaagtttcggggccagtagcagtgtccagcagagtgatagcaagccaagtgcgttttcgtttggagcacagtctggtgaaaaaaaggatacgagtgcaggattttcatttggagctaaggctgacgagaaaaaggatgacaaaccagctttttcatttggtgctaaacctgacgagaagaaagatgacaaacccgcattctcatttggtgccaaaactaacgaaaagaaggacgacaaaccagcattctcatttggtgctaaaccggacgaaaagaaggacgacaaaccagcattctcattcggtgccaaaactgatgagaagaaagatgacaagccagcattttcattcggtgccaaaactgatgagaagaaagatgacaagccagcattttcattcggtgccaaaactgatgagaagaaagatgacaaaccagcattttcttttggagctaaggccgacggaaagaaagatgacaagccagcattttcatttggtgctaaacctgacgagaagaaggatgacaaacccgcattttcatttggtgccaaaactgacgaaaagaaagacgataagccctcattctcttttggagccaaaactgaggtaaaacaagacaataaaccatctgtctcctttggtgcaaaaccagaagaaaagaccagtgacaaaagtaaagatgattcgaagcctgcattttcctttggagcttcttcaactacgaaaactgatgacacttccaaagataaaactcaagagactaaatcagcctcttctactacttcaggtttcagctttggcaaaactgagtcaaagagtgaaacagctgagacctcagataaacaagtcaacgtaaaaacccaggatatacaagctaaaccaatgtcaatcaaaaataagactttggaggatttaattacaaagtggacaaaccaattgacaacagcaacatcaacctttgaaaagtatgctaaagatataaatacatgggattcgatcttagtttcctcaggagagaagctaacccaactctataatgatgctgctttagtggagcaaacgcaacaaaagatagatcaaaatctaacatatatcgagggacagcaggatgagcttgaggcgttattggatggctacaatgctcaagcagagtctcttctttcttcagtgtcctctaggaattttgaaaaatccaatgttcagtctaatggaacgggaagcgagccacttctcactaatgatcaaataagggaaagagcatttcacacagcagaattattggaagacaggttggacttcctaggaggaaacttgtcatcactagttaacgagattaataacatcagcgataccttcaataagacactaactaacgataccactgctggacccgacgttgatgacaatgaaaataatacagttgaagatatcttgcaactgctgaacacgcacctcgagagtctcaaatggattgagacgaacgagcaagatctcaagaataaactgaagatattaaaggaaaatggactgtaattgtgcttaccccatttcgtatcgaagtgaggtacagctccatagattatatattcctctctaactaaataattttccccggcagatttttcgaggttttcacttatcaaaataaaaagcttggagtaaatctccctctaccaaaccacctttaattaagttactttggatcagactatttatatcctgttatgttacgattgagccaatagagaacaaataattataatcaaacaagatgatagtgcaacggttatcgttcaggcacatatccatctataaaatggtgccgttcaagataacccaacggtacaaaagtcatcacaagttgaaagagtttgacagcaacgttaatctgaataacaggccaaaagcaaccttaactcattcattgataaatttcactctgaaaaggattgacaatttgatttttccaaagcttgaagatgatgcagactccagtatccaacttgcatcgaagaggtcgacttctaatcgcattaagagcataatgaaaaacaattctctacaacaagagctttttcacttgaatgacattaattatgtcaattatctatccaaaattaatacctacagagctctccctaaagagctcaagcacaagtttcagactactctcgatcctcactatcagctccaacttcttttagattttaatgaaaaggagaatccaaacagttttattaagctggatctattacttcattgttacttgaagattgcaaacaatattgacgacgccatgttatacaaactcatctgtaaactgcttgacatggaatggtatcataatagcacactgatcataagggcctctggcttgaatatcaactcaatttttgagttatttggcaaaatatttcaatactgtgaaaacgatttgaataatcggttcttgtactaccagttattgagtaagtacctagaatattcttctagctctatgataagacagattctgcaagaaatttcgttggagactgaacttgtagacgttttccagttgaacaacaatttgcaatcaattacaacattggatgaattaatggaacttgaggattgtgtggtgcatcctttcaatactttagaattgctaaaaaagaggatgcaatttgaggaggttagtcatggcgatctgacagaaaagttaacatcatcgggcttgatgaaccatccgggagtcatatctcagctagttcccaaactttatgacaatatcaaccatttgaccacactcttagataatgccaccatcggaaagcaagattggtggtatctgatccatactagttcaagcaccaagaccgtccaacacttgatgaagattcttaaaaatcggcacaaagacttaatgaataaccgcaccattacggaacatatgactgataagctactaaaactttcaggcaccgtgcttttgaggcattacatgaaatatgtgtttaacgacttatctgcggctacccaatccagggttttggtttactgtttgaagcatccattttgcaatgatgacaccaaatttttcactgagacttatcatagatgtcagtccgacgttcagtcactgttgaaagtgctcattgatagactttttccagcaggtaagattgatgcgaagcattatcctcagctaattaaagttttttctgcccatcctagactagaattttttccaagctctctggtgactattatggttaaatatctcgggaacaatccagaagttatgaacaatacacagctacagaatgatattcttcaatcaatttactctatcgttgctaatcaagaattacaaaacaaagtttccatcaatagacacctgaccaactgcaaggggtttgatcctgaacaacttttagaaagtttcacagttaaattattcattcaacttcttacccaagccacttcagagcgttcaagttatagaatgtttgcctcagcattatactccacacagggacctgcccgaattttcacctacacgaataagctctttagatttgttccccaagatttactttcaaattctcaggaacctttgagcatattcatagaaactttgacaaaatctacggtcagagacctaatctcaacagtgccacacagcaataagcattcgaaactacatgctgaaatggaatcaaggattctgggccaatgcctaagacatcttgaaacactgacaatatctgagccacacttgcgttcaccaccaccatcacactcagacgcaggctatcgtatcaaattaagatcaattgcatatttattagaacagtccaccatcagaaacatagaggatggggcgatctacctgaaaaagttaaaagaccaggatatgaaagtaccgaacccattaataagagcatttctatcaggtttattgaagaacgagcagcttccaatgataaaacggctacgaatgttccagaaagttacagaccaagaactttattcccataacaactccatgctgggaaggaagactgtaatcactctggtggacacgcttttgcagatagcacttaaagaggagaaagggagcatatatcgactcttatgggctcttaagttagctcatctgaataaagtggacaagaaatattttgtcaagtggacggaaactctgcgattgatgaaaaaacatcgtagaggttattggagcacacataatacatccaaaaagctcaacttcatctaaacagctcacaattgtataaagtcaagaatcctgtactatataataaacacttcacctcggagtcgaacatggcacgctagttgtcattaagtccagaatccaaagtaacatctgtcatcgcctttaaaaatcattcgatgtgcccgatgctcacctaaaaagaaatggccctctctcattggtcaagtagttccatccagtgcaacaaaacatcgtaaaacgacataacaagaaggaaaaacacctttccacgcaaattagcacactcagtcatttcctctgcttcttacaagcctctcaccttgcaatagaacttcaaactgacccagctgtgaccacctaactcctgtggttttgagcccttgctcgcgatttttctacagttttcaagcttgaacctagacaaaaaaccataccaagacagaactacttcctcattattcttgttttaccaaatgtttgctagatctttccgccaggctctgagaaccccaaccagattgactgttgccaagcaagttagtcccattgtcagattaaactctgccattggtatcagaagttactctgcccaccacgaagagacctacgaggagttctctcaaagatacgagaaagagttcgatgaggcatacgacttgttcgaagttcaggtaagtcagaatcagattattggcaaccactgccgtcgattgtcaacgttgtagaatactaacatgcgcttcttttagagagttttgaacaactgtttctcttacgacatagttccatcaccagctgtcattggtaaggctttgaacgcttgcagaagagtcaacgactatgccaccgctgtcagagtttttgagggtttgaagcacaaggttgagactaaggagcaatacgatgcttacttggaagaattgaaagacgtcagagaagagttgggcattgatttgaaggaggagttgttccctgagtctgcttaagttaattaggactcttgctttttgaaccattgccattactaagtgttaaacagaaagatattcaccaaagcaagatcatacttttgttaccttagagaactctatatgaagtttcgatatttataaaatacaccaatgtttgagtgaactggaagaagggtttggcttggaaatgtcatctgtatgcgttgtttttgttggttggtcaacatgtttatttgtggagattatcttgagcccaatttttgaccttacctgccctttcaagaacaacttgttttgttctcatttgcacagatactcctgggtcttctccagcattgtagtactcctttctcctacttacttctagaacgtctgccaacagcctatccccctaccactgtcgctcgagtcctccacccaggatctgcctggccgcgatttctcacggccctatttggcaaaacataaacagggacgaaatgtaaacatcaaactaaactaccaaaacaccttggtacaaacaaaaacgtcaacgtttcccccacaacaatcagtaacattgccgacttgtacaaagaatggaccaggaagataaagctctgctggtatatgttccaaagcccggggacgaagagtttgtgaaggcgagggtactcacagagaatccaattggagatgacgaaattgaaatagaggtcaagactttggaaggggaacagtttacaacaacagtgaagcatctcgaccgggtcaatcctgtgaagtttgacaagtgtgatgacatggcctcgctgacgcacttgaacgaaccaagtgtcctggacaatttaaagagaagatacctggatggactaatctacacttattctggacttttcttagttgctgtgaatccgtacaagaaactcaacatctacgacagaaatactattgactattatcaatccatggagtcctcgttgtaccaacaaccacaattggacggtgactctgcaattaacccaaaaccccatatctttgctgttgcacagaacgcaattcagaggctggtgaaagaacagagaaatcaaagcattttagttaccggtgaaagtggtgccggtaagactgagaataccaagaaaatcattcaatacattaccaccattacagcctctcacgagttaaatcaaggctttgattttgaagagaaaattctacaggcaactcctatcttggaatcatttggaaatgcccaaacagtgaaaaataacaattcgtcacgattcggaaagtttatcaagatggacatcgactactataaaaaaaccttggctggtgcaagtattcagtggtacttactggagaaatctagagttgtcaagcaagatgctgaagaaagaaactatcatatattctatcaactccttagaggtctttctcaatcagaactgtcaaaatacagacttactaattccattactgacttcaactatttgaagtactctcatgctgatatacctaatgttgatgactcgcaagattttcagaatctcatgaaagcactacaggtttgtgacttttccgagacagatatcaaaaacatattcacgaccctagccgtaatattgctgttggggaatatcacctatcacaatcctgatagcgataaacaggcaattcctacggaagacgcaccatttactgaaatccaagagttactgcagttggaaaatccgcaactattgaaaaatgcgatcattaaacccaaagttaaagccggaagggagagtgtgacacaagaaaagaattcccagcaggcaaaagtctcagttgatgctttggcaaaagtcctctatgagaacttattcggcttcatagtggataaaattaataacaacttcggatattctggtttatcctccaacactagcttcattggaattttggatattgcaggttttgaaatattccaaaaaaattctttcgaacagctatgtattaactataccaatgaaaagctgcagcaattcttcaatcatcacatgtttgttttagaacaggctgagtatgtgaaggagaatattagttggaagtttgtcgactttggcaatgatcttaaaccaaccatagaattgcttgaaaataaaccaaattctagggtaggtatcttctcgatactggacgaagagtgtcttattcctaagggatctgatgaagaattcctaaataaacttcacaaaaattttgagatcaaagaagatggggtgaattcgccttatggcaatgctagatacaagccaaccaaggtaagaaatggcttcattgttaaacattatgcaggggacgtgacctatgatgttgatggttggttaggaaagaataaagatccattgaacgaaaatattattgaagttctttctagctctttgaatcctttctttgtggatctgttttcttcaaagttaaaggcagtttcattacgatctagtccttctaaaaagaacaaagggacatccaagactgttgccacaaagcacaaagagcaactctcctcactaataaaccagctgtctcaaacccacccccatttcgtgagatgcatcttaccaaacaaccaaagatcatcgaatatgttcgaccagaaacttatcttggaccagctgagatgcaatggtgttttggaaggaataagaatcgcaagagctggttatccaaacagaatcccgtttgacaaattttactccaactacggctttttgtctaaaaacaaaattcgacacaatgataataacttcaaaagtaactgtgaaattgtattgaacgagttagaactttctcccaatgatttcaaggttggtcttacaaaactgtttttcaaaaatggagttctagccgtattggaagaaagaaaggccgctaaactatcttcaacaataacagggttacagtcgaatatcagaggttttattcaaagatccgagtttgtagataaacttcgaaaacatcaagcggctaggcttatatctaaaaatttcaaagaatattaccatctttcacgcaatgatgaatggtacaagttggcgttaagattgacacctttgatcgaaggagaacgtaaacttgctgaaaagaaaaaattgaaaacaagaattgactcattaatcaaacaggttgctacattggaagaagagaaagtctcattttctgttctcaaaagtgaactggaagaatccataaacgtgttgacgaactccctagaatccgaacgaagcctatcaaacactaaggataaagaacttgccaatgagaaagctcatagtattgacttagagaagagtttatcagatgccaaccaacaaattgaaaagcaagagaatgatggtaaaattgtcaataatgaacttttgactttgaagaaagaattggaaaagttgactgaaatggaaaaacagaagtgttccttggacgataaagtaaagtcattatcgcaggaactgattgctgcgaagagcttgcagcaagaggttgaatcacttaaaggtgccattactaaccgtgaacaaggagaagccgatctcaaaaacaccaagatcctgttggagtcaaagcttaacgagtctgtatgtacattgtttcttcaaatggtaattattacccgtttttttttcaactttgctgaaaatcaagtttactaacctagtatttagaatttaagttttgaaaaagcctctgctgagttgagtaaactaaaggaggagaataatactgttaatgccaaacttaatcaattagtctctgcacaagcagaacgtgagaagaaattagaaaggagagagcgtgaactgcaagacaaagcccaggatctggagtccaggctttcacaagtacaccttgttgaacaagagaagaaaaaggctattgacgactatactgcaattaaagaagagaataaacttctgaagcaaaaagcaaattccattttagttttgaatacaaaacttgagcgggaagcaagagaagccaactctttacttgaagccaagattgctgacgatgttaaatttgagaggggaaagaaggcctttgatgatcagatatcgcagttgaaggagaaagtagaagaattgactaaggagctaagcattgaaaaagagaacagctctcgtgataagatttctctcaaagcactggatttggaaaatgccaaacttttgaaggcaaagaaaagttatgatgttcgaaccgctgagttgaaccttcagctgcaacagtcgaaggtcgcatcgccagccagtccaaagaatattttctctgcttccgatactgaggtcaacaaacttaatttacagcttagtgaggaacaggcaaaatactctgttttgaaatcagaaaagcatgctcttgaagatgagctgaactttgtgaagacaagattagcatctgaagcttatgataacaggcaattaaaggcgaagctttctaccattagtgaacaaagcggcatccccatcgaaagcaacaacttactttcttctccaattaaagctagccgctcttccctttccgataagatagcagttgacgcttctgagcttaaaatacaattggagacagaaaaggctgccaataagaggcttgaaacaatgaatgttgaactacaaactgaacttcttagatacaaaaccctttcttccagattaaacaatcaggacttcagacccgttgattttggcaatgtattaaaggactctacaaatgacttaaacaaaatgagccaagatgaaccggccaattccttgcgtcttaactctatgttaaatgaggccaatactaagctgaaaagacttcaaacaggtgatcacgtatctcagcaacaggagattgtacagtacaaatcaaagattgacagactagtaagacagaatcaagatctgaaggactctttggaactatacaaatccaggtcggaaaactattatggcaagcttgaggctgctgaagttgccgtgaaggcatccaagagaagtgaagagttcttgaggggcgagcttcaagttgctcaagagagaataggtgtcgcacaagagaactatagaaaatcggatctcatggtagcacagcagaattcgacaatcagagaacttcagaaagagctttctgatagtctgtttaacttgaaaaaattgaaatccaagtacgaggatctagaggaaaagtttgagcaagaaacagactttagattatcaaccacttcttctctttctgccaacaaggatagagaaatcgagtcgttgaataaggaactctttgagaagatggaaaaggaagttgaactaaacaagagagcaaagagtctaaccatgcaattggaaaccactcaaaaagaaaacagggccttaacaaacaccacaaattctttaattaaggagaaacatagtctggatcgaatgataactgagatgaagaaagccaatgatgaactgaatgctaaacaaatagatttggaacacaaagtagcaacgagcgtccaacaggttataacctacaaagcaactgttgaggatttgaatcgggaaagaaataatttgttggagtccaagaggcttctggaagtaaaagttgccgatattacaaaagatcttgaagctcgtatgcgaatttatgaagacgccaacagtaatcctgcacatgtctccaaattaactaacgaattgaatgattaccgtcaacaagtcagaactttcaaggacaagattgaggaagacaaattgagattcaaggaatacagtgacaaggtgtctcaattgacggaacatgtaaacatgacagtggaagaaaataaggctcttagtaactacaatgaacaattgagcaacaagatcaaatcattggaagcaagttctaatgaaatggagacgaatatcaccaatcactggagtgaaagagtaaagtctctagaagaaaagctagccgaaaagaagactaaagagtttgatgaaaaccaaaacattttcaatctacaaagtctggtcaaggacttgaacagaaaaattgaaaattatgagaagctgaacgagaggtctcaaaatgaagtagacaacctgggtcaaactatgaagagacttaatgacaagatagaatctctccaggaagaaggatcgcaggccattttgttgcaaaaacaattggagagagaacgagatgaattcaaggagaaaagtttgaagctggaaaaagagctattggatgtttatagtaactaatatgtacatggtatatttaacgacgtgacagaacttagaaccaacctctcgtttttttctttgaagctttggaagcggcatctaaaccaactccaaaagatgccaaagtaccctcaatgtctccataagattctctgtcaccttgaacaactatagtcgggttgcttccggtcaagactttctttgcaattgcaactagatcttcctttgtaactttgctgattttatcacacatctctgtgacatcaacttttctgccataaacttgaatgtgtcttcctagttcttctaattgaaccatcttgctctccaagttcatcaacaaagaagaccgtagctgatttttggcacggtttacttcggcattggtaagagcacctttgcccggattttcagaaaacaagcagctcagttcatgacctaagagttctgcaacaactttatttgcctgcggaatgcttgaaattgagagaccaaacagccccgagtctgagaaattgtgtatatatgaattgcaactttcaataaaaccgtactgattcagaactcgcgtgtatgctctggcatacattccttttcctggaccaccagcagagaaagatccaccaccaccgacgagcatctgcaaagtagccagtgagtagacatcgtcagagtccacggggacaccttcaaatgtaagatatatgtgatgaaactcgggaagcccacccataggaggaactggaggcaaagaaagttctcctcctgtatatttagcaggttctttgaccactggactggaaccgacagatttcatatcgcctaaatttttatcaacaagttccaaggccttctcgtggggaactcccaacatagcaacgaccaagttctcaggtctaaaaaatatttcacgatacttcaaaagggattctcttgagatgtttgctaaagactccttcggacagagcagcggggaacccaaattttttgatccataagctacctgttgagacaattcgggaagaattaggtcaggttgcagccataactcatccaactcataatctgctgttgctatctgattagaaacttcctcctcagtaaataaaggttctttgactgtagaactgaggatttcagccatcttgtccacatctttgttgaacactgaagcctggtatatcaatgactctcttgaagaggcacacataaagttgccacctaaatgattggtgttttctaccatagatttcccatcgaatttggatgttgatttgaatgcaagtctatcgatgatgtgagagtggccggttaattctggaaactggctctcatatcttgaaccagcatcaacgaaaatgcccatggcactaaaatggcccggagcttcgtccgttacgacacgaataccatttggcagtttggtaagctttgttggcatcgtcttgattcccgtagaaaaccgacgcttgaactcccttccagcaaactgtctgagcattagtaagtagagtacgatgaactgcaagctctagattcagctttactaagactttgaataatctcgaaaatgattatataatggtgaagccattattaggtaatcggtgcttaatatatgaagatggagtgctaatctataagtattttcttctctactcattgtctagatagttcaagacttctaatttgcgtttttctagttcctccaatttggagagttcgttcttcaagatcttgatttcctccttagcaagctcgtttctgtcctctaccgaacttccttcgctatcagtatttctgtggttcttgtagagatctctaattttatgcctgtagtctgaaatctcatcatcaaggctatcagaatcatcagagtcttccctcagatttttaaatttccacttgtgggtagtaattggcatttccgaggtcttttcgtcgtccagctcgacaaccttctcattaaggtcactgacaagctcgaggcagtaatcgtggtatttctccaacgaagatcggtgggagattgtgattatagtcaatcctcttttcttgagaagcttgaaaagataatcttccatgtcgtaagaaattgcgttggttggctcatccaacacaacataagtcttattgtggaacagtactctggcaatgatcatcttctgacgttctcctccactcaaaaggctgaaccaggaattcttggatatgtttccactatctctttcagtgccgttgcttgccgtaacattgtcgttcttgatggagggcctgaagttcaaatcggaattgaatctttcaaacagatattccaatccgacatccttcagtaacccaatcagcaattcatcatccacttttgatgtctcactcgataatggataaatgatctggtccctcaaagttccggcggataggaagtatggcctctgaggaacgtacataatgttagagtcgagaggtttcgatagaaggccttcatagatgggccacaaaccggccaaacacctcatgaacgcagtttttccacatccattctttccgattatcagtaaattgtttcctttcttaattgtaaaagaaagcgattcgatcaacttcggaccattagctcctttaggcgaaggtacaataatagggatattctctaatcttaaaccatcgtagttggtctggatgataccattgatgaatcctaaactcttcatgttttgagaactgagatggttcaaattggtgaaagaggacaatatcctcaaagatggtagtcttgcaagggaggtttgttggccattggtcaaatctaatccatactggaatccactatcatgcacttgatgcaaattcagcaataatgtgaagattctgtctgtataaccagacaattttgaaacatctttaattgaatacatcaatcgactacccgcatctgccattgagagcattaatcttttgttgacaataaaattcttcatgtttttggatgaattagatgtcctcttagatgttggtgcaagaagaatgggaatggcagagtaaagatatccgagacaagaccatgtgtatttaagaatgtagtcctcccagaacccataatggaacctttgtaccatttccttgaaaatttgtttctgaagatccccaaagatactcttgatttttctattctcaagagggatacctttaaagaaagatatttcctcagcattgtagatcaggttaaggttatagttgtaatagataccttccaagtttgcctttttcttaagcattttggaaaatttgggggctttcaaacgtaggaaccaacaggtaatgaaataatttgtgaagattccaacaattcctgcagttcctaaattgtctctaaggtatattgcaaagaaaatcaaatccatgaaaggttttccagtgttggtaaataaagaagccaacgtcgaggtgaactgtttgatatcatcggtgagatactggtcgatgtatttcgaatccagctgatattccttgggcaacatctcgttcgtgttgaactgcatcttgtagaaaactaaacggttatccatgtagagatcgtggcaataacgtaataagttggttctaaaactcaatgacaatcgtttggtaacatagcggatacttgagtttgtgtaggatgcaggaacagctaaaagaaaccagtagatgatgtctctgataaactttttcccttgtaaaccaatgagattcttcacaattgatccatctaacttggttaccagcaatgttagatatgttcttaatattagtaaagataactgggcaacgagaagatatgagttcttatctaaccatttcgggatcagaatcagtttccagataatgaacagtttatttaaaaatctggagttgatagctttccagaaagaagtggctcctggagaatccttgagaagcatttcttctttaatgtattgcttgaagaccaaattgtccacgctgatccgatcatagtttgggtagggaatatccacggatatggtagagtttttgtatggaacctcaatctgctttgcgattctgttacctctttgtaaagggcggtttttgctccgtttgagcaaatagtttctgatattctgtattagctttgctatgttataagcgctgataccagcaacggaagataatacagctgtcaagaaaagaaggactggcttagaggtccaacggatgttcaactgggccagccatttcaactgccgcttgctaagtagcttatgaggtaagatgaggttgtccatctaaagacgtcaaagagggggagagcgctgacattctagagcagttgtcagggcttaaatatccgtctcttttcatatgataattggggacaagtttgtatgcgggatgcagatgaccagagctactcgcatgtgattgtggagagagtattcagttcgcgcacaaccctctgtgtttggttccatctgatgcgactttaaaactgttgtagttggtaaagctaagccgcacgatcagatgagctttaaatctaagtgttaataaggctgaacactgggtatttgagcgtatttcagaagtaacatgtgtctcaaagaactaagcttgatgctgtaaaagtgtttgggggttttggaacctaaatttggaaaaataacgtgcacaatctgttttaagatcagtatacacggagatggctgaaatttgttttgccctccaacttgcaagaataaatacaagaaatacacacattggatccagtagaattaatcagtttcaccaactttaccttggatcacagactgtatataaccttttgtcagacttatgaattttgcacccctgtcgcatttctcgaattgaccaccacctgataataccgagtgatatttataaccataggatgtcgttatcaacctttctaggcgtcacatatgtcacattgtgggtaagtgcctccaactgaaagtattctgcttctagaaccttttattaacaaaatttccagtccctttcgttctatcctcctctgatagttaatttcaaactaaaatcgtcagatgcaatatccatagactttctattgttgaacaccttgggctacgtcacctatttcatttcattatttcttcaattatacagttcgaccgttagagtcctttacaaacactactaccatggtttacctctactttccgccatcgatcttctattcgttgcccatggtctgatactgaacctgatcacactcagccagctatattgctacagagtctggaattttaagagacgaagcttgaggataagttttccaacatatctcttcttcttcgtattcttcgccttccaggctacgtattatatcttgtctattaaggatgcaaccacctacaatttgatggtatatacggtgaatctttcgctgtggaaagtcacaattagttttatcaagtacctcccacaactgtacttcaatttcaaaagaaaaagcatgatcggctaccccataatgagtatttggctggaccttttgggaggcatatttgccatgcttcaattgttttatgactattctttagtgagtgccaagtgggaccttttggtgttggttagtaacaataaaggcaaattttggctctcgatggtgacatttttctttgatttttgtttcattgttcaatattattttgtgtatcccagccgggcagttaatcatgaggaagacaaaatgatgagtagagtctgattgcatttatcaatactccacatcctcactttcgtactttgcaaaatcgaaagtgaactctctatacaattcatcagaatccagctcttcaaatccgtaagttacattcgctttgaattttcccagctccggatttgtcaggggatccaatacttcttccggtgcaagttcccttttaatatccatcaattcatcagagatagaattgatcttcatttttcctctcaccgtttcagcttctgaaatcgaatgagcattgctgatatacttatccactaatctatttctttcatcttttaattgtcgatactttatttctaatctgctggtcaacgtgaatcgtagagttcttgtggttataggagacttcttcattggtttgaaaaaatcagacaagacgttgtgctcaaatattctagaatttctcgcatcaagttcttccagttggtctgtctccttgataaaaaaagattccaccaagtcactgtctatcatacagaactgttctcctttgataaaactgtctctacggggtattttgtattcgggtgggactcggttaagcttcaccaagtgctccttctctgccatcattatcctggcagtcaaagacttcgtgttcgaatctttaagtctagtggcatatttctgtctgacgaaatctccagcaacgacctttttagaaggttctaagtcctgaaacacggttcctctaatctcttcgtcattcacaaaggcccagggtatgtctaaattagtagtttctgtgttcatttccgattctctttttttatgtgagttttttttttcttcctttcgtctctgaaatttggaaggcgccagtatggtgatatttccactatcgcagtagtaacttcaggagacgacatcttgaaaaatgacaactcaacattattcctagttaaagagtgggcttgaagctgatttttaatgattacgaagatcagatctcgaagatacttcttggctacgtcaaccaacagttgtgtgacctgcaaacttcctgtcgtcgattgttctgggttaaacctcacaagttctgtgggatgcatatcttccgtgtcttcaactaaactttcgtattcctcataatcttcattggctgaatcatttgagagtgattcagaggacaaagaaataggcgtattatcaagctcttcatcagaagaaacttgggtcgcttgggtagcatccagttcatcagactgcattggctcattatgctttgatgtttcagactctgattgtccttcgttattctcaacgttctcctcgttgtcattgcattctttttgtagcttctgatcgtcaccaatttcattgccagcattctgtttcaatataccgttgacactctgaacttcttcatatcgaccattattgtccacattttcattagcattctcgagatcaagttcttgcaagaaacctgcctccctctcctccaatgcaacataagtttcactcatctcgtaacttatgggaaagtctttcatgctaaccaacaactttgaggtctcttcatttgattgacatactgccaattccttcttcatcaaaaggtaaaactgtagaatctccacttctgacttttctggcaaaagttcctctttaataaggtcaacttgattaattgagaaacgagagagaccattatacaagtggtctctctcatctgccgtccaaacacattgagcattgattttggtatccttccgaactttgtggaacccacgagtatccaccaccagatcgtccctacatttctcaaacacaaagtctacgaggctggaactctcgtactgatgaacgtgaaattgacgccagtaggacgcgttccccttgaaaaactcagatggtgtcggaacaatgtcgtcgtcagtggtactattttgcgttacttgccagggccttattcttcttcgtttgtggccatccttggctgtggaataaatcatccaattactgaggactaccgtctagctctcctctttgtatcgaagctctcccgatgctggtattgcataatagtatagatccaaacaccacaaagttttctcttcgtagtgtaaactgggttgcgagccccgactacagtagtactggctcctttcttcactcgagcgagccattggttttttttcagtccaatcattggttaactagatcacagtctaattgttcactacctctaacacaatgttgtcccgttcattgatccagtctacaaagaccgccaccagaaatgtgcgttttgcctccactaatgctagtaagcagagcattgttgagaaggtgaccaatttgtcatcgcaagttgtttactggggaaaagtcactggtgaaattgccaaacaagtttacgtcaaggaaggcctgagtcctcctaccaccacccagatccaaagtgtttaccaagatctctacaagaaggctttagaatcttttgctaaccctcaagctgccttccaatctgtcaaggaatccgccaagaacctcaacaaggatattgtcctgaagtacggtgcttatggtattcaattggttggtctgttctccttgggagagattattggaagaagacaaattgtcggttacccatctttcggacctaaggctgctgcccaccactaatcgtgtataatattctacttttaaatttcacaggtaaattagaccagatttattgtaaactatgtactctacttaccagatttgcgtctcttggaggactcgtatagtactcctcttcgtttcctttcctctctaattactgtgggaacggtactgatggattctcgctccacaccttttttgattttggtcagctctttctccgaaagtttatcttcagtctccatccagctggcgtaaccattattttgttcactctgtttcaagacattaatgatgggtttgatggccaaagaatcctccttggtgaaaaatgtcactgctgaacccgtgtggccagcccgaccagtacgaccaattctatgaacatatgcttcagctgatgtagggacatcgtaattgatgaccaggttgatgcccttaaaatcgattcctcttccaataacttccgtgcagatcaagacccatatatctcccttttggaatctttccacaactctgtctctctgtatttgggtacgctcggaatgaatcacatctacgttcattttgtcatagatcagctcatggaataatgccttggctctggtgatcgattgaagaaaaatcaagacagggggcttgaattctgagttttgaaccatttggcgcaaagcaactaactttccctcctcacttcctgtgtagactactttctgcttgatttgcgtgtttgcagcttccttgcggccaatgttgatccttataggctctttcattactgaatgagccagctcttcaacttcctcggggatggtagctgaataaatggacatttgaagctttgggttagaacagttgtgaagaacatcatcagtctgttccaaaaattctggggcaaacaacttatctgcttcgtccaaaacgagatgcttgacttctctcaaatcaatcttacccattctcacaacttcaatcagcctcaaaggggtagacaccataacatcgtacttattacccttgatgagatcactgcgcaattttccgcttagtgacttggagagcaaacctattatcaaattcttgccctttgtcagcttgagcagctcattgtgaatttgagtggcaagttcttttgtaggagaaagaatcagtcctctaatcccaaaatttttctgattttgtcccaatttctgtaccaatgggatcaaaaatgctaaagtcttacctgaacctgttggggcacaggctatgatatcatgcccatgaagagtggaaggaatactttcacactggattggagtgggttctgtgaatttggcgtccgccaagttagataggagtttcttgtctaattggaatcgagttatcaaatcctcaaacgagccaatggggaagggaatgtcgttccctaccacctgaactttgaaagcctttctgaacgctttagcatcggattcgctgacaattttaggaggaggaggtacatattcctcctcttgttccttttcaatacctgtgttgctgtctgacttcgagttgtcttccttaagatgatacttcttagtatgaaaaaaatctagttctttgtccacctggccaccgttcgacttgacagaagcagcgacatctttgtcactctgcgagacggtcgcgtagtctgtaaaggcgccctttgtcttcttcagactggcccctctacttaacactctaaagatatccatgtttagtgtgattagaatatttattatcccctcctgtacgaaaatcttttttatcgtattgtcgcgcaagaagaggaacatccgtcatcttgcacaactcacctgaacatcagcgcgcgctacttttgtaaggccgaaaaattttgtcggcaacgagacgaaatatcagttgcacttaaataggtcacactaccaatagggggatataatacaatgctaagaacgtggatacaacggaggagcattgtaatggtaaaggggactcgtgtccagggagccgttagggacccctccgagtttctccgcttgaagggtagagaatacggagttacagacggaaacattggtcatttgaagcaatatctacagacaacacaaacgggcaaatacagcattcccgataacgaattactactacaaattctcacgcataagtcctttgctcatgggctgaaaccatacaatgaaaagctttccgtgattggatttcaattgctaaagttgcaaagttcagtgcatgtaatttcaaaaccttcagactccccatatgcattgaacggaaagaactttgactgccttggctccttgctcactaaatcaatcggtaaccacaagtctttggctcgctttgccaaggagaaacaatttgatcagctagttttctggaagaaacgtgatcctacattagaagacccagctaccagtggagaagacacggtgttgggaaagacagttcttgctctgatcggagctatcaatttaacacatgggaaaaaagtggctacagagttcatcgagactgaactgatgccgttgttggtagaggatgtcacgaggtgacctgtatatattatgtaaatagaatgcatgacaaaattcaactgctggcacaattgacgttgctaagtgatgctgatgatctggtttccactatataaactcctgtgtacgtgctggttcactcttactccacacctccctattcggtccctctttctcagcctcagttttcggcttatgtaatgacaactacaacacgtccacgcgttttgttcccttttcaacaacacaaaatcaaaacatttttgttcctcctaataattttctagctagaaactggccatggtagtggagcaagatttggtaaagtaccacagtgagctgaaggagttcctgaagaaaaattccccaaaatcaagggcatcatcgcatgtcacacagggtaaggaaaagctactaaggtattcccgtggacagttttgtgagctatgcacagacgtctacgatgagatgaagagaagaaacgacagaacgaatcaggagccagatcatttgctccccaaaacgacttttcatcccaagagaaatcaagcaagaaagattttgtcctccttaacatttgctcgcttcacggatctcgtaatggacactgtttcagaaattgagagaagagagttgcatcttcccactaaaccagaggagaataacggaaacattcttaggtccgcccaaaatgacgacattccagtcggtgacactagtttggagtcagtcaagagagacagcatagatgatccagtaactcaagatttaaagaatgcccaacttgggatcaggacgaaaaacgtagttccaaacaaaacaacgttggcttggtcgagcgacgaagaggatgaggataatgatgacgaaaacgagatcactcgtggccacggctttgattctatatcttctcccgtgcgtgttgagggaactgcttccccgcaagatgtccagaaaatgagtactaatagattatcagatgatctcaatcagctggatttgtcttcaaaaaacccttcagtttccattcctccaaggctgaatgtaacgactagtcctgatttaaacctatccgctgccaggggcgttccaaatataggatcccctcaacaaaagagcaaatctatcatgtcggaggattctccaaagtacaatgaagtgtcccagcttgagaaagagctcaatacactaaaagaagagaatgctaggttagaggaggctttggatagcttcaaaaaaaatcaggccgcctcatctgaaacagacactgagattcaaaatttgaaacagactattgaaaaactagaacttgaaaataaagagaaacctctattaatggactctttgaagaatgatgaaaacaccctctcattgttaaccgaagagaatgccagtttgaaagagaaaattttatctttgcaatccgagcttgaaaaaaatcacatatcgaacaacatttcaactactaactccactaatgaagaaactccagagtcagagctgaagcgacgatctaatcaatccactattcatgagcaagaagttggtaaatggcagaagaggtatgaaactttgaggtctacgatggtggctgaacaaatctctgtgccagtgagtactgatgatcttaataagttttttagtcctcaaggcgtcatttccaagaaagcaatttcagatcttcttgcttcagtagaggcgttcctactgatccttcataaagacgttgtagatccagaaaacctgttttcaggtatttcgtcagtggctgtcaatgccagtgtgatcatcagcgaagtcgactcaatttcttaccacaagaagaagaagagtcctttgaatgctgccatctccaatgcaatcacctcagttcgttactatgccatctacaagtctgtattttcaaaagtggctgttgacagtgctattagtgccattctctacacaacatgtgacttggttgcaattttaaagattcagaccaacaccaatgcttccaacactcttgaaaatgtagcaactgaagagaccgcatcatcgcgtgcagaagtggccgattacaatcttagccaagactcgttgaatgtagatgatgataaagacacgcttgttaggcctttaaagattacccagagaatttcttctaacaaaacaagtggtgatattctaccttctcctatagctaccaacgttctcgggttcatgtctcctatatccacatcattcggtcacagagctgtaaattctcaagtttcgccagatagtgaaactagctcttttgatgttcaattggaacgtgatagattacttgagcgagcaacggctgtggacttgaatcagaacggtaacacagaatcgaatccacatactcctaagaccacgtatcctccagcttcaaagcaatcaactgaaagttccaaagaaaatccactaaatggcaattcccaatcccctgatgctagagcttctcgtggttctcgaggctctattctgaatagggttaaacaacttgagacagcgtctcaggacaatgaaccagaaaagagcaagcattcgttcaaaagatccagtgtcgatgtcagtgacgcttttaataagtttggagccaagagaagatcggttgactctaatttctcttctcaaaggaattcaattgacaccaaatcttctacaagaaactcggtcgacataacttcagtttccaaaagcccatatgacgctactttaaatcaagatagctctgtcgcaggatctgattcaaatgcacttggaatatctgtgggcgcaacaaacaatttaccagatcccctaccacaagaatcgtatgctagacccaattccattgatatagacgacaatactaacgaagttacagttgactctgtcgaacagctcaagatacattcaccccagaaagatgtcaagataccaggaacgtttgaaagtaatgcacagaatgatgaaccaaagaaactaaactcaaatggtggttcagaccatattatcacaccaatgaggttaaggaaaattgaatcagcgtcttctagggctgactcaatagggcagaaaagtcttcctccgtcacctaagcaagagcctaagataatatcgaacacagttcaaagtgcattgatgactccaccagagactgctgttgcaacggacaaatctgagaatttgcatccacaacagtttgaagaaaacgaagaagaggccgaaacatttgatgtgcagaattttgatattcttaatcccgacaacacgttgaaacagttactattatacctggaacaccagacagtagatgtgatatccacaattcagacgcttctcaaatccattaaggatcctgatgctaccagaggggaattaaggatgagtgctagcgcaatccacaaggtaatcgatcaaatgaccgaagctacaaatatttccatgagccaaacccgaaatggtcaattgagggcgcacggctcgtgggttgttcagagtttggacggctgttcccgccgaatggctgcgctttgcgtcttcagagatgatgaaaatgactccgattatgcagacaagaatttcaagcagcgtctcgcaggagtagcctttgatgttgccagatgtacgaaggagttggtgaaatcagtcgaggaagccaagattaaggacgatatagctgttctagatgcccgtctttccggagaacatgtcttataaatagaattgagaaacaaatcattagtagacttagataccatttcatgccattgccattctatctagttgagtttgaacacctacgcctactaccagcattcatacccactttaagacctttcgtctatacctttacatgcatgttcgagcagagtcaaaaggggcggagggtttccaaaaggggaactcagcgaagagtaattcgagcgctaaatcacgtttcttactaagaatggcataaaacctaccccttaagccaaccttaaatcttactcttctttgctttcttgaacaactgctggtcatgattgatgagaagcaattgaatcaacccaaaaggagcgtcttaagacgtctccatatgctgtttctgccattactagctatctcctttttcctgatatatttaagtgatatcacacagcctctcttccgtgcccgaaaggaagacgaaaacccgttggaaatttacttgaaggcattggaaacgaatgaagctcacaaatggtcaaaggtgtacacttcgcagcctcatttggccggaaccaactacggattggttgagtttactaagtccaaatttgaagaatatggatttgaggccagtgtcgatgactacgatgtgtacctgagttaccctattgatcatagtttggaattgtatgagcattctgaggataaaaatgacaagctcttgtataaggcttcgctgcaagaggacgttctctctgaagacccaactacttcaggcgacgacctgatccctaccttccttggttacggtgctaacggcaatgtatctgcagaatacatctacgctaactatggaaccaaagaggactttgaggatttggtggcccgtggtgttccaatcaaggggaagatcgcagtcattagatatggtcaaatatttagaggcttaaaggtgaaatttgcccaagaatatggcgcaatcggtgctgtcatatacagtgacccaggcgacgattatggtatcacccctgaaaatggttacaagccttaccctcatggtaaagccagaaacccaagctctgtgcaaagaggttctgcccaatttttgtctgtttatcccggtgacccaaccacgccaggagttggatcgaagaagggagtagaaagagttgatcctcatgctacaaccccttccattccagtcttgcctttgagtttcaaagatgccttgccaattttgaagaaacttaataaggaaggattgtctgttcctgactcctggaagggaggtctcgagggagttgattacagtaccggcccagctaaaaacattcatttgaacctttatagcgaacaaaactttactattacacctatttacaatgtctatggagagatcaaaggtgagaatgctgacgaagttatcattattggtaaccatcgtgacgcttggattaagggaggtgcttctgaccctaacagtggatctgctgctttgattgaacttagtagaggtttgcacgccctaaccaaaacaggatggaagccacaccgtactattgtactagcttcctgggatgctgaggaatatggcttgattggatctactgagtttggagaacagtttgagaagttccttcagaagaaggtcgttgcctatttgaacgttgacgttgctgtagctggaactcatcttcatttgggtgcctcgccatctttgttcaaactattgaaggataatgccaaagaaatcactttcaagaattcaaccgagactttgtatgacaactatgttaaagatcatggcaacgacattatttcgaccttaggaagtggaagtgactacactgtctttttggatcatttgggaattccttcgcttgatattggtttcattgctggaaaaggtgacccagtatatcactatcattcaaactatgattcgtaccactggatcagtactagtggtgatcctggatttgagtatcataatgtactggccaaatatttgggttcgttggttttgaatctctctgagagagaggtgttgtacctgaagcttcatgattatgctaccgaattgctcaagtacctcttggaagcctacgcccaaatgccagaggaatgggacgatgaagtaattggtttcagatcttcctcgtgtcatcgtgcgaaagcatctcatcatggtaaggatcctcatcatgagggaagacgccatcacggaaaaggattccattctaaaggagggcctcatcatggggaacgccatcacggaaaaggattccacgctgaagggggaccccaccatgagaaaggaccgcatcacgaaaaagggctccacgtcgaaggagagccccatcatcagaaaggacctcactttgaaaaaggattccatcatgacatggagatgtaccataagaaattggctcatcacggtaaagaacccaagacgaagctaaagcacttgaagaaacaagttgagagtttaatcatcgatttcgccaataccactcaaacatatgacgcttacactgacttccttcagaagcaacatgagattagggattctctttcattctgggagaaaatcaagctacattttaagatcaaggcagctaacttcaaacttaaatattttgagcgagttttccttcatgaaaatggcttaaagaacagagaatggttcaaacatattgtatatgctgcaggaaggaacactggttacgccggacaaagactgcctggtcttgtggaagccattgaagacaagaatctgcatgatgcagtaaaatggcttcacatcctttccaagaagattgatagtctacagaagtcattagagtagttagtctatttggtgacgtcaagtattctatttatttctgtttcgttgataactctctttttttgtttggagtcatacaaagtaaatagttgaattgaattttttacaacgtttttcttgtgattcggtaaaacgttcaccgcacaaagttccgtcattgtaggaagggagaagcaggagttcttgtcgacgaagtcaacgagcttcatcaattctgcaggatcggttatcgtttttttctggggtgtgagtatattgacggtagtgttgtccgaggtaggtatagtgttctgttttgtgaatgcatcgagcgtctttccattagtcttgacagtctgtttatcatctttcttgggcgcccagtaactgaaaagtggatctattgggaaagaaagggcggggatcagcggctgttgtcttagttcattgaagtaagcatgcagtggatcatcagaattttcggtggttgattccagtttccttactttcacgacaggcactagaggtcctatcaattttcttttcttagatacagagccgttgttggagtcttgttccacaaactcatctgcttcggagtcggattccagatcttcttcctcgtcgtcatcttcttcaccgtttatatcttcgccttcaccttcttcgtcttcttctttggaccattccaaatcagaatcgtaattgtaatcaatctccttggattcaattttagaccatggtgatatgggcaacttagggtcaacgtcatagactgtctgagaaaaagtacccaggtatggtaactttgcgttttcataaaaacataggtactttataggcaactgatccaacatactattgatttcactttcattgataaagtttgtgttgatctttgtaataacgtcctctgttttgaattttatcaacgctggattgtttttgaatatcgggatagatatgtgattgtgtgattggttttcttctccaaggattaactcatcaagctcttcaatactctctggcgtcgcctctcttgggtaatagacagaaacattttctttcttgaaaaacggcaaaaattttctttcatagtctgatttttctctgtgatttgcaattggtgatgagatacagttgttatttggggcattttcgtagtcagatctagctggcgagcttggaggtgcagagtttgatgcttttgtgaagaaggaagcaattgtcaattggctcttatccttctcctgtttttccttttctcttaattccttctcttgctgttttttcagtcgagtttcttctcttttctgttccttttctttgcgttctctttcctttcggtctttttcttcttgctttttacgctctttctccctgcgttcgtgttttattttttctctcttttcttccctttccttttgctgttgctctttcttcctacgacgttccaactccattttttctttttttagacgtttctcctgttcttctttctgttttctgagtaggcgctgttctttctcaacctctcgtaaagccattcgtctggccttctcagccagtttttcctcttttgagggctttgaaactgaggaatcctgggtagaatcgggctgttcttgtgtcacaatctcggtttgggacgtgtcaaaatcaggcccactagtgtcttgagaaaactcattttcttggttggacttttcataatcttctatcagtataaagttctcaggctcaacattctcaatgcttgctggatctggttctttcagagtcaatggtagctttaactgagccatttcagacattcttcaccatgcaactgtaaacgcgtggttgatagttgatctgtagaaagtctcattcgatataagagaagacgcgcgtaaacgactttttttaacgcattttggtgtttgggtttagattatattctccatctctcttatcgtagcttgcttcaggaaacgtttggtggcatggagtttgtatcgactcagatacagagtgcctatgaagactacgaggaaaaagagcgccatgatagggatatcaagaagaagttagccagcttcaagtctgcagagtttgggcacaactttgcggaacagacaagccaaaactcaaaccctcgtaaacgcaagatttcggagaaaagtcagaaggaacgacctattagaagcctgaatgctcaggtgttgaatatgttccacgggaatgttgaactgataaagcagcaaagagccttgttgaaagtgctatctggaaagaagaggaaggtcaatgaagtcttgaagcacgttgagaacattgagctggagaattcaacaactcacagagataaagaaaaattgcaggaacaagaatcaactcaagagtttcccgacgattttggagaggtgctttacaccaagaacgaatgggacttgctgattaattctataagaatccgctttcccagattgtcagcaacttcgaggaagactttaaacatgattacagagaagtacaatgagcgtttacactctgcagaagtcagcatttgggatgcgtcgtcaatgccccctattcagttgacttctgatgatattcgggtgttacatgatttgaaggaggacgatgagactgaacccaatgaactagagtcgatttcagacactcgatcagtcattttaacactttcacaggctttaaagcaggataccagcaaaatagtagaagaggagcaaaatatagaagaagtagaaggtggcatgccattatcacaaggcgtcgaagacgttccagactcggagccagaagttttagctaagaacgagagaagtattatttcacttaattctgacatgattgtacaatcatcacaagttgagccaatcattttatcttccgatgcaggaactccgcaaaggagaagagacagttcacagctaacacaaccacttgaagagcccatactaacaacacacctgaagtcatctccagcactgtcaaaacattcaaaaacgccgacgtcaacccaatcgcctattaaacttcctttcaactttagggagtctacacctgccatagaccagcttcccagttttctcgatgattggagaggtgctgtagtatctgacgaatctcaggaggtggtctatagcacagctcagaaccattcacaaactaaatcttcagcatattcgacggcaagaagcaattttgaagacaattccactaggaaaacgttaaacacaggagaaaacgaggatagcattacagtgttaaagaaaacaatagttccgttttacggtaaaataaacccagaaaaagagatcgtctaccacagtattgaagagaatgaggaaggtgaaactagagagataaaatccaagttgatggatagaatgcgtcttccaaacaatgaagagataaacgtaattcctgactcagaatcggattcagaacatgacgtgagtttcttagaagtgatttctgttgtgaaacgtagagaaccagaactggaaggagatttctctggattcaatactaatttattcaacccacctagacaagatacgctaatatcccttgatgagaatgattctgaagaggttttccgctcacagagtcaaaattatattcaattaaataatactcaagatcaaacccaagatccaacatcaaaacagagagaacctactaatacacagctggagccagataatgaagtggtcaatgatgaagagactttcgaaaaatggaagttgttattaaagagcaacccagaaatatatcagcagattgtgaccttcaaaccactatttctgagtgaaataataaagtttttggaggcaaatggcttcctgatgcctaaaccaaaagatgtcaacctcttgaaaagatttttggatactcaaagtgtctgtttcacggaaagagcgcgtaaatagtgttgatgatcacctttttatagatatttcttattgtctagctcgtcatctttaatgaacaaaaaatagtttacgactttgcaaaacttgtacgatgcccatatgtggagcacccaaagacccagtcctttgtaaatcagctgtacaaaggagctatactcgttgtcgtggtaatcactaacaattgtcgataagtgctttccaattgtgaacaagaaaaagaacgacagggacgttattagaagcgctttcagcaacctcgaagttgatactggttcatctgctgatttagccctttttatacggctaaagtcttcgtactccatgaaaggttgtggggatgacggcgaagggtgtatggcaatagaatgagagttcagctggtcaaaaaaatgagatgtgtaagcaaaaagttatgcgaattctgtggatcgaacacaggaccttcagattattgagaccgaagttttcttcagtctgacgctctcccaactgagctaaatccgcattttcctgaatccaaacgggctattattttgttattagaatgttaggtctactggactagatgaaattataaaataattttttgagacctaaaagcctatgagcgttgaaacttaatagttaaaatggttaaaccatgctacttagtacaatcaaacattggtggcgtgctctgtgttcttctaatgttcattggcattctaagtttgtatgggagccatgctgagaaagtaattatccccaatcatttgtgagctataattgatatattaaattacaaagtataacatgagtgacagaaagtcaaaatttctgaccaagcagaacagtgcgaatgagtatcattcgcctaccgtctaaggagtttagaatgtcaacataatgtgtataattagcttatttatcattctttatcatcatgcttgaaaaatcttttcaggtccgagagtcagttcattttcaatattcctgatacccatgagctgatatagtaacatttacactagttttgacaactttaattctgcctgttttcttttgaaagctctagtcagtttatctttggaaggttccttcaaacctccagattcttttgataggttgatggctccttttaagaaagtaattccattcttcaacagtattgctttattggagattgcttggggaacattcaggcaactccgctcaatatcgacatcggctcttgagatcaacgtagaaatcctcaatatagagtactctgaaaaattttgtgcatcctgtggttttaataagtcagtttctttcacaatcaattcctgagcctttttatacaggccattcagagtcgtcaagtacttccatttgtcatcatcattaacctgcacaccatatagtatgaccgtgtctacaaagttctgaacactatctgcagcctgaagaaatcgtttataattatctggtaatttggaatcttgccataaatgcaataatgagtcaaaatccaggcatttcgaagcaagcaaggaagttttggaaatggttaaatccgacattctagcactgggaatctttggaaaattgcttgaaacaacttcatcgagagaagaaacaaattcttcaaaatggctggacactgtcgtcagctgtgattcgttgtaagtggactcgtacgctgtctgaaccatcttgtaagctgattcaattgtatctagaagagtttcgatgtccatgttttcatctgccaactgtgtttgaagaactcgactgaataattcctcagacctagtagcatagttaaacagtgtgtcaaagtctacatcctcatcaaaagccttttctatgagttctgtatacaaaacggcagcattgaaacagatatcgatgtagagattcaagtcttcggcaggtggtggcagattcaatgttgtttgatgtgcaattaggattttatccagcggttgaatcaccgagtttggatccgtctcaaaagtggagatcgtttccaactttgaaaggtcaatttcttcctgtgaagtaaacttcaaataaacgtggaaaagcagccttgcagcattataatgagcgtcgaagtaagccccatctaactttatggcggaattgtaatgattgtaagctctctggtagaacctaagagatttttccaagtccgaactgatccacctatcaccagattcttcgtcttcgatggcctgattccagaactcttcagatgtagtaggagttgacttctgagtcttttttgaccgttgactttctgcaattgttagtagacaaattaaaaaaagaaaacattgattctaaatttgtagcttacttttcattaactccttccaaaaatggaccagatgcttgatgctgtcagaacctttatcttgtttggcgagtcagcgtactcatctcgttaattacatcctaacagcattcggtgcctcagccaagatttttttattcgaacccccctcggatgtctggttccgtcaaatttattgacaaacgcgatgcgcgtatctctcaacccagtgaagcatccacacattcaggcgatgtcccagtggaaccaattcccagaccgagctgccaagttcaaagtgtatgggtctcttctaatggtccacatagatggaccagatacaatggaactggagctaactctgtggcagcctccaaggtcggagatgcaaaccaaagattgggagatccacacggacatcacacaggtgacacattacaaagtcaaggcgtcagctctggtgttcaagttgaagagtagcaagaacttgaattttctgagacagtgcaagaacctaagtggacgcaatttaagtatgctacaaggtctaatcagctgtttccagggtcaactgtcacaagacggaagaataacgatgacgaacatcgagctgctggacactgttcgtctagaatcgctactgaaagatggagataagcagctcgccgagtttctcatcaacatggaccggacaattcatatcaaactgaaagatctggtgtcctggttgtatgagctggataaactatttgcagaggcgaagcgtttattacccacaactgctaatagaagaccagaccaagcactgtttggaatggacaatttttttgtcaagcaggaactggacagtgatggctttgagagggtttacaatggttgtgtcgagactgaagctgataggcaggcccaggaagcagcagagttggcattcctatttggagaaaacccggctgcgactagttctcaaaagggacatactaacggaactgcgctagaaaaattacaccccatcgtgagcttgtctcaattcaagaacaattcttcgttaaaacagtccgtgaaggtacgattttcttcgatcaaaatcataggatatgactacagcgaagaggtgatgattgtgcttgggtacaatgccccttatcacgtcaaaccatttcaaatcaagatctccgatgacttgattcaaatgactctggctctgaataaggacgaggagatccttccgttcttaggggtatcagatctgagacagcttcgacaatccctgcctgagatcaatgttaagatcaaccgaatcaacaattcccagaaaggaacaatctcgctacgaaagctggtaactacagtcccttcaaagggacgtttaatcaagtactcaactgattcttcactggatgaagtatatcattcggctgttactgataacagtttattttgattaagtaatcgcttatatctagttagatatacttatagcgaactaatttaaggacattctataaagttgctgggggagattggacatcctccgggcgcgcagacggggaagggcagaaggcatgaaatcctggtgattagcactacaacaatttcttcatgtctaaattcaaatttggggcccacatcagtacttcgggaggagtgtcgaacgcagtgaccaactcgactaatatatccgccaaaagttttgccctgttcctgaagtccccaaggcgatgggtctcgccaatgttcactgacgatgaagtgaataaattcaaagctctgtgcaaagaacacaactataattctcgtacagagattctcccccacggttcatatttcattaatctagctaatcccgatttggaaaaggaagaaaaggcctatggtgcattcttagatgatcttaagagatgtgaactactggatatagggctatacaattttcatccgggaagtgatctaggatccgatcaccaagaagctttgaaaagattggcgaaaaacattaacactgctatcaatgagaccaaatttgtgaagattgtaattgagaatatggccggccatgggaacttgattgggtcagacctcgaggatatcaaaactgtgattgacatggtagatgataaatcaagagttggcgtttgtatcgacacctgtcacacatttgctgccggatatgacatacgggatgaagagtcatacaatgctttttgggaactttacgataaaacaattggatttgagtatttgagtgctattcacttaaatgattccaaggctccgttaggtgctaataaagatttgcatcaaaaaatcggatggggctttttaggcttggagccattcaggttaattgctaattcagagtttcttcaaggcatcccactcgttttggaaacaccgaacgataatactcctcaattgtgggaagaagaaataaagctcttagagtggttagaggggaaatcaaaagatgacccggcagttttggagagggctgctgaattgtccaagctcggaaagactgaaagggatcagcattcagcaaaatacgcaaagaaagtagaaaagggtaagaagaagacaacaaaaaagggaagcataaaggaccagccaactgtgattgatcaattgaataaacgaaagaagtagaatggtagaataggcttatgtatgcttggagacgaacctctaagtttagtattaagtattgataatcacaataaatgcccaccgggggaatatcatttcccaactttaatgattttctggagaaagtcaattatctcagaaaatgggaatggtgatggggcacctaaagggtctggaacttgagtccaatcagaggacattagtttgacaaaataactaaaaagccaaggctttgatttgaacggaatcattgataatccatcagttgaatggcccagcgtggttttcctcctgtacatttttagacgactacaagtcgcatttcacttctacgatcaagaataggaaaacgtctccgaagttgtcttttccatcgtgctatctataacgttgccatggcctgttggcgtcgaacttgacatttctgatgaatgttgcctccttatctcaggtgataactgtgaagtggctgtaagttgatagataagcacaattcatcgtactcccatctccctgctgcaggacattgctcacgtaatcttcctttccgtacacaactgacctgaccaacacggacactctcaaccaaatgcattctagagtgccgggttattattgttcaaggctcccatgatcaagctgctagagattctcgactttaacacccatactcgtccccgattggtaggctggctgattcattatactcacagccaagatctttattacataatcaatgcaccgatctcttgcctctttgaggcagtaacatgtaaacatacatctcttcttttgctacattctttcactgctactaaaccccacacccaaatgagtttaaggtctgctactgtccgtgctactggcttatctcattccttcagaagatatgtccaccaaacccgcaaaacccctaccaatctgctggataaaggcccccagaaatatgggctaatgaatctacagagcctcaagcaagaatgcagaagaaagggcatcaaagtgagtggaagaaagatcgatctgattggcagacttgtgaaccacgatactaccgccttcggtgctcatggaatctcatctactgccacgagctccgcaaaaggtgatggttcatctattgagttctttaaatttcccaagccagaggacgacccagaaccaagtatttccgttaaagtgccttcgctatcgagcgaagcttcagaaaacacagacgcagtagtaaagaagttgcccgatgaatcgccagagacttatattgatacaaataaagacaacattgtcagcgtcggtgcccaaagcaatgctgaggtgacacaacatggaatgaagattggccatttttttgaatggaaatcaccatcctcagactcagcctataaagatgaaccatttcaaccttcgaaagaacgtctgagtgagcgtgataaagttgttctggcgtctgtactgggattatccttggtatggtggtttctgccaatattctaaatggcctccatggctttctctggaacaagtatagagaagaagagttcccaagtagtgaggttttccagagtgtaccctgttgtttgatgcaactagcgagaactggctctgacgtacgcactacatttggttgtagcctctactctgttttcttcctgttttctgtatagtatctattttccgttttatcgtatcttattttattttggtttcaaatattgttatattataaataaataatgcctcctcagcaagcaaactactccaaaatgctctgtgtctatcggtcaacctcaccaaacaccaaatccatggtaccaataatggcaacggcgtctggcagaaagtgaccacgggcaatgtggtcaaatgctcccaaatgtgcaaatccaggtgctctaatcttacatctgtaaggtctctcagaaccatcggagaccacgtaaacagccatctctccctttggagcctcaatggctgtgtaggtttctccagcgggaacagcgtatcccttagtgtatagcaagaagtgatgaattaaggcctccatatcttccttcatgagagctcttgggggaggagctaccttaaaatcttcaactttaacaggtccagggggcatctggttacagcactgttcaatgattctcaaagactgtctaaactcagtcatacggatcaaatatctgtcgtaacaatcacccttagttccgactgcaatgtcgaaatccactttgtcatatgcatcgtaaggttgagattttcttatatcaaatggtacacctgagcccctcaacatgactccagacagaccatagttaagggcatcctcggcggtcacttcaccaattccaatagttctttgcttccaaattcttgaatcagtcagcaattcttctgtttcatccaacctatcaccaaactgtgtggcccacatgtaaatgtcgtccaacagtcctgcaggtaaatcctgcgacactcctcctggtctaacgtaagcactgtgtaaacgagctccggacacacgctcgtaaaattccatcaacttttctctctcttcgaaaccccacaagaatggagtaagggcacccacatccatcgcatgcgaaagcacagacatcaaatggttcaaaacacgggtgatctctccgaaaagtgtacggatatattgtcctctctctggtacttccaagttgagtaacttctccacagcaagagagaaaacctgttcattggtcatcatggacacatagtccagacgatcaaagtatggtaatgcttgcatgtaggtcttggattcaatcaatttttccgtaccacgatgcaacaaaccaacatgaggatcggaccttagaatctcttcaccgtgcaattccagaatcaatctcagcacaccgtgggcagctggatgttgaggaccgaaattcagggtaaaatgacgaatcttagtccttttgacaggatattcaggatgatcctcgttctgtaagttccaagactcccattcatgggcatcctttgcaaactcctcgtacttgccgagggaagattcaatgccgtcaacctgtactggaaagaagtcattcttcttggtttttacgtcgtagaaatcattgttgtccttcgtttgagcggcacgggcaatgctggagttcgacagaaatcgtgatccaacgcgggctcttgcaagagacttccaacctctttttgcgtgtagtctggcaaacatgatctaggccgtttgtagggtgttgatggaggaccttttttctcattacaactggtgagattcaattgggtagtttgtaggggccgggctcgtaactctacaagatgctgttagatagaaaggatgtgcagactagatgctatgaaatagtcgcgcgaatttacgagaaacgataatgtcggcctggatggatgaaaaatcggatgggcggcgccttcaaatagaaaaattcgcgaaagagtctttaccccagacacgtttctccccccccccccacctcgggtttatcccgtctggaaagacaaagaagtaaattttcaagatcggaatcgccgggtaagtgaccacgactaaatttccacctctatataaagaaactatctacccttctcgccactaaatctacactaaattcatataacactcaaagatggctcgttcttccgctagacgtcccgctccaagaccagctccaagagctgctcctcaacaggccagacatgcatccactgccccagctgttcaacaccaggctcctccagtaacccacgctcaacctcaacagccaggtatgttcgcccagatggcttctaccgctgctggtgtagctgtaggttctaccgtcggtcataccattggtgccgggataaccggattgtttggtggatcgtcctctgctccagttgagcaacagcaacaacttccagctgaacaacaatacgcatcatccgcccaagtcaaccaagaggcagcccgtgcctgtgacgctgatgctcgtaacttcaccagatgtttggacgacaacaacggaaacttccagatctgcgactactaccttcagcagctcaaagcttgtcaggaggctgccagacagtattagagaaaaaaagtaggtacgaagtggttactctagatatttattacctcctgtgtatagactaattaatcaaaatgtttttctatgattggtttatgaggtcatctaacaagacactgggaggacgtcgtttcttcttggaaggatctctttttgagctaccattggaagaaatgttgggagtaacgctttgcctggaggtgtttcctggcagcatcgatgaataagatccggcattgctgtcaaagtcagtaaatgagtcaaattcattgttagagtagggctgtaccagttcgcccactggagagatatagcacgatgctctggtggttccaattttatttattgaattcttgtaagatctaccctgttgtgcaaccatgtcgttgagatccaccaaggaagatctggaattgagcagattggcagagtaaattgaatggttttctctcgtcgtggcatcgtttgccagtttattcagggacaacgtagaatgatttccaaaaatagtgctcatgtcgtcatctgaatcgccagaattgaactttcctttattgaaaatgtagtttgtattaagttgttccattaagtttcctgtgtcagtatttttctttgaggtgtagtagttgtaaagtctatgcaagtagtagagaaaaagaactccaacaagggcagagccaacggctatgaagactgtgccattcaaagctgtctctctatgtataaagggatcagccgaggtcggcactgtgggagtgaacgtgactgaatatgatgaagtggtttttgtgattaaagttgacatttgaggcatggcggttgagtttgtagtggtgctaagtcttccaggtcccttggtggaggactgtgatgaagatgagtctgtctcggaatcagaaccggaagtaatggttgaactggaacttgctttagaggtggaagatgcagttgacaaactgggtctgttggaactagtactagaactcgtcgtactttctgtatcttcgtcgtcatcatcttcgactgaagtggtttctgtgtctttatcctcagttgtggtactggttctctcactctgtgatgaggaactcgcactagaagttgtgctagttacactagcacttcttgttgaggacgtcatgctggcctcagaacttgacgttgaagctgacatttcggggttgatgagctgtttcttttcaagcctttgcggattgtgaagtatttatttgactgcttagttaattcatgtatgacacggtcttcagttatgaagggatgacatgatacgagacgcgttttttcggaaaaaccacgagggacgatgtaaacattacttcccgacttcttaatcggggacccgcagtgcatatcgaaccttttgcctattgtatccaccctccactgaagaaaatgcttgactattgttggacaatcccttatacagcagagtttccaccctttggccatgccaaagcacttttggtaggtgaaaagagaacaccctaacacctccgctagtgaaccattatgttgtaagtgaagccaacaccaccatccatggatggcagtctgcttttgacttccattgctcataacaacgttaggtacatctgctatgattggaagttgatacctgtggatgatcatggtgtcgccttggtcgaacacgaaaaagacttgcgtctgtttcctttgactcagcacgggcgtaactacgtagtggttgatgaacagaccactgttaaattagcgtccttcgatgatttgttcggtagaattacaaattctgctagtcttcctcttaaatttataaaaaatggtcgctctttgtttttggatgatggctactcgttgtcaatctatgaagtttcaaaagatgaatcttctataaccagagtttcgaagattgaattccccgaaaactatcgttggtcgttgataagggagcactatgtgatcattggtgatgagaaagccgttctttccagccctgcattcaaatccaaagtgactatcagtaataagctgctaaacgtggttacattaatccagaatagaaagtacttactagtctacaaagaaaaatacagcatactcacaacgataggcagtatagatctgtggaagctagtagaagagtatccagtgtctttgcctttaaaaaatgctatcgtttcaccagtgatgaataaattgtatctggtaaatgagaacaaccatatattctccatcaacacgaagaacaataataggaaaaagaataaacaattccgtttgcattatcatttaacccttccattttttgttgcctcttccattgctttggatgatcgtattcttttggtttctacagaggattttggtgtcctaagagtggacactggaaactcaaagccaacatttgaacagtttctctctccaaaggtacctatccaagatttggcattcatgcattccagttcaagggaattgaccaccagagaaggttttgttgactggccggtaacttgccatagaattgttcggccttctaacttgtctcttcatatatccccattcttgatcacacagagtaacctggttgcttccttggtttccatattagatattccaagagcagaatacacgtcgttcaaagttttagactttgacaacgtgtttgactattgggtttctgatagaaataccctggttgtcaggcattttgatctaaccatttccttatattcaaggaacccagaatccaaaatcccgatgttgaagaaatcagaaaccttttttcaagttcccattgataaaattaacttaaaggatgttctcagtgttaaggataactgtatcctgtacaacgacaagtgtattcaggtttccgctggcagagttgaaactttttacgtctccacgcccttggattcgtttgatattataccgaattacggcattgtatattgtgccaacggcagacttgaatttctgtcgttccagtctaatgcaattgattttatccaagctgggagttattattccatcaaggctcttaaagaatctgaacaccttcatatactattcacagacggtgctcaactatattaccgtaacatctcttcacggcatttctcaaacagtgtttccagtatcaagctaccaggtattctagaactagaatttagacagcccgaagtattctgctgtttgacctctgatggaggtttccatgatattatttttaatgaagtggactccaatctatatataaagagacagaggataattggtggtgcatctttctctcgaactcaccataagagtaatgagcttatacatttctggggaagtcccaccgtaagtcatgggctgcagcactgtgaatatacagggttcacgtctttttccctgccgattgagtgtcagaagcccttaatggtttttgaaaattcgttgctttatggtaatagccaggggttctttctgcttcagctaccagtgctctcacctgaaaagtacaggatcatgaatgttaacaagcagttcttttccggatttcttcgctggacattcccccttttgcatactgagaatggttttttatttgctgccatatctctcaaaccggttcatgattttcgaatggaagccactttgatgctactaaatcaggaattggatattatctaccaagagtcctaccctttcacctttagcaatgtcacagttctagatgagctttcaaacttgtccaagttttctcacacagtcaataatctgcatgaatcatttatagttgcctatagcagacctggcgaggatgtattactggtattgtatactcttagaaagaactctgaggggttctacttggccaacgaaaacattaccttggactctatcaaatatgtcaaagacatttcggtttttgacaatcaaataatatgctcaggaactggttcaaaaattgtggaatttaggcatgacggttcttgggccttggaagctggtcgtttactttcttctgacccggatcttcgacagacaataatcttgggtgataaatctcttcttcaactcactaattcaggcttctacgcagatggcgatctgaattgggaagaacagataggacaaattgataagatcgatagagttatactcttgagaaaagatgtgtattgttttgccagcttgacaggtggaaaagtatacattgttgagataaaacaagattttgaacttacattgatcaaccagcagaatttcgcaagcccgatcacttgcatttattatgacattgtatcctgtaaaatattcgttgcaattgatcgggccaggttgttttcaatggttggtgaaaagttcaatttaagtcatattggagggattccattctaaatacctaataacaagatccattgctgatttggttatgaagtctgtatccatgcctggcctgcagtcacgatattagttctatgcttactgaagatgaactaggggaacgaggaaaggaatactgtattcaattctcgtccactcaatctatcaactaagattgaaagtactacgatgactacccagttcctgcacaattttcgaagtagaagcttttgcaaagtccaatcgctttcaactacaataaatatctattttaattataatttgatcggttcaaagcccctaagtcaaacttgatctataaaagtagtgtcccgtcacataatacatactagaccatacataccaagtgaactaccatactcatctgtatcattcgaattattctggcagaatcatgttcatgcggagggtatctataataaagccgcagaatccattcagatgtcgtagtacaggtttctccagattatttgcggatagtgtcaaggcccgcataaccccagttaaacacaatatgaacttgaataggctgagcttgaacacccttttggatgccaaccatacaaaggcattggacgacaaattaatgggtcacaagattcttccttgctccacaatcacagtttccgaagcttttgaccttaaagagttatttcggaacctgaatagccggaaatttcagtgctcattgatcgtgcccgatgagatgatccacgtcaagtatgagaggaatccggaagctacaggaacaaatgatagtcaattccatgatatcttgttcctccacacaggtacggtagttgcatggggtcttaccgagaaacaggtggagtctagtattcttcccctggctgaatcgtccattgtgacaaaatatgagccagagagcgaagacatggattacatcgaaatagaacctcaaacttcagatagaaattcgggctcttacatggctggtgatgtcatggtgatttcgggatctcactataatgatagactgcttgacaagattgcatttgcctatggactggccagatccaccagaacagcggtcatcgaatcgtctttggaacgacacatccagatgacgaaaaaaaccacagagaacctttcaactggaatcaaactgggcgtagatgctaaggaggtgttgaaatcaactggtcgtttgttactgctccgaggaaagttgaacctgtactcggagctgattgaaacccctgatctctactggtcagagcctcatcttgagaagatttataaagatatctctaaaacattggatgtcaatcccagaatcagcattttgaatagaaagctagactatgcaaccgaggaatctaaatcattactggccacattgaacgaggagaagagtgttagattggaatggattattatctacttgatcatgattgaagtatgttttgaaattttccatttttatgaaagatatgtggattataaaaccaaatcaacgtcgacagagcatgtttaaaactcttcaatgccgtcgacaacttttctccaatttttaaagaacccttggaaaaacttgacagcgaggccaacatctttgtatcccacggtagcacgaatactgtgcatggacaattggggaattccaagatcaatggttctagcgccagtactactggaaatactgggtccaatggtccctccagaccttgaatcgttccgaatctggaagtactgcactttatcatcattgagtttagccagctgctcaacaacgaccttgcctaacaaatctgtggccatatggccattcgaatccagcgcaagtgcaatccctgtgtttggcagtggcttgtggtgctccaagtacacttcggtgaaattgggatttaacaaatgtgtgacatctgcagaaagaatcactgaatttgcatatagtctttgcagagtccctggctctgaaattttcaatgcagcgattgctctggaaatggtcgactcaagtagaccacccttggctccctgtctggagagagatccgatctcctcgttgtcataaagggcaacaagattgaaagagtcgtctgtgacaaaggattcgggatccttgtgacgtctgataagcgcttgtagagcagagtaagaacaaatacgatcatccactcttggggcgtaaatgaactcattggaaagaccgcccctagtacctttttggacatcgaatatgtccaaatcgaaatcaatcaaggaggacactggcactcctgctagcttagatatgtagcggagtagttttaaagaatgcttaccaatcaaaggagacttttgttcatcctcagtgggtttctcctcgtcgtttccgtcagaaaatcctacaacgggaactgcttgggtttccttgttgaatggaccgttggagggagtaccaaaatgaggggccaaagttggaatatgagcaacaggatgaggtgtactgttaaccaaagtggtggaaagcttgccggaagattcatttttgtaaattactcttccaccaatacccaaatctctatcccaccagacgtcagacaaagcaccagcatagggggaaactcccaacaactcgtagccatcaaccttactcttattggagactggcttcagcttagttgtgagagcatcgatgtgacttccgatagctcctactcccttggctggggaccagaaactaccaattgtgaaggcagctaaagaggttccattccggattgtgaaatacgctcccgtcttttcagggtcgaataatttggaccagtcagctgcttcaggaagatattcgaatccgcttttcttcaacaattccgccacagattgcaccaaatggtaggtggtggggttcttgtaggtaaactcgatgtagtcatttgcaaaatcgtcaaaatacttctccttttcgttgacatcagttgccagattggaattgtctaagttgacttcagatggaactctctcggggacatctggagatgtgtgaggagagagcacttctggggttgataatccagataggactgagaggtcagaaatgtcatgataaatgcgctgtgcttgacccacaatttcaccaagacttcctgatttttgcaatttcaacaagttctccagcaacgtggctaactccttggtatctgtcatattttatcttttcaagaaccaaggaagaaactgtgtattaggccctgatgagatatatggggtatttatatggaaaaatggctggggaaggcgttagcggagcctccccctagatgattgcgcatttacggtgtggaaccttcccatcgttcccactggcgcctgaaacccagaaaggtaacttaccctcgaaatctgtacattaaacgtgacacatatggcacgattgggaaaccagcaagtgaaacttccagcgatgtgacatttgctcattcgctcgctgcaactacgtaaacattgtctcaattattccatttttctccctataaccttaaattatgtttaacagaaggagaagcagatcaacccatgatttcagcgcctacacaggcgttaatgcttctaatgccaactttgcaacggctaataaaccttcagagaatgcccttgcggcagccagtgttatcggactgggtgggaacagcagaacaaacagtctacagagatcaaactcgttgcaacctcaacacagaacggcctcaatccaaaggtcagcatctctgagacataactcgttgagcactggcactttggcaactcgtacagtgaaaaaatacgtcccttctgccaatggtttggttgccatggacgtggtggtaaccgatgttccaaaaagacaaccccaaaaaacttccagaccatactcccgaaacggatctcgaagcagtagtttacaaaacagaaatagctatcagccccccggaggttttgcgaatcatagctttcaatcttttgaccacacaaactacaaggctgtaaatcgcagcagcagccttcgtcatcggataagttcatcgactctgaactctcaagtgactcagccaagttccaatatgaattacaactatcactattccccaaatgtcgccgaagacactatcttggaagacgatggtgatgtagactacaaacagctaattcagagtctaaattccgaattatcggaaattgatgatgaacgcaataagattctccaagaaaagaaactgctggaatcagagtatcgcagaaaactcaaagagagcgatgagctcaaactcaaaaaacagcaagcaaggctgaaggaactacatgaaagtgaactgcaaatgaagaaagagcataaagaggccgaggaaaggctgctgaagttagctaacgctgaagcagccctagagaaactgaattcagaaccccttgagcagccagttacggttaccgaagaaatagaagtaacggaagtgaccgcatcagttcctaaggaggtcgctgaagagttggcagataatattcagaaagctcaagaagttccagacggttcctacttacctccgagtgaaggtttaggagctcctttcacaatagatgctgatgccattccaactgtagctgatatggttctcaaagaagaggatattccaagtattagtgttcgtgctgaagtttcagataaggaatctattccagaaaataactctgctgcttttcccgagaaggagggatctcctagctccgattatcaagaagatattccttccaccaaggacactgaagtctcatcagagaatactggttccagtcaaaagctcagcatggccaaacaaattcgcttgaaccgaccagagctttcatcttcgcctattcatcctaatagagcaaatgatttttcctcccttgaggagcaaacagtaaattcctctgacaaaccagaagcaaatgacatctcttatgttcctccgagaagtgaaaagagaccagtcgtcgaaaatcccagaccgaaatccgctttgaaaaagcattcctcaattcagagacaatcccagtattctaatggtaagcacgttgagaacaagaaaactccgctcttgattcctctgctgctgcgaaagcatatctatcgcttaccactgctgaaaacacgagaatgaatgctgccaatgccaatgccaattctcaatcactgtctagaagtccaagcgcaaggaagcagatatcgtctcaacaccacatgacttctttgagaccacaaggcacaggtgctagtaatcatcgtttatctgaacctccagctagaagtctcaatggtttcggcagcggcaatattaaagatagctacacttctccagatgctaaacagcgggcccgtgacctttataaaattgcaaattctaagaaacgattctctaccctagataacggtacggagctacagcgatcttcaagttttaataaaaataaagaaggaaccgtgagaaagcctggtcggttaactttgagagaccaggttccttctgaccctagtaaggtgcaaacaactgctgcccctgctcagaatgttcaaccacaaatatctaaaccaccagaatacagctcaagattcaacgactctgattccgaaaacgagaatacgtcattttcaaacttaaaccctccaaaacttcaatctaattttgaagattcaccagaacggactaagaaaaagcaccattcattttcccccttccgatcttccagtcaccaatcacccactactcatactgaagctccccctgccactgaaaccagatatttcagcgaacaagtggagtctaagcccacccaaaagaagaagaagttcggaaagctcaagaagcttttcgggttgaataacaaatagtactattacatactatcatatccttgttttaattaatcaattaattattagatagctattacatggtgccattattatcccttaccaaatcgtttgaacttaggatataaaaaaaatgcgaattctgtggatcgaacacaggaccttcagattattgagaccgaagttttcttcagtctgacgctctcccaactgagctaaatccgcaagttataacaacttttcatccatgggcccattatcaaaacatactacgtcttccttacactttacactttaatatatgtagattatgcgtttcctctaagaatattatttttttgctaatatatacttcttaaaaatcgatcaccttttctccttcttggtcagaaccgatttggtggtcaatatgctgtaagaatgctttatctcccttctcaactgggatgctatcattcagaacatttgcctcagcattgttcaacaggtaatcattatcctcattgttatcattagctgtgaaatcgtcatcctcttcattgtaagctccagtgttgcttccctggcttttctcgctagatctagaagtgtgatcggagtttattcttcggcgaacttcaactgcaaccctacgcccatcagccaggatgttgttaaataagtcacgaacattggtagagcccttttctaccttttgatccaagtgaattgactgcttaaatgttctggtgaaaaaaagttcggaggtttcgtcagccaaaacaaccattctaaaagttggcaggttcaagtatacgggtgctgaagggttcaacgcaggattagctataacagatttcttttcagatccctcactttcttccaactcaatcaaatcaacgttctcctcctctggtaatgcgtattcgaaagctcgatgcaaaaagttactagtcaaagaaagatacctctgggattgctcatgaacccacttttccttatcaaaattcatttccgatggaatactgatctcatctgaggagtcaaaattcttcctcttctcaactatcttttcggcaatttttgattctattgctttgtttgttatctcgtcaaaaagatatccgtccctccatggtgtggtcaagaaaattagatcttcagaaatttgcaatatgccgtcacgatcaactttccctgtgccgttaacgtcgtatatctcaaaaaagttagatatagaggtcataagatcatgttccatcagtttattcattccaacggcgatattctccaatgtgagtccggtttcttcatccgacctccagtttttaaataatttaatcaaaaaactcttttgttgagcaatgttttctttctcttctaggtttatccagtcaacaaggccatccatgaacttggcaaacattttgaaattcataactgaggaatcagatccaacttccacatagttgttgttcagtactgagacatatctatcataaacattcgataagtgttcctctttcaagtttggagttttaggtagttttctcaattgggcctttttcagataagattctattccagaaataacctcatttctattcttagttcgatactgtacaaaggtctcgtcagaaatatgagagaactctctgaaagcaactaccagtagctcctggaacctggtcttgttcttgtaatgaatatcaggaatatgctcatctagactgtgaaaaaaatctttgaatactgcgatgcattcaccatcgtcttcacattccagcagcttctccccgtttatcttcacaacagctaacgcaacctgcagcaatgtttttggaccatttaaaaagaaaatgtccattattctgaaggcataaatcaacggcatcgtgttgagaaataaagacataaaccatggtaaagagacaatcgacagctgaatatcgtgcttgttgaaatgctgatgcatcattggaagtgttttctcaactaaactttcaaaaactttctgatccagcagaacgccatacatggtcttggagtaatatccaggaatgatctgtccacaaagcttgtctagacaccagtatgcctgatcctcagacatgtaaatcaacatggcagcaaccacaatattcattgcttggcaataaccgatttccggatttttccatgaataagcagttaatactcttcttaagcgattaattccctctggattctgatatgcattgtattcgggtaaagatcggtacaaatctttttcaatttcatcaatggcaattgaacttttcccttggtttttagctagtaggtcggtatattcgtgggagttcatatatctgtcgtagatggaaccacaactcaactcccatatttcccctcgcaatctgttgggtaaaccgacatttatgagtcgaagaaaactcttgtcaaagttgatacacaggttgcgaccgtttcttttcaaataattccaccaagcctttgtcttgattctattttgaagtttcacaggatcccccggaaatttgaaaattagtcccagaccgccgggaggaggggtcacaatgtccatcctgctgctaccattcttgcttagtaggaactcactgtagagggtttccagaaatgggaccaattctggagtagctttcaaattttttgtcaagcacgttttcaggttgtaactaaattgttcacaatgtgaccgaattccaacaaactgaatcgtgatgcgtaggtcgttatacgtcaagatgctcaaaagaaagagataattccgactgggaagacgtttcagttgtttgaccatggataaatgaagttttaggcatccggattgtctgtcatatgtgtctctgaatattaggaaatgctgtgaaagatacactttaccagaaagaaaacgcaattgacttagatttgattccagtggtacttcggggaaattcttattgaaactattctcaatcgccaattctgcagcacactcatctacaatggtttctccctggcttatatgatactcgttgcaaaacaactcgtctttactaagtcgcttctctgttggctgtttgtcgaaaattgatagctgtgaagctttagagatcaagttgttgagcaaagacatttttgcaaataaaactggatgcaatctttataacaggtcttcaattggggtcaattacggtttatgctgaaggtggaattggtctttggttggtaggagtgacggaaggtcgggtagggtcactttcaaatatatctctgggcaaagtttcgcgaaggcttgcggatgtacaccttacccttcatgcatccaagaatagatgaagtctggaaggctttaggtaataagtaaattcatctcaattataccttaaaaactaaagtaacctacgtattagagtgtttatggttgggtgaaggacgaattactggctccaataattccggccctaagggtttgattcgtctctttcctctgatctctagaccacgattggaagcctccatattgtgtctagtattttcgtctgttattatcttctcttgtagatcctcaattgggacgtacgtctcaaagttcgaaagttgaggcaaagttttctcaagaggcttggagtgtttgtgtgaggacaatttgtttcctataattttgccagtgtgattaaacacaaccttgaccacatcctttttgaaattcaggaaaaactcttcactgctccataatttgttgaagtaggtcagtttaggaatcttgatagtcagattctcaacatctgccaacgccaacgctccagtccctttgaaactgatagagagggtagtgggacggatttctgctttgtttatcacggcgtactctgcagatcttttcaacatttgagatacaccatggtcaacatcactacctgttaaatcgattctagagccaatctcagacgatcttggactcaaatccatgctacttgatctgatggtagacggagaatccaataacgaagagactgagctgtggctgtcattcttgagaccgtttcctttcttcttaagaaacgagagtattgagcctttctttggtttggaattaccgctttttgaggattcaattgaagcagcagatgataaaatagaagctgaatcaggtatgtctgaatcttgatcatcattaatagcgtcctcttcgtcttcttcggcagaatcttctgtgcctggataaacaaaagtgtaaacctgcctggctgtggtgtggtcaacttgaatcttcaaaggttgaatttcaaactcgaacttttcaatcactgtgatttggcctactggctttcccatcctccaagttatcaggaacatcggttcagcctccttgcaattgggaaggtcggacacttcattgcctattaatggcgccaacgcttcgggatatcttgcacccttacgtaaattaaaagcttggatcagatgaattacaatcttactattgttggcaccattcgtagactggcttcttacaaagtaagagctggctattcccacatccacaaatggcttagcgtcttcatcaagtaaatgaataataagttgatcggtaaaaatgaagaagttacgaccttcagaagaagacttgtttggacccgtcagatccttcacgacctgcatcaggtagaatagttccaacgatagtcttttgttctcgatgtttaaccacaacaccttatccctatcttgttgtggcaagagcgattttatcaaattcatataaagcttcagattctttaacattgctatctcacgctgcaagttattaaccctgttatcaacttggccaagtccctcaaaatcgctgttgaaagctaatgtgttgcgaagcctgttttgcgttttgcttctttcataatcaacatgaaggaaaaccttattcactatggtatacacagcatagtattgagttgaagtagcatttacagttagtgtgggaaaccaaactttgattgtgtctctctttgtcgcccgactctctttgtcaaaatgtaaaggattaggtttccagcatatcaaggcaatggaagtcttttcaaccaccaatcctgacttgagtggcgatccatcatagcacatttcaaaacccaaaaatggtggccaggacgtaccttcttcaaaatggaaatatccgtagtccttatcgtaaaacttctgcttattcaaaacatagtacagagcctcttctaactgaataccatatctccgttcaacgatatcatatgcagcattaaaaccaacttcagtactatctgatcccagtattgttaccacactcagtgaaatgtctcttgaagtcaccaaaacacaattgtccagatcctttaccgatgtaagttggatttgaggcgagatgattttaaataaatattggtctgtgtatgactgttcgtcgtcattcaaggctctaagaattgattcgaaatgtgctagtttttcatcacaaacttcgaacggggcgtccataaattcttcagcttctgaatgcttcgcttctgttggaaacgagttattcataaattcctccgctaacttgacagctttccgactcaaatcaaaaacagcagatagtctatcctctatccgatatatatattggagaatcaaatctcggatttcctcattccattttaagttcatgttgtggattataaatcgattattaaacgttgaagagatgttgacattagaagtatccatcatatcccgaaaaatggacttactggtactagttggtgtcaattgagtgtcgtctgtacattggtactgatgaacacataagtcttcaagatccatgatcataccttgtatcgtttcaagcctttgtttgaaacttcgattcttttcgacgagatctaaaaccaaacgggggtcatgagatggaagctttcccaactccataagtttttcctcgttacaccgaatatgctcctcaaactccttagcccgttctcgagccaattcttcctgagtatattcaggatgattttgtccgattaagcaattatgagatctctcttggccgaacggatactctacctcattactagttctcagttgtcgaaagtaagaaaatctcggagagtaagcaacagttatcatcttcaaacgaggcttatttgaggttaactcaggagcatgcaactcgataaagtcgtcgtcatccacccacgacgaattgatattctcctcgttacaaggattgggctcagctggacctggaatgttgaatgagttcgatttttgcaacccaagggaggaagccacataactttctagagcattctcattgaacactgcggatataacttttatgtacgtttcagtgaaatctagttctccctgatacattttgaagtgccaatcccttttgcaaaaattgagaatctcgtttaggattctggtttcctcctttctttgatgtagatccatagtgaacgattcaacatgagcttttaggccagtgaaagcgaccttgttctttgacttcaggtcttcactatccgtatggcgataaacatgagaaatatagagcggtttgagaatcatctggtacttgatggtcattaaccgcgtattagcgtttgcagtcaccttgccgtttgatgttccaagaatggtattctctcttgtccgtgtagaaatactattgtgaaacaatccccaccattcaaagaaatgcgcaaaagcaaccggtgataggtgaacagagttgtacaccttctctcccctactagattccacagatattgccatatgtgtatatttgcttctgaacccatgataagcatcccagtcaattttttctgacttgttcttgaaaaatgagggatgtttcaatctgacctcataatgaggcttaaaaacagttgttctttgtttgaacccggggatggagtagaaactagaatctgcttcctgttcaaacattagtccccaattccacttaacttcatcactgctcattttgataattaccttgtcaaaggtaaatggtgtagaccttctgctcaacctatttgaccactcgtcgcattggacaatggcaaagttgggaacaccaatcttgaactccttactagtcacaacgaccaattcttcgggcagaggagaatgattgattttcaagtttacgtttttagaccacgtaaaggcaaaacctgcaccactcccaaccaaactatatggactcaaagagcccttaataatcaaactcaaatctcctttgaaatcaaaatccaccattccatgcagtgacagcctcatcttatcccaaaatccaatcttaggagagatatcaatcggaggcttggtaaacacctcaaaaatagacattgcatacgaaagtgcaggttgatgtgattttccccaagtgagaatagaaggcctgttactattcactttcaccttcaaattcgtataggtcttgatatttgttagagttcttggtactttaattccatacgcagagtcagaaacaatatcacacttgagctcctcaacgaagggaacttttacccatctaaactcgtcaggggtattcatttgctcaccaatgatgcaatctccttctatttgaattggatcgtcttcatcacagtccaacagtagcataggtaggggaaaatcccgtagcctgatagatatgttggagctttttaagtcaatatttaacggtattaatgttgagtattgagtgtccagtggtattcctttgcctgttttgtaaaggaaatcagcgtagtcatcaagctcaaacccttttggctttccaatgaccaagtccaattctgcaaaagctaaagcaaacaaaggtagcatacttggtgaactcatgatattgtacctttcaagtagttcgttagagacttcagaactattgacgttaaattggtacatcttggatgaagcagatttttccctatctcgtttgcatttgctgattctgtcgatccaagatttacttatattggccagcaatttcatcttgatcttttcaagacgagattccaattcgagagcttcattcacctgatttatatttgcctgtgagtcttcatcatgtgagttacccagttcttcgaattctctcctttctcgttcacatttagaattgaactcggaccatagttgatttctcatttcttcatactttttcattttaagtattcgtgatctactttccataagtccaattttatagattatcgtaatctcggcttcaaaaggatcatcgagaaggaataggccaaaggctttagatttcaacctcacttttggcattctgagtggcttcttgggatgtggtaataatttcggcatctctaatagtttcagcttgaaatcgtcaagttcgaatcctttgaaattcaaatttatttgcaaagcagacttgaaaaagttgacagcattgtccaagagtttataaactaggaaatattcgggaactgagatatccacagacgatgtctctattgtgaccagcggctggtcctcttctttgaaacacgtactgatgaaattctccttgagctggactatacttatccaagactccattaccaaaggattagggacaaatagtcgcatcgtgaaagcactcatagaaaaatcaggctcatcttgttttttcacaatttgcacaagatcgaatgcgcacaatagtttttcatcgtatggtaacgaaaataatacaagtactgtacccacttgaatttcgatagcagcagattttgatgaaatttcaacagatttgtcaacgtcaggatttcttttcttggtgggaatgatctctttgacaaaacaaatagatgctctggccaggagaagcaatacccagacgtgttcaattgtcatcaaggaatcaattgaagaaactacaagtaccgttcttgcagaactcttcttgactaatatcttgtcaactatgaggaattttttctttgcttcgttattagaaatgtgacttgtcaaagagttaattgacagtttctgaagtcctgaaccaacggtcagcatcaatttcgtaaaacagagggtcagtccatgatgatagtctgaaagatccttctcatttccttctattttaaatgaaggaagtattccagttgctccgacagttatgctcaaagaacaaacttgaaaacaaaaaggttgacaaaaagcacagatgtgttcttcggtggtttcgataaactagcaaagtttgttgttgatgttaaatccagcttgtggaaaagcaacgcaacataccgcaaatgactaatgttcgatagttgcaacttaacagtgccaataaaggtatctactttaggagtgaaaagtttgtcgctcaaagataaggagaactcgctattcaacttgttaagatccagtataggtataacttctgaattggtcttgatatttgcagcaatgtgtcgtattttcagtagcattggaagaatattcgagtttgataaatcttgtgtatccaaagtatacgaaatagaagctactttaaagcccatactaatatcatcaaaaagaataacatcaacttgggtcttcagtagtaaaatgttaaatgatgttcttgccagaatgctaaaaagtggttcgagttctttcttgctgctatgttctgcatctgtctcataactatcagtcgatttgagcatttgttgaattgcattcaattgtaaaagaggcagccttattctcaaattgtttatagtgaatgcattctgtaatgccttgatagagttgggatcattcaaggacagacattcaaataatggcttactaaaattcactgtgcttaaaatgttaccaaagggaacgtagaatagccttggtagatcaatgtttttcaatttatcatgatactcaacttcaacactcgtataggaaagcaataattcatataaatagttctcattcagcacatgagagtcgtaaactgtagtagtaatctgttctacgctgaaaatcagtcccgatttatggattctaacattatccaattggacgttaaagtttttgagttttgaaatgaagcttaatgggttactctttgaactgcttttggattcgtctttacctgaagtttttccctttgaaagtggaattctgtctagatcgacgccaatattcatcaaatacagcctgaatccgctcaattcaaagtctacagtggaattggcttccaatatgatcgtattggatttaaataaatcgccattgagagagccatcatctaggagaaacctgacaataaaacctccatgatcgttggcaaaatacaatcttatcttctcgactgtcaattcattgccagcatcatcattaaacgtcaatccaattagtcgaatcgaattgaaagcttttgaccggctcaaaaatttggagactaccggaacgtattttttcagcagagaaccattcttttctttggttggaacggaggactgcttaaccgagccagggggaagtttcttcctatggaccttgactccatataactcgaacaactttgactgtttgttcagtaaattaaacttgaagtgctctatcgtcagactaaagcttgaagtctcaatctcgattccagaaacacttgagaagtaaaaggaccgaatggaaattgacggtattataaatccaatcagccatgggacaactttgcaccaaattaggaccgctgtggtaagtccaataaatatgcggtattgatccatgttgtgcagtctgtcacggaagaaagacagctgcgtttggctcgcagctccaaaggtgcgggattagttatgtgccaatgcttacatcagcacacgaaattcattacttaggtgatctcactagggagtgtcctatcgatacataaaattacaaaaggtgaataggaagtttgacgaagagtttcctgaagtacattatgatcagctgataccaatgtcagtgaccatgttatccagtaacgaagccttaacttctcgatttagcgtttcttcaatgttagatgtgtcagttgcgttggtcagtgaagccgagattggcaaattagatcgattcagctgtttaaatctccacaaaatatacttgacagcctttccaacgtcattcccaccagtgtaatcggggaaaaaattttccaggggtgaggcaggcaacttgtcgataaggatgtcaatcttattcagacataacaagatcgaagagcgtgtaaaccatctggagttgacaaccgaatcaaatagcactagagactcagttaacctgttctgctcatcattttcactcaaagtctgatcgtactccgataacgaaacgcaaaaaactatcaagttcacattgtcgaagcaatgaatccatttttttctttctgaacgttgcccaccgacatcatacaagttgatgttgagatcttccagttggaaattgatctccaaaataccagaagtctgttgtctcattcttagaatatcggaaactgatgggaaataatccggagccattattcttggcgaattatcgatgaaatactgggcagaatccatgaggtaaaatttgtgccttaaatcggataatagtttgagagtagctggttcgttaaacaacttggtaattttttcagccaactcctggttgaatgattcatggtcatcgctgacagacaggacataatcattaataaagctcaactcatcggtagtcagattagtcagctcgttttccaactcgaattgacggattcctttgattaactcttggcaaacgtctaaaatattctgaaagacgacctttttgtacttgattagctcatcgttggtaaatccgttctgatgaatgattttaatttgctttaatatggtgcttttgccgctctccccagatcccagtagtagcattttggcggtcttattaaccttgggtttggtgcttctcgtcacagcattgccaggactgcctcctgacccacctctgcttgaggcagcccctttgattgtgagactgttctttgtggattgcgtatccgccgaccccctcttgttgtggctgccatcctgctctttggaggcacaaattcccatgattgctaggttgaattattggtcctcctttttgataggtggtaattgcttgatctgagatatttttttttggggttgcagtttggggatgatcgtctgatgaatagagagtgagcaggagcgggaaattgggtcccatcccttgcagaggatcttcatagggcatttcgcgaatcgtaaaccctcacggaagaaaggacaaccaggacattccgagaagcctgactaagctactacagggtttactaagactgtattaaatatcataatctgcttctattcgttaaactacacaggttttcctccaataaactcactccatctgcggacttcttcggggatttcgagaggtccctcagtagattgctcttggggcttggtgtgcaacttctccttcagagcttgggcgaatagaatggaagtttggggctcattgaacaatgggatggcaaagtcaatggcatttcttctcatgacgtagtcctcgtccagtaaagactctgcgcgagcacgagcgaggttgaagacacacttaatatcgtacttctggaaaacttctctcagctttctcttgtcagtcttggggaattcaatgacttccactgggatcgagacattctttcttaagtagtcggcgacctcctcagaagcagtgtagtagtggtaacctagagattcaattgtcttggcgacggtggctaagtattccttggtcaagtcaccaccaaacaaaattcctgaaggtggctttggtaaatggaaattcatggttgcctggatagaggtccagtatgcttcttgaacatccctaccaaaacaagcgacttctcctgtggaagccatctcaactcctaggaatgggtcagcaccagccaatctggtgaatgagaactgaggaaccttggtagcaacgtactcgtagctctttgccatcagatccacaggagcaggaacattcttattgagcaaagccttggctgcaacatcaatgaagttgacacctagaaccttggagacaaatgggaacgaacgagaagcacgaatgttacattcaataaccttcagatcaggcttaccagtttctgggttctcagccttgatgatttgcatgttgaaaggacctgtaatctcccaggcagcagcaaccttgtcagcaatctccttaagtctagccataatttcaggctccaacttttggggaggtaagaccaaggtagcatcaccagaatggataccagcattttcaacgtgttcagacacagcatgaaccaaaaccttaccattagaagcaacggcatcgatatcaatctcttctgcgccttcaataaacttagaaataacgacgggatgttcagctgaaacttcggctgcattacccaacttttcgtccaactcggactggtcacgaataacagacatggcggcaccacttaaaacgtaggatggacgaaccaacactgggtacccaacgttgttggcaaacttttcagcagcctccagggaggttaattctttccatgctggctggtcaacttcaatagagtccaagatggaagagaacttgtgtctgtcttcggctttgtcgatgttcagaggatcagtaccaagtaccttggcaccgttctcttgaagaggaagggcaatgttctggggaagctgacctccaacagatacaacaacaccttgggcatgctccagttcatagatatccaaaactctctcgaaggaaagttcttcaaagtacaatctgtcgacttcatcaaagtcagtagagactgtttctgggttatagttaatcatgatagtcttcttgccgctttctctaagagcacgtgcagtagaaacagcacaccagtcaaattcgacggaagatccaattctgtacacaccagatcccaaaactaaggttccatgctcatcgaaggtgacatcactttcactagcattgtaggttgtgtacaaatagttggtattggcggggaattcggcagctaaagtgtcaatcttcttgacgaaggggacaattccaaaagacttccttctagcacggacttccaattcggtagatccgactgcaagagcaatctgcttatcagaaaatccaagtttcttagctctggtgagaacgtcatgggtcaatccaaacagagaaccaatagcttctagctccctctgttgttcgacaatgttcataatcttgtacaagaaccaattatcaatcttggtaagctcgtggactctttctacggtgtaattctcgtgcaagagagcttgtccaacagccaaccatctacgatcggtagggttggcaagttcttcgtccaaattctcaaactttccaccttgtagacctacaaatgatgggtcgatctgtctaatggctttttggaacgattcttcaaaagttctaccaatagccataacttctccaacagacttcattgaagatccaatatctcttttgacatgttggaacttggccaaatcccatcgggggatcttggtaaccatgtagtcaagagatggctcaaagttagcagaagtagtctttgtgacagggtttggaagttcaggaagggtatggcctagagcaatctttgcagcagtgtaggccaaggggtatccagtggctttcgaggccaacgcagaagatctcgataatctggcattaacctcgatgactctgtagtctagtccatcaggctgtaaggcatactgaacgttacattcaccaacaacacccaagtgacgaataatcttgatggcggcagatctcaacatgtggtactcttcatcagataaggtttgcgaaggagcgacaacaatagaatcaccagtgtgaataccgagagggtcaaagttctccatgttacaaacggtgatacagttaccaacacgatctctgacgacctcatactcaacttctttccatcccttcaaggatttttcaaccaaaatctggggggccaatgaaagggattgagaagccaggttcttcaattcttccttgttgttggcaaaaccagatcccagaccacccagggcgtaagcagaacgaacaatgattgggtatcccacgctttcagctgcatccaatgcttcatcgatagtattgacggcaatggattcagcaatcgggatgttgatttcattcaaagcctgagcaaacaaatctctgtcttcggaggtttcaagagtcttgattggagttcccaaaactttaactccatatctgtcgaagacacccatcttgtccaattggacaccgacgttcaaaccagtctgtccaccaaaggtcaacaatataccgtctggcttttctctctcaatgatgtaggtaatgtattcagcagtaacaggcaggtagtaaatttcgtcagccagagcgtgagatgtctggttagttgcaatgttggggttgattaggatcgaagttttattagcttctttcaaggccttaattgcctgagatccagagtagtcaaactcaccagcctggccaatagaaagaccaccggatccaataacgaggaccttggaaacgtcgaccaatttgtgagcattttcgtctgtaaatcccttgagaactccagcccctgcgtaggtggctgccttctcaatgatactcgagttgaatctgatcagaggaactgatctacctctgacggggatcgatcttctggctagattccaaccaagagattgtaatcctttgaacattttgagacagtaaggggaagagtagagagggaaaggaaaaaaattctgaaaaagggcgaaaaaaaacgggagggagtcataatgcgaatgcgcggcgggtgtatgacataacgtttgttgcaggtgacgaaccagaaaaaaaagttacattctcaaggaatagagaggacttatgagagtcaagttcatacgagaacatcttactagatagttcctacaggtaggctgctctgtaacaggtttatccaggttatacactcatttggctgctttacagctttaaaaatcggttgtcactaaggattgactaattgggaaatttttcacttaagcgcggtctgtgatcaggtgtacggaggtattagatcattttccagaaggattacgggggctttcttataagagatctacatatctaaaagacgacattggtagcctgaaatagcagtcccaggatataagcccttagttccattctgaactgttgtagttgttgaattttttttcatcctaatctctcttccatctcacttggtatggttgagaagcatagtatataccaccaacttctagttgagtgttccattgatcaatgtatgagcataaagcagtggatatggccagctctcttggaattttagtctcgtctaccctcaaggtgaatcctgctcctgcagcaggcacaacttggcctatcctttccctgatttcagattctttctctcctacattggtgactctctctaaccatttgcccttataagtccattgataagttactccatcagctaatgtgaacattctataactgtcattggcatccacacggtggttgataacatgccatcctagttctgccgcaggcacgtctggggctctgatcaacagaacattggatctcaatccagctctaacagcggcaacgggttcgtcttcaccattaggtcctgtgtttgtgatgctagatgaatacatcttgtaagctcccttgacagatctagaacggacaaaccagaatatcctctgagaagcatctgtaggaccaattgggcctgatccttcggcttgggtatcaaacacatcaaacacctttgaaccggttccaaatctttttctaatagcatactcagaaggggtgtctgtaagttcgacaaccctgggcacgtaccgagatgctcgtcgatgcggatggaacaccaaagatttggccaccaccactggtctcattattggagacagaactagttcaataggcattttatggcaagaagaagcttgttaagactggagactggaatggcagttgtaagggtatttatactgagacacagagacatgcaaatggggtggtatacaacactgggtctgaggtggggtcggtgcggcggttgcaaacatcatccgaaggattgggtttgatcacgatgggagcttattagactaccaggaatacgtcgtacggcgatagctggaaagatcaggcctctattggacgactttttgtacaaacagtgaagaaaaaaactcaaaaaaacgacctcggtgagggttgaactcacgatcttgcgattaacagtcgcacgccttaaccaacttggccacgaagtcttacaacgatcagaaaacattccggccttatataacagattgattagtcaaatgtccactacgaccactatacagcctttaccaacatcgataacactacatttattaccgaatacaaaatctcctagttacagtctgaatcctcctatttcagacaaatttcctatgttcctgtcttttggctccaagtatcgtaaccccagcaagttgaatattttctcctcatcttctccttcaacaagtgtccaatcatcttccttgaaatgcattttagataaccgaattcccatcttattagcttcatcgatcacacgtcgtttgggcttgaataacccttcattattcagacgtaaccctttattgttagcaagggtcctcatgtacctatttagaatgtcgtttcctgtaaaataaatcagagcaccagctctatatttccatttaacagccaaaaaatccacccttcgacaaaactttttatctgtcagctgtcctccggtaaggaatttgagaagctgatcatgagctgggaatagagaacatttcagataaccagacttgaacagctccttcaccaaagttgtgagaaactgagacaatttggtttcgtcgttgcagtcctctttcatgatgaaaaaatctacatccccacaggtttttgtttctcttctgtaagatccgacggtttggactataaactttggatcaattttcttgcctacgtcgcttacaaactcagaatgagcagttacttcttctcgggggattttttggttccagtcgtaatagtagtacagaccaagtttaattgcgtctgtaaattcagattcagggactttttcaaagatatcgggtatgcttcgaaccccataatgattgaaccatttctctgatatcacagctccaacaccatgtattttctggagctctttcatcacatgagcttccgttgattcttgctgtctctttaactgaccaaactttctggtctcaataatttccacgcaatgatctgctagactctttccaattttgggaatgctaagtgcgtcttctcgacattctatttccttgggcgcatttttgattgcattaatggctcgcagatagctcaaagatttgaactgcagaccttcaacttttctctctttagccatttgtgagaaatagtgtatgattagctcattgttggacatattcttcaggtcctcctcatccgactcgggtgtcgatgctcggagagattcagaatctgctagcacctttttcttgatatcttctatcttaggcggcgaagcaagtttttcaaaaatcaggctatgttcctcgtctacgctcttccttttccgtttttttgatggttctttttcctccttgacatcgctcagactctcagactctctctcccgtttgacttttcctttctgttctgggaacgaaaacaaatacttggagtacggaagcagtttcttctcttccagactatctgtcacccaggcaagtcttagaactttatactcgtccagaggaaaaccagacttgggaaccttcagataactagataaactggtcatatcagtcaatttctcttcgtcttcaactacaataatcgtagtgtagtgaagagcttcttctgaatcatagtaatctggaatcagctcagaattgaacttttttacttgctttgcaaattggtttattgtggggtatagagttgcaccattcttcgtgtacaaattgtgcctgaaactggccaacttagttctcaaaaaaggaacaagcaaaaagttatagcccttaaacaattgtgacggttccatatcaatagatcttggatgacgccagcaattccatctggagcaagcctaatttgtaggagagaccaaccaggtgaggttgctcatagtaaataatagtgcctcatatgattgagattaggtaatacaataatacacactgttcatgtccacttgggcaaataagtgttgcagtacaagatggtgaacaggtaactacttagttctgcagaagattggtgcgtcaattgaacgaaatggttcaggactggatagaccgtcttcaatagcttttggtaccatctatcaagcttaatgttggataagaggttcttgcttctatcaataaaaacttcatttcttgaaagagaggaatccaagatccgaacagagagcttcgtgatgttgatcttttgtgaggtgaaataaggaggagtttttttccaccaatgataaactgctgaacctaatcttttgaggaatgacggatgactgagttcagagtataacgactcaaaaagctgatcgtttatagactttatcaatcttaaagacatgttgggactaacacgagggaacttgtttgcaggtaaaacgtctaaaaatatcagcttcgaatcccctccgatccttttcgcagaatcaggatcaacgttaaggaagttgctgaaaattgaactcgaagctgcattcttcctattttttaagccattcacctgttgtaaatgtaattgtttgtcattattgattcttaaaagatccaatagtccattattgagtaggctcaaactggtaatacaatgttggtggatgcttcgatcaatttcttgcatatccacctcaagaacatctccccgaggatatatcgtattggagtagtcattgaaaacaatgatgctctttaggttcaaaagatgaactcctgactcagagtccagcgaggaggcggaatccaaggcgtcgtcaaacatattgacattgctgtccaatatacgtttaaacgctaacacactgtccttgatttctttgtttgatctgctgaagactgggagacatctgatatcctgagagtcttctgattcaattgaatttatatccttttcgttgaagctagtgatgtagatgataaaccctttttggttcagatctcgagccagattctgaacgttgatgttacttggagaaccaataatcagtacaacttcatatctacctccattcggaagacgggctgctttggatcgtgcccgtttatttggcatctgggaataactgtagcagagcaaacaagttgcggcaacaccacaaacgccccatatactgcatttgtgtttataaagaaagttggtcattatgttcccagagggcactggagctttgtccactgtgatgttcaggttggcctgatgggttatgtccttgatggactcgaccgagtcttcaaagacggagttgaactccgaccttttttcttgaatatacctgatggattcctgcgcataatcctgggcctgcaatatggctccccaagtattctcaaaggttttatcgatcagttgtgtcatagtgtggagaaggaagagtcggcaaacagaaggataggttagaaggggaggagaccatctgagataagaaaatcatgtgagatcctaacctcagaaagtatatttgatagtagttatcaggaacagccatgaatttcatgtcattagtactttcgttgtggttgatcataaatggctgctctattactattaggttttaaaagtcgatgatggacgatgccaaacttgaaatgtgggcagtatgccacgtccattcttcggggtgtagtgtacgcaactgagggcgtgttgttctgcacacaagacgattagtagtctcccccagttataagatttgaggatgctactttttgataaaagccaatgaccttttaattttcaatttggagctgaatgtttatatgtgctggctttacgaaattgggccgctttgatcaaatccacttcaatataaaatgacatctttctactactcattcgaagccgtgcttagaaaacagggaaattctatcacgagattacagtgtaaggagactcttcatgtacaaagccccgcctattaactacagctgagcaaaaacactgtgaactggctctgtacaccaattggcatcacattatagccctaagatgtccatccaaaaacaattgcattgcccactgattaaggggcaggaaaatcatcaacagtttttgggttgtccgaaggccccatttaatgtctcctgcaaccattgcacttagaatcagcacacattaccttccagtcagcgttaactaggtagctgaaataaatgtcatggtaactccgaattaccgtattgaccctcgtaagtttcccgaatgtttgctcagcctctgattcgactggaaccccagatattcacatgcaagtgacttctcttcaaaacacactaacgtagggtctcataaaacctcctcgtaacacttcatctgacttctcttcccactcttcattcactctgtgagcagcctattgcgccattctccattctgccagtacattttttgagtctcggcagattgccaattccggtgtctctcgaaatttcggaaagagcggtctaaactctgcatccaaaacacaacggtgtaacatcataaggagtcaatcatgggtatcaacaatccaattccaagatcacttggtagtgaatgcaagtaagtaaactaccaaacattttggtgtggctagagagctctgtcctgttttttgcagtcctttctctctccctctcccttcaatgacaaatactaacatcaatagaaaagttgctaagatcctaacttccttcatcaaaccaaaccaagtgtttggcccggacgaagtcattccaaaggaagttcttcaaaatgctcgtggtctcgcagttatgacagttttgaaaggtggcttcctattcagtgccagagtgggatcaggtctgataatggcaagactccctaacggagaatggtctgctccttctgccatcgccaccgccggtgcaggtgttggtggtcagattggtggtgaattgacggactttgtatttattttgaacacccaatcagcagtggactctttcgcacagtatggatcaataactctgggtggtaacgtttcggtggcagctggcccactgggaagaaacgctgaagtttcagggactgcttccttgaaggctgtcagtgctgtttttgcatactcaaagactaaaggtttgtttgcaggtgtttccttggaaggttcagttattgtggagagaagagaggctaatagaaagttctatggagataactgcaaagctaggcatattcttgccggtgatgtagctcctcctagggcttgtgacactttgttgagagttttaaactccagagttttcaaccccaactatagtggtgaccactacgatagtgatgacgagttctacaacgatataccttccaccttctctgatgacaactcaagttataactcgccaagaacaggaggttcaagaaggggaggtagagggagaggccgttctaatgatgatatttactcagatgaggaagacgataactactacagtcgttctagagataagtctacaagaacaagttccaaatggcgggacgacatatatgatagacctcctactgacagatcatctaaacctacttataacaacttttcagatgatgacgatagtgacctttctggaagagtgaagaaacatagcctcagtgagaagaaatccagctctggtgcctccagaaataggtccagaaacgaaacagcatcatcgtcgagggccaacaaagctattgctttgtattcatttcagggtgagcaggcaggagatcttcctttcaaaaagggagacgtcattactatcatccaaaagtccaactcaactgatgattggtggactggccgtactaatggggtagaaggtattttccccgccaactatgtagagttggtttgatcatgtcctaatagtttaaaatcaacttttttggtttccttttatttatgaacatcctgtaataaggttttggatgcgatgtttgaacgcttctatatcgtatttttcaatcttcctgtaaagaaactctgggtcttgcttatagcaagactcataaatttctcttgcgatccattcagtgtcaaatttggatttgtagtacttgaactctgggtccgtgctaataatttttgagaccagctcatatatcctttcaaattgtctcagaactgccgcatagtcgggagcaacacagggaacttgaattacccttccattgttagttacattgaaagcaataggccttgcttccaataaagggggaagccctatagggtacatcactggcatattaattgtaggtgttggagacggacttgccgatactagtctcttaaaggtggtgttggcatactcttggacgaaaaaagaaactattccataagttctcattcttttcattgcctgaagacacgcttccttttgggccatttcaacatgtccaaaatcgtcttccagtttgatgctgacaacaaccccacaattcccacaccagctgtgaatcatttcttcggaaatatagttggctatgttgttgattaagattaaattacgtggctttctttgatccttttctttaacgtaggtcattatagctggttttccctcaattactttatttttgttgagctccaagaatgatttggctatctgattaagtttgaaatacaatatagcccaactactttgatatcttggttcttgtcttacaattatcgtgtcgcttgcttcggcaacatcaaaatctttgcggacctgtgcttcggagtatacaaacggaagattctttatgaacaccgccttcttgtttgtaagtaaacgttgctgctttttcagttttacttcttgctttaactcactcgactttttcacagttgactcataaactacacaaacgacattgtcatccttttcgtacatcttcatcacttcagcagcctcttcaggtttagtgaactggacataagctgtgttttggggtttgtttagtttacaacgaagtaaattttcaccatctctgttgaaaaactcgtaaagttgtcgggtattcttaaactcgacaggtagcttcatgaaaaaaagattggttccgcaattctgccaatcgtaatttgcagggaggattcgaatttcatggccttgaaccttcttgtaattcaaaacatcccttgcaagaagagcctctttcttcgaataaaagttaagatatccataacctaatgacttgcctgtatgtctgtcagtacacactttgaccgaacccactctcgtgattgggagaaacaggttcattagatcagactctgtgtacgacttgggtagccctccaatatacatggaaactttgttcagtacctcagatagagttatcttgggagtttcaaagtctggaacaaacaagtttgatcgagccgtcagaggaatgatctctgtggagttgcttgaatttgagtcctcattcaacatgacgctggcagttttctttaattgtatggttaaaagagaggccagccatttctttctgtaatccgaccctgtattctttctgtgttctctacctctttgcaactaaaaaaaaaaaaaaaaacgaaagtagccgcatgacaaaagtcaatgtgatacaacatcctatgttgtggcagaccttcaattgggaaacttgagtacgttccttatccagtgttggacaattgccttgccctctataaaatccgggtcttcctgcctgacaatcaccgcggcgtgagatgaagtggttttggtaatgtaaacgggaaatttgttccaatttagcttgttgagattgtgaacgatttccttttgaggtggagagagtttcagttgaaatggtctgaaaaattctaagtcctggttcatgtctttggaggacgagaaatccttgaactcaagagtggatagttcttccaaagtgacggataaagaatcctgactttcctcaggctgtccatcttcgaacagaacgggctcatcccatctcttagaagtcatggcatcccacacactttcgatcaggtcttctgtttggttctggatattatcctgcaccgatttttcaaactcatcataagactcgcttaagcgccttgaaagagatggtcttctccgaataacaggcttctgctcgtcttcgtttgtaagttgatacagatccttccaaaagtcagtctctgccgctgaggctttgataactctgacagtggattgaaatctttgaattaagttagtgaaaataaaagctataacccagcaaggaacgtaaatgactatgttgaaaaagacaaaaaaccatttggcctttctcttgaaaaaattttcagcaatctgttcggtggactcgaacacatcttgctcttctaaaatagtatccttgggggtagtcttggataccgtgattgttttcttgacatctagaatgttaggttcaaagtccttgataaagtggaaactcattttcgacccgttctccatcttgatggcaccattcttatcgatctgaacgttgggattcttgtccaatatttcaaagggattcatagtggagattcctgcagtccaccacgatgtccttttgtcatttgtcacgttggcatacaatgacttgtacttgaagccgttcaatgccttgtggaaaaccgaagcaggattggccattaagagcagaagaggttgatagttatagtttgttttcaacagaggcgacgcaggtgtttcctcttcgccaagatttacataatcaatcaccctgactttatccatcaaaaacatctgtttaccactgtttgccagaagataaggaaccaagcaattaaagatcttaacggacataccatctccaggagccaagacccccacatgaggggagcaaaaggtggtgaagttgactggttcaatcgatttaaagtaccctttgatgtacagaacaccgattgcatagcgggcaatgagccctcctaaggagtaccccatgacagacagatgtgtgactgtgtcttcaccattgttcagccgtgcgatttccttttccacctcttcacccactcttttgccacaaaggtcaattccgtcgtaggtcttgtaaccctcattggatccagttctgtatacgacgattttctctttggaatggagggagacagttggatcagactcgatttctgattggatataagacaaatgatcggcctttccccaaagaccgtgaactagtaaaatcaagtgaatgtttgccatcaatttagtacaggtgattagaattatggaggggggtgagaagggaaggagagggcttatatataattgactgataaggattagactgatctggaatgggggagcgagatgatacgaaaaatatgtgtgtgtgatctcccaaacgcggctccattttatgcagcagtgcataatagaggttctggagaatgtcaacagcaccggacgtttaagaggaaaggggactggaaagtcatgccatgttgaaaaggttgtgaaagtgtttactttgtacacgggccttctgagcaaacgaattgggtttgagatagctaccagggttgcccggtgtgttggttttcatagcagttccgttggtttgtctgggatcgtccaataatggagcaaggcttcctgctttattatgtcttgagaactccacacaaacgatcttccttttgcatggtccctcagtttgtaaacctcatgtcccgtttagtctacatgttggattctttcggactaaccgtaacagtaggtgccttacataatactctgataacgcaccaactctaacccaaaaatacttcatcctgaaaagcccccctaatcaatacagcatcccttccgcctctggatctacatctcttctctctcaaaccaagttcgaaaagaaagtagtcgaggcatcttggcatcggaataaattatgcggtatatctgagattgagcgaaaaatgtctgctccctaatctctcaggaacccaccgtagatccgttttcttcccctttacctcttcgtccttccttccctgtccttgatcagttggtcttccaaagttattctaatatcatgattctctttgctgctagacaccttgcaatgaccaaatcgacgggccatttccctttggctgcccatcgatacattgcgagatgccattttaagccggaatctctcgttcaaaaggctagattagcaagatcattcggatcatctggaccatcctctaaacctgactctcaagctaaggatattgttcccaaaaagaagtccttttggaatactttccttggtgttttggtaaaaagaacagtcattggtgccggaatcatttcgtcaagtgttgtcactttattggttgcattcttcatttatgactctcaaacttacaaccaagattgctgcaacgagaatctacaggtccctaagtttgctctagatcctgaaactggtggtcctgaaaatttacccatactcagatcccagttagacgccatggatactgactccaagaaacaagcttatcgcaaaccaaagctagtcattcttggctctggatggggtagtgttgctctccttaacaatttaaatccttcagattatgatgttaccgtcgtcagcccaaccaattatttcctgtttacaccgatgcttccatgtgccgctgtcggaaccttggaaatcaagaccctaatggagagtattaggtcaattcttcgaagtgtcaatggacattacctacaaggatatgctgataaaatcttatttgatgaaaaactggttcagatatcctgtaaaggttctgacgatagcaatcagaaattctatttaccttacgataagttagttgttgcagttggctccacgtccaacacccatggagttacagggttgcaatattgtcaccagttgaaaacagcagctgatgctttacagatcaagagacagattgtaggaaatctggaaaaggcatgtcttccaacgacaacagacgaagagcgtaaaagattactttccttcgttgtatgtggaggagggcccactggtgtagaactggctgctgagatttttgatctgttaaacgaggatttaaccgcaacttatcccaagatccttaaacaggaagtgtccattcacataatccaatcccgaagtcacgttctcaatacttacgacaaaacaatcagtgaatatgccatgaaacgattcgaaaatgataacatagatctactcactaatgctcgtgtaaatgagattttgcctaatgaagttgttttcaatcagaaaaactccattactggagaactggaaactaaaacagtaccctttggattatgtgtttggtctaccggtgtctctcaaaatccattggctcaaagtgtcactgcctctctatctgaacaccaacacaacaagagagccatacagactgatgctcatttgagggtgcttggagcacctttaggtgacgtctacgcaatcggcgattgtgctacggtaaagacagatttggctgagcacactgttgagtacattagacattacgtggtcaacaagtattttaaccaacggtcgcagcgaaatcaaatcatcactgatgacgatattatgcatcttctgctctcacactctgagctcatggaactaaagcgtcatatttctactaaacatccactggcctctgagagcttagaattcatcagtgagctaatccccaaatatgatactggaaataccggaaaattgtcgtttgatcaaattacaagactcctcaaagaaattgattccaaagttacttcgctacctgccacagctcaaagggcgcatcaacagggtacttaccttgggaagaaactttcgaaattaacttcttctaacaccactttgtcaatcgacaccataatgaaaggagacattgacgatgctatcgctaaaccgttcaagtatcaacatctaggatcattagcttacattgggaactctgccgtgtttgacttaccaggacgttcttttgtgggaggtctggttgccatgtacctatggagaggtatctactttgcacagtctgttagtatgagaaccagagttctgctgttcatggattggttgaatagaggtatttttggtagaacatgtatttctatttagagtttgtcattccatcatcattgcaaaatcatcttctattgtgctcaatgtgttgttcatttgatccagtaaagctccaatctcatttaccaagacttgcttcgatgtcatatcactgaatagcttgctatccagttgtggcaatgcaattggaggcctattgacagtcgtagacgatggtgcaggcttcgaatcgtgctcatcaaaggaacctgatgaagaatcggtgggcttggtacctgttgtaggctgactagcattaatcttctcaggagtagttgcgctacccatgatcgagctgaaggatctctccgtgagaggtgtcatcgctaatggaacttgagcggcttgagtggcattcacaccaaactgattaatttgatcagacgtctcactattaggagaattgccattggtggcaggaaatgttggtacttgcagctgttcttgcaaaggactaggtaacgttggttgtggcatttgtaatgtaagataacttttattccgtaaagttttgttgtcctttgattccccggtaggtggttgttgtgataggggaataggaccggatgcagctttattaataggttgtaacatgggcatgtttgtggttgaaggcatgggcttcatttgtgggggagtgttgatcgatttctttgggggagaattcatatctggaaatgctttcttaggagacggtgtctttctggttgcttgaatggatgcggacgacaaattacttgctgtgtgagcaagtggtatccttgcattggaaatagtatttgatctcctagttgagagaggcacttcaatgttactttgggctctggagacggttgacgatcttaatttggtcggtccattacttccgctgggtgtacttaccgaaaggtcgtccatgttagggatttcaatctccactataggggattgttgcgtaggccttggtgcaatttcctcaggtgagggtttcgactcggaaccttcgtcaaatagttgaagcaaagattttggcgtctctttcttgactgtatcccgtaaagtacctgtgactgttttgttgactgttgtttgtccatatgttggttgatatgtcgcttcctcgcctggaagatactcgtggtctgaatcctcattcatgtaatagtttgaatagtctgcactactgagactgtcaaaatcccatttgatttccaaaccttcttcctccgcttctttatttttttcaagctcatcatcaatgttgtatatgctttcccttgatcctttcgtttctctccacaacaaatacctggcgattagctcctttagaatggagtttggcacatttttggatgatttaacgagcttgcaacctagtagctcctccacggtggggcgttcttccggattctcatccagacatagtgctacaaattccttcaacacagtggagtgttgtcttccttccaatctggggggcttagactttgttatcagttgcatggctctcatagcatccttatcagagtagggaggatttcccgtggagatttcatatgcagtaattcccagtgaccatacatcaaccttggcattataggaagctccttccatgatgacctccggggccatccagtatggagtaccagccatggtggttctctttacgctggtactggtcaactgagctgcaactccaaaatcgcacagttgtatatttccctctttggtgatcaaaatattagctgctttcaagtcacgatggataacaccagccttgtggacataatgaagcgctattaataactctctcatgattacggcgcaatagcgttcttctatgggtcctgttttcaaaagagatcgcaatgctcctccagcgcagtaatccataatgatccacaaccgcgtaccattcagataggagccctgatagtgtgtgatattaggggcctgtttcaactgactgagaaactgaatctcctgttggacttctttcacctcatcctcgcctgtgtcaagattaaggactttgatggcaacaacccggttcgtttgcctgttgatccccttgtaaaccacaccaaatcgacccctaccaatgacctcagtccgtttgaacagcttactgacaactgcgtcctctttaaccattggaatgttaaatgcggacgataggaatcgatcagtgtagtgagatttttcttttacctgaaaaggatcgagggcagattggaagggggcctcagaggaagcgagctgcgaagcagaagctattgtaagccaccgaacctgcgggctcgcgtgtgtcaagcgatagccttttagttttgagagtgtaccacacattattgggcaagtctcatcaacaacgttttctctcgcccatcgaaattttggtgcttccagttcaaatctccatctgactccctaaatgagtgatctgtccaagctcctaaggtcgtcaagattggcccaggttgcacgaccaaacacttgcaagaagattgccgcggggaagatatatccaacacatcagatcattcaaacaaccccaagctcgttgttcagaaacaactttggattgaaggccgatcttccctccaaggtgaattcaaggtacattgttttagacaagctggatactattgaacacatgactggttttgaaaaggattcttcgttttactggaagaagcaaagatttcaggaactcaatatccctgtcaatgtccctgccaataagagcgaacatggacatccattatttgctggaaacacagagactagaaacgacactgttgtcaacagaaacaagcttccacttgctagtctgctgaacctggatagtacgacgccgaaacctaaagtggaggaagttttgaacaaagttgagaaattgcgtaaaccttttttcaactggctatatgagaagcatcctatggtcctgcatgaaatgctatcccctaatgaaagcaaaaagagaagaagtaacattgaacatgccgtgacctttttgaaagaatatgagtccaagaattccacagttgtgggtgtcaagaagcagttgagcgaattggctaaacttgcagatggaagagccaaaattgctggtaccgggggcctttcttacaatttgaagaaccgactagcaaactcacccaatggaatttctacaaagaaccatgcgccagctaggctgttatctaacagtgaaaacaacatgttcgctgtgggtggttttgttgggacttctttcaactattacaggcgactcaatgctcctacagataagcatgctagacaggagaaacttaagattgaagtcaccaatgctatcctatccgatgatggattgtctattgacgtgggcaaatccagggatcgtaccacaagcagtgttaacggtgagagtttgttgaaccttcttagagatattcacaagtcttaaagctgtcaattgagtgaaatcaagaatattatcatgtacatacgtatttacaggcacaatttacaagcacattcacatagtaaaatctctgagtagaacagctgtggctacgctgacattcaaactatccacagaagaatctaaattctttcgctgacttttcaaagaaactaaatgcgaacttctgtccagcagtgactttctaataccgtcaccttctgaaccgactatcaataagcacggctgttctgacagagtggaggacaattcctctgacaataactctctgttggcattcttcttagggacagaactaacagcggatacggtagcccaaccgttctcgtttgctgcctctagaaattgtaaaggtttcaccacgttgaaaataggtaagaattccatacatcccgcggaggatttagaggccactgaattcaaaggtgcacagttcttctctgcaatggcaacaaaatcagcgcccaggtaatatgaagaccgaataattgcacctaaattatgaggatctgaaactccgtcaatgtaaactcccaagggaaatgagccattcagcctttgaacctcgaactgttcttcagatcttacaccataatcctgtaaagtcaagctgaacacacctttagaggtaaccgtagataaagctgcgagctccctagtttgaaatttagctgcctttaaaacatacccgttgtggacgttattgttgcacagcagattcaggtcgtttttactgtccacaagcttgatgtccactcccctctctttacagagttcagttatttcttcgtgtttctcctttgggttatgaacatataaagtgctcaagaattctctattgttggccttcagtgctgccaatactgcctgggccccaaatatccgttcttctaatgggttctcctttgggggtctattcctccttatttgcttggaatctggactcaaatcagaatttcttgatggaaatttttgggtccttgcagcctctttgtctagtcttacttgcttctgtttggcgtgcacatgagcgtacttcctcttaaaccaagtgtccttgtcttcgccatctttttcccatgccttcatcctggtattattcggcatgtttctgttgaaactgatggattttccacccgaaactatcctttcattatcaaaattcttgaaaggtgctcgtatcagcgtggatgcactccaactgaaccgtctaactccatttagccggagtatctctaatcgattcatgctgaagagttactttctgatagtgaaattctttctttagcgaaagcaggtcctggaaggacctggatcccctcgagactctggctccagaaggagaaagacgaagaaaaaaacgaaaaaatatatgactccccctctcatctttccaacagactacaatgacaggagaacataaacgaagttccctcattaagaggatcacaaacgaaaccaaaatacaaatagctctcagtctcgacggtggacctgtgagtctggctcaatcacttttcaaagataaggactattctgcagaacatgcagcccaggcaacatcatcccagttcatctctgtgaacacaggaataggattcctggaccatatgttacacgcacttgctaagcacggcggctggtctgtcattatcgaatgtgtaggtgatttgcacattgatgaccatcattcagcagaagatactggaatcgcattggggatggcattcaaagaagccttgggccatgttcgtggtatcaaaagattcgggtccggatttgctccactagacgaagctctcagtcgggctgttattgatatgtctaacaggccctatgctgttgtcgatctgggtttgaaaagagagaagattggagacctatcgtgtgagatgattccccatgttttggaaagttttgcccaaggagcccatgtaaccatgcacgtagattgtttgcgaggtttcaacgaccatcatcgtgccgagagtgcattcaaagctttggctatagctatcaaagaggccatttcaagcaacggcacggacgacattccaagtacgaagggtgttcttttctgagtctggaaggtgtctacatctgtgaaatccgtatttatttaagtaaaacaatcagtaatataagatcttagttggtttaccacatagtcggtaccggtcgtgtgaacaatagttcaatgcctccgattgtgccttattgttgtggtctgcattttcgcggcgaaatttctacttcagatcggggctgagatgaccttagtactcacatcaaccagctcgttgaaagttcccacatgaccactcaatgtttaatagcttggcacccatgaggttgaagaaactacttaaggtgttttgtgcctcagtagtgctgttagcggcgacatctgtggtgttatttttccactttggaggtcagatcataatccccataccggaacgcactgtgaccttaagtactcctcccgcaaacgatacttggcagtttcaacagttcttcaacggctatttagacgccctgttagagaataacctgtcgtatccgataccagaaaggtggaatcatgaagttacaaatgtaagattcttcaatcgcataggtgaattgctctcggagagtaggctacaggagctgattcattttagtcctgagttcatagaggataccagtgacaaattcgacaatattgttgaacaaattccagcaaaatggccttacgaaaacatgtacagaggagatggatacgttattgttggtggtggcagacacacctttttggcactgctgaatatcaacgctttgagaagagcaggcaataaactgccagttgaggtcgtgttgccaacttacgacgactatgaggaagatttctgtgaaaatcattttccacttttgaatgcaagatgcgtaatcttagaagaacgatttggtgaccaagtttatccccggttacaactaggaggctaccagtttaaaatatttgcgatagcagcaagttcattcaaaaactgctttttgttagattcagataatatacccttgcgaaagatggataagatattctcaagcgaactatacaagaataagacaatgattacttggccagacttttggcttcgaagtaccagcccgcactattatcataacatcaccaagacccctattggtgataaaagagtacgatattttaacgatttctacacgaatccaaacgagtattactacggagatgaggatcccagatcagaaataccgtttcacgatagggagggcacgatacctgactggaccacagaaagtggacaattggttataaataaagaagttcattttcctgcaattcttctaggtcttttctacaactttaacgggccgatgggcttctaccctcttctctcccaaggtggagccggagagggagataaagacacattcgttgcagcttcccattactacaatctcccgtattaccaagtttataagaactgtgagatgttgtatggctgggttgatcatgccaatagtggaagaattgaacactctgcaatcgtccagtacaatcccatcgtggactatgagaatctccaaagtgtcaaggcgaaagcggagattatactgaaaaaccacgagccagattcaaggaagaaaagttcgaaaccaaagtcttacagcaaaacaaggctttccactcatgtcaagggttcaatatactcatatagacggctcttcagagactcgttcaataaagccaactctgatgaaatgttcctacattgtcatacccctaagattgaaccttacaggataatggaagatgatttgacacttgggaggaacaaagaagctaaacaacgatggtatggaggacgaaagaatagagtgcggtttggatatgatgtggaactttacatctgggagctaattgaccaatatatctgtgacaagaatatccaatacaaaatttttgaaggtaaggacagagatgctctttgtgggagtttcatgagggaacagttgggatttttacgctccacgggggattagcatagagtatgtatataatccagtattattgaatattcataaaaaaagaggtcgtacccggattcgaaccggggttgttcggatcagaaccgaaagtgataaccactacactatacaaccaatttttctttagaatttgtattttctgtttttactcaaattagatgactctcttgatggatacttcaagttttattcagagttacacggtcttaccatgtagtcagcccttctttaatgtgcactgtaaactttacctgcactatttatgacaatatcattgcaacaaccagttatttgttgattagaaagtataatatcggagtttacagtgtattggtctgtgttttatcatgttttgttattctcgcaaatcgttacgctggtgatccatttgtcgtgttcctcaaattaccggagttaaagctggaaaatcaaacagccatatcatcattgttgtagaaagtctcctggacgttgagtaatgacatttacacaccaaaaaagtatattcgtatttcatatcctagggtataggctaagaactacactcgtcttcgaactcgtccttattagctcagttggtagagcgttcggcttttaagtcaacacaaggaaccgaaatgtccagggttcgagcccctgatgaggagttcttttttgaatttttaaacttcaattacgggccgtctattatattattccctatttaccctttctcttgcccatcttagcctcaattagaagattacttcctttcttcaccgaccttgagatttgttcttcgtcactcgagtcgctggcatcattctgatttcgttgtgagttctgtttctccaagttttcttgacgaaacctccttctatcgtcgtttctcatcttgtttttcaaagattgtatcaccttactgtcatctttggaaactctgtggcgattgttgattctggccaatttgtcatccacttgacttttcatcttctgttttttggtcatggtagaaaggttcttggtaccattaacaaaatctcctatggtgccaatagtactctcttcatctgcatcgtcattattagcagatcccagcccagatccctgtcgtatcaccggtaggttcaaaaatgcgttagcatagtccgcagactcactagttgtagttttctgaggggttatgacccacgaagccaccttactgtttgattgacttatggcatactgaaactttgcctgcagttcattcttgtactttatttctttcctattagacatctggatagaagttcttgcgcccctacaatcaggcctcaagctagaagaagttcattttattttattttttttcatctggggagacaacatcgcgagtgttgtatccacgtcggtgcttcattaaccgttctggacgatatatacatgcattatttacttggggatggcagttcccaacagctgttagctgcaatctccaagatcttacggtcatcaatacgtgagcagtttttaagcaggattttggtgtacaattcctcagcttggtcagtcctaccgattttggttaactccttgatgagaccagaaaccgcatggaagttcagttgcatctcatgttcttgaagatacacgaaccaacgcacagacaactccaaatcagagtgtcggccggcttctattaccatgttgaaaggagttgccgttagtagacagtattttatgttggttgttgattgttccaagaaatagttggccaattcaaggttcttgagttttagtgcttcatctatgaatattttcagaattttgtcttgaagtcttttggatgatagcggatgtgttcgaagctctaactctttcaaattggcatcatcctcccaactttggatctctcgcacagttgaaatgtaacattcaaacaagtcacagagagtactttctcttaaactgtgagtctcatggatagaacgaaatagtccaatgtatacatccgctaacgtataaatggctccatatcgtagtttttgtagctgggtttttactataatttcatcgtcattgtccttggatatctgaggcaaattagagacttccctggagaccgagttatcatagatataagaaaggatccctagtttcgtcaaaaggtcttgcccttctctaaaaaacctgcaataataacccgttataactttgatgtctgagactctgtgatgcctcattaacttgaagatttggtcgatcacagttgatactgctgtatcactgatatcttcaccataaaacttgagtattcgattgacagtagccataaattcttgagagtctcccatgttctgagtgtactccaagtacaagaataaatatttctccgttatgggcaatcctttttcttgtatgctcttcagaaccatgtctcgctggcttgggttgaacattagggtatatctgaaaatcaaaagatagtacttattggtaacgtcgatatatttggaattcgtgtcagactttgacgtttggtatgcgaagagtttttgattgtacagttccaaatatgtttcactcttttctctgttccctcttttaatgatgttgttgatgagcttatagcacatgttgaacgaataaatgtgctggatgttgtccatttcctctgttgacagcttatgactgtccaatagatagttggacttgggaagattcgaaacctcactcacgtatctgtctaagttgtttccctctcttaggtctttgaacactttattcataacagtttcttctggtataaacagccctgagtatatgactctatggaataacaaatgataaaggctttttggaaatttgtttactacctggagcagtaagttctcattaatagtatacttcatcgtggggattcccgattctcttcttaaccacgccaagtactcaagaaattcaagtatctgttcgcaggtggcatctttatctacaaggtcggtgaaaatcttagtggctatacttgatctggacttgaagaagttcaaatcaaaataacttaatgcaatcttgttcaagagggaaatgtccttgttggccatgaatgaatggtatagaccaagacgtttttttgagtttttcgtcgcccaaaacgacttgaatgctttttgaaattttttgattgtgatgagagcatctagcttttgtatcgaagggccaaaagagtcatctacaggaacttgtttcaatctagaagtattttcaatctgtgaatttctctttgtgatcgtgctgaaacgcaagagatgagccgacccggctatagacaaaggtatagcgtacctgctatacatagaaagcctgaattttgtgggaattctagcacgtaacataaaaccttgatggcatctatagagaaagaactatgggaattgaaatattgagatactgatgctgattatataatcaatcatggtagtgctaggtttgcctcaattattgatgaactctcaatgggggcaatggttaataaatcaagcttattgacgaggttggcagtcgccaggaaaaccattcccctttcagctttggataaaactaatagtgccctttgggcctttctagcaggtaaaagctccctgtagacttcctcgaaatgagcagttccagcttctccccatatatatgttcttcccaggaacaaccttgaaatacacccaactacttctcaataacctacacagaacttctatcaagagctcattcaaaagaaaaatgcatatcaagtcaattcctatgagatggggcaccggtgataactacagctatttgctcaccgatgaacccacgggacattcttggataattgatcctgccgaacctaatgaagttcttcctgaattggagcctttggctcacattgagctcaaggcaattgtcaatactcatcaccattatgatcactctggaggaaactcgacttttcacaaaaaatacccctcccttcctgtgattgctggcaaagactctcctctcgtaactaagacgccgaagagcaatgaaactctgaaattaggcaagaaccttaaaataacagctctacatacgccatgtcatactcaagattccatatgctggtatgttgaggactcagagtctggaaagaaggcagttttcactggcgacaccctattcacttctggctgcgggagattctttgaaggaacaggtgaagaaatggacattgccttgaataaggttcttgctagcctgccagatgataccgttgtttatccaggtcacgagtatactgccagcaatgtcaagttctctaaatcagtgatgcccaacaacaatgctttggccaaattggatcaatttacttctcagaatgagttcaccacaggcagattcactattggcgatgaaaagttgttcaacccatttatgaaacttagtgatgaagctgtagtgaaagctactggtgtaacatcgggcattgacagtgatgtcatggatgtcttaagaaaaatgaagaacaacttctaaggtggtattatgcaatttccaatctatctatttattatttatactgttaatttgtccatctcttgaattgcgtaatccaaggtataagtctgttccaaaaggtcatctattctggagaagtgacgttcactatacggaatgattccttcaatgaacttgacaactccaggcacttcaatcaactccttcaaattgcatcccttcaagataactttgatcagcttttgagctacttcaaagtatcttgaattggtgttccagtctctgattctcttgaacaataaggtaatctgatcaaacgctaaacctttaatagtcttttccaaagcaaaagatccaagaacagattctgggtcttcgttggtagaaatggatgctttcaagactttgtacagtttgataggctcatctaaagttagcgccaaaaggaaagcattattccagtctttattggaaacataatttgccaaagactgctcctgctcaacacgggctttacggttttcctcttcctctttcaaagttgcatcggtaacgtcttcccaaaaactgaactttccatctgcatccgctgtaacaaaattaaacccgtcattctttaaacataaagcccaaattctattgtcatgattgtcaagcgtcttgatacattcaccggatgacttatcccagatcttgatcagtccgtcagcaccagtggtaactatctggttgttcttgttgaagaattgacacctttggacggagttggtatgtccctccaaagtttttaaacaggtgaaattctgcagggaccacaccttacaggttttatctccagatgccgtaacgatcagtttgtcgtagaggcagaaccgtatgtcccaaagacctcgcttatgacccttgaggattccaacagtctctccagtatcgatgtgccacacctttgcggtcttatcataacttgcagtcgcaaaaaactgatcgttgggtgcaacgtcaatagcattgatttctttttcatgagctcttctggtaaattcagaaaccttcacagtaaatggttcttccagttcttctatgtctctttcaaaatgcttgggaagcttccatttctttatggttaagtcagtagatgctgttacgataaagtggggtacaccagtcgaagtcctggatagagcaacagccgtgacaggccccgcatggccgataaaaactgccacattgacaaatcgtccgccattgtaaaaccacaaccgagcgtcatggtctttgctagcagatacaacccagttaccgtccaaactaacatccagcgcattcaacaaatctctgtgcccttcgtatagttgcatctctaacgatttattaacagggtcaattactcttaaacctggggagtttgttgccagtgctagaaggtttaattcagggccaacatatctcatgtctgcaatggttccatgattacccgctattctcctgatttctgttagtggagaaccctcactaatgatgctaacatcaatctctactagcgtttgatctgataggacaagataaagagacccttttggctgagcagctaaaactccggtaatgataagctcttcgctggtctctagtggcttctcagtagagtttatcatttttccattattgagactccatagttttagtatgcaatcgccaccagcagtgaaaattgtatgattgtctgtgaattggcagctctctacctggtgcttcactggtaaaaccaacaactgcttccaggtcttagtattccaaagtatcacaattttgtcccttccaccggtcaacaaacgttcgccatcagcattgaacgccaaacctctaactgcgccattatgctcattgattgttctgatagccttgcgcttgaccaggtcccagatcttaacagttcctgtagtatctccacttgccaatctccaattacctccatttagctctccgtgaaaaactagcgagcacacagtcgtaccatgtcccttcagactatgtgtcacatatccgttttcgatatcaaatactgtaattataccgtcacttcctccaaatgcaaacagtgtagaggtgggatccacggcagcgatgtatgctggcgaagaaagcttgaaatttgtgacaaactgttctgattctaagttgaaaattctgagctgttgagattgggacacaacccccaaatatctgccatcgggggtcaactgaagggcagtcactatctcgccatccccttccaagcggtgaagtacggtatttgtctcgacattgctgatcacaacatcttcctcgactgcggtagccagtatcgtaccgacttcgttcatcgtggcagcacatcctcctacataaatagcctccaaatcggtggccgcaaatgtagacctcaaacttgtactattcatcgatgttaaaggagtacctgatgttaccgtattttttttttgagaactgaaatttttgaaattattcctacatggtgttgggatggtatttgaatctatatacaacaaccactctgtggttacccctattatctccagtcgttattggcgttatccaagaataaatcacctttctccaattgaagcccaaagttgtttcccatgttaagcatctgagtctcaagttcttgttcgaaggtgttagcttgtttattgaacttggcaaaaatagcacttcgaagtctgtaaaagttgaacaccaggtttatcaccagcttgacaatcgtgaaaacggcatatctatagacttgaagcagggataatcgaaatgatggtttatccaaattgcttctcacacttagtactatgtcttctttcagtgcctttgtgagttcgtcgttgaatattttcaagcggttgactgtgcttccatatttgtagttgagtagttgtatcatacgcattgatcttgcaatgaatgatagacattgtgggaacttgtccgagttttcaaaaaaattaaccagattgtccctaataacaagttgcttctcatagttggagaggttcttgatcttttcagctcgttcttcaaggtctttcactcccctggtagacatggaagtcatggccacaaacatgtcagttgattgaattccccatttcttagagatagccgccaatttatcataatccagttctaagatagctctccatagatcactatacgttcttctgaaatcatcagtcaaggaaatgcacagcccaaagtcaatgacgaccaactgctgactattatcttctagtcttctcactatgaaattgcccgggtggggatccgcatggaagaacccccatgaataaatctgttttgcatagcaccgtatcaaaacttccaacaactgatgaacatcgaaattgctcgctctgatagcctcactgttaactaaagaaataccttcaatgtactccattgttatcaacctggacgtggaaaaagcaggatacaactggggaactgaaatgatgcccttgaactcagaattatttacaagatttccaaaagtggtagtgttattgtattccactttgaagtcgacctccttacgcatttcaccgataatataatcagcactgaaactcaagggtacctcaaacacccattcatacaatcggagcacattcttgaaagtaaagagatctaattccagctgatgtgcaatagcaggatgctgaactttgagtatcacctttgtgccatccagcaacgttgcctcatgaacttgagcaattgaagcactggcgatgggaattttttctatgcttgaaaacttctctctataatcatctcccaattctttggccagcaatccatcgacttcgctccaatcatcccgtggagcttgatcgtacaaatgtcgaaacttttctctaaattctttgggaaatatggccgactggagagccattatttgcccgactttgacgtaaagacccttgttagagacgatgagctccagaagcttggtagcggatctttcatgaagggaagatatatcatcgtcaacattgaaatgaagcttataatcaatcagaatgctggtgaggacagaaagggaacggacggtcctagtgacagcagaatgcgcccatttgttgtcagcatagtatgcaaaagagcccgtagccaaaaagaatgcaacgaacttgacgaatttgcctttggctttaggttttcctgatgaggccgttgaaaaggaacgtgagatgtaccctggagcaaaattggtggcccgaaaagacgccctcgggatccgggtaagtatccgaagtcttggagcttctggaaggatcataaaagttcgatttaatcaatttgaattacttgggaatgggccgagttcaccaaggttaattcagcaatgaagcttatcggtttggtagggaaatgtctcttggacggcgggagataaaaatggctggtcgcgaaggaagcccattattccccacgggactcccccaaccgaaacgtgttaccccgcgagaacagatgcaagtcatttctcggtgacatgatacatcagcatcgacagcatattgtttttcccctgcctgccttttccttcttttcttattactctcgtctatcaaggataaaataatcatatctaatgggaaaagatatcactaaccacctgttgtttgaaattgcaaccgaagtggccaatcgggttggaggaatttactccgtcctgaagtccaaggctccggtgaccgtcgctgaatataaggatagatacactctaattggccctctcaatgccaacagtgctaacgttgaagtggaagagctacctgtattggatccagttctgaagagaactctggactcaatgtctgggagaggcattcgttatctctacggtagatggttgattgaaggagccccaagagtaattcttttcgatattggtagcgccgcaggttatttgaatgagtggaaatccgacctgtggaacatcgctggcgtccccactccagagcatgatgtcgagacaaacgatgctattcttctgggatacctagtcgcttggtttttgggagagttggttcacaatgatggccacaagagagcaattatttgtcatgcccatgaatggctggccgctgtctgtttgcctctttgccgcaaaagaaaaatcgatgtaaccactgtctttactacgcacgctaccttactgggcaggtacctgtgtgctggttccgttgacttctacaacaatctagacaagtttgatgtggatgctgaagctggaaagagaggtatctaccaccggtactgtatcgagagagctgccgcacatagtgccgatgtgttcactacagtgtcacacatcacggcctacgaggcagaacacctgctcaagcgtaagcctgacggtgtgcttccaaatggtttgaatgttatcaagttccaagctgttcacgagttccaaaacttgcatgctgagaaaaaagagaagattaatgagttcattcgtggtcacttctacggacaattggactttaaactcaacaacaccctttatttctttattgctggtagatacgagtatcgtaataaaggtgtcgatttcttcattgaatcattggcaagacttaatcacaggcttaaggcatccaattctaacatgactgtggttgcctttattatcatgcctgcaaagacaaactcttacacagtggagactcttaagggccaagccgttatcaaacagttggaaaacactatcaacgatattgaagctttggtcggaaaacggctgtttgagttctgtcaacatccagctacttctagcaactcctctcatattgaaatgcctgatatcgacgacttgctcaagccatctgatagagtcctgctcaaacgtcgaatgttcgccatgaaaagggagggattaccacctatcgtcacacacaacatggctgacgatagtactgatcctattctcaaccagattagaaatgttcagctgttcaacagaccagaggaccgggtcaaaatcatttttcatcctgaattcttaaactctaacaacccaattctgagtttggactacgatgagtttgttagagggtgtcatttgggagtgtttccatcctattatgaaccttggggttacactccagcagagtgcacagttatgggtattccttcaatcaccactaatttatccggattcggctgctacatggaggacttgatagaaaactcttcagattatggtatttacattgtggacagaagattaaaatctgtcgatgagagtattgaccaattgacttcttacatgttcgatttcgtcgacaagaccagaagacaacgtatcaaccagagaaacagagttgagcgtctgtctgatctcttagactggcgtcgtatgggattggaatacgttaagggtcgttcattggctcttcgcagagcttaccctgacgagttcaagaaccagaacaatgagcactctaacccattcagcgaatccaacagtatcaaaatcactcgaccattgtccgtaccaggttcaccaagagataagtactccagcagtgccaacatcatgactcctggagaccttggtacacttcaagagaacaattccacagactatatctcgtggagattaggaaatgatactgaagaagatggactagatgtaacgcttcgtggactcagtgtcgccccaagtgccgagcaaagtggtgacgaatttgatgcctgaaagctgaattttgtagtatccatattctaaccggattttgtgacatcttttatattataactacgcccttcttattggctgttttattctggtccctcatcttgactgtatcattgtaggacgaagagtctgcttcaatcttggatattgtgaattttcgaatgctgacgagcctgagttctctggacatccactttccgttttcatttctgagttccacggcgtttgagagaagtatgttgcaatcgtcatccagtgctatcagtatccctttgatctgtcttccatctgtgatggaaactctgagtggcagggatatcagatcagttggatggagcatggtgagttgtgcttgtcggaaggaaaatcgttcagtggagaaagagagatgcccccattgtgaattgtttggtccccgcctagaaaaccgtatgcgcgatcaacatttctatcaaaccttttctcctaacacaacaaaacccaatggctcctcatccgtcatcgatcttgtttggggtccaagagggctatcagctgacagcagtgtctctcaaatcaaacatagcaaccaaatatgtgcttaataatgagttaatttccggtttattgcatctcacgcaggaatctttcaacggggacaccaacgttgactttaccaagatcaatccttccctggcaacggatccccaacattatgaagaatggagcaaaatattacagaagcaagttgatgcactggagaaggaacaagacctaccagattccacctaccaagagcttgaatctctcgacaatgacattgccaatctggaaagggaatatctcacgagatacaaacttgattctaaacttgaggaggacaaagataaacaacctattcgggaactggtcgcactcaacgatcagatactgacaagattccaaaccaaatatcacaagtacgtctacgaagtcacgggagacttgaataccgtaccgcatgtcacggtcgtcacagacaaaggcgaagttcaggaatcaacacagccagaggaggacgaggatgaagatgtagaagacacaacgccccaagagtatccaagcaacacatactaccggattcaaaaacgcttagttttctagccaaactcggaaatagattagaaagaatgcttacataatagctcagtaacgtagtattcgcgcggaggtgtcctgtctcaggctgaccccatactcaaataatcttctctttgtctcaagagtcgactctacttgctttccaacacagccgcctatctactatgagttctcccaagcgacgcatcgaatcggatgtgatgaagctactgatgagcgactacgaagtgaatttagtgaacgacaacatgcaagagttctacgtaactttccacggtccgaaggaatccccttacgaaggaggagtttggaagatacatgtggagcttcctgatcaatacccatataaatcacccagtatcgggttccaaaacaaaatattccacccaaatatcgacgaggtcagtggcagtgtctgcttggatgtaatcaaccagacatggagccctatgttcgatatcttcaatatttttgagacattcttgccacaactgctgcattacccaaacgctagtgatccattgaatggcgacgcctctgccttgtacctaaaaagtgaaaagacttacacagagaaagttaaagaatacgtcaagaagtacgccagcgcagagcagttccaaaacggccacgcaaacggcaacggttcggacgaagacgaggacgaagacgaagacctgagcagtgtagggagtctcagtgacgaggatgacgacgatgacattgcgggtacaatggatggtctctaaagcatggatgtcaaatggcaggatggatgtgtgctaattttacacccccctggcttatttcgatgtcacccgacttaactaatatttaaagagtactatatagctaagacacgacttctttttagacgttctagaacggccctttttccagatagcagaggtagctagtaacgttaccaacatatgtgatatttattaagaagcagttagagttaaagttgaagaatatccgccgtacatggctccaaaaacaatactggatgtccacgtttatcaccgagctcatgacgacgccataggacattacttggcttttccgtggaagcctatatgcactcagcggggttttaagacaggaacggcatttgcctatataggtcataattacgtagtaccgggtttgtgttcttgcatgatggaaacttcgtccgaagcttatcttacgaagttgtagtggttgagaccatggtgtcgatcgatctattaaacaatagagactgcgtttaagttacataaaaaaatacttatggtaagttcggatgggatcatgttcactggggagtggaaatttccacagcgggggtgcgatcctccatcagaaacggctgcgtttgattcagtatctccaattctaaagataatgggttgtaattatcatcttcgtctcccagtgaagtctctaagcgaggagagagtgcctcggaaatggaatgctgctgtgcttgaggctttacctggaatacactggagttaaaaacaaagtctggctgggactggcccacaacagggctcgaaggctcggttccaaaatcaaagttcatgtcgtagttatcttgttttaaataatcgtccatcatcgtttcaggtgctgcaaaggaacggtaatgtccccgttggcgagagggcgcacgatcgttttgcagcattgaccatatgtcgttgttaaagtccatttggttgaagtcgacattcacctgcggcattttctcggagcttgaaatgtaagaaaccgggctgatgaacccagaagtgggagcactagctggtctttcatcgaatatggtgttgtggtccatctcaaatacagcagtgctagctggagagctggagatgttagaagctgggagtgtctgtgtgttcgtgctggtgctggtggtggagtttgcagtagaaggagccaccaagttagcgttgtgggaatgctgatttctttcgcttgaggaagggcgcatcgaagcagactccgcctgttcgacttggctgttatgcattttgggagaagatgggttagcaatttgtgtgttaatctcaatcactgagttagatctctctgtgcttccaggcataattaatacaccgtatttctcgtcgtgctgtctgatatattcgcagcaacgatctccgtacgccttcggcgttagaccagcaacagatttgaagacacgatgaaagtgccatggagatagtttggatttggcagctaactccttgaaacccaacactcctcctctgcgcttccgcctctttcggttctcatcggcgttggatgaggacatgagagcctcctctgcagaggcatgtttggaggacatcagagcacaagcggcagccaaggcgatgtgacgacatgccaggtcaatcagcttaagatgatcgttttcgttcttgctgagcccattgccagaatccgagatgtcggggacgctctgcctcctgccgacaatcttattcttgatgaaactgtgcttgatggtgttttccttctcctcttcttcatccaacaatggaggcatgaacccgatttggtggttgacatgctccacagttcggaccaggaggttaacatccacttgcagggtattgatatcgcccccgtggttcggggcaatgcaaaagcggcacttagagaagcccaattgctcagcttcctctatggtatcgacgaaagaaacatcgctcttctcattcgaatggttgaaccccagtccacagttcggacggcaacatgtgttagtgcgtctgctgcaaacaaagaacttgtccgctgcgaacgggtcgttaaattggtaggcattccacctgctggcttctgtgtgataagacatttcttaaaggcaaattcgggttggagaagatgaatttgaactgcaaaaatgacagaagtcttaagaaataataatggcgtaaggaaagggatgaaggcattttttatatatccgcgcatcgatgatgtcagaattccgaaaagagggggagaacacactcaacttttcgaacatgctttagtggtgacgatttcgtaagagtaatgccggtttctgcacattatagagaggcgtccctagaaataagcggttgtgcacaccacatacacataattaatgcacggcggggaattcttctgcacatggatttcatcttgaggaacaccgtccgtctttcggagaaaatgacgtagtcgttttagagctcacaaaagcgctgtgcctttcaagtattgtttttggaaaaccgcacagttgtttccctaggaggaaggtctacacttgggattcaagaatggaacgattttttcattttttattgttatcccaaattccgcccagaaaaagcggtctagacaagcgaggcggagattctgcttaacaattgtaactgcccctttaaatgccttccggggcgccattcttcccgccaagtctacggtaggcctgttggcctgttgacttcccctgagaaacggtcactacgtaatattacactactgttgtacataattacataactatgttcacatagttacataattacataatgtcctctgctccagacgccgacccacacacaaagttcggactgcgcgattacattagtaagttttatggccgccctctcttcttgggacatattttatgtgggttccttagccgccgtctccgcagactcacacagcccagtggactggactttttttcccgcccccgaatatctcacacaatttttccttacgcattcccgccattgcccaaaatggggtcatagcccgagaaaggaaacctacagctctttacccgttttgattttttcctccacttatcaactaacgcaaaaaactggttggtacacctcttatctatctcagctaataaccgttatcttgccacgcagtgtacaggaaatagtcttatttttgtagtggaaagattttcaatggtcaaactgttacttatccatgaatcagcaggaagaagctactagtatcctgttcaagcgccacggagacctccattttgccaacctcaaatacggctatgtggtgcttctgctctcgttgttgtatctggtctacgagcttgttgttggctataagtttacccgaacgctgaaagataacggtaaccggcggaacatttgggccatccttcactatgcttcccccttgaagaaagtgtttgtttggctcgtagcattgactgtcttggagctgattggagtgtttcactaccatgataaacctggcctgttcttgaaacgcttgggaagaatggccgtggccctgttgccattggacatcatcattgcattccgacctagtgtcgtgctttttcagaactacctggacctgattagcgtccatcgttggttgagcagggtcatcctgttgtttagttttctgcacagtatcggattcttcatcaaatggatagtcgaaggtaacccccattttttgttgctgaaatgtgatattgcctatatattactggctgcctttgtggttctgtttgttgtctctatcaagcccgttagagtggctaactacaaaaccttctttattgttcacactctcgtcgtgggcatgtttgtgggcctcattcagattcatgcaaaacccggagtattgtggtacgttgtggcatgctccattctgttggcctatcagctgtttgtgaccttcttctacttatgccgaacaaaatccgattcaattgaggataacggaggcgacctctcagtcatatctatcgatagaagaggactgccaataccagaggatcaacttttgccgcatttaagaatctctgcagattttacctcttcttggcggaaatttcataagattctttacccatcccatccttatacgatcgccagttacgatgaagaccattttcatcttatcgtgtccaataagaacagatttcaatgggacgctaccccagtgtaccatctatccacaatcctttacacctcccccctaattgctccaacaatggcagagtcgattaataatgcaatcatcatagtggcaggttcaggaatctcaatgggtattccgctgtaccatcttctttcttcgaatacagaggcaaatattcagctggtttggattctacgaaacaaggccgacgtctatattttaaagagatttggggtcaaaggagccaatgttcacattaccaaagaaactgaagagtctcaatctaacgtggttcaagacgaagaatttgaacatttccttaccgataagaatgatacggagctccaagacttggatccagcaacaaaccttcctgacgaccatttagaagctgaactgaagcgagatttggaaaccgacttagacccacacgtctcctcatcctctgaaggtcataaagaagaagaaactccagaaaaaactatttattcatttgggcgtccaaaaatcattgacataatcgaaaactactcctcatcttgtcaaccgtcaagccaaagatgggtgttttcatgcggtcctcagtcgttagtggacgacgttgaggatgctgttgatctctctaatgatggaaagcttgactccgacaaaatcttttttgccaaagaagtgtattccatgtgaattcgataataatgaaattaggaatcaaaggagaacaacaaaagcaaatcggaaaactatagaatccacccaacgtctttccccaatcccacccactatctaactaaccattatagaagcttatttaccccactataaaaaaaacggcgatcacgcgaccactcacgtgacgtatttatagaggccctagtttgccacctccatatcatatgatatacctcttaaggccagtagcgcatctccttttcttactaacgtctccaaatcttggtaatgcctaagttgaagcaccccaaaccactgagcttcaataaccctgcggtgggctcgccattgaagaccgtcttttcgtctgttgacttgccgtcggaagaagaccaggatgattctgtgaagatactatcagatttggaattctaccaccttgactaccctaacaatgtcgatttcacagataaaggatcaccctatttcgctttagataaaccacccactttgtatctaccaaagaagttgccttatgctatagaatcagtccacgatcaagcccggtatctgagccatatcgttaagcatttattcattgccatcaatactttagattttcggaatgcaattcctctcacagccaaagatttgcacaattcctcttcaattgcccaagaaagtcaattagagtacagagatgaagagaatttcgtggacaacgaagaagatgactttgaggacgacaacggtgacattgatgaatgcattgaagaacatttgctaggttcctctactcctgcatcacaagttcaaccaaaatctgcttcgatagtgagcttgaagaattggactatagaattgctgtcattcatcaagatgaaaggaattatacccttagaccttagaatcaagctcatcaggacgttttacggaataaacttggttcagggtcaaaatcttcaactaaatctttatctgcatttattcaaagtactttgcaaggatcaaaagatgcttaaaaatctgcatttgccctggttgcaattgatgaaacagttagagaattactaccctcatgccgattttaactatgactcaggagatcgcaaacagttcaataagctactgaaactagccacttatgctaaccccttttttgatgagaaagacattcctgaaattacagaacgaatcctatcgaactttaccagtcaaactcaccatacggttcttgttgttttaaacagcatgttgcccatcaaagtagaaagagaatatatccccacattgtttttcatttgggagagaatcccaccttcaaagtcgacgaccgagcttgtttcaatattaggtaaagttacggaagaagctttggtggctattgcccaagaagataagcagagtttgggactctatggtgtgtttacccagaagcagtttgaaactatcatgtatcacttggttcctagcctcaagatttatccccaatctactagtataatgcattctaagagctccaagtctaacacactattcaaagcatacgctcaaataatcatcaactcaattaccaaggataattacgaattcattcttgataaactgtcaacaatactgtccgttatggctaattatgcacatccttcaaatcctggcgtttggtcttcttcaattgcaaaattgtgccatgcattgtgcttacaactttatcggcgtcatcttcaagaaacgaataaatatcctcataaaatgaaatctttgacagctcttccttcgtccatcaaactcaacggtgtcattactgacaagataatcgtgaagctcatgaaggttataacgattggaacccaatcacggaacaacgaggtcgtgaaaacgtatactgcttgtctttcgttgttgggattcatcaatcctaatgttgtacttgataacgtcatcacagatatttacacgtcctttgatactgtcaattcctcgcacagattggctgtggcactcaaacagtgcactgttctggccagatatatggcaatcactccggtttatcgcttacatttgatcagactgatgtcgttgtttttggaggcaattgattctaacgacttgagtaaatcctacttggcacttcagttttttgcggcaacatctttatcggttccttttcatgacttgagtgggcagtctgaagcatccgatggaggtatgctagcaatggaattaacatcgcaacatgtttcctacttagaatcatgtttcttttctccaggcgaccatgaagagtttccgatcgacaaagagttagaaagcttggcagtgaagtctgcaacatcttccttcaccttatttatcaaacagttcttttcacagctaacgaaattgctggagaacttacccaaacctgatccaaacacagacaatattgagctgaaaattgtaaacttcattccagttgcaattggtattatatttaattccctgtccatagacctttttagaatttttgctaaagagttccttgaatacattttggagaacatcaatcatgaaattactgacgtgtacttgaacatccttgcttgtatcattaatcgagatgctgagtatcaggtaccaaagttctatcacaatttgattccaagaatcaagctagaaataaatgaaaatggagctggtaaaatcattggctcttcagacgatatttcttcacgagatcgtgctcttgcatggtatgtttctttgctcggagcaacgatggaaaatgctcacgaagaactattaaaattggctgacgatgtgctggaaattactgaatttataatggacgaatgcactggaagtgctgcccttgtttttggtcccaacttgttaacttcgatcttatcgacgttaaccaaatcgtctatgaccgaaaaacttttgataccagcttatttgctcgataaaattgacgaatcgtattggggtgcatttcaatttgactacaaaatgaagtacctagaggacaaaaatttcacgactttcaaatggttcctgcccacagaagaaaccgttgaatttgcagttaaattattggaaatacacgtgcaaaaggcattgaagaaccttgaaaatttaaaagaaacacatcagtcaacagttttccagaatgaatttcggcgaaacgtttcctacattggttgggcattgtttggtgtggcagaattgtttgaccctgctttcagcaatgaatccgatgataagctggaaaattttaaaggaagagaaacacctatcacagttagcagaaatgaaacgccagttggaagctcaccaactggctcaaatgccaaggacgaagattccaacttagactgttttgagaacgtacccattagctcgtacaaggaggggagcaaagaggccgacgaggatgaagagggttcagaatatgaagtgttttctaaggaaaactctgtcacccctgaaaacgaaacatctttagaagattcgccttcgggtatttgcccgtcattgacatcaagggatagtaagctatacagatgcaactacttttttggagattccaagtttactaaggaaagcagtcctttgtatcataagattcatcaaataagactgtcaattggtgagtcacttcacgacatttgcaactttttgatccaatatcatgaagctgacgtagccgctttcaaatcactttcaagcctgtttgctgtctatatttgtgatgtaggcgtggacacctatattcaaactggtaaaacgaaggattcatatcgatttttgacctcgttatataatctaccaagacttagaaaaccgtattcaagaccgataatcggagaaaggatagaattgttccatcagcaacggttatcaacatttggtggtacaagaatagtcaattctatagaaaagcagttggttcatgatctggtacgcctttccatgagcgtgtactctgatattggacttatggcacagaattgtctcctgttggtcaataagaagttgataggaactctgggtactattgtttcagggttaaacattgtgagcaaggcaattgatgataacgatgacctgaagattgaaaggtctctttcttttttctacctcaaaggagtccgaaacaagatacaatctaactacgttgagctgacacgatatatcaagttattgttattatgtttgaagcgaagcaactctattatatatgacaaagcgacacaccttttcaaggcagttgtgtcagcctggagtttaccttcatccgtatgcaatttagactttgagttgatcaacagcattaagcccccgtcggatctttttgttgaaagccaaatcaatatactcagaattgctaaggagagtaagcgcaagattaatgcattccacatccacaaacttgaaacagagctttataactcatattgggagaatgataaatcatggcagatacagtacctaattttgaaactgcttattcagatcgaaaacgaatatgaacacaaagatttcagttctgatgttatagagttgatcatcaacaactgtagcaatgagcatcctctactgagtgatttgtgtctttgttcttcagtaagcattgtgaacaaatttgtcaatctttcattatatgagcacaacttatcgaatatgcatgatgttgattacttggttaaagaattcactcgtattgatactacccccaagaaagaaaacgggaataattatattaatgaatatttagctgaagtccacaatcttgaaagtccaaaatacttttttgacaacaaaataggcactaattccttattttggagtcgagacttgattgctataaaaggcgacaatctttcatcaaatgagctagatctaactccaaaagaacaagaactcttcagacgtttaggacagaatgtgatgagcaaagaatggttctacaatattttcaaaactatggtccagggattggaacagaatcccaactttcgatcgtcgcatgtctatttcacagttaacgtcattcagatgattgtgaacaactatgtccccgcatctaagttatgtgttcaggacatcatcgatctcattgacctgatatatgttaaggatgagaaagccacacatgttttgacaatggagctcattatcggactgatattagggtacaagatcgctgatcagaagtataaagacattgtgtgtgagcaagttcttggacgctttgaaaagatcatttgcaatgatttgtctcccgacacgtatccggtatggagtattttatcctggtggctaccgcaacatttggatgtcaggcggtatcccaagatatttaagttctttacggattttaaatttgagaataccgatgaacgaagcagctttgggacacattcccgtttagggctgctcaagtattttattagcagtttgggaaaaagatatcccttaaacgaaactacgttcgacaatttgattggtaatatgaacagttccttttccaaagttagaattcaagtctcgttgattttgtcgatgctcacatttattggaatagcaaggaatccaagctcaacttttcaggagtttttagtgaacgttaagaatgatgaggaaaatgttgaaactcatttggggattgtggaaccttataagtcagcactctcttcatgttttgagaggatagaatcattgaggaaagcaacaattgatatgaattctcaagacgttgcaagaaatgattatatctacgtttccaagacgttcattaagtatatggattctttatttttcacccaagaatcagctgccattcaagccaagtctattgtgccatatatccagtttctattcaagctagatgaaagaaaggatgtttgttatctctcacagatttcaccaatgcagtcatacctattgttaccattctcgttgagcaacggcaaaccactgcaacttgtccttcaaagtttattgaacctacatgatatttcccaagatcctctgtggcatcagattctgtcaattttggactttaccaaatctattttctatttgaaatacctaatattgaatactgaacagcacatggagctggtcaattttgttgcaaagtttctattccatgggaattctgaagtccgaacatctgctgcaaaagttctatcaggtatgattcaaacgttgagtgatagcgaggtagagtatctcatttccaataatttagccgattatctgaaggggcttactgctgacaagaaaaagtatttgaaactaaaaacaaagcccaaaagctcgaagtctgaagatccgaagaaggatctaccattactattaaacgagttgcacggctacacccttggaatcggaagttatttgcaagcttttccttatatctcgccaattcctccatggattcctcaaagtttatcgattcttgctaacaattcagtgagtgtcgaaggtatcgttgggaaaactgccaaagatcttttgagcacatttaagaagactagacaagatacatggcatatagacagtaagttctttggccaagatcaactagaagacttggaaggtgttctttggaaaagctatttcatatgaaaagatgaaaaataaatacaataaatataatgcgtattatgatacatgtgctttagactgcactttctaattgcaatttaaaagcttaaagtttccagcttcttcgtcacctgggcagccccatcgatagctatattaccaccttcgataggtaccttagccctggatgactccaagccctttagtaaaatgcaggctttacaaattttgtttgtagatagataaccacagctttcacacttattgccatctttgttcagtgaaacggagccatctcctcgcacttcaatctcttgggcagtgtttctcttgacaacgttcttacgctgtttcttgggcttaagtttgaaattttctccactttgaatgatgtctattatacaggacggtttaatggcttctaacgatttcaaaagagttctagccgttcctctaaatgcttctggagcgtatgtgcattctgtagagaaataatccagttttttgtagtgtgcataaagcacaatttccttttcgtatgtgtacttgaatggtttcgatctcttgataggagatcccgaagactgtgtaataatgttggtgctggactctaatctgttcacatctcctctgagaagattcataagtactgtctctgccatatcgtccgcgttgtgaccagtgaccacatgtgctatacctaacctagcagcacccctatctagcgcttgccttcttaaaaccccacaataggtacaactactccgtatcccagcacaggccacaatttcgtccatagaccaagaatagagttctttatatgatacgatctctagcggcatctggtattgttctttgtttcttttaacagtggcaagactgtcatctcgatagccaacgattccttcatcgatagacaagagaaccagttccaagccatagtcatacctttcattcaacgtttttaaaatgtgggcaagcacagtgctgtctttaccaccggatgcacctatggcaactctttcccccttgtgaaagagatttgcgctgatgatagtattatgaatttcggtctcaaagacattgtaaaagcattccttgcatagtttctgaagcgtttttggtcttttcataacagccttacggctatgacataaatgacaggcagtctttgggttgaaagccattgcaagagcagtttgatgattccagccaggatagtattcaaagagataaaaaaaaatatttcagaacgttcgctagatagagagaggttggtggggaaaatgatgagttgattaactcccgttttgctgacctttacgtgctaaagtatgctttttacaatgacacgcatgttaggggaaccatttattccataatctaagcttttgaaacgctaaacagccgtttcaactcaatttttcacttcacttcatattctagcagcttacataatcagactaaagtttacgcagcatttgatctcactcgaggtaagcaaatttttttttcttttccaccagccaaacattaaacagagatgtcccgtttctttgcgtcaggttattcagactcggatctatcgtcatcggacgaagagctcttgtcaacttccgaagaggagctcatcaattccagtgctgatgagcaagaggcagagcaagacaatgacgaaagtagtgattcagtgttcgccactgaagaagagtctgacgactccagtgacgacgattatggagctagagctcgcgggccctcctacttcttgaagagctcttttgctaagaacaattacagcgatgaggacagtgaaagcgaaggagagggtaagaaagtggtgaaaagttcaaaggataaacttttagatgaaatgagaagtctcgtagacaagatcgaaatcagaagagatgtcaaggaatggatcgggttgttagctgagtttgacaagttgaataagcttttaaccaaggctcgtcaacagaacttaggtatcccaagactgtatatcagcatgatcgcagagttggacagcactatttctgaaattggtaatgaggagatcaaagccttgaaggctgatagttccagagctttcaacacaactaagcaaagaacgagaaggtttgttaaagaacacgccgctgcaatcgagcagtacagagccaaccccgagacatttgagaaagagttggacgagcaatcagaagagaatactcccaagccttccaaggctcttatcgacgagcttatcacttccctgagaaccattcaagaaactcgtggtaagaagaacgtagatagagacgagcaaatagccactttggaagagttagttcaagatgcaaagggaaacgatttccattccattttggtgtatttgatgttaattccactgagatttgaaagttcctctcttgtccaatctatgccaatcgaccaatggacaaaggccaagaatgaaattatcgcccttctgaaaattttggagaaggtccgtaatgagtacgttgtcacagagctggctaccgcaacagacgaattgggtcaagagccagaagctgataagaatggtgtcaaacacattttgggatctgtgacagctttggttgagagattggatgatgagctgaccaagtctttgcaatcgacagatcctcatgctaccgaatatgttgacagattaaaggaccagtcaactgtttatcaactactcctagccaaccaattgtacttggaatccataatcgagcctgctgcctactcacagaaggagggtgaacagctagctagggtcgtgttaaagagattagagaatctttattacaagcctaccaagctgattatcatcagtgagaaggtcggatggtctaagctgacgaacaagcaatcgttgatctaccctaagttcgaagagtcagacgatgagctggagtactgcaatggacttataaaccatctttcatctttgctatacaaacaaacaaactccattttcaggaaaaaagccatgttatgtcaaatctactactattcgttcaatgaccagtattacaaggcacgagacatgttcttaatgtcccatttacaatctaccattcacacttctgatattccattgcaagtacttttcaatagagctttagttcaattgggattgtgtgctttcagagcaggcttgctaactgaaagtcagcagattttgcaagagatttgcacttctcaaaaacagaaggagctacttggtcagggatccaaccaaagacaacagcctgcctctcaaattgacaaacagagattggttcctttccacatgcacattaatttggagcttttagattgtgtgtaccttacagcgtctcttttgttggagattcctcaaattatccagcagagttctggcagaaaagtttcaaacaaactacaagctacgaaatctttcagacgtacgctagattactacaacagacaagttttcattggacctcctgagtcgacgaaggattacatcatgagggcagcctcttccttgcaggctggaaaatgggaacaggcaatcaacttcatttcatctattaacatctggagtctgttcaacaatgctactggcatcaaggagatgttgtatgagaagtttcagactgagggactgagaagctacatctttgccaacatattcttctatgagaagttgtctgtcaagcaacttgcaagtttgttcaaactccccgaagccaaagttcttgctgttgtatccaagatgatctacaacgacgagatcagtgcatctttagaccagttcaaccagtcgattgatctttccaaggattacgagttttccaagctccacgaacttgccctttccttagccgacagatgccaacagctggctgagcgaaacgaaagacttgcatctggtggacatcaaagccagtcttccaatgtcaaagaccaaaagaagatctatagtaaataagtagaaacccgagttttatcgaacgcttttcagttccgaaagaggcaaccttgcataatcattcccaaacgggaaattgtgcttgacatgcattaagtacccttttagcgaccctacctttgaaatctttattcttcttcagccctgccctgtgtctaaatctgagtacggcgtcatccctcttacgttacagcgccatctcacctccagttagaagtttctaactataaaactccagtatgaggtcatttatgagatcacacaagagagagtcttctctcggaagtgaatccgggctggctccccctcagataccgagcagatatgccgaacttcatggagaatttgtgccaaaaccatctgtcactgccccgtcttctccgtcatctatcactacagagaggaagagcaaaaaccccatcaaggtgttcatgaaacacaagagatcttcctccaatctgtctccagtttcaccaacggtaaagatttccacccatgaaagcccacacggcctgccgttgttgggcaccaagctgggcaaattgaacaaacaaaatagttcgcccgagagcattccaagactgaaagcatccatgagttccgataatataaggccgaccatcgtcggtacccgaacgtatgactggggaagcaaaccaggcacttccaaaaagaatgaaattaaacctgaaatagttgatagaatcaataatgatttttcaaggtcgagtaacgatttgatcgagaaccccttttggccacgctacaagagcgtggggacggttgctctagacccgggtgcttcaaagcctgcgagatcgaaggaagatcccaattcaaatgattcacagttctccttcgacaagagttcatcttcaatttattcatcccgaaaagagcccacgaagcagtcagtgcctgcattaaacctgaaagttgacatattcaaggatgaagcggatgagaacattgtgcctgtcactcccatagatcagcagatttcttcagagttctacgatcaaccaccccagcatgacgaagatcccccaagtgatttatcgtccgtttctgacttttctttcgaggagaactggaaaagctgtagaaacacctccattcggtattacaagagccaagcacagctacaagtagaggaagataaaataaagtctaaacatgaggctcagttacaaaagaatttcctgggatctgacttcaatatggaagactttcaagaagactttaattatgatgatgatgatttaggggatgatactgaagaattgttcaatagaaatctatttgaagatgaggacgaagaggagaatgaacctgtgtgccaggacgattgcaaggagaagtgggaagcggtcaatattagccaatccaagattgaaccccctttatctactagtttggaaagggactcactgacacctgagaaacctagcatggacttgtttgggtatctggataaagctgaagctcaagcaggtgtccagccacctccgaagaaagatcaagaaactgccaataaagacacgaaggagcatgatctgtttaatgaactaggtcgccccaaggaaaacctcaaagtccctaccagtgaacctcccaaaggactttttgattttttgcagaatgctgaagctaagcaatcgcaagaacgactcaacacacaaccatcatctcaatctccatcaccatctccatcggatacacagccaacaaataacatcttatcgttattagcaaaagcagagaataaagaggaggagaaattgactcaagagaaggccaaagcaccaccagttaccatcaagcccaacacgttcttgtaccccggtaaaagtatcaagtatcatcagcttgctactacagaagacactagttttactagtcgatattcgtggttcccagatgatgataaatccgaaagtacacttctatccggtcagctaagggtaccaacttcagaagatttgtatttggatgaagttaataggattccggaggatatcaatgtctcagagtgtcgaagaagcagatcatttcaaggagtacagaccccaagtgagtatgatataaaagaatgtgaaggtttccggagattcaaatcaatgatcaataaaccaaataagagaaacggagtccccattctggggtccgtaaaacccaggtctaatcgatttgaacagaacaataaaactgtgacccttttccatcatcaagttccaactttgcaaacaattcatggccttggctccgattcatcgtcatcttctagagagtcggacgattcattcaaaaacacaaacggagaactgataactccaatcacatttaatgaaatgccaccctttcttgggtttaagaatcatccagattctcctttaactacaatcagtgaaggttcttacgacggcacacagtctccgttggaaacacatatcagtaatttttaggttgagtagcatgcatactagttgaaaataattgaagcattaatttatcatttctcttgacgtttccaagtgtgaaaatttgtgtttgcagcctcaaagctaaagttttcatcttgcctgaccacaggaggctgatattggggttgataaggcgtcctaatcttagttgtcttcaaaactgtagagttgactttgtctttaggaaaaactaagtatggcaaattgaactgaggtttgtagtcgttgtcttttaaagcacttccaagtgcactaagatcgtctgcgaggaaattgacttctttatcttcatcttccatttcattattgggaatggcagtttcgtttatatttgttattatggatgtatccgtatcatcatccaaacagtggtaagttgctgattgatgcaataaatctgtatcagagccgaaatcgctatatgtgacacgatttagtccacttaccgttcgtttctgtaaaatctcggtttcatctccaggaacaaaacttaattctgatctggcgctggcattagacacgcttctaagagtgggttgtttgtttgaaaagtttcgaccgccattataatacaatgaataaatacgatttaattcatgatctgagatggttgagtctgctctagcaagagagctgggttcatcatcaaccaaaacaacatccactacctttccatttgcgattcttcttctgataatcgacccattagtgttaagtgacggactgctaaccaatgagatagtgtcttcctttccagaaagatctatcaaaatgtttacttgcttatcagcctgatcggattctatagtataattttcttcccccatattggttgagcccatacatgaggggtcttcatgctgaatattaggttgctggaatatatcatctctcaatgattgacgggactcaatatctgattttgaaggagactttgagtgagccatggaattgttaacggaatgaaaagttatcgatgccagactagattcatcgatatttctagcagaaggtgttcttgtagcttcaatttggagtgagttctcgtcgttgtcatcggtaaaaatgttatttctcaacgaaattctatcactctgactaagctcactttgatgaccacgacgggagggagtcttcctagcagattgttgctcaccagacatgctattcccttgagaggaagctttagaatgcgccgactggccactatccaacctagtctggtgtctcaatggagacggatctcgaacagcagttactttctctggatgcaaacagtcagctttcgacagcaaatgtgatttgggaagttttctctctaaagatgagtctcgtgaaataccaggagtaggatttacagattcgacagcctgatacccatcgcccgttaagatgaatgtgtcagattgtcgttttcgattctgtttgctgagtttgtccgggaactttatttccaaaggaacaggtaactggtatttatctgaaaggttaacatcatcaggtctgacgtacacatccagtttcttcctaggagatggtcctaaacttgcactaaaaattgacgaatccctgctttggacgctcttcaagggagagggagtcctacttagaggcgggtacacagccttccttccccttttttcctgtgatgtgttgctggtcccagagacgtttgatatcactgtagagggcaaggagggtagctgagagctgatgctttgtaagtcatctggtatatctggtagatccttgactgacgcaatcatgtgaccagaagactcagggtcaggattgatagacggaggtgaaacaatggtttgagttggatattatgaaccaaatgagaatgctgtctgatatgtcttgtttaggagatgtgtaaacaagctcgcgcgaaaaaacctgaagcatgtcggaacactgcaaggaacatctgggccgagagggccaggtcgatgctacgagggactcatgaggtagacccttaatgacgccattggggaccctacaaaagccaacaacggatgataaactgatgggcattatctcttccaagcgattgtctaatttacgagcgttgaaatagttctagttttttttcgcttctttcagagaggttccacttccgggatcctgaacgacactagaaataatatgtggtagacggctccctcccatggatgggcttcctaagaccggcaagtctctagcattccttactacctcgtcctggatccatagtagcacaaactgagcatctaatcatcagacttaaactaaatattcaataaatccctttcaaagggtagtatacaaaaacgaacgactatttcaccccatcgccttaagactcatattggttcctgcttcaacactggttccaaattcgaagccccggactcggagttatcagttttcagctgtgccttacgacgaagtctctccaaatcttgagagtccctctgggcacctttttccacaaccaagttgcgtaataatctattttccatttcaagcctttggatttttagttccaacttttcagcattctccgtcagctcctttatattgcgctccatagcttgctctttcatcttcttttttatacggaacctggcagaggctgcagtgttccttcttctcttatcgtcatctgccatatatttatgctctggcacctgtgccgacgacgcattggatgactttcgaagtccctgctggacagaagatggttctacactagcagaattgttaaaactgagagatgaaaccgactccgtctgattaccacgacgctgctgaccatttgactgaaccccatgaatttgctcgtaaggtgaaatggggctcgtagtgctggtcgcatctctattggaaggattactcgagccagagttgtagttgaatacgtcgtttaggctcaagatggttctttcattaagatttgggttcactgattgcaggtagtttgcttgttgtcgttgttgctgtggttgaggtaaatgttggtattgcgctaccaacgtggccaaggtatcaatctgggattgattcagaccagctgctaccagagaggacatagcaccaggaggaacgaccgccttcggaagacctgataattcagtgccagacttttgtcttccatggccacggtcttgtcgctgaaagttcaacggtgaaggagtgttagtgccgatcgtggaaacagtagcaggatcatttggctcatcattgccgttattcttcggcttctcttcatcggggaaaataaatgagtcgtcggcaaaagctgctagctcagcagacagttgatcatcgaaatttgtcgggtcgacgtcgggaatgttcagatgatcaatatagaccaactgctccaacagagcagctgacgtttccgtattatcctgatcctggctggttccattaaggagatttgtttcgaccatgttctctctgctgaatgacattgtagtggatctgctcctaatatatctggtgaatctcgagttgaagccacagaccaagggaagttgaatgtggaattgagttcttggaaggagaaaatctcaaacggtttgaaaaaaaactttgaataaactaaaaagacctatttgagccggacttgaaggtgatgttgagatacttctagaggctttctattggcctttgtgacgagtagagtcctggacgtggttgcttaagtgttgagagctaagcaactttgtgtcttggctagactatgggggaatagtaattttgctagattctgggggacattacctaagcaggataattcttttcagtggcttcgccatctcacgtgatatggcatgacatgttttttttttcggcaactggattttgaggaggtttggagatgtttacagatatctgcgagttttcgggtctaaccggacgttggaagaaacgtttcagtgattacataatacatttgtttttcttttcacgatgacgttgggtgtgtcatttattcagatttttttttttcgcatcgcactgctgcagccatgtcagtcggtctgaccccgccgcgctacgctccttccttccaggaaaccaggagttcccttctacaacctgcatcctcccaccaccttctcccccagattcgtagaaggaaaaatgaaaaaaaaaaatttccctttgcaattaatcatcgcctaaactacccaaatcctatcttaaacgcaaaatgtctaccattctggttgttggtaacggaggcagagagaatgctctggtctggaaactcattcaatcccccaaggttgccaaagtttatgtcgctcctggaaacggtggtacccataaacttgacaaagttaccaatgtcaatatcggctcttccaaggagaatttcccacaactagtccagttcgctcaggagaacaatgttgatcttgtggtgccaggtccagaacagcctctggtagatggaatcgcctcttggttcaccaagatcggtgttccagtgtttggtccaagtgaaaaagctgctttgatggagggctccaaaaccttcagcaaagatttcatgactaaacatggaatccccactgccaagtttgccaacttcaccaactatgacgatgccaagcgttacattgatgaaaacgaccaccgtttggttatcaaggcctcaggtattgcggctggtaaaggtgtgttaattcctaccaacaaggaggaggcctacgctgccatcaaagagattatggttgacagaaatttcggtgatgctggtgatgaggttgtgattgaagagtttttggatggtgacgagttgtctattctttgtatttcagacggctactcatttattgaccttcccccagctcaagaccacaagagaatcggaaacggcgacactggtctcaacacaggaggcatgggagcttatgctccagctcctgttggaacaccggccctgttgaacaagattagagagacaatcttgaaaccaaccgttgatggaatgaggaaagacggtttccccatggttggatgcctctttgtcggtatcatggtggctcccaatggagaaccacaggtgttggaatacaatgtcaggtttggagaccctgaaactcaaacagttttgccattgttggagactgacttgttcgatttgatgcaagccactgtcgaacaccgtttggattctataaatgtcaagatatccccaaaattctctaccactgttgttatgtccgctgaaggttatcccaactcttatcgcaaaggagatgttatcactgtggatgaactacctcaggataccttcattttccacgctggtacctctatcaaggatggtgaagtagttacaagtggaggccgtgtcattgctgctacttccattgcagacactcttgaaactgcggtaaagcaagcctacgttggtgcctctaaggttcacttccagggaaagtataatagaaccgatattgcccatcgtgcattcagagatgctggtaaacaaaaaatctctctcacatatgctgactctggtgtttcagttgacaacggaaatgctcttgtcaagaacatcaagaaactggtaaaatcgacagctagaactggagccgactccgagattggtggtttcggaggtctctttgaccttgcgaaggccggctacactgatgtcaacgacatgttactggtcgctgccactgacggtgtcggaaccaagctcagaattgcccagattatggacatccataacactgttggaattgatttggtagccatgaacgtcaacgacttggtggtccagggtgcggagccattgatgttcttggactattttgctactggtaaactggatattcaaatcgctgcccagtttgtggagggtgttgctaagggttgtatacaggctggttgtgcgttggtgggaggtgaaacgtctgaaatgcctggaatgtacgatcctggtcactacgataccaatggaactgctgtaggagccgttttgaaagatcaaatgcttccaaacgaggagcagatggctgaaggagacgtcgttttgggattaggctcggatggtgtccattcaaatggattctctctggttagaaaaatcttggaaaaaacaggattcaagtacaccgataaagccccatggaatccttcgaaaaccattggagaagagctgttagttccaactagaatatacgttaagcagctgttaccaagcattaaacagaaactcatcctgggtttggccaacattactggaggaggtgttattgagaacatccctagagctcttccagaccaccttcaagctgagttggatattaccaagtgggaggttcctgaaattttcaaatggtttggccgcactggaggtatcccagttcctgatattttgaagactttgaacatgggtattggtatgatcgccattgtcagggctgatcaagtggagaagactgtggccaacttgaaggctgctggtgagaaagtatatccaatcggaacattgcgtcctaggaaagaaggagaatctggatgtaatgtcattaatgctgaaaatctgtattagaatcattatgtgtttgtatgttatgtaaaaatctgttcgttcatagagttgttcagcaagtactccattaattgatacgtcactagagtgatattaccactgctgctgactttgatcagtcttggcaaccaaccagcccagaacttggaaattccctcgttgaagctggttctgactacgcaggtcatccagtctctatacacttgctttgcgtctttggattgcattcttgttttcaccacatcaatgggctgtgtgatggcaactacagacatcgaggataacataccaattcccagcatagttacatccgagatatcagttgagttgggggagattccctgtttaatgaaattgtaggaagaaaaccagaccattgagttggccatctgcctaaaaacagtcaaaccagagccttgcaaaaacccccttatgccgttggtactatatatttctttgatcgcaagagtaaaagtagtacttggcgttttcaaaaaggactgctgggttgctgtgggagacttggtggttcttacaacctttgtttcgcttttgacgctattcacaattcttgtgggttcctttgaaactggtttacccttttccaactctagcgtattctgaatgatggtagttttgatattctcaaacgggatgacccatagcgtttctatggctcctgtcattagccctgcaactacaactcttggtgctgttgtttttccgttctcgttagccatgaactttgaagctgagttgaaaatgaaaaacctgctgctggccttcagagtatttcctatcatcaaagctttacaacctttgaagtatgaagacgggtgtttcattctggacgcaaacgttccaacatgcaattgagagcctgttttgacaaactcaaagggataagttatagcagtttgggcacaggcagccacagaacctgcaatcatggcagttaacaggttggattctggtaagttatccggaggtacatagtccatgttagggaagggcaattgagaaccaatacaaagagcacttggaaggttcccagagtacccagtagctgagatagctcaccgtgcagttcgtcgcgacaaccttttagagttagtatattctgacgatctttcgctcacgatctaggcctctcattcccacagtccccgaattaatctccagcccaaacaaaaccccaaaagtatcaacataaaatggggttcttagacaacgtgcaagagtcatttaaaagcgttttatattcactcactacaaacgatcactatgcggagtattccagtagacacacagaacacaacaagtccaccaccagcttgagagccagtgttaacaatagtagcacctcactagttgattcacagcgttcttccattgcgtaccgcccagggctgaggagccaggtcaccaacagtaacatccggttgcaggactatgtcgaaggacagccgcctctgccatcggtggccgagatctgggaaaggcttgacaattggttggagagggagtatcctgaacttggtgaaaacctggatggaggcgcaacaagcagcgacttgaaccagtttgagcacgatctggacgtgaatttgcctctggatgtcagagaaagttaccaaattcatgacggtcaattgtctcatgccaagcgtgtcgggttgatctttggtcttacgcttctttcgctggaccgcgttaacgaggaatcgactatatggagaaatgtcgcaaagaaagtagacacgttgaaggataaagggttcgtcaacagacaaagcagtattccggccggttcagtacaaccggtgtattcgcacgatcactggatcccagttgccaaggactatgcaggtaacaacattgccgttgatttggccccaggcccaactggaaaatgggggcagatcatattgttcggaagagattttgacaccaaatatgtaattgcccagtcatggacagagtttttgctagctgttgttgaggacctggaagagggaaaatttttgatcgatgagatcgatgaatcattgatgttctacgagaagggccgcactgtggagtatttacgagtgcttgtttacagagcaatgtccaaggatagaaaagctaagcacgaacagcagaagaaggaaagtctaaggtctcctgcaatggagtccatcgaatctattgtagaggttccatctcaagtagtcgaaaaagcagacgcgggagcaaaagtgcaatctgaagataaaacggagactgagctgaatgctgatagtacagagaccaagcctaagtccacaggtgttgaatcagcccagccaataactgcgacagccacagaggaaatacaagagccatcgcttaccacaactgcaccggagccagaacctgaaccggaagttgaaccagaatcttcaagcagtcaagtctccagtacagaaacagttactccggtagaaagagcgcccgcagaaaaggagccttctacggaagtaaaggccactgataaaacagaatccctcaaagatatttccctatcatagttttaaatattgaccaaaagaagattataccaatgcatattatgtatccagtccccatagaagcgcgtatcgcgatgccagtatttatttcctctgagtctcatgatagctagaagcacagaatggagcagatagacaaccacaacctatatcagaaaggcaagttatttaccgtataggtcgacatcagacactcagctaacgattgtaggacttgtagaactggagaaaaaaggcctggtggagataagtagccttgcttggtggtcggtttcttcttataagcacaacaatggcctgaaggaattaagagaagataaccccgacacatactggcaatccgatggtaatttacctcatagcctcaaacttcacttttccaagaaggtttccgttgaaagaatcagtcttttcaccaattatcaattggacgaaagctactcgccccaagtgatatccgtctactcaggaaatggggaacatgatttgatcaaggtgacgacttgcgagctagtcgaaccaattgggtggtctcacatcatattcaatggagttagagaggacggaatcctaaacacattcttcataaagctatcgtttgagtctaaccaccagtcgggaaaagatacccatatcagaagcttgaaagtgtgcagtcccagaaatatagtaaacaaaagtgacagcacagacctaataaactgtgaagtcaagccaaccagcataagattgatttccgaaagtgggatacgatagagttgggtccgtcccgtttggcataaatcattacataatcctatctacctttagctctctcgaatttccattctctttcagaaaaagtcaagttaccttcatctgttcataaacaagcgtatcaaatgtctgatatagcgtcaatcttggagaaatcgcttcaccatgaatatgccaaagaatcagaggctcaactggcagcactggaaaaccatgaagggtttgccaccgaagtgctgcgagttgtcagcaatgaagggtatcccatgaatattcgattgagtggagcagtgttcttcaagaactttattcgaagaaaatggctggacgaggatggcaactacaaggtatcagaagttgatgtgaaaatgatcaaaaaggaagtcatcggcttaatgatccagttgcctccgtcattgcaggcccagatcggtgaagctgtcagcatcatcgcagacagtgaattcccgcaaagatggcccgaattgatcgacgaactggtggttagaataggcgaagacatgcttgtaaatagaggtgtcttggtggtggctcactctatcttcaaaagatggcgtcctttgttccgatctgatgaactgtttttggaaataaagctggtcttggacaagttcagtgtgccgttcttgaaattgttcaaacatgtcgacgaacttgtggatcaaaatgtgaactcgaaagaacatttagaggtactactggatgttctgttgctactggtgaaaatttattacgaccttaactgtcaagatatcccagagttctttgaagataacctcgccgctggaatgtcccttatgcacaaatacctgttgttcaatccccccgtattgaagaatgacgaggaagaggagcaagctgatcttctcactaaagttaagacggccatatgcgaactgattcaactgtatactataagatacgaagatgtcttcggaaagttgattcccgatttcatgaaatgtacctgggacttgctcattgagacagacaacaaacctaagaatgatcttctagtctccaaggcattgacgtttatgagttccacagctagaattcccgcccaagctggcttttatcaagacgaggagcatctaaataagatcatcaccgccatcataattcctaacatccgcatacgtcaagctgatgaagagctgtttgaagatgatcccattgaattcatcagattagatctagagggggcagactcggagtctcgcaaaaagtctgcattggagctgctcaaagagttaaaggaacaaaatcagtcaagtgtcacgtccattggaatgaagtacgtgaatcagtatctacaagaatacttacaatctcctagtgagaattggcgctctaaagatttggcgctcaatttgtattcagcactggcagtgaaaggtaccatcaccagtaatggtgttacttctatcaatttactgcttaatgttgtcgagtttttcacaactactgtagctacagatttagtgaatgatcaggtgaatccaattttaaaggttgatgctataaagtacatctacacattcagaaatcaactaacaaaagagcagttgattgaagcatttcaacttctctctacgcatttgaacaacagtgagtacgttgtgtacacctacacagcaattacattggagaagattctatcaattaaacagcacggtaaacccttgtttcaaaaagcagacattcccacaaacgtacttcagctattaattaccaatctgttccaattgatcacaagcaaggattcatctcccgagaaacttgccgagaatgagttcttaatgatctgtgtcatgcgaattctggttgtttccgaggatgcaattaatcatctaagtaaggaaattttgacgcagttattgcgtataattcaaagcattgctaagaatccttccaatcccaagttcacacattatacgtttgaatccattgcagcagttgcaaagtaccaaaagacaattgatgatgatctgttggaactggtagtacctcaattattaccaattttggccgaagatgtccaagaatttgtaccctacattttccaaattctggccttcttactagagaactacccgtcaactaaacctttaccaactgcctatgggcagttgatcaaacctctcatgtcacctaccgtctgggagttcaaagggaacattcctgctgtaaccagattgttgcaggcaattattcaacagtcgccccaaagttttgccactgatgcggatattactcctgtactgggagtcttccaaaaattaattgcttccaaagtgaatgacacttatggatttgatttactagaaaccatttttttcaacattgatttcactcgtttagcaaattacactaaaacagcagcgatgctattgctacaaaggctacaaaactccaagactgagaaatttgttaaaagatttgtggtaatgatggcaacttttgcatcgatcagtgaaaaggaccagaagctggtacgtaatgcttcccttttgggtcccgattttgtcatccagtttgtagactcagttcagaatggtatttttggacagatactcacaaatttcattattccttcgagtgatgggttcaacaatctgagggatcgtaacgtgattgtcatcggattgaccaatctcatctccaccagttcacaattttactcaccagaaggtaaatatcgtttacaattgatcccattgttggacaagctaacccacctggtcaccacagaatcaatttcagggtatttgagaacggaggacgagcttgacacctctgaaaatgaagagttcttgtttgggtcatcatttaataagttaaactccatcccctatattccattcacaccagtattaaccctatctttgtccagtcaagacctaattcgacaatttttcaaggagcggctaggccaactgaatgaaaactgtggaggaacgttgggccaaatattcggctccctgagtgttgagtcacagcaaggactggcctcaatggggatttgaaatattcaaaataatacagaaataacattagaagtagtagttgaatgaaatggacttcataaggacttcatatctatatagttacaaatataaatatctcccattaattattacacttatgagtgatttggttttctcttttttttccgttttctgttacattgtctaccttaaaatttctcgtcataatcatccccaatcgtgagcatttttttcacttctctaaagaagtatcgtcttttggttcttgttgttgaagttcctcctgctgtttctgtctttctctctcagcgatttcagcagcggttaaaaaccttccaccttgaccccttggccgcctcatcgcgtgtttatgtcttgattcatgcaaataaggttttctacaccgagctaccttcaagctctcttctagacgtgctcttgcgactcggcgtttcagtattctgtggtattgttttgcgttcacataaaatggctgttcaccactctgttccgtggtctgcatacctagttgactggacccgccagggggggccggctgggttgccatcggtagagtttgagcagaatctgcactatatgtatgctgctcagagccctcgtgctgtttcaagtctggaggcaagtccaaagcaacgtttatagcattagtgccatcaagcggtgtttctcgaccgtctaagctcgaatatggggagcctgcgagtgactgagactcgtaaaactctggccctgctatttgatgtgactgaggccccgaagttctggagtaaaattgttgttgatgttgtagaggaatagttgacattgtccaggggtggaggagagaaggaagtttagcaaggcctttgggattttgcaggagggagtgattattttgtattattttcgcgacaacatgactataatctggggggataggggatccgaaataaaaggatcgactcaatcctagtgggggtgccaggggttgaatacataatctgtggacatctgtggagttctcgaaggatgaacaccaagagtgacatacacctgagacctattgttgttgaagtaagaagttcgagccagcttgcttaatatttggtactttccaggactgaaataccttcaaaccaaaaaatagtactcatttggatctaaacttttgggcttagtaaggtctctctctttatctctcgaaatattaatggctattggctctgagtgagggtttgaatcgacccttgcgttgtgtctgccaatgaggtcatcaatttcgtccactcgaagcagagaattggttattttactccctattgatcctagtacacccaaaactcttgactgtctctttggtttcgtaacttttctcgttttggagattagatcattctgttgttgtctctgagatttgagggccccactattcttcaataatggggatagcggcaccttactgagttcaggaatctgtctgatcggagaatgttcacggaattcctgtcttttgtgtttttccttcagttccaatctatccaaaatagaaatcctgtctgcttccctttctcttgatggtagacttgaaactggcttatttagtaacttagtatctgtgcggtcaaatttctgatctctaaacgaggaagtataaggctttcttgtataatccttgtgagctggcctttcgttggttcttgtgtggagtctttgcaaagggtcttccctgattacattattgtgttgattggttcttagaatggatttcggcctagaagccggctctttcttattgttttgcactcttgattccaaaaaatctaacgctcttttgaccctatcattcttgatttgatgttgccgatttcctatcggctccaatggttctctgttcatagtaatgtgtgtttagggtatgggtacgaatctttgtgagagacgcgataaatgtgatgagattatgtaaggtgagtacaccacaatgtctggacgtgtctggaaagatcaactgtaacaatcgtttttcaaaattgatcgcagactaaacaccaattccctaatcttcctatagatagcgtgatttgatctatcttttggtgtgcacaaaactctattatatcagtcatccaacatcgctactattttgagacgcgaatcaccgttaacgcgtcttctcaagttttgaaccatcactatacctgtaggatacatgtcagatccagttctccctatagaattgcatccggcaagtctcaggcccctctcttatagagtgctctccaagaaacatggtcttcacataaagagcgaggctttggcaggattggccaaatacattggccataaatatggaaccaactggaatagtacccaatgcatgaacttcttggataactttggaaagatatggaaagagcaagatagagggctgttcatagataaagagggcactgaaaagatcatcagagaagttactgacaaagaaaacaagcgagaagaagccagcatagtgagtcgtaaagaagtttcattggattttttgactagcaagaaacacctggcaacggcacaagaattcgacagcatagttgaccattcgttgaaagaaacttatgtcattaatgaaccccaaatagactggaaaaattattttcaagtggtgaattacgatcagcagccccttttcagattcaattctctaaagagacagttggaattattcaggaggtaccctcaaaatcctcttagtccggcaaacttggctcaaaccagttcagcagttgaaatgtttctcaacaggtacaatttggtgtacgaaagatttattcgtgacgaagagttcaagccaacggtgacaagaataaagaacctgctgggaaggaacggttcaagatttcttattttcgggctcatttcttacaataattcaggcaatctacaattgcaagatgattcagatgctattgaactggatatctccagatgtactttttccatgggttattttgttccaggctgtctagtggtttgcgatggaatctactccaagaagaatgtgttccattgcttgagtatagctcatcctccagcagaaaaaagagaaacttcaatggagatcataggaaatttagaccttttgggcatacattcgacttcgaagcaaatcactaaaattgatcctgacctaaaattgaagttaatgacaaccgagaaacaacttgattcccacaaaattttgatactaggaggtgacatatttttagacgacctgaatgttttagatgctttgaaaaaattgttcgccaagttgacacaaacttttgttgataatcaggtagatttaccactttccattgtgctgaatggtccattcaccaaatatccattatcatgttctccaatcaattttagcttctcttcaatagcatcttacaaagctgggtttgactctttagcttctattttggagaagttccccgagatttgcaagcacaccaccataatatttgtcccccatgacaatgacttatggcctagcattgtgcaccgtggcacatcttcattatggccacatcaaccaatttcaaacacattcatcaccaaactcacaagaatcatcaaaacttgtctcgtagcgtcgaacccaaccaaacttaattatttgtcacaggaaatcatattggttcgagacgatattaatgctagattcaaacggaaccaaattaccaagcctgcaccagtagaaatcgaaatagacatagaaccaacacaagtttcaactgaagacgtggtttcagacaagtcgatatctcctgaaattcgtctggcaagaaaaatcgtcaagacagtacttgaccaaggacatctgtcaccgtttacgacggacatacgcccgattctttgggattatgacccatatttgcatttgtatccatctccgaacttactagtcctgtgtgacccatctgccccaagatttgatatcacttacatggggtgtcataccatcaatcctgggaagttcctagtaggtaacaaatgcaactacaccatatattgtccctccacaagtaaatgctcgtcagaagagatattcatttaaaggtatattactctctaccatacttctcgattgttaggactattcgcttcggcatgcaataaacaggatctattggttccaaatcatcaaaacccattaaacttaagcctgcgatcccaaataatgtatgatatacatcagtctggttatctggtcgatctgagataccaccgtttacggcgtcttgacatgtgtaaataaactgcctcaatgcttcctgatctatgcaatacagactttgcaaaatgctcaatgatgacaagacccaccaggaatagcatacatctggtagtttctcaggtctgccattcaatcctcctccttttacctgtctttcggacaaccatgggatcaacatgtctttatttacaagatccaaccgattggcgatggctaatgcggcaacgcaaacaaacacttgcgcagcgtggctttctgcccctggaaccattccgtaagctccatcgaaattgctgcactgagcaataaattccactgctgggtccaccacttcgggggtcagttctcctagtatagataaacagctcagtccagtatacacaaacctggtatccacctcaccaaatctatcaccttcaaaagagccgtctttcaattgcaaccctttaacaaatgtgacaagtttgtcccgttttgtggcaggtaatatatccagctgaccgtaagtcttgagtatctgaacagctgaaagggtagataaaatgtgactgtcatgtcgagggaatgcaccaaaacctccgtgtaaatcatcccagcaactcagcacaaagtctatgacttcctccttattgaaagtatcctcatatttcaatgtgaatagggcggtgataccccagtagaggccatctacgatgttagtatgaaaaaaagccaactacaagccattgatggaaggcaaactactcactcatcctcaaatgctcagtcaaccaataggcgtaatcatccttgtggctgtccaactcctgaatgtattttctgtgcaattctttatgtagggacattataatagtggaacaaatgcaaacattctggctcaagtgaaacatctgaggccgcgaataacctatgcagatcgttttaggactagcatccccacaattacacaaattggccctctgacgggatagaagagagaaaaatacagaatcagatgatagacgtatgagggaaggttgaatctattcgattcgaacagggagaatagttttcagagtgattttcaactcagaagctaggccatggatgtgctagatctacagaaaggatcgaccaagccatacataatgaactttatcgtgtattattgatacgcattaaggtgccactctatgcacaaacgtatgcagcaacaaattgaattcttgatgagactcattctttttagctccatataactattaagtgattattagtcgtggacatcttaaatggagggcaagtgtgactgcaattaagcatctgaatcttggcctgggttggtggtctggtagttcaaccatttccacatctgccagatggagtatgccaaaaaggcacccaaaataggtccaagccagtaaatccagtggtagtttgggaaggatctagcagctactgctggaccgaatgaacgggcagggttaagaccagcaccagtgtagtagatacagatcaaatgggcgatcaacaaagcgataccgatgacaaatggagcgaaccacgtagctctgtgcttttcaacagccaacatcaggacagtcagacacaggatggcagtaccaaaagcctccaagaagagacctctagttctggaagcaccaccaccgagagcgtttgcgaacgcaatttcgccaggggtcatagcagaagcggcaccggctgcagccataccagcaacgatctgggtaaaagccatcaggatacctctgaaaggggggatggctctggcgagaaccaaagctagagtcacagcaggattcaagttaccaccagagactctgtaggtaatgaacacaccgaccatgacaccgaaaccgaaaccaaaagagatcataatcagttgggcaggattagaaccgccatctggggtctcaggagcttggttggcgatctgggcaatgacgaaagcagaccacaagaagaggaaggttccaacaaactcaccactcatggcgatgaagtggtttcttacagagtccgaaccgaagccccatctagcgtaggctggtttgtaggcatttgtaatgtatggagcgtcctcaggcttaatttcagcttgaccgtcagcagcttggttttcaatgtcaggcatcttcggttgtttttagtttgttgttaaactggattacagtaacggaaaatgaaaggaaagaacaccaaaaaaggtgaggggcatgtttatttatatgggccgtctccagccaaacaacctatgatggcccaaatgggaagttcatccacttttctggattgttaggaagcgtcccaaattgtgaacgactgtcgtttcttgcaataattgcatgcatggaattgcagcattttatgcagcataacacaggggggacaactttagctatactcttccagcttccggcaggaacgtggcatatgggatgggttgtccatattataatttgaatgggaggtgctgaattgattaggtgaaacacaatcaagaacagaggaatgaagggacgactgttggactttttgtgttgatggggctacacctaattcgtagtcgaaatgaaacgggaaggtggcatgtgaccgaagttcagtgagccgaattaggcaaggcttgttattttttattgtttcgggtaataaatacctaaggctgagatgcatgtttttcttagaggaagataatccgctgtcaaccaattacaatatgagggagaattcttgaatgggttagaaattctggatcatcaggtcgcctggccgtttggtgccccaatgcagcatgaataagggccatttgcatcttagtaagctattgcctatgtgattgagatcatgtagagaaagaagcgtcttttatgctagggcgacgcatgattgcagaagtttgtgtccagcgatttggaagaaaaggcccagtgcaaaaagaaagggtaaacccttggtaaccagccggtgacaccaacgattagggttgtatcacgatttcgtagcgtttgtttaaagtctaaggcggtcaagggaaggatttgggctaataaactgaatctcttggtttattcacctgcgtctattattgaattctgtcctgttgcaaatttctgcggtggttttttttttttttttttttttatttgtattgtttagcaggggggccagttgtcttggatgcatgagaaaaggaggaaaaactgccgcatgagatgagattggccagctgctgaggtggaaacaactagtgattaccagcttgagaacttgatcggcgcttgaagtgaaaaatttgagcttggcaggtaagaaagcatcggctgcagatgttgtggtagattaacacagtaaagaggatttctattgtattagagaaggatctagactattttttatgtgtctttaggcacagtggataatagatgcaagagtttagttctctttttggtaattgttagcatcaccttgtgattaatatataaagcgaaattatgattttaagaacctcttgctgcgctccaaacaagtaattaatagtgttataattcatagagttgaaatatggccggtgaacagttactcaaaacataagctaggatgagccggtgttaaacgagtagtgaaacttaaacaaggccaaaaccaccacaacgtcctggccactttaccgttctcccatccacattgacagctccgctctatcttacacctcctttcacctcacaacctacacgtctttcatagtatcgattaccattatacaaatgaacactacctaacggttggacttggcaacacgttccaactcatccttcttcttaatagcgtatgaagtagatgatcccttagcagcgttgatcaactcctcagccaaacattcagcaatagacttgatgtttctgaaagcagactctctagcaccaatggtcaacagagcaatagcttggttgactcttctcaaaggagaaacatcaacagcttgtcttctaacggcaccagcagatccaactctggtggagtcttctctagcaccagtgttgacaatggcgtcaaccagaacttgcagagggttctggtcagtcaaaacgtgaatgatttccaaggcatgcttgacgattctaacggccaacagcttcttaccgttgtttctaccgttcatcatcaaagagttagtcaatctctcaatgattgggcactgagcctttctgaatctcttggcggcgtactttccggcagtgtgggaaacaaagactggctgtctgatttgaatgtagtcggtcaaagagatgtccttgacggtgacatcctggaaagaccatttgttgaacagcttgatctcctcagctccctctctgatatcggcagggatcttggtggacagttccacgtattggacctcaactggctcggcaacaacttgttcgtcgtaagtttcagacattgtggatctcctacttgttgtatgaacacttgatgtttgaagaaaatgaatttttattgaggaaaaattgcaaaagtcgcggagctctcgcgcgcacgcctaacaaaactggggacttggatgggcaagttttcgcgtgactgttgccgtttacggtgactgctctcgtcagaaactccacgtgcaaactcaacgtatgttcggaggtcagctatgtttttttttatttttgtttctccctttttcccctcatcttcctctcctctgttgtcctccatccaacatccattcaacatccaaccccccttcatccttcgaaaaatcggtcactcaatccgaccatcctcacgtgatcttatcatactaaccctagagccgagaatggatcatctatagtggggaagacctaaccctttatatacttgcatcctcagcccttccctgcaattctcctccaactccgcttcagtttgacacatcccgctaattcacacaaagatggataatggaacttttgaccacgagcaggccctgccgaagctgcccgtcccagccttggtttctactgccgagcaaatattgcacagtctgaaacctatagtgtcaccagaggaatacaaattgttggtggcacagaacagtgacttcatcaacagcaagaccatccgggccatccaggctcgattggtcagatcctacgagaagaatgactgctatctggatgccgaaggaatcagcaccacaactcctggtacttacggtgaacttcgtggtaagacccttcctagaaatccttttttcgttcttgaggacgacccgttgtccaaaaccgttgttccccccacccaggcttcccgtgcttctgccttgattcgttccgccttgaggtttgcctgtgctcttcggagtgaggtgttgaaaccagatgtgtctcccaagagtgggaacccattgactatgaactcgtaccataatttatttggaacctccagaattccatatgaagtcgatgctagaaatcgtcaaaaaatcggaatctctctgaaaaaaaccgaatcctacaatgattcccgtcacataattgtcatcgccaacagtcagttttatagtttggaggtgttgaccccaaacaagaaggacattgggcacaaattatggttttctcgtcacgagcttcgtcaaattttggaagacattatcgcagactctgaatccactgatatcattgatagaacaagacaatccgttggttcggtcactacagagagcaaggcaacctggaattacatgcgtctcaagttggcagaagaaaacaaagcacaattggacctgatcgactctgctttgtttgttgtctgcctcgaccatgaatctcctactactgatgacgagaaagtcagctgtatctctcacggtaccactcgcatccagaagggaattcaagttggttcatgtacttctaggtggtatgataaactgcagattattgtcactaagaacgctgtggctggtgtcgcttgggagtccacttctttagatggaacctcagttttgcgttttattagtgacgtctacacagattccgttcttcgattagctagacaaatcaacgggtccaattatactttatggccgaaggctgatacagtcaagattgatagtgaggttgtgaagccaacattttcaaagttgaccttcaacttgtctaatgagctattcaaaggtttgcatttggctgagactagacttgctgatcttatcagtcagcacgagtatgtcacaacccaaattcctaactttggtaaaacatttgctaacaagatgcaagtcagcgcagattcactgttccaagttgctgttcagataagttattatgccctatacggaaaggttccatcaactgcagagccaatttcattgagaagattcagaaaagccagaactgagattgtatctgtgcaacgtgagtcagttttgaaggcctgccaggtatttatttctcagttttctccagaggagaaatgggagtatgttgctcttgcctgtaacgaacatgcgaaacaggtttctcaggccatgaaaggtaagggctttgaaagacacttgagtgctctcagatctgcctatattcaaaaagatttgttggctaaactataccctgatatggaaaagataaacgataacgagatacctcctttaattttcgaccccgctattgacttcctataccaaactgagttattgattgctaactgtggtaacccagctttgaatttgtttggagttactccatcaattgccagtggatttggtattggatatattatcaaggatgagtctatctcggtcgtcgcatgctctcaatggagacaaacgaaacgattcttaactaccttgaagaaggtcattgaagaaatcaagaacgattgggctaaagcgcatccagagattaaaaccaaagctattgggtcctcaagagctagggagttagaggatactgtggacaagtttgatgatgtcgaatctcatgtaaacaagttcatcaagtctttgccacaagaactgatcaactcgaacaacagtctagaatacaaaaagaagccaacctccaaaggcgattctgttgcggctccttctaactacattttaggtggctatgactatttcaatgttggagagttagagtctcgctctaatcaattaacccgagcaaactcaactttagtatctaggagtggcagtgcaaccaacttaaaggcccttgctgaccaaactgttaccactatttctgaaaaagacgaaagcaacgtcaaggttcactctccacctctttcttccagaagtaataagaacagtattgggcgaaagttagtcctgcatagcgagtaattgcggtgtgctataagtattttttgtcttatattattgtctatatatcatgaatgacagcctgcttgtctagtacttctctgtcaacacctttgaattgtaaccctaaaaggatattgctcaaaatcagcagtccaccagatatccaatagttgacccataagtagcccatgctggataaatgaccagtgaatacgggccctatggttcgtgcggcggtttttccaacattaactgttcctaaaaccttggtaagttcgtgtggatcgatcaaggtcgtcaagagaacctgccttgggaccacatctgttgcagaaagcatctggttgatcagtagaaagatcacagacggtggtaactgagcttcgaacacgggtacaaaaatgaatgccactccagctggaatttgagtgtacagtgatgaagaaatgggtcccaaaagttttgctagccatgcggatgggattgcggccacagaacttagaatattgttcacaaagaacagtcccccaaggaatgttgcagatactttgaatgtgattttgaagtagtagaccacccaagctggggtcatgaacccatagccaaaggagtctaacatgaagcaaaccagtaacttgaacagaattttcctagtctttggagagagtttagaggaatctattggttcatcaaccatcaacaatggtgtcgactcggtgccgaatggaggcacatatgatgcttcacattttttggacagaaacaggatggaaataaactttgccacagccaaaaaggtatagagataaaagccacaacgataagaccaagctcctttccaaccaattgacttgaagtaatccacgtatgctcctgccattaaagaccccagagcggcaccagccgctgtagctaaccaatgaacagcatatatctctggacgatgatttgcaggagtcatatgagccatacacgcttcctctatagatttgaacggtcctgtgtcatttcctgagggagatattacgcctacaatagcagcgagtagcaacacgtagaaattttcaatcgtggatgaaaatgtgagtcccgcaataaccattaataacgaaccgattatcattactcttcttcgtccgatatgatcgctgtaccaagttaagtagtaggatagtatggtgtctcctaccagagtcaatgccatgaaccagccgatataagcttcctcgatattaattgccttgagatagagtgtcaatatttgattagtgaccccaaaagaggccattctaataaaagtggaaagccatagtaaccttatgtcggcatttgattgctgaagcgactttgttagatggatcattccattgactttctggtgatgagcgtggtgcaagggaagaatcattgtctcgaaatattctgataccaagactatgttgccaggaagagagaggagttacaatataattgcctatccgttagagcatgtcgcgtagggatagcagccggcaacaattccatgctggttaaacaccgattgttggtattaaccacaggttcccgcctccactgttcacccctagtctctcatcttgcggacatcgcgaactgcacgttatcgcatgtatacataactgttgaatcacaagagatttaaccatctttccccttcctttatgcaaaacaaatcagacctgagatatgaggaattcagcatagctccaggtcagtctggcatttttcaaggtggaggattcaaaggaagagtgaagaaaatagcatgtgtggaatgtagacaacagaaatgcaaatgtgacgcttctgataaagcaccgaaaccttgcacaagatgtaccaaaaaacagttagtgtgtactctgcaaagtgacttcaaaagaactgttaaaagagctagaatggcccaaatagagaaagagttcattgatttaagacgctctttacaagaaggagctgtaaacggagttcctttgagagggcagagttatgggccttcattcgaacctcccaatcaacttccaaacaattccactttaccaccgattagaaatgttgttttgaataatcctactgagaatgtgatgactcctttcagtaatttcatcggctcagagtcacctccagtgcctagcggattgaaggacgatggccgtatttcacagatcgccagtaccaagatgaagctgaacagcaactcaagtaaacctactccagctattcatagactgggcaatactaatcacagtagaaatgaaccaatcgttttagccccagaagttttaagttgcaccgataaaacgctggatgattttactattgagtcccaacacatcaaacaactatatcaagaatttgtagacaattatcatccaattttaccagttgttgatatctataagggcccggagaggatatatcgactgtgcccggttttattttggacaatcattttcatctctctcagaagattcaaatcaaacgaattaaacagggaagctagtctcaatctttacatgaaacttggccccattttgaaatctgcaatggctgagctcactattgcgcccattacaaggttcgaacctaccgaagtcaacgagcctatattgaacgtttctagtgtttattcagtacaaagctttcttctgtacactttctggcccccacttacatcatctttatctgctgacacttcctggaatacaatcggcattgctatttttcaagctattcgtattgggttacacagtgcaggccaattaaactctaacgaaaaggcagaattggtcacagaacagatacgtacatggatcgcctgtaacgttgtttctcaaactattgcttcagcatttggatttccagcgtttacatcttttgatgccggagttttatcgatttgtcgagctggctcaaacgctaacattcctcagagtttaattcaaatgatggaattagagcatctagaagatcaggctgccaaaacgttgaactcaaaccctgcagaccatcttggtttagttgatgctacggaacgaatacctttactacaaatgctaggaaaccaaactgatgagctggagattaaaatgtcttttcttcaaccactggatgatgttagaaggtttcagcttctgtccaccagaatgcggatactaacttactattttttggatactacaaaagtggcaacttttgagctgcagagaggcttgatcaaggttttcaacgcttctttggccctaatcgcacacaccagagattctacggaaagatcaaaaaagttcatcaaatatctaccaggagtatatatactaactatttggcaagcatcagttattgtcaacagaataacgaattctccaatgaactcacttattgatgttggcgctggtaagcaactataccagatagctattgatttgacatcgaaagcatcggtggtcaaatatgatatggcgtatcgatcatctggtataatgaggagtatgtgggcattattccatactttgaactcccagaattttttcaaaggaatcaatgtcaacattcgtagtcgattatcggccagtgtattctttgacagcctgttgatcttgaaagagcaatgtggtgtgatgaaatttgtacccaagaaactccatagcacactggcggatgccacaagggatccagcaactgcctttgaaagcgattcggataatgatgttgaggaaaatgataccaaagtgaacaatgtggattcaaacgataaacagcatccacaacagaaagttaatgcgaacggtaaattttcaacaaccgaatcaagaaagaaacagcgatccttatccagcacaattcacccagaatcttcggcacgtagaattatcaatacgattcccttggatccgcaaccaatagaggctccaattgccaatcaaaaacagaatttatcaaaacatgttctccattcaaaatccaaccaaactccaaccgcttcagacgcaatccaatccaatcaacagtctttcaaaggaggcccaacctctattcaatcgaaccttaccgactctccatcgtcttccaacttagatgcaagtgcagggttggggtttgatatttgggattcaacacaaaactgggacactgacctgttgtggaaagacattgacaacgttatgaatgagtttggttttcatgctgacatggtttaagagttcccaatcttatatttacaggtcaatttgaggtagcagccactatcaaccacctatctccctaataatttatcactaaagaacactcgtgtctacgcgatatgcacctacgcacggttcatgcaacaaccaggggaagctaggcagtgaaatacgacacctttttgttgtacatggaaaccatattggttggtacacataatatgtcgaaatgtaaacaaagctgtcgagggtgaaaacaatgcctagtaaacaaaacacattaaattccaagccaaactttttcccaaagcttcgttaggttcaccaaagttcaaccttaagcagttattctatcgcttcttctgataacaagatgtctgcgaatcaggcaattgatccagaagtctttgatgacccagtctactgtccaataccgacaagagactcagtaatacggtatcagaataccaatgacagacggtccacctttgaatcgaaggctgatggctctaagcagcaaccgtcagattcgtcgatgatgatagcctgcaatgttagagctttgatagtgcaattgacgtctcccaccaagattgactactcgttcatgtttgacttcttctttacatatagattatatctggaaccagatttcctcatgaatttactcttagcaagacttgaatggtgtcttaaaggggggaacaatgtgagcgtgcgaagactggctttaatcagaacttttgtgtgtttacgtcattggttgctgaattacttccttgatgacttcacggataacacaaagattagagcatcttttgttgcttgcataaataggtttgcttccgattcatcgtacagaaaagatcagctgatttccaagattcttgtcgatttgaagaaaatatatatcaagctgtgcgaaatctattggtcgaccctacctttagagaaactcgtcaatgtggaattgatcaactacaacctttcaacttatgaaaatcttaactcatcaaggctatctttagtgggattgcagcatgtccacaatcccgcccttcgaagatctgagatagtttcccttaacgaaaggaactcgctgtcgtctaccaatcttctgttgcaacaactggattcaaaagtatcaaactcatttttacccaacaatagaaccacttcttttcatttgtcaagtaaacctgcatcagttgtactgagaacagcaagaccaaggcatccccatcatcaacttaaacccaaggattcgctaattagtttaagcactggtataaagtcaacaaacgctaatcaagaagcgagtatgtcatttccggaaaatgagcatatcaaacgtctttcgaaggttgatgactacaataaggagaacactaacatattggaaggtggaatatctatgttcaaagatgccaaagttagttacatcgtgccatccactcctctcaaaaaaatgaacattgaaataagacaaaggtcttcgcctcaagtcagccctattaaaagaaaaccgactttgagtaataagaaccccaagaagggtctatttggtctgcattggaggaataagactttgcctacctctgcgatacctcctgaacgcaaaagtaagtttcaggtaattaatcaaccatcggcggaccttggggagaaaacaaaagtttccctaccaacagaaaaattggatattctggggcagagagtcatcgaagagttcaatattttacttacaaagaaagagcttcgcaacaggattgcgaaatattcgttgcttgaacaaaaacaatcaaagcgtagatcaaatttgtcaattctcaatgcatttgaaaagcactgtagcaaaagagatagcgaaagcatcatacacgaagttaacaccacaatcaatgctgatgaactcttactagccttcaacaacaaaaacgataacagaacttcggccaatcttgataacgaggccagtttcaatgaaggtgttgtgaatatggacttgaacctatctaaacgatcttcttttaggagtccatcggtaacacttaattggtctcactccatgaatatgacaatagatatggattacgaaccaatacaagatggcaagattccaaaccctccggaggttttgcccgacttgctatcagataatatggacaatagtggcgatcttgctgaagaggatttccattctacaaagagtcacatttctttcactgaagatgaagttttatcttcaagtatgcttgagaagcttcaagaagatagccgacatatgactccacagcctgaacagaagaatgagaagaatcaagaagaggaaccagtattacttccagtttctgaattggacttcaagccttgcactgacattccacaggtggacgactcttttgcgatggaagctcaaaagctgacttctagtttgcaaataaactcacctacgaatactgcaggcgttactgggacaatttcacaacaaggagaagaactagtattctctttggaacctctacatcagacaattagttatcagagtttcaataacagattctccattagaaatatctctagagaaagctgcagcacccacaaatcttatgttacttatgactccgacttgagccatatcgacatatccggaagcgtagaatacgactcttttggctataaatcccttaagaaaaaaacaggattttcaagtttacgaattggagtacttaatgagcagttacttagagagttgccattctatgaacagcccgatgaacaagcttgtcaagaatgtgcaccagtctcaggagaagtgttatcatcagacgatgaattgactccaaccatgattttggagcatcaaaggccacgtagtagattgcttcaacttttccaggaagacttgagcgtaaccaaaaaggaaacaagggaatcgggagttcagcctgagtcgtctccaaaatcctctaatgttagtatgatttcatctgttagttcttcttcctttgtgttaccatacccggggttaagtactacagcgatagctgaacttgccgctattccagatgatgctggactggaggatcctatccaggctgccctgaataaattggaagcaaatgacaaggaagaggctatgagtctatatggactcaacgatgaagtcgaacatttcaataaccaaccatccactcaaagaccctctttggaagaattaaaaatccaggaaaatgtaattgacttgttcataaataatccattacagaaaacgcccattaccgtgcatcagaacactccgacaccaaaacaagttttcaaagacgagcttgaactcagcgaaagtgatatctcaaaatcggaattgtcttcatcaacttctggaaaagaaaatgcaacaaagatcattgcaacaaactttgaccatacagtggagaatacaatgagcaacggcaaccatatttcgtttgttctaagctacgactcagagttattagctcaacatttcacaaacattgagaaggatgcattaagtgaggttgattggaaagaacttgtagaaatgaagtgggaaagtactttggagcctatccacagttggtttgaacttttgttgagcaaaatttcgaataatggggttaacctaattatttccaggttcaacttaatgaacaattggataatctcagagatcttgttgactgcaaacttggaagacagaatgttgacaatttctaaatttatccatattgctaagcattgtcagtcgttgcagaattacgccactttgttgcagatagtcttagctctgaactcaaccagaatcagcaggctcaaatccacttgggaaggaattaacgcgggtgatattcttatccttagaagtcttgagaaaatcacgtatccgtccaaaaatttccgtaatttgaggatcgaattagacaaagtgacagcatccaaaggatgcataccgttcattggtatttacctgaatgatcttattttcaacaatgaacgtccttccgtcataaagaaaaatgtggaaagttctatccagacaaaagtcaagattatcaactcgcttgcggaagatgacacagaattgattaatataagcaagttttcattactatctagcattgtgaaaaatctccttcaaatgatcgattggtcaaagttctacgattttaaaaccgataaagagattctcagcaaatgcttgtacatccgttcacttagtgaaaaggaaatggactattgctttaactgtatcgccgaatagttacatagggtaaaaaaatatttgcatgttagtttgagctttgatcagtaaagaaaaattaatagaaaaaaataggatcctcaagaagtaggcaactagcttcgtaaggtccccagggtcaaactcgatccgacaactttctgagacttcagaaattagcactgttgctggaatttattgatataccatccttaatacagacatcacatcatgtaactggatatgtgtccacctaaagtatggatgctggttcattctgcctacaatacagcactgtaataaaaaaataaaaaagcaaaacattaacggtctatactacctatagaaattctacctagacagtagaacaagcacataatgattccttcagagattgagttcagaattggataggcgtccgttatataatgtaacaagatataagtgcgccaaacgctttcaccagattaacccgatcaaacaaaggaatttcccgaaagaagctcaacctcatccaatggacactgtatgaaaatacgctaaaaattcatcatttgagtattaaaactcggaaggatgaagaagaaaaaaactactattgagaggtgctttgtgcttttatatgaaatctagcaacatgcgcgggttcataacggaaaataattatcagaaaaaaaaaatctatcaaggtgcattgttaacacgacgaaaactccacaatgaagaaggagagtaaaaagactgcaacaaagtcactaagatcgaaacctaatgcaaaatcgcctctgaccaaggcaacatctaagggcgatcttctgaaggaaactgaggcttctgtattaagtcttgagcagatttcacaactgacagaggaaatcaagagctctcccaagttctataacaacattccaaaactacttgctcaatatacttacatagactcaagcaatattgaagatattacaaaggctagaaaacttactaaattgctgttcaaagtgttcaaaaagttacttactgagggacgactatctttcaccgcaagagacactgctgacaagaaacaaatctcatcatggttgagggccaggtatgaggcgtttaagattgaactactgttatctttgcagattgtcgagttacatcaggaatccaagtactataagctggatatcctagatattgtcattaaactgatcaagctagaatcctcgcactgtggacctgctgggaccgaaccatattttgctacaaagttgtacagatctcttctattgacattattacaaacaggagacgaaaagaattcgctgaaggatggtaccattgacaattacctgatcttagaatttaaggaggttctatttcaatatcaagatttaaaatactatttttttcatgaaattcaacaggagctcaattctacacagcttgaaaataaagtactagcattctctaattatttgacattgttatacgatcaaccaatttacgaagattttgataatgcagaatatttggtcgagtacgtaccaaaacttgcaaagactgaacttcatttcaagttggcatttgagaagtgctggctggggttgctaaattggaacatctcttttgcacaaaaccagactgtattgggattggttcacaagcgattgctgcccttcatggaaaaccagcagcaattgatggattttctgacggatacctatgatttaggatttgagaacaaccatgttaacacatgtattttatcattgaatgggctatttgaactcatgaagaactataatttggaatatcctgacttctttaccaaactttaccgaattttaaatcccgatctcctccattctcctcataagactaggtttttcagaatgttagacatatttctaactggagactatctctccagtactatgatagcttccttcattaaaaaattagcaagactttcgttgaccgccccaatttcaggaattgttattgtgataccttttatatacaatctattgagaaggcatccggcatgtatggtcctcattcacaacccaaatccagcagagaattaccaagatccgtatgacgacaatgaaacagatccagacaataccagagccatcgaatcatcagtttgggagcttgaaaccctagctactcattatcatcctaacattgcctctctggccaaaatcttttcacagcctttccataagtacagttacaatttagaggatttcttggattgggattgtgctaaattattagatggggaacttagtaagaagtataaaacggaagctggattggaatttgaaccagttgatagagtgtttggcgctgagtccgaagaagcgcaattgaaagcccaacgggaggtttatatgagtggatgggtatggtagaaatgtgtatattagtcattaaccaaaagcttgagctttctctaagcctcttacaacgtattcgtaagtccaaatgctaattgcagtagtaggtgcggttttcaatagggctggtgttagacccgaatagaagccccgtaaaccttctctaataaatattttctttgaaatggtcatgaatgtttctctttcatgcccgagccactttctgtgcacttgtaatcttctccgtattaaatccaatggaaaagtactggatttggcaattataccagccatgaacccagatatcggttcaatgaatgcaagctcatcgtaatgagagtctaaatttctaaggaattcataggcaaagaacgtcaaccccatggagagggaaacaccactgactgctgttcctatacccgaataaaatgatttgatgccttcgtgtttcaacatgtcaatggaacaaccaaacatggaggcaaagtgtttcgatcgattggaagccagccttgtacgaagtacatcaaacggataagacaccaacgtactgaaaaccccagagacagatcccaaaatcagtgagtgaagggaaacgggtactttgaagttgtgacgattctctgtctgcgtcaaaaacgtattcactgtagaatagcaggtgaattgagttgctccatataacatgtacatgatctcagctggtatgttacccttccacagacgcttaattcccccttctgtcgcaattatttttttcaaagttggtattatcccattatactggggaaccttagcatgagagttgtagtaggattctaattgcagccggatcttgatcacatctaagggagccgtgacagctctagcaaccataccactcacagaaccagctgtgacagaaactgctactcctactgtagcaccctgtctcaagtgatcgtctttggccattgatcgagagagagtggggcagggctctgataaatgttgggcttactgtaggcaatcgggacgatgaggtttctctcgattttatttttatttcaacgcttgagctcggagattcattcttctcgccatcccccacctaattgcctaaagtagaagtgaaagtgtatttctttgggaccaattgactgtctggtaaacagtatatggtgtggtatgtacaatatcattacaattttggcctatcacagttgtacaagaagggatttgggaggaatgaaagctgaggcaaactcactgcgtagtcggagcctagattaaatgtctagctagatctgtagatgattggaaattttcaattgtttcgatgcgcaggaaagttgatccctctgatacaacaaaaacatgctaccaaaaactcggtaacagtatgggtgatgtccattgcactcatgttcgatcctgaatctctagatcttacggtaacaactcgcagttagattcctttgcataatccaataactcgctctacgatatgcttcctatttttgtgatttctcaagacttcttttctgctccaaaacctccggattattgaataccaattcttcactcaaattattcaattcaccttgctcgttctttaaacgagctagcatagactttgacattttggcttggttagtaccaacggatccaatgcttctgattttaccaagttgtgagttcttggaagccaaacctaaacctatctcttctccaaatgcgtcgatcgtagactcttcctgtgttccaaattccatcttgttttgtgccttacgtaactcactcatttcaaattgttttttcagcttccgtatcctacgtcctcctctctttttcgatggctgatctattggaattggtaaagccttcgtaggtccgttctctgggggagcctgaattttctctagtttctccgttacttcatttctccacttgaggccaaagctgccactgtaatcttcaccagcggtcacatcaactcttgcggcaagtattactttaccagcaactattctcagtgcttgttttctgaaatctggataaacttgctgaaccaaatcacagtggtatagatagcctggatcgccagacttagagccaagggaaggaatattacacgatggagtgtgggatagccccaaaacgccatgaactgctatcagctgagatgccacagagggaccaaccaatgctgtaacattaggagcaaacacttgaactcttgagatgacatatcccagtattgactgtcgattctgaacaaaggtttgaacaacatcacacgcctcttcaattacttgcatctctttctcttggagcgattgagtgttcttctgtgcctgaagactggctgacattgaaacgaccagaactttatcttggggcaaatactgccttaattcctcttccaacttgctcgatttggacaaggtgtatccaataattttaacaacttggcaatactgcacgggatctgtaatcaacgcctccaattcaggaaacactgaatgataatgtattctgacaaatgtgtgaaatattactacttcgtccatgatcttatccaaaatttcattacatttactcaaaaagtctctctccaaaactttatcaacaggtttatcaatgagttcaccaattttgtgaattgccttttccacttctggtttcacctgagaaaggccactcactgagtcaattgcaagaagatcttgacggttcacgaggtcatgcaaacttggcccaccattcagtgaacctcccttgctccccgtaattaactcagagttcagctcttcgtcatcagagaaatcggataccaaatcatccgccaaacccattatttctccagatatctaataacaccaaagcatatgaactcttagatatgatagtgcaccaaacggttttttttttcgtctcatgctaccttcgcgagcagactctctcatgggtccagagtcatagggaaaccttttctccatgcgaatattacctagaggtttgcaaaaatacaagtcattggtaacccagattcacagttttagatcgacgagtatgagcacggttcctgaatcaaacatccctccaaaggtaaagaccgaaaaggagcttgaaaaggaaagaaaaaaggctgaaaagttggctaaatttgaggccaaaaaggccaagcaggaagctttgaagaaaaaccaactggcaaacgctgagaagaaaaccaagaaggagaaaaagcctgttgaagaagtctctgtgtatgtagaccaaactccaaaaggagaaaagaaaattttggcgtctttggaagatcctgctttcaaggcttacaaccccaagaatgtggaatcctcatggtacgaatggtgggtcaaggagggactatttgaacctgagtttggtcctgacggtaagcccaagcctgcgggagttttcagcatccccgctccacctcctaatatcactggtgccttacatattggacatgctctaactatcgctcttcaagacacattgattcgtttctacagaatgaaaggtaagactactttatacctgcctggatttgaccatgcaggtattgccactcagtctgtggttgaaaagtcattgtgggcacaggaaggcaagaccagacatgatctgggccgtgaaaagttcatcgagaaagtctgggactggaaagacgtttatcaaaatagaatcagatcccagtttgaaaaattgggtgcttcttatgatttttctagagaggctttcaccttgaacccaatgctaagtaaagctgtcaccgaggcgtttgttagattacacgaagatggcaccatttaccgtgcgcaaagattggtcaactggtctgtcaaactaaacactgccatttcaaacatcgaggtcgagaacaagatcattccagctaagactgctatttcggttcctggatatgaaaataagatagagtttggtgtattgcattcttttgcctaccctgttgttggatctgatgaaaagttaatcgtagctactacccgtccagagactgtttttggtgataccggtgttgctgttcatccagacgacccccgttacaagcatttgcatggaaagtttgtccagcaccctctgttggatcgtcaaattcctatcgttacagatgctgaggctgttgatatggaatttggaactggtgctgtgaagattacccctggtcatgataacaacgattacaatactggtaagcgtcaaaaactagaatttattaatatttttactgatgatggataccttaacgagaactgtggtaagtacaagggtttgaagagattcgatgctcgtcaaattgttattgatgatttgaaagcgttgaatctttacgaaggtgaggagcctaacgagatgactattcctacttgttctcgttctggagatatcattgagccatatttgaaaccacaatggtgggttgcccaagataagatggctgcagaggctattaaagccgtcaaggacggaaggattaccatcactcctaaggtttcagaatcggaatatttccgatggttagaaaacattcaggattggtgtatctctagacagttatggtggggacaccgttgtccagtttactttgtcaatattgaaggtgaggtgaacgacgagaatgacggtcaatactgggtcagtggtagatctttggaagaggctcaagaaaaagcttctgccaagtttgctggaaagatattcactcttgaacaagacgaggatgtccttgacacttggttttcgtctggattgtggccgttttcgactttgggatggcctgataacactcctgacatgaaacagttttatccattttctatgctggaaactggttgggatattcttttcttctgggtcaccagaatgattcttttaggcttaaagttgacaggagatgttcccttcaaagaggtgttctgccattcattggtccgtgatgcacagggaagaaaaatgtccaaatctcttggtaatgttgttgacccattggatgtcattaatggtatcagcttggaagacttgcatgcaaagcttttgggaggaaacttggatccaagggaggttgagaaagctaagaaaggtcagaaagagtcttatccgagcggtatccctgaatgtggtactgatgctttgagatttgctctttgtgcctacactaccggtggaagagatatcaacttggacattttgcgtgttgaaggttacagaaagttctgtaacaagatttaccaggccactaagtttgttttaatgagattaggagacgactacaaaccccctgctacaggtgatctgactgggaaggagtctttggttgaaagatggattttgcataagttatctaaggcttccaaagttgttaatgaatccatcgagaaacgtgacttctttgaagccactaatgccatttaccagttctggttatacgaactttgtgacgtttacattgagaattccaagtatctgataacagaaggtactgctgaccaaaagaaatcggctcaggacacattattcacctgtattgatgctgctttgaaattgatccatcccttcatgccatttttgaccgaagagatgtggcaaagattgccccgtcgtgaggccgagaagagcataatctctatttccaaagctccatacccagagtacaatccttcttacgatgatatttcgtctgaatcaaactacgaacaaattttggaaattaccagagccgcaagatcattgtttgctcaatacggaatcactaaggaaggtaagctgtacattgagtccgctgacgctgcagcttacaaattagcctcagaagaaaagcattctattgtgtcattgattaaaccagttaatgatttgattgttattgactctcctgagaaggttcctgaaggatgtgctttacaatctgttactcctaagatcaatgcccacattctagtcaagggacaagtagacctggacgctgaaatactcaagacccaaaacaaagtttccaaggtggaaaaatcattgcaagctctagaaaagactttagcctcaagtaactacgctagtaaagcctccaaggaaattcaagagcaagatcaaactaagaaacagaacttcatttccgaattggagggactcaatgctacgattgcaaacttgcaacagctcaagttgtaaattgagcaaatgataactttaatttttcatcctgtttatatacgtagattgttattggtattagtatttccagatatagtcccttgacactttctcggttattgtctttcgaacgattttattcatcgattcaatctcttctatgctttggtccaatactgtcataagttccccctccgtgaactcccccactgagtcgacgaacaaaagttcatcggccctgccgcttttgatatcaaagcagaccaaatgatgagatattgaggattgaatttgttcagaagttggattgaatatcagtctatcatcgttgattacggcatatgtcgacaagaatgaactcaaaagagatatgttagcgtcaataagtgccaggtacgctccattgatacaggcatgtagatccttcaggttattctccgtcgcttgactctttgatataatatgcaaatgtacttgaatcagctgtcttggatactgaaatttattaatagttccatttagaacaactctcagcttgtcttccatgtttttctctcttgtggagccgacacccacttcgggccttatgttcacctctatggcacattgtgttggtaattcttgtcgtggtttagcttcaattggtccggttaccgagcaaattactttgacctcgccaatcgaaatagtcgaagagccgtcaactttattcaacagagacgtttgatactctggcaataccatgttgtatgcctttgatgtgttcaagcttctttctctactcttctaagaatatttttctttgcttagatactagtgtaccaaccacttgaaaatccatcgctgtccaagatgttcccaagatgttcgttccatcttcaagggtaaattaagaattcccaattgggcaatatgtaaatatacattctctcccttcatggctatcaatcacaaacacaccttcttcttcatctctatcactcgtatctcaagtcttttctacgctttgctcacaaaccactgaattatgacgctaaagatgaccaacttctttggccgtagctctaagcttcaaaccatggatggaggtgaaatggaagacatcacctccgaaatgaaaggtatcacatttgataattataacgatagcaaattttcttttgagcccactgctccaacaaagctagagaatcctttgctagaaaattacctcccgaatgctcaactgataagaccaatgaccagtttaaccggcaaggaaaacactcccccaacttctccagctaagagcgtactgtcccatcagaatggaaattatggacagagtcccagaaaatcccgacctagttctcccacaagaaagcaacgagagattcaattgaaggctaacagccccaagactcgtcgtttggctacagtttgccaaatgtactttctggactactattatgacatgtttgactatgtcatttctcgtcgtgaaaggctggaaaaagttcaggacaccttgatgaaacttcctgaagaacaaagggagattcaatggagaaactacacaggaagagaaagagctcttttgagaaagaggagaaataaaccaagaaataaggactttaatattataactcaggttggccaaggtggatatggtgcagtatacttggctaaaaagaaagacaccaaagaggttgttgctctcaaagttctgagtaaacgtctgctcttatctggatctgaagcaagacatgtactaaccgagagagacattcttacaaataccagatctgagtggttggtcaagttattttacgctttccaagacgcagataatgtctacatggctatgcaatttgttcctggtggagatttccgtactctgttattgggagcccgtgtcttgaattctcctcaagcaagatattatattagtgaaatgtttgcagctgtcaactctttacatgagttgggttacacgcatcgtgatctgaagcctgagaacttcctgatcgatgcgacaggtcacatcaaacttactgattttggtctggctgctggttctgtctctacagataggatcgaaagcatgaaactaaaactgaatgaggtcaaggatttgcaattccatcccacagagaggtcgattaaagagagaaggcagctataccaatctttgagggaaaaggatgttcactatgcacactcagttgttggttcgccagactacatggctttagaagttttagaaggcaaggcttacgattacaccattgactattggtcattaggatgtatgttgttcgaaattctggtaggatatcctccattttccggtgctagttctgatgagacatatcacaacctgcgaaagtggaaagaaacactgagacgacccaggttggaagatggacgatatttttttagtgaccgtacatggaatcttatctctaggtgtattgcttctcccaaagatcgtgttagagacatgcagcatgttatggctttgccttattttgcagaggttgactggtcaaatcttagatcccgtaaacctccattcgtaccagatctggataacgaagaggatgctggatattttgacgatttcaacaatgaacaacacttagccaagtacaaagatgtgatgttaaaacgagaggaggatgaacgaaaagctcaaggttcgtgtagaggtgactataagaattttatcggttttaccttcaagcacaagaatgaccctaatagcaacccttccaacatcttgagtcctattttggacaaccagaatgttagggcagatccaaacgtgagatatcaaactcattttggtactctctattagttaagaaaaaaattatattatggtattctaattgatgatttgactttatattattgtgttgttcattgtgaaatcataaggtttgaattttattctaaagttttgagcctcttcctcttcaacatggaatggttggacacacttttgccattgtgacctcttgggagtcgaaagaaggtacgacagaacttttctagggagctgtaggtccacagttccttctttgggtaacttggcaatgtacttgatatattttgactcactgtgtgccaccgtgaagagaatgtattcttggtcattcataatcgactcaagcttgcttttgtcttcttcgatggtttcatctaacttttcaaattgtactgtgacattgttgggatacatttccgaatttttcttgcatgttttatgtaattgtgtttcaaagccatcaatcaattcagttggaatggggacgaattgaatgtgataatgaatggcagaagatctgctgatttcaaaaaataccacgcagtaattggttgtctgaatggactggaacattttgatcaaagccaactggtacttgagaatatctctgtaaaagtctgagttaaggacactgagctgttgatcctcaacgccactacgtaaggtgggaacatgagaaattgcaataataataccatgtccactgaaattcagttcatctcgaggaaaggttaaaggtcctttagctactgtaagatagaccgaactcgaaattgagataatcatataggtagccactttggggtttgagagacagaagaaacaggttgaaggatccacaagccttgctcttttcttagaaacactatctggttcagatgatcgtttcaggaccttttcttcttcaggctcctcaatctgattttcaaaagggttctcggacgatatatccaaatgttggtcttcactgttcgataaaccaatcttaaatgcataacaccatttgtcttctctaccatatttagctaatgaaatgaacctggttaccctggttgtatctttccatttaaagggatctctttctaggtattttccagagtctgtaccaactgcaaaatgatatcttggttgaaccattgacactattggatccagtttttcattactgaccaaagtcagtttcttctctctagcaatggccttgggccactgaaaagtcaacaatatatccacaattttgccatcaaaatatttgtacattgcatcgtaatccgttatcctacctgagatatacccaacagtcaatccacaattcaacttgtacgtgccaaagcgtcccaaaaacagtaaattgtcaacttcaggtacttcacgctcaatatctttatctaattcctcttgacaatacactgggacatccagggatttcaaattctggaaatcttcactcgatgaaaaggcatcacccatcaagaacacagcttcaaaaggtccattcttcttatgtaagctattgataatcttgaaagtctttgacgatttcgaaggatctggattcaacaaaaggcttgaggttagttaaactttattgaagggtcagtgctggcgtcaacttacattttaaactttatatcatccatttatagggcagagaaaaaaatctacgaattcccgttaaagctaaagacgctcgctactaggaactttgcaaagggataaacaccctctcaataacaactaaatatttttctttctatatatacagtatgtccagataataatactataaaatctagattacttcgttgatgatttcactggcttccttgtaagtgtttagtaacttctgacatttttctctttcttgagccaagttctcatcttcgaagagtaactcatcaaacatggactctttatagagcttcgaaactaacctgttttgaacacactccttagtgtagtttaccaaaagacacataactgcctttgggacctgatcttgaatcatctctctgacaatgtcaaaatatgaatctatcaagcgtctgattaactcacactccaattgttctcgctcggatagatgagcttcggtatccttatggagatttagagcatccatacgctgaatagcggtttgagcctctggctcattggaaaagtgcaacgtttcactgtcttctgcgaattgaaatggcctggtagctggtttattttgatgtaactgttgctgctggttctcctgctgcgaatctttcccaaagaaaaagtttaagaaagactccttgttatccccattctgctgttgagcatgacgagaatcatctccatgaacagagtcactcgatttgcgatgcttttcaataagttgactgacagaactgttagtagaaccattttccaacaacaattctttaggcgaatctggactcgaagcagaaccagtttcagttgacttcttcttctcttctcgtgttttaattctcatactttcttccttttgcttttttctttcttcaacaacactggtcatagcggcagcagcgccaacaaagttaggatggtttgtgttgatgtaagccctgtggatatcaatgagactttcaacgtattgggtggttggtcctagcctttctctgagcaggtcagatatcacctcaatcagtttagcctgcaactttgggtaacgaccaagttcaggagaaccacaattgtggcaaatcttcattagttcttcatacaccagttctacgcacctgtgtgatgggccctctaaaagcttgatttggggtttaaccaagaggtcaaatgccagttctgggacaaagagggaaggtctgggaccagtagagttccgaattgcagttctaatatcgctcactgataaactagcagttggattaatactcaacaaagaacttccaaaaacatcattgtaaatggaatatatccttgcacctccacatagttcttttgtactgacagaagaggaatttccctcaattgagtttacaaaattagttgcgaactttgtcatcaactgcagaataaggccacctttgttcgactcagaaactgaacccatatctccatacgatgcaagctcttgttcagtttgacccatcaaggtgtttaatttagccttgatatcaggcaatctttctctaatgtggttcatcaaagtctgattgaggactctggccaaatacttggttccgcatctgtttgcaatattcctgtacgcagcatgagattggaaaaactcttcttcagctcttaaactatcgaagagtgctttgttgacagaaatgtcctgttgtgatcggttgactactcctatgaatcccagttttagtgggtacacctttccagtaagaatgtccagggcattggtcccatgatccatcaggtcaaccttggagagaacaccgattgttctcttaccttggggatctacttgtctcgctaacttcaaggcttcactgttaaccaggtcaacatttgctggggatacagcaaggatgattgcatttggtctagcaatatattccaaaatcaagtttttgatctgcctttcaatgtctgttggctgatcacctatgggaatcttggtcaaacccggaagatcaaccatggttagattcaacacatttggcgaataaattttcaaattgatagggactctactgattcctttgttcttgcctgctattctggctgtttcagcctcaatttctcttcggatctcttgaaagttgtagaaacgtttccctggcaagtggagaaattggccccattctgcaactggtgattggtcatccgcaccggatggatcggcgttctttcttaggtgatcctctagtgtaggctcttcagcgacatcagagctttctgggtatcctgggccagaagaggaggagttttggtaaactaatggatcatcaggctgaatgttgatcaactgaagaatcaaaggccttctggtaacgattccggttcctctgggtaaaaagtctttaccaacgatattctccaaaacagatgatttacctgcggattgggagcctataatcgtcaataggggaaggtctagctcagtcaagtttgttgttgtgactatgtcctgcaacttgttgacaactggaataagatctttcaaggcagacatgattgcgatacggagcgggtttcaatcagcggggtatcttaaaattaaagcaaaaatgaaaattaacgcgtgatctttaattaggagtgcttttgaagatgaacctgatcgcaagggtatagtctttatttagagttgtattggtcttttgggttcctgaaagcatggcaatgcataacattcgcgaagataatgtttggtggcaaggtaagatttggtgctactactggaggaatatttggcggagacgcatgaatacttcggcagatgagatacagatctagaaggaagtagcaataataagaacagttgagagtgagcgtaccaggtaaccagcagtttccatcctgatgtcatctgtctgtagtctggaatttattggtagaacgagtaacagtatgcgtagtaatgtgttttattcttattatttcgaatcatgtactaggtaggtctattattgtcattgcagatggtcactctgtgaactgaaccgaaataggtattagtgagattgataatatgcactcagcctacccagttgggtttacgtatacgcaagcattgtctgggcctcaggcaatgtttggtgggctatcagatgaactgttcgtcattgataatgcccttatttccaataatttaggtcgcaggcctgtactctaaattgacaactatgctaagagctaaatgtgtatacacaacgaggattcgccacatttacaactccatttaccactaatcacctcacaaggtcaaatcattcatcattgtctaattacaacctcatttaccgttgatctcaacttgtgaaatattgaccaactgtctaatgttcccttggcgtgtctgtaagcttgcattttatttccaaaagcactccgcatctcaattctttcatttattaggctgatctgtaacagtttgtttgctgttcaagtcaggaattcatgctaattcataattgattgagttgaagtcacctaacgaacaggataaattgttaaccacttcaaaaaagcatgatcagatggaatccattgaaactgctagtgctaggcgttccccacgtcccccccccttcttcatacattgaccctatttgcgtcgtctaatcatggatgtcaggtcattaactaaaggtggagctctaatagaaggcttagatatagtcgactcctggctaggtatttccatccttccaactattgaagaaaatacttcatcaccaaaaacgttcttgatatcgttaaaagagttgatctcctccacagatgagtaatcttctcctgtcacgaacaatttcagcttaagaaactttttctttcgaaagaccaccatctcctcgtatttaactttctcaagagcaggtacacccaattctccagaaacgccaatcacccccacagtgatccctaaacggaactcctgtctagcacttagctccaaccagaatcgctggatactcgtagatttagctcgcccttctaccaccaagtgctctagaaatctaccttttggatcatctggaagtaaaggaatcttgtaaacggctatatctgactcctgggaagaaaaaatatcaccaacttcccacttctcgttcggcaagtattttagtatacttgacttttcagctccgggaatggtaactttgaactttgtgtttccgtggaagtctaattccgtgaccaattcgtcaattatacggatccaccatctcagtagactctcaccggatagttgatgcttcagatggttttttcctgagttggggaagagatactggggttcagggcgagtgaacatgcaaatttgggcaataattggattctttggttcgaatccaacgtaatgcgtctttgggttgaaggattctcttccagctgatatgtcagcaagaaatttgagagaatcagccactgtgtccactttttcgacgctttcaaacgtggggtatcgtggcaatactttgcccaaacattgtcctagatccaattgaagaataaacttcaaacaactcttcacaaccaaaccaacctttaacgatggaacagagatgaggcctgcagtatccgctttggatacaaataagagcaattgcgtatgatctctatgaattatcacgtatcgatggacctctagtccaatcactgggactttctgagaatacagaacgatgaaatgctggatttttatgcacgtagagtcttcacttagaccacacacaacattcttagccacttttggttgcgattggacgtgtagaacgtcaaacctggtgtcctttggaaggaattcctggaggtactcagatagtgacatcccattaaggaagaaaattatataatctaaaggtctcgagaattgaagctagctgaaaaagaaaaataccagatcatcactacgacatatttggatatacccattaacatttcgtttaattttataatctaagcgttaacataatcttcagggtagaacactaatctttcaactccagacgcagtcagtacaaccattcgtataacaccacctgaagatccatcccatttgatcgcctgcgacaacgaagttttgataaattcaacagtctcatctcttgtcatattgcttttgaaattcttgttacagtatccataaataaacgtcgatcccgaaccggcaatggcatattcttgtttgtgaatagaacctccaattgggatactgtaaattgcacccttctctttatcatcatatccggcacagataataccagctgttaatgcatccttgttgttgtagcacaattcctggaataatgacgcagctatcttagtagttggtggtgctccatgttgggcttcatacagttctaagtgatacttcactatgtcggcaacagcttgggtatctgcagcagagcctgatctacaacaccacacggtgccgtggacttgagtcaatttatctgttactctgttggcaatgtaagcacctgtagtggtacgagaatcagcccccaaaatgacacctccatcaaacttgacggccataattgaagttcctaggttgacctctccctttttcagatggtttatatccacattgatgccgttcattggggatatgtattatttttaaagtgtgtatgtttcagagaatatgtcaactactaagaaactcactccctctctcttgccactgggtgttaaagggacattctgtattgggtggtacacttgtctgagaaagagaatcctactatatattttttcgttcatttttctctccaaaaaaattatcgccagaacacaatgtctcaagtaccattgcaatttgatttcttgacaccctccggctctgcttggggtccctcatccactgtccctgaaaatttgcgtttccatgacatcccatacgctccttactcaaagtccgataagctaggtaaggcagctgactggcaacaatccaaggagggaggatctcagcaacaatctgtccaaaagaacgttaagttacaaagaggccaaagagatcagtaccacgcttatggagcttctgcggctgcctcatttgctgctgagaacgatgaagacggtgagttttcggtcgttgacagctccatatctactgctaaggactcattcaacttgcctaacgctcaatcgaataaccagaataaccagaatgctaatcaacagagacagcccactgttctccgaggaaagaaatcttctgtccgcccacaaactcagcgtaaaccaggctactctaacagcacttggtacaacaaccgtatgaaggaagacatcaacaagaatagagagagctctatcaaggtgagcaaatcatggaagattatctctgatattgaattttctaagcttactaaattaaatttggaggtcggtcctggttccgatgtccgcaccttcggttctgtcccattgtaccagaagacttttgagaaattgaacaacggtgtctctgctcctctcaaagcttccaatcgtcattccattaatcctaccgtctcaaaagaccctatcatcaaggagttggctgagaagaaggaagcaaaagtgttcttcacctccaacgttttaactcaattgatgtgcgcatcaagagcttcctattcttgggatgtcattgttactaggaaaggtgacaactattattttgacaagagagatggttctattttggataaggtcacagtggatgaaaactcctccagccctccatctgatactcatgacactaacattaataatgctgataatttgatcactgaggctactataattaacgacaattttgttgactcaactgtggtgccaaatgcaggcgtcactcttgacacggaggagccacctttcccaattggtaaggatatcctaccaaagggctacagatacagaaaattcttgttacctgagaacgacgaggaagcagaacctttgccaatcatagtccgtaccccagtagatgcttacatgaaggaccaaggatttgtctcggtcaaagccttgaaccagtatgaccctaaggagtttgactggaaggtcaaattaacgcaacaacgtggtgctattatggcttctgaaatgaagaagaacaataacaagatctccaactggactaccgaagcaatcttgacgggaaacgacacaatcaaaattggatttgttgctagaaacactccaaagagcaaccaaactcatgtcattctaggtgttgctacctacaagcctcaagatctttccgcacagatcggactacaacaaggtaatggttggggtattgtcaagtcgttgatcgatattattagacacgaatatgaacatggtgatgctaccgaacagactaagtttgtggtgacgaaagatcctaaggcctccaagttagtgctgtacgcagccgtggatggaattttgggcaatgaagaggatgaatccgtttaaatagtataatagatgtcgtttgtcgatatatgagtaggacaatgccagtgaaatgatgcgagattattattacattaagaaatctttttatgcaccatttatggagttatagttttctaccagttttccttgattaagcaggccgtttggtgacacatggccttcggcagtgtcttcgccatctgaatactcgggacttttcagaatattatcgacaatgtaatattgaatagcgttcataattagtgggaaaatcattaacacaatgaagagctgcaaccttggatgaccttcagtccagctcaggatccaatcagccattaaataaaaccaatcattggataataatagaaggtagattgtactttttgtgaggaacaggcctaatatgtagagagccagctgtttgaagtaatagctcaacttggggggattaccatactgaccagatactatgccttctatgcccagtcttgaacacccattataaatcatccataagaataaccagagaatgggaatgcccaccgtggtatcaaacagaatattgaggaagtaataatcacaagggttttcgtcttcgtcatcaatgtcgaagtcatcaccaccaaatattatgcttgcgatgacattcaatatatgtattcccaaactgccgaacacttgcttagacacgtcgaaaaaccagatcagccatggtctctggtggggatactcttggtatcttttaaaaagaagggaactcagtgacagaagccctaggatcgcttgtacaaacaaggagaatggacctagtagcttacactgatcagacattgctgagtaacgaagaaactttaacagaaaaggatgacagaaggggaacacatagggaaagtttcgcgtatgataaacccatgtgggaggagacaataattctttagacggagtaagtggtgtaatgctttttcgtccggggaaagctctttcaaaagccaaccgcgagcctcagttattttctccttcccaaagatcacaccgacgatgtccgaaccagctcaacaaccaaaagcagaatgtaagtaggcttttaagcttcagaagaattagggattaagcgtactaacggcgttgttagctaagcccaagccatgttgtgtctgcaagccagagaaagaggcccgtgatcaatgcttattaataaatggtcaagactcaggaaaatgtgatgacttgatttcccaatacaaggtctgcatgaaaggattcgggtttgacactaactagctctcagatgcgtgaatatctcttgtaaataggtcaaaattgacaggcattcatccatacggagatccaactgtggatacgctgaacatcttgattttcggtgaaaaatcgtaacatctctggccgtctaggcagagtaacttgatagctatcacagtgcgtcccaaccattcttgtgaagctattttattttgacttctctcagcatgtttgtccgtttagcctcccaaacttcaaagatatagtttcaccatagtataaccgcatttcgtaatcaatcgcggttaaagcaagtatcatgcgctaatatataagaatctcctaagttgcctcccgaattcagattattctcccaacaattaacttatcggcatggctactctattaaaattgaacaatggtctcaaacttccccaagtaggactgggtgtctggaagattcccaacgagttgacagctgagactgtatacaatgccattaagcaaggctaccgtctttttgatggtgcggaagattatggtaatgaaaaggaagtaggacagggtgtccgaagggcaattgatgaaggactggtcaaaagagaagatcttttcatcgtatccaaattgtggaacaactaccatcaccctgacaacgtcggaaaagctcttgacagaactctttccgatttgggtttagattatctggatctattctacatccatttcccaattgctttcaagttcgtaccattagaggagaagtatcctcctgcattttactgtggtgatgggaacaatttccattatgaagatgtgccactgctcgacacttaccgtgcgctagagaggttggtggatgctggcaggatcaaatccctgggtgtttcgaatttcaatggtgccttgttgcaggatcttttaagaggtgctcgtatcaagcctgtcgcattgcagattgaacatcatccttatctagtgcaacagaaactgattgagtacgctcaatctgaagacattgttgttgtggcttactcgtcatttggaccccagtcgtttttggaactgaaggtcaacaaggccttgacggctgtatctttgtttgagcacgatgtcatcaagaagatcgcccaagctcataacagatctgctggtgaagtgttgttgagatgggcaactcaaagaggtctggctatcattcccaagtccagtaaaccagagcgtttgagcagtaacctgcatatcaattcctttgatcttacgaaggaagatttagaaaccatttcgtcgcttgacctcggcttgagattcaacgatccatgggactgggacaagatccctatatttgcctagttctgtagtaaataggtaatagtacagcgtctcgaaatcgggaacggcttatcgccccttctcctcagttagctcgtctcttcctccttacattgccaactaccacatctcacggcccatgtccattataaatcctctcaagaagaagctttcggtggctttgatccaattgaagacaactgccaataaggagcaaaacttgagagctgtagccaatcaaattcaaaaggccatatccactcgttccaatgtagatttagtggttcttccagagtgttttaattccccctacagtgttaaggaatttgccaattatgctgaacagattcccaatggagagactaccaagtttctgagtaaacaagcagctgatcacggaattttcatcgtaggtggttcattcccagagaagggtgaagatgacaagatctacaatacttcattaacatttgacagaaaaggtgagattattgccaaacatcgcaaagtacatctgtttgacattgatattccaggaggtatcactttcaaggaatccgtctccctgtctgcggggaataaggctactgtgttcgactctggggaattcggaaaggtgggtatagggatctgctacgacgtgaggttccctgaattagcaattctggcagccagaaaacacaatgctggaatcatgatttatccaggtgctttcaatactgtcactggtcctctccactgggaattgttagcacgttcgagagctgttgataaccaggtcttcgttattctgtgttcccctgccagagatttggatttttcttaccatgcttatggacattcattggtagttgaccccagtggaaatataattgccgaagctggtgaaggagaagagattgtgtatgctgatcttgatccaagcttactggagtcagccagagctggtatacctgttacaacacagcgtcgctacgacatatatccagacatcagtgagtcaagtaaggtatcagctgagtaggtttccatacatagatattccgtaactatactcctatttggcactcttaccttaatttgatctcttagtgacgacttattccctagtagttagcgaattcgtgataccctttaaatctccccagaagcttccttatctccatccagcatcaaccccattacaaatccaatgttagaagtcctcaagggattcaagtatgaatctctatctgaggggaagttttcgccgtccagaatcttctcacagatagtaatactacaattggtttattacgtgattgcttttatattgttctacttcaccgcttcgttggcaggatttcaattctctttacaatggatcttttcatgggaactggtcacgtctggaaacacgctgggctggacgctattttttctctggctattcgattcactcctttgtgttgttttcatgatgtggatcgtgggaagaagtaaactggcgtgggactttgccataacaatacatctgatcaactttttggtgtgttggctctattccggaagaattcccgcttctgtcttatggtggttcttgcaactcttaagctcaacaattttagtaagtctgggcacttggtctacccgttggcaagagttgagggacaccttttttgaaggtttaatcgagcctggggctacgtcaggagaaagggaccctgaactgggcatttccacagaattaacggacctgcctccgaaataagatgcaagtctattttgcttgttttaatgtgtatatacctgtctattcattgtacctgtagtctgtcaagatcagtactttggatggaagctgttttgaaggctgaggaattagtattctcaacctctccttggagtcatcggcaccgattacgtaggcaaatcccagaacggagctattagctacatcttccattaatccactatcgtccttggtgtacaaatatttttgtaaatccagctgagaaggatttaccattgttagtatacaatgttgtagagaactctcagaaggttcaaatctcgagaagaaattcatcgtagaacgacccttacggtcagcattactggaatcgggaatgaacgagtctgctgaagggattaacgactggtcaaactcgttcgtattagtagattggaatagaatcacttcattataggcgacagtaatcgtgtacggagataacacaatcttgtcaaatccgtaaaaatattctttaatcactctctgttgtctgctgcggatgaatgaatcatccttttcaacacaaccaccagactttgccacctttaccaagttcaattttttggaaggatctgaaggtggattattaagcttggtcaactttttctttagatcgatagacaatctttcgttaccaatgacgacaagaacattgatttcgaaatcgctgataatgttttctataatgttgaggtttttgatgcttaatggcggtgtatccaccacaagtccactatttccaactattggatcttcctctaacctactaagacagctgacacccaatcgagagacttcatatttgtaaaggggctcattcttttccaaggattccgatccataatacttaacgatcggctgtttttggtggtagaagctggcacctgttgtgattgtttcgcccaggttgatattctcaacattcaacatttcactaataggggtgcccgttaaaacgcctggaggtgtaaacgcactctcttgtgggttcagagaaaccaataaaggctgtctatccattttctgagcataagatactaagatccttgccaggctagttcttccacagtctttgcttccaataatgagcacccttggacctttgagtctatcattaggttttctgctcaggttttgcgcagtcacgtatttcctctgttcctctaacaatgtatgcagattgaaatagattggcattgtggtttcttcactaacgtattcagatgatggatctccggagaattgtaacttacagcctctatacgtgaaaatacatgatttcaaaggtccacgaaacgtatactcaatattctgggaaatttcagtaccaaatatttcagcaaatccgtcgatcagtttgaccttgattgtttcatcgttggaaacttcgtatctccattccgagttaggttttagagtaattgtgttcgattgttcctgaacaacagctactgacttgatgaaaaattagtataaatagtcaaaaaaagaacgaaaaggcggatcgcaagaagtatacttacgctagcttcctgatccagaccaggtagcgacatagttattctattcaccagaaatgttattctactaaactggctcttagacgagtcgaaattttgattcgagaaatatatgtgttgatgtatatgtattacgtaaagcgatctagatgggtttatttggacagggagagatcaatcttggtgatccccagatagctcagcaaagcaaccaaaatactcaatccaatgtaaattggtttcctcaaataggcggcaagagtgtatctgtatttgagtccaaccttaacgtttctaagatcaacgaccaaattctcaaactgtaatgtcaccttggtgtgggatccaaaaatgtctagataagaatagacttctgaaatcgaataatcggtatttgcgagaggggactgcacggaaataaattcagctccttcaggcaagtaaaacgacagctcgactttttcataaacaacgtcagtagaacctccaattagaggaacttcgagtagatattcatccttatcctcagcatcttctcgtaggaaatcactaagcttgtgggtccagccaacggtgaagttgtagttccaattaccaaaaattgggaaacgtggtttgacgattaagttgttttccataaccaatgaagttgacacgtttccaaccagatctgtgaaataaatgtcctttatttcgacacctttgtatagtgggaagtggatagcagtgatggctgggcttgatttcgtagacattcttttattcatccagtcagctcgtgaaaatccagaaattaactctgcagctttgttggagtaatcgtaatgctcttccacttgcaaagtgtttaatcttggagaaagccacaaatctctgcgaaggtccttcacgtaaggcaagggcaagtttctttcgtagaccaaagagacggggctttcagtatatggagcaaaagattcctctgtaacatcgtacgagaatccgccctcaagcgatttcaactcccagccgaatgggtcagttgcaccgattgtcttcacctctttggctgaagaaggtccttggaatctaatcttgtagctttttgttggataagcggaatagggcgccttgttggttgttagcactagattttgaatatcaccaagcgcctgctttctaggaaatggctccagttgattcgtaataaccaatgacacagcaaagctcactttcgatttaggggcaatgggaaatggaagctggatcaccgaataaactccaccttcaatttcatcgatatgtgaatccataggtacctcgttctttgacgcatcaatggtggaagcaaaagaaaaggcaatggactcagaaacgttctttggaatggcaaagtagtatgttgaagcgggctcacttcctgtgtttatagccttgattatatgcctttccttgacgaatgatttcgacaaatcgacaactttggcataatcaatattttcccaggtgttgatgatttcaccaaatacactgcctatcaaaaggaacagaattgagatgaatttcattgtctgtccgagtatgaatgatagatgaaatctaacttccacgtatttgatgggagcgtattggttagggcactaccatagattggaggaaggtaagaaagggaattgatggaaagaaaacgagagtttcgtggtgctttgtcgaatcagttcaaatttagttgacctttggccacttcgtaccctaccggtgtgctgtagcccttctcttgaaagggtacatgagatctgaccatccaatttgcttatgtaatgagagtgatatttatcgacgtgtttctgaacgcgcgagctcagtatgttagtttgaagcgcctaacagttgatgcacgcaagacagctcctctattttaatatggaatgagtctcaagtatgatatcgagcagttggtaaaccttctgtttcagttgtgtgttgaccgtgatgtgtcggttacccatttgagtcatatagtccgaagttttcaaagaattttccggctacaagagttgattggtgaacatattcaagctgaaatactgtcgatatctagtagcatatacggtgaatccggtttccatatcgtaagaaatgatgataatgtcctgcgtcctagcatatcaaatgttattaaagaagccaatgacccacatctttttttgagtggtgatccattctctcaacaaatggattctctccagcaagagctgaaatcggtggggagtatgggcacctcaaactccaatgagccggtgcaggatgatatcaaatccaaggtaaacctgcttattgatacttatgctaattattctaccgtttccctcactccaaggctgatcaaattgactcacaggtttctactgtatgaatacaaatatcatcaacagatagctgtcatggtagataacggagaaacaaacgaagtgctacgaccattgaacctacatgttaacgatgatgattttcattacctttatacgaactttttgactagcattattgctcaaagtgatctatccgaagggcagctcttcgaactatcaacagctctagttcaaacgtttctcgatatgaagcatgtaattggaattattgatttgaaaatgttggaatacttcaatgaacaggctgttctactagtgaacgatttagcacccgcctctgatactgtgagcactttttttgctactaacccaattttccccacatttaccgactctaagaacaatgaaaaagttcaagaactcactgagcattttggtctcgtagaaacatttggcctactgaaagatgttgtctcggtttatttcactgatgagtttctaactgcaaagtatttgaacttgagattttttcatgacatattcagagagtatgctgagataatagtaaatgaggctggtcctcaggatatctatcgtgataaaatcttccaaaaagtggaaaagtattgtcgactcagacagattgataacctgaagatactctgtattgagttgtttgaacaacctacggaagactttgctcttgcgatcttcaatgtcaaatcaagaaggaaattattgcacaagactttgacccactggtttactgtacacgagaacaaacaaattgacgatgaactgatggtcatttggagaaactacactcaaaaggcgtacctgaaaaaatggtcgaacgcttttagagagcgacggaatcaaagcaaaaaggcaattgaagttcatcattccttgactagattcctttattttagggtctggtctaatagatatgcagttcatcaagccttgaatgcatctagtcatcttctatttaaaaggaagtattttcagaaatgggtacttaaaaaggccaacgtttccagcatggattccctcatccccaaattaaatttacacacaacaggcccaatatttgacatttggctactaaacagctccctaatgacctctcaactctcaaatgctaaaaacaagaggctattgagagaatgtttggcctcgtggactggaaagagcattaaagtcagaagcttgcaactacttagcgataaattacaatcaagaactttgatcagtaagttcttctatccctgggttacacaaataatacacgtgaattctcaaaaactaaacgaaaagggaaagctctttgtttattcacgcttctttagtcgttggaaacgcataactcatctacattcacttgcagagaaaattgggttaatgcaggaacttaatcttcggaaatatacattcaacaaatgggcggaggcctgcaatgacataaggaaggcaaacggtttccaccgtggcaaggtagtagctcgggcatttagccagtggaaattgtctatggtagctaagaagtttgaatttgaatccggtcggaaactagttggaagaactttcaaggtaattcatttagaagcaaaaggccgatctattattcataagcaggataggttgactatgaaaggaatattctcaagatggaaagcgcaattgattatcaatcaagaacgtgcagatttttcaagattccactatgaagccgtaacaacgagaaaactgcttttccactggattttgaaaagagatagagtagtaacgaatagagaagctgcaatacggtttcatagaaaggttcattttagggaaacacagactttagaaagacagatctttcagttttggattgcccttagtaaacacatcatatccaaatcaaaaatgctggacggcatgcatgactcgcttgtgaatcaaaaactatataaatgttatctgaatatttggattaacaaaagcaatgaaaaagctgaactgctgacaaaggccattactttaagagaaaagaaactgaaaacgttggggcttgatatctggatcaactcgttgagcgagatagataggatggaactaatgtgcagggagaaaatagatgagaatttcaccagggtatctcaagagttacttcgagactggagaatgaaaggactcaagtggaatggagaatttcaaaaagctatacaattcgaaaagcgatggaaccataaccggttggcaacgttatggttggtgtggcaagactcgtacaaagtgcttaaggccaagaagagtcgaaggagttcacctgaaaaactatcgaacaatgtcaaccaagaggatgcagaaatgagtacgagcttggaaggaacaatgtcacccttagcaaatcgcagaaagcatctcgatacgcttgcaagaggtattcaacggcttgatgtctttgatgttcctcaactagcacctggaagtcctacaacacccacacgtcgtggacatcagccttcattcaccactccagggagagtccgccgcatatctccaacgccaagaatttcacccaccaggacaccatcgctcaatggatcaccagaggacttggtgcctgctacagaaaggattagaagaacgcgagtgcagacactaaagaaacgatacgcggcagccagaatcacagaaccgctcgtatcagataattctagatcaatggcgatagaaccattcttgtaagaaatagtggctttatatacttgatggttaattgatggttacaaaaaacgtgcctattccaagagttgaccgttgacattaataaggatccctcgaattattttctcaccgacgtttgattcaccatcaacagaactgcttccatactaaagcgaagaaggccaaggatgtctgatctagcacaagaattcaatgagccggtccttctcgccattattggaggtaccggactgtacaaacttgactgtctccacccggtcgcaaaactgcacataactactccatggggtgctccttcttcagccatcaccatctcaaagactgctagtgggttccctatcgcattccttgcaagacatggagaacaccattctttgacacctactgatgttccaaacagagctaatattgcagccttaaagcatctcggtgtcaaggctattgtggctttctctgccgtgggctctcttcaagagcacatcaaacccagagattttgttgttcctacccaagttatcgaccgtaccaagggaattcgcccatcttctttctttgagtcgggctttgtcgcccatgctggttttggagatccatttgacctaacgcttaacaaattcgtcaacaaagttgttagcactcataagctagaaggagattcgtcgtttttccacacaagtgaaactgagaagaatgacttaacccttatctgtatggaaggaccagcattttctactagagcagagtccaagctgtaccgttcatggggaggatctgtgatcaatatgtcttgtctaccagagtccaagcttgcaagagaagctgaaatagcttaccaaatgatctgtatgtctaccgattatgacgcttggcgtgatgacagcgagcctgtcactgtagagacagtcgttggccatttgaccgccaacggagaaaacgctcgctttgttgctactaccttgattgaagcattagaacagcctttgattgatggtacggttggaaatgacctcatcggatctatgaagtttgcagtttctacggctcctcatgctcgcgctcccaaagttgctgaaaagatcaaatatctatttccaaatcattatttgtaattagattgcaattcatacagtatagatcaagtttcattcaaaaggcttaaggcatcccttgaagggtgtcgagcaacttggcaggagctttctttcttaccagtaatattcttttccttcgcgcaattatcatcttttaatctagtacaatttcactctcatcagaaaaaacattctaatgaaccacacgtttgccacacctcctaggaatccctctcctttgaaggagttggcattctctacttcaagagacactcatgaagaccctttcttgaggtccacaaagagcaaaagccggtttccgatctcaacgaggagtgctccatctcctttcaaagtgactactccattcaaggataacgtcacggaaaatggcagttttgatcaaatagatcccagctcgctaaggattgatgataccgtaacaaagttaactagaactcccatcaagcctttgatgtcatctccattcaaatttcataaaacacccaggaacatgatggttccacctacacatccctctgtcaacaaatccataacaccaaacgcttctaaactgaacccaacaaggtttcaaaatgattctatcgatcaactcttcaaaaaatctctctttaacaaaaggccctccaaaccatcaaagtcgaccttgggctctaaaaacgacttcgacgaactggcttccgagtccaagaggaaagatagaacactttcatttttcaaaccaaagggggctccagcaaagaaactgccacctaatgcattcaacaacaaggctttggaccagaaactgatgcctaccggagactggttgaacccacaagtggaaaaggcaatctcgagaatggtcaataaggactctcaagttaaaaaactgttaactaatgcaatgctgtgggcaatcttaaagctactactgagtattacagtcataataacttttaacctcgacttctcagataaattttatgagtggtatgagtatatcacgtatttcggccattatctgtggatcttactgcaatcactattttttttcaatgtggtaacctcattatttgaactattcaagccaagagatcaatgcttagatcttaatctaactcccagacaaaggcagcttttggggctggaaccattgaatgagacagatctcagggaaggaacagattatccagtgagcaaccttccaaaagtattgccaactttacaacagcagcaagagcagccagaaaacacaagttttggaacaattaaccagagttttgcatccatgagtatagacaccactaaaaacagtactttggctaatatctcaagcttaggactacaaaaagctccttccagcctcaacaagaatgtatctcaggggattcctaaattggtttccagtaacaagtatctgtacgatttgaatactagttttggcggtgaaacgagtttttattagtttacctatagcatagttaaaggaaccatcgatggcctgccatgtgcacattgaaagggcaattcacaagatttaaggttttggatgattgttctgcattgagctgtatccaaagacgtgccgaatttcacagcagaacggcaagctagagaattcacaacattaataatcatatcaggaataaatggtaatgtctcaaaccatttttcaccaggaggctttgggcattttttcccagcttccaaatcgctcaggtattgcagtattcctgattttagtgattcatgtgacagctttccctccgtaagcactgagggcaggtgagtgagaattattctagagttcagactaatgaatctgatcccccaggtagatagagagaattcaaacgtagaaaataaattcataaccatttcaggtaaatcccaagtaatgttttcaatcgcaactgaacagtttgagagattattaatataattctggaagagtttctctgccttgactctttcgtcgcaagcatgttggtctaacgcaagcagtacggtcccttggtgttttgtgactaaagtgaccacaatgaacttttgatccattaagccaaccaattttacggaactcaggtcatctttactcagctttaagtttgaacagaagaatggtgaaatgttgtccttcaaaggttgaatctttcgtgttttatttttttcaggtgcctctttgaaggagtcaatcattcttttattgtgttgcagtgatccaatataattaactgcaactttatcgattaggcattttgtaagataagtcaatgtctggatttcatgcactgtattaatagttttctggggtccttgtgttagttcagagggatgctggggacctgtgaaactaacaacgaacgcaaaactagggcggtgaacattttggctcttgtaaagttgggctagttctctagttataagattgtaaagcctttcgtccatcaccagcctcttgttgagaaaaataaaccgatgtgaaatattaaatgtcggattcaggccaaaaatggaatcggctttataatccatatgtgaactttgcaaaggtaccatgctagatcccatatttccgaatatcaggtcaaatgaagtgctcagtctgtcatctggggatacagctttgctaactgaaaggatgctcttttcacaagagacgtcaggctcaataaggttgatttttatcgagagatcaggatttgttgcacacaatgggaaaagcgccaactttatctgttgagaaattgacttttggctggtgttcgaaatataagtacgtctaacagggagattatagaacaatccagtaatctttaccaccgtcccttgaggtgatccaataccgtaatcatcacattccgtcaggcttacaacatgagtcccattattgtagacagtggtgaaacttcggtcactgcttaacactttagagctaattcgaagcgccttggatatctgggaaaggctgtgtaatgtctcacccctaaacccataagttttcaaatcctctaaatcttcaagcttcagcactccttttgaagaccagtattcacttccaatcttctctagttcgcttggtgggataccatggccattatcctcacattctatgcaaatgatgttatctaattgaactgatattcttatttcggttgatccagcatccagactattctccactaatcctttgatgacatcgcctatcagattaagctgaagattggacttgagagcgagtgatactgctttatctaaacgccttactatggacatgtcatcgttgcttgtagctatgacttgaaactcgaaaagattagatagccaggcgcgagctcatctcttttggcacgaaaaaaaaaattacaataaaaaaacttcagcaggtaaaattcttaggagacatggctaagaagaataacaagacccctgtcagcaagaaggctgctagaaagcctaaggctacaaagaattttacggactttgtcttgacaatttctgacgatgaagagggcattcctgatttggacattgatggtgacgaagacgacgagaaaacgattaaagatacagtaaccgaaaataaaaaagccaagaccaagacaatagcagcaaaggccaataagaaaaagactgaagccatcaaggatgaagatggaacctctctgaaccctgacttcattttctctgtggaggatgaagatgtggttgaagaatttaatggttgggactttacaggtcatgatagtggaaaagttaggacgttagttgatttggatggaattataaggagaaagggtggcttaggtgttgtcgcctctactggtgaaaaaagtgatttggccgaagctgtagatgagaatttaatagacgaagaagaggaagacttaccaatagagaatgaagatgagggaatcgatgatgaagaactagccttggacggatttggaatgggtgcaaatcaagaggaagatgtggttgtagaggaagaggttgaagatgatccaactcttgctgaacccgaacccgaaattacggagcaagtggagccagaagatatacaagaacctgaagacactgttgaggaagttaatcgatacttcgaccaaaccaagaatcaagaagtcaacaaatctgttcatgtgacatttcaatctctctcattgtctagaccggttctcaaaggtttgtccactctgggatataccaaaccttctccaattcaaagtgcttccattccgatagggctgttaggtaaagacattgttgctggagcccagaccggttccggtaagactgctgcatacatgatccctattattgagcgtttactgttcaagccatcaaaaatatcggctaccagagttgttgtattgacccccacacgtgagttggcaattcaagttaacgatgttggtaaaaaaatcagtcaatttgtcaatggaatagagttcggacttgctgtcggtggtttgaaccttagaaagcaggaacaagaactcagaaaaagacctgatattgtgattgctactcctggtcgttttatagatcatatcagaaattctccaagttttagcgttgaaagtgtcgaaattctggttatcgatgaggctgatagaatgttggaagatggtttccaggaggagttgaaagaaatattgacactacttcctggaaagaaacaaacaatgctgttttctgctaccatgaacaacagcatcaaagatttgattcagttgtcattacacaaacctgtgcgtattatgattgatccgcccaaacaggcggtatccggtctggttcaagaatttgtgcgtctaagaaagaatttggaaatgaaaccagcattattgtttgacattctaacaaaggtgaacccttcccaacaacatagaattgtggtgttcattgctagaaagatggacgcccataaactgcgtattattttaggtttgctgggattgaaagtgtctgaattacatggatcgctgacacaagaacaacgtctgaagagtatcacagattttaagaacttaacagtaccgattttaatttgtacagatttggcttccagaggtttggatattccaaagattgaggttgttatcaactatgacatgcccaagacttacgatatctaccttcatagagttggaagaactgccagagcaggaagagaaggtcgctccatcacttttgtctctgaatccaaccaggaccgtgctattgtacgtgaagcaatgaagggtattgccaccgctaagaatagagcgttaggaagaaatgttgattgggacagtattgaaaagattcatcagttaattgaggagaaagcagaaaccataggagatattctttctgaagagaaagaggaaaagcaatttttgcgtgctgaaatggaggtcagaaagggagaaaacattctacatcacggagaagagataatgtcaaggcccaaacgtacgtggttccagtctgaagctgataagaaaaaggaaaagcaaaaatcagagcaacagatcaactccaagaaacgtaagcgattggaggctaaaaaagaagctggtggtgaaagtatgtacaagaagacgagagatgatcgaacctccaatcagaaaaagaattcgactcgtcaaccttccaaaaaccagatgaagaagaagctgggtaaggtgaagagtaaaagatgaaatctcacttctgtagcatagttagattatctagcgaatatttctcacctggatttttatgaacctcagacctaaaatctcacacatcctcctatcttctttggactgatccctcctatcttttgcacactcaagatggatgatcgactatcagctcaacttaatgcgtttaagaaccgcatcaggaatacggccaatattcctgcaccgaagagaatagttcagctggatcctgaacctaaagtttcgcctctgagacaacaccagcagacaatcaagaaggagcagcaaaggtcagaaatagaagaggagcttcaacatgaatccaccaggagcctggcaaatatttctggaagtcatctatctacccagttgcacttggccgtggaatatattaagaagcaggataaggaggtatctatcaatgaactacaaagacatatgtccatggacatatccaagacattattgccgttacttaaaaacatagatagaataagatatgaccccgacagacatactttggaatacatgtcgctgcacaatattcgatctgccgaagatctgctgaattatcttcgtattcaggctacttttaaaggtatcttagttaaggagctgaaagatggctggagcggttgtcttgcggctatagctgagcttgaagaggagcaaaaaatcattgttctacgtaccaagaaggaaaacgtcccaagactggtctgggctaataaaggtggcaagttgggtcagatcgacgatgactttatcgaaatgtggagtaaagtgaaacttcctgatgctggtaatttacaggaagagctcattaataatgggttaaaacctaccagtgtggacccttctagtatcaaaaggaaagtcatgcattctcaggaaaataaacagaaaaaacctagacgaggaaagatcacaaatactcatatgaagggtattctaaaagattattctggaagggtctaaaaacataaactaagtgtattagagtttaaactaagtgtaatagaatcctgtaagtaaggtatcaaacctagaagcatcatacgaaggtgctgaatctgaggccgaacaacttaattgttgagattctttctttcccaatttcagcaattgaatgctttctcgtagtgattgtaagtcacttatttgcttgcgagtatctggtgaaagatccttagtcgaattggttaaaaattttaagccatctgaccaagtgtatgaggcctccttagtactggtgtagaatgtgaatattatctgattctgcttactgatcagatcaattcgctcataaaaagttctagatgcaagagaaatcaacctggagttctctgggactgattcctcatgttgcaaaggaatggcaacaattctggagatcttggatagatctaagaccgcaccattggaatctatgttaggcttagtggtcagttggtcggtgtattctttgtagattattgattgaatgttcggagataggatcatgaagtaagatcttggttttttgttgttggctgccgcttctattggattttcactatagacccatgaaccgtgagatagttgcagaaacctttcctctttgataaattccagaacttctttatgaataatcttggaaacggaatgagtttcttctttccagactctcttatgtgactttttgatctgattcctctgaaatactctaagctcctcgtaggtcaaatcgtgaaccgtttggatcgcaacagtataattctcgttttgagaaataagttgttctaaataaatcatagcgtagtctagcaaaactgaaatgacttgcaaatcagaagtatcggcctggctatctttccaaattctcagggccagtcccatcaagttagtgtataatagttcgctgctgattgtgtgttgcttcaagctaggatacttgtcggtatttaggatttggtatagtttgtcactactcatgatgccaacttcaatgattgggaagcagcgatcgtcttgagaaaacatcaattgctcaaagtatgtcttcttaaaagcaacgttcaaactcaaaagaaagttgttgaactgaagagcagacagcactgataacttggacagtataaatttctgagggttgtcagtaaacccagctcttacaaactcaccctttgtggcgggtgtaccattctcattcaaagaagtgttcaacgattgcaataaaagagtaaaaataaaattgtggcagtcatatttcagttgaatctttgtttcaaacagaattagttctgctttatgactacaccgaatcaactcatggtaacgaaatgcggcatccatatccatgccctgttcatactttaaagtcaacagcccagtgtaaaaattgccccttttcaagttgcgatacagcattgcgagttcagggattcttgattctgtagcaatgtacaacattttatagtaaaaatccaaaatggtagcaggtagcttagaatcatggattggcaacatgctagctaaagaagaagtgtactgttccttctcaatcaatgcatcaagcaaagtcctatacactggatgagctttaaatatgttaccagagacgaaaaatatgagcagtttcacaaccgatctgacagattcgggagaagagagttgagttgttatctccaaaacataatggagtagatctttggtgaagagggaggtgagtttctcactagacggggaaatatccagtaccttcaacaacacaacaactatgttgatactttcggttttgtcttttgaattgattagatactgacacagtgactctgaatattggatagaacttgtttcatctaacctactcaagggatctaatttcatgttagcaggagcagaacgaagaataacttttcacttaccttgggagagtagctctttgatattattgttgattttccggtaaccctcagtcatacccaaaacgtttgctgtaaaggatcgcttggaaagttatgtctcaggcgccttgcagtaggatcgccgatgagaaatacactaataattagtactcgcagatatttgtaggggagggtaatgctgctcagtgcgttttgcaagcgggggagacagaaggaggcgagcattcttttataggggtctcttggttcaaaagttgtacagggacgtgctaatgctaccaatggcccttgactggtactgaactgtgtgcatgaccaagcactctctagtaaagattccagctcagtcaccgattaagattgggtgggaaacatagtattgtgaatttcataccccactgattcactaaacgctactcaaaaaacagttctaaaaagcaagtacatagaactaaacaccaaacaataaaaagtacttctaccatgtaatttcagatctagctcaactcgcttgatgacttggataaaacgctaaccatataactataacaagcgcatgtagtttagcggtaaaattcgacgttgccatcgtcgggcccccggttcgactccgggcatgcgcactaatgctattaagcacattcaattttttcgactaccaagaatcatcggcgtcctggactttgtcctcccacagtgtaggtcgttatcttttgaaccaggaatggcccggtagtgccgcctcggataaacttactctcggtcactttgcatgcaagcatttcccacagaaaaaattcgtcgctgctaatcaatttcccggttgctcggcagttggcaatagtcgtacccttccgattattgtgcgaagtaggtactatcagtgcagtattttatttttctctccagttggcattccggtaaaaaacattccttaagatagctgagcccccacccattcattaaagcttgatatataggttttctttttctttttattgctcgtgttcaagttctcatatggcctccccagtttcgacgatcactcagctggccctggtcccatatagattccttctccaggtagtgttatcatgcttgaacgagcgcaacatagtcacactacctgttaactttttcatcaacttctccccagtgttcatatggttgatgatattcaaaaatgccggcattataccccatgaatggcgtcctccaatccatgtcaggctcatgaaaaacttagatgagatgatcttcagcataagctcggtatcagcatggatttcactattgttgtccatcagcattgcatcgctcgtctatgattatttttatcggttaaaacccgaagacaccagaaatcaggcagacacagtcaagtatgatctcgcagacgattcattcgatctggaagtcttcgtcattgacgatactcaggaatcgaccaaaagagaaagcgaagacgccaataactccgattcttcagtatcatcacattcagaggccgtagatagcttcgttgggactaaaaaggtcaacgtatatatgcctctcaactgttggtattggataccttgtgcaatttttgcgatgtcgtggatcatattaaacttcgatcattggatggtgactcctttgacgaaaccaaaagatttgtttgcgtgggctctctacgttttgggtcatttctttgtaccattattcaccgccatttggctttatgtcttccataccccgggagctctgaagtattactctctttgtctcggcttgcagaacatagctggagtaattacacatctctgtttccccaatgcacctccatggttcattacactatacggtgaaaatgcatctgctaactacgaaatgccaggttacgcagcgggtctcattcgtgcagatatggccatgggctctcatttatcatctgatggattccacttgtctcctatcgttttcggagcatgtccatctattcattcagctatggcgaccatgtcatgctattttgtatgttattacagcagatgggttcttcccaaaatcatgttgttgatctttgttacatgcttgtggtggtccactatatatcttgaccaccactggagaatcgacctctcagttggtatggcatattcattagtcgcatttaccctcttgaaaggcaggttgatgaagaaagaatttgattttgtaactgctagacgaaagggagacttttgcaaaggttccactgtggggatgcgtgtttttcagggaacctttctccgggatttttttgatccatattcatgagtataaatcgctcacatacaagagacaaatatcctcttgctttatttacgccatcgtatataaactgtatcattattcgaattgtatcctgaagtccagtctctccgtgcccccagtcgctcccctgggaggagcttaacctcaacctccgcccacactttttttttcctttccttcgcgcatatttttatcaaggtaggaactttctccataaccttaaaccagcaaaaaagtaaccttacttttcgacccaaacatatccatgaaccagtacttcaataatgaaccatcaaactcaaggttttcgcctcaaaaccagccgtctcagcatcaatcacctccgtctcagatgaaaccaaacgatatggtcatgaatattctggctagcattccaaagtttcatagccagcttactccgcaaatgctgctagaactggataagaagagagtcaacattcttctttcaatcaacgtgattctcatcgccaaaacgatggagcttcaagtccaacttaacaaatattttcaacagccccaaaaccctaagcttgaagctcttaagaacttatatcaaaattgtctcaagagggtccatgtaaatctctcgtgtttggcttatatcaacgaaaaacacgccggtggaaatacttctgaacagataaagcaacctctttttcctacaattatcacccctgttcctgaactacctgagttgtttgagtggtatcagaaacttcagatgctctatccagaagctgtttattatcagaagaagttgttaatgctgaagcagcaacagcaggaacagctccagcgacaacagcaacaacaacagcaacagcaacagcaacaacaacaacagcaacaacaacaacagcaacaacaacaacaacaacaagaacagcagcaacagcagcgacaacaacaggagcaacagagacagcaggaacaacaaagacaaagacaaatacagatgcaactacagttacaacaacaacaacaacaacaacaacaacaacaacaacagcagcagcaacaacagcagcaacaacagcagcaacaacagcagcaacaacagcagcaacaacagcagcagcaacagcagccacaacaacagttcattagctctgccacttccactccctcttcaaacatgaactcgcaaatgatacccccgcacatgggcactacaaacagtaatcattccggtgcaaacactccacaagtaacaacctcaagtggcccatcaaggctgagccctgagctgattttgaaccaggttagatcccaacaacaacagcagcagcagcagatgcaacaacagagacaacaaatacctcgtccggcacagccagctccccaacaggatttcgacactaacagttatttatccaatgactttatcaatattccaaatcaggaaccactagatttatggtaataattacttaataatatagataatctttcaaaactacatagtctttttttatgtttattagtacatggctttcttgcaatcctccggtgtcttctccagaacctcctccaatgtccacctaggagcaatgcccttcttatagtctcccgggtgcttctcaccaccagcaatccctgtgctgaacttcaaaaacaaagtatctcctatctcatcacaacatttgagcaaataatctatatcctccttcttcaaagaagaggaaacgcagaatcgaatacgagaagacgttatatccgttgcaggatatcccacaacaacgacagcaacctttctatcgtacatcattcggctaaatgcaggcatcttggggggaagatacagtaaaagggggataacaggagaatcatcagcaccataaacaataaatcctaatcgctttagtcctaatcgcagatacctagaattgaaggcaatcctttgtagcctctctttaccttcattaccattgagttgtccatctataattttcaaagaagtaatgatttgtgtgagcacagcaggtgacattgattctccataagtatttgttgtgagatctaacttcaatctgtctatgatggctttgtcggcagcgatgtaaccgcctgtggctccaaatgatttggtaaaagtacccatcataatatcaatattggaagaagaaatgccaaaatagtcacaaacacccttaccattgggtcccatagcaccaatagaatgtgcctcgtcaacaaataaataaaacttgtaacgcttacgcaattctaccagttttggcaaattacaaagggttccttccatggaataaagtccctctacagcaacaaaaatcttcttccagggtctatgagtctttggctgaccttgggaaatgacacttctcaaagttctttccagcgctgccatgtcgttgtgagcaaaagttttgactgaggcgccagacaaacgaacacctgtcctgatagatccgtggtttaaagaatctgagataacacaacacttagagtccaccaaagaggtgaagagatttgcattggtcccataacccatggaaaataccaaagcattgtccttgccagtaaatttggcaacgacgtcctcacattcaagatggagatcagtagttcccacactaactcgaggaccagcactgttggtaccatacttctccaccgtcttgatactttctgaggtgcacagaccagaggattgtgcgaaccctaaatagttgtatgaactcaaattcaagcgctctgtgacggtgccggaataattataggtattgttgtaatcgtcactggttctgtcgtaacatttgatgtacctaccgggaactccacatatgggccttgcaaaacagtcatctaatcttgttttcaaacgacgcgtgtagaaactttcaaaattggcataccatggagcaataccatctttcaccatcacatctctgaatagttcagggtgaaacaacttcccaaagaagtctctaatatggcctattatgatcaaaataaggtaattaaggtatgttgcaatcaggatgaaatatggaggttcgtcctcgatgggaactggaagcggctcgccagggttatgcttagagacaaagagccattctttactggtcaaggacccaaattctttctcggccttctcttgtggtgaatcattgtctatgagagcatctgggatagtttttgacatgatctttttcagcacggctatatagcaaaaagcaaaaaaaaagaccgaatggaattatatggtctaaaaaaacaaactggtggtaaaataaaaaaaaacgactggtgggcggtttcaaaggagactaatgatcttctatgcccgcggaaataaatagtactccaacgactgaactcagcggtattaaagtttgtgaataaaattacaaggcttagaaagcttggttggtctttcggtatctgtagatggtagagttttgagaacatttcatttccacagtaaccaacgaacacgacccgtgacttccgggggttggcagatgttaacgcgcgcgtggtagaagtttatcttgggaggtgctagagggtgctcttggccttgttcgctggggggaagtgtttgtagttaacgtacaactcctcatgactggggatcagaatttcaacttgatttgccgctaatatgagtgaagagttgaaggagccaaaaaacagagcccctttacctaatttcagccatctagtttatgaccttttcgaaaaattggatacatgtgtcaaatcgcctcatattcctgaatctctcagaagtcgaaagaccaagataatagagcagtttgtccaaaaatggagatttgagataggtgataacatatatcctgcctcaagacttatttttcccaatttagataagcgtcactataatatcaaggattttacattgatcaagttcatattggacatcttccaagttccaaaagactccgaagatacgaagattttacgtaactggaaagggaagtatgagaatagaatgcgctccaacaaaaatgatctagctcaattactcactggagttattaaagctaggagaggtgctgttttggatcggccagaaatttctattgacagactgaacgaacttttggatacaatgactcgccctgaaacaaaaccgtctgaccaaaaaaagattttgacggagattttcaatcatgtagataatattgaactgaaatggtttcttcggatcctactgaaaaggaagttaatgggtggtatggattttactttttttaggcagtggcatccagatgctgtagaattacttcaactggttaatgacctgaaaactgtattctgggaactgactgatcggttgattccattgcctgaagcgggcagagtcatcagagttgggcgtgcattcaggcctcaactggcaatgcgacccaatagaacttacgatcaaatagctactctatttgacaataatttctacattgaagataaactagatggcgaacggattttgatgcacatcagcttgaatgacacaacccaacaacatgaattcaagtacttttcaaggagtggaactgactatacatatttatacgggtcaaactacgaagaaggtgcattctctcctttcatcaaaggttgcttcatagatctcaaagatgacacaaaagaaatccgatctatggttttggatggggagtttctcgtttatgataacaaaagaaatgttattctcccctttggggctctcaagagtgccagtttaacgagattgatggaggagaaaaacgattcggaagactctcaagagacgcaagtgtatttcgttgtttatgatcttgtattcttaaatggtacatcatttcaagacaaagctctcaaggtaaggcggaatttactgaataaaattcttgcaaatccaatccctaacagaatagaagttatcaaatacacggagggtcatgtcggatcggatatcgaagctgccatgagaagtgctatacacgacaatcgtgaaggaatcgtagtgaagaatccaaaatcaaagtattatattgcatccagaaatctcaactgggtcaagataaaacctgagtacttggaagaatttggagaaaatatagatttgattattctaggcaaaagaaaaggactgaaaaacgcctatatctgtggactcagagagagtcttggtaatgaccggtacagattcttgtcactggccagaattgccaatggatttacagggcaaatgtatgaagaaattgaacattcactggggagtaaatgggtcaatataaggaagacgcaaccaccttatccatacattgatctcggagagatatcatcgatggtggactattgggttgatcccaaagaatctgtcgttttagagatcaaggctcgttcaattgatattggtgatggcgggaaacgttacgcagctggtaccactctttacaatgcgtattgtgtaagaattagatctgataaagacttcttatcatgttcgacttttgcagattacaaagaaataaaaacttcaaagagtagacacaaaacagagaaaacacacagtctaatgagtaaacgaaagaggacaatagtcactgaaccaattctcgctaaacaaagtgtatcttcgaagagcagcatattcaaggattacatcttttatgttttaagtgacatgttgggtgaaaaacgatactctattgctcagctggaggctttgctggtcgagaatggtggcagaataactaagaatgattgcgtagctcttgcagatggcgagaggcttgttttacttagtgacaagattactttcaaagtcacagagtactttaataaaggtctaaatgtctttcgaccaggcttcattctgaagtgtcttcagctgaaaactataattcctctacaaattaacgacatattactggcggatgagtctttgatagaaaaggtaaagaaaaactccgaccgatttggggatagttatacctctcccattgaccgtaaggagttgcgaatgcttatgaaaggtatacctaagataaagttagaacacccactaaaatttccactactgtacaacttgttcaagggcctgaagttttatatcgcaagaccatgctatagatctccatttctgacaaatgttatgagtccatacttgttagaagtaatagtgattctaggaggatttcttacaactgatattttccaatgttcatttataatcgtggatacttccaccacattcaactattcctggttgactgaggaggcgaccatacaggatgaagttgggtctctaagaaaaaagctgggtgatgatctaccaatcgtcaaaggtgttctagataaagtaccccggatagtagagaaagagtgggtgttcaaatgtatccaggaagggacaatcgttgctgcggatggctataactatatcggttaataaaaataatgatttacatttaagaagtaacagcacatatatactgtaagattaactttgcgtaccctaaattttactaataaacttaacgggttgccatagccttggtaaccacacgtttcaatgccaattcagcttttctgaagtcatcaccggaagcatcttctagctccaaagcagccaaagcgtcagacaaagcagactcgatcttgtccttagcacttctctttagcttggaagacaaaattgggtcagtgatggtagactcaatggaggaaacgtaagcctccaacttctgtttggattcgtgacggttagcgaagtcctcgtcagccttcttgaacttgtcagcatcgttgatcatcttttcgatctcggaagaagacaatctaccaatagagttagaaatagtgatgttggcagatcttccggtagacttctcgacagcggtaaccttcaagataccgttggcatcaatctcaaagatagcctccaacactggctcaccagcagacataggaggaatgttcttcaagtcgaactcacccaacaaggtgttctcagaacagttgacacgctcaccctggtaaactgggaattgaacagtggtttggtggtcgtcaacagtggtgaaagttcttctcttgatagttgggacagtggtgtttcttggaacaactggggcaaagacgttaccttgcatggcaacacccaaagaaagagggataacatccaacaacaacaagtccttggtctcttcagaggtagattgaccggtcaaaatagcaccttgaacggcggcaccgtaagcgacagcctcatcagggttgatggatttctccaattgcttaccatcgaagaagtcagacaacagcttttggacctttggaattctggtggaaccaccaaccaagacgacgtcatcgaccttggatttctcgatctttgagtccttcaaaacttgttcaacaggctccaaagtagacttgaacaaatcagcgttgatagcctcgaatttagctctggagatttcagcagtgaagtcttcaccatcgaacaaggagtcgacttcaaccgtggtctgagcaacagaagacaaagttctcttagcacgctcacaagcagttctcaatcttctcaaggctctggcatcgtcggagatgtccttaccggtcttcttctggaattccttcttgaagaactccaacaagttggtgtcaaagtcctgaccacccaagtgggtgtcaccagcagtggccttaacagtgaagacaccaccagcaatgtgcaacagggaaacatcgaaagttcctccacccaaatcgaaaatcaaaacgtgcttctcctcctcagacttaccagcaccaagaccgtaagcaatggcggcggcagtaggttcgttgatgatacgcaaaacgttcagaccagaaatggcaccagcgtctttagtagcttgtctttgagcatcgttgaagtaagctgggacggtgacaacagccttctcgaccttttgaccgatcttagcctcagcgacctccttcatcttggtcaaaaccatggacgaaatttcctgaggagagaattgcttggtctcacccaagtactcaacctcaatcaatgggttaccgttgtcgttgacaaccttgaatggccaagacttgatgtccttttggacagactcgtcatcaaaggctctaccaatcaaacgcttagcgtcaaaaacagtgttctttgggtttaaagcagcttggttcttagcagcgtcaccaatcaatctctcttcaggagtgaaagcaacgaaggaaggagtaacacggttaccttgctcgttggcaatgatctccactgcggagtcgtaagtagcaacacatgaataggtggtacctaaatcgataccaatagcaccttggaaaacaccgtcagccattatatatatgcgaaaacttgaaagtttctttgagaaagaagaggaaacaagaaaaaaaaaggctctcctaaaaaaaatttttcaccaaccactagaggttttttttctaggttagcgaaacagtaaattgtgggtaaaactaaaaggttacccggttcatcggctgtggcatggaatttatagcccattctagttttgctcaccaataaatagtctcaccagtcactgattccctgaagtagtttgtccaaggaaaactgaatcagaaagacagctttctgaacttgagacttagttccagttatagaaatatgttgcttaggcattaattcctcttctagtgcactaaaaatcttgattttagccttggagttagttcgtatgagttcaattctggaacctttacagccaattagataagaagtctgcctttttgtgagccataaattgtgcgttaccaatatatccacctggcttaatggttgtaaagggagttccttcttgcagttgtacaattctgaggatcttgttaagttttggaaagagcttcgagtcttagtatcagtagaagatgctcgtttgaatacatgatagagaacctcttggcaatctgccagagtgagcttgtccagaagagtaattgaggaaattactacattgtatgggagatgaaagcgtaattggctgtgtctatcgtgactaccagcggttaaaactccttcaactgtcaacctgctgttaagccattctttatccagagccatcaaccagatgccatcaatggtcaattgtatgatggaaatgaatgagttcgcatcctctgtatggaattgagagagctctgatattgttcgcatctggatctgataagtggccatcaaagaatctaaccatctgtgaacttcttgttctttgacaaggacgggaacagtcagaaaggctggcggcctttctacgccattttctacaatcctcaggcgtcgcaaagttgtggtatgaaggatgccagtagctgaatcggcccgttgccacaagtcctgataaatgcactgtgaaaggttcatggcgttctgatccttgttccccccacattgtgatacacatagaactaacaacacaaggaatgttgtatgttgtccgtcagaactgacagggtctaggatgattcattcaagatgtcactccaagcatgcttaagaaagtcgtattgagcgtatgtctgcaccatcatcattctttgttcccgaagttgcttcacaatttcccacaccgggtcgtcacattcaaccagtgcctgtttatgattcagcatgaaatcaaacgtgatgaacgttcctgtccggccaacaccggctgaacaatgtgtaattaaaggatcgttggggtctttgagatgtgaggcagtttttgagatatgatgcaactcatcttccaaagaaggagtcgaacagtcggcccagttactggtccatatatgatagcatttcttggtgggaagagtttcggaaaccatgtccatcacagttatgttgaaaccattttctgatttcaactctttcacttgaagattgaattctgatttataaaccccattactggtaggaatcttcaagctttcatgcatatttctaggccaatagacgtggcattttctgaccccttgctctaccaaaggtgtcaagttaacgacgacaatattatttcccttgacttcattgtagcacatttgccagaactctgtgatggtatttggagtggggccttgagtagcaatataacgaccgctactctggccatacgttacttcgatatgagaggcatttatgtaatcatcattcgtttctgtatccattacgggaagcctgaccctattgaaattgtagggtgtgacattactgtacctgtttctgtgatgatctaacccatctgaaatactgaaaggagagttatgatcaatgaaaccatgttctattctctctctctcttccttcaacaacaaagcaaattgcctgcctattttaccttaaatgtcagtaagaacttgagattatggtctatgccacgcctacgtacccttggccattttatttgctgtgtattcgatgagtaactaagatgagattggatctcacagcaagataaaagcaagagagcaaaaaattgtggtccctagcaggatcgaactgctgatccccgcgttattagcacgatgccttgaccaactgggccaagggaccattttcgatcaaagagataccaaattcacgaatgactgctaagtagatgttttttttcatttttcgattgaatgtatctgtgatggtcgctagaaagctatgtggcaattattctagatcgaattaaacacttataactcaaagtctagtaaactttcataagtgttttcgcaatgcgtaggagaattttacaaattgcaacccaatcacttacacttcacaatttaaccctcaaagacaatttaatgaaatctatatattaatattattttacaacccgaatctaacaaaatcaaatgtatgaaatctattcctcttcatcgtctgtattaacaggcttgggagtaccttttggagaacttagccattcaatatgacgaagtcgtcttcgctcttcctgagctttcttttcatttctagtcatcttcttctttctttgcttaaccttgatattggctggagagtcatcatctttagctttttgtgccgcagtcttggcggctgcaacagtagaagaactagaattctttccaccatcttcaaaacgcccttggtcaatttcttggattcctttggttaccatagtaccattctccactatccactgttctggacatagagctccgacgaattcgttattatgtgaaatcatgacaactcctccagtccagtctctaatggcaacagcaaggcctcctaaagaatctctgtccaaatagttggtaggttcgtccagaactaacaaatgtgggttgttccacatggcaccagcaatgacgaccttaaccagttgacctccagataaggatcccatgggagtatgatctgcaatatccgcgtcaaggccaacatcttcaaagtgcttgctgataactgatggtgttaactcacgataacctaaaccttctctggaagcttcgtgatcgtcaaatttttgtaccagcttgtcaaaaccttcctcaattaaacgttctctggaaacccaggaattgtactttggtaaccaaaacttccatttaatttcgtattggaaagacttcttcagcttttgtctaccaacaatggcttcaatctgcctcattcctcttccatcgtcaatatcaatttccttctccattatttgtttctcgtcatcggaaatcttacgtgattctttcaacaggacttctctatcatcaccaaacttgtatctccattgcaagtactggttggcagtcttttctttgtgctgttcgacgtgctgtaatgcgtgctgcgcaatgtaaccaatacgtaaatttggatgtttctcaaccttaccttcttttggaatcaactctccagtcaaaagcttgatcaaagtcgacttaccagcaccgttaggtccaagaacagcaactcttgaagataatgaaagagagcatgaaacattggagagggatggcttctcggcaccagggtaggtgaacgtcacattggtcatcttagcaacggatctagtattggatttaacaccagttaaaattccggggggagggaaagccattttgacgttagaatcagttaatgtatagtaagctttaccctcaggttttgctttgacaaaatctgacaaatttcctttgtagtaagcaagttttttattctcgtaatgaataatgtctgtgcaaacagcatccaagaaaccggaatcatgggacacaatcagtgaggtaatatcagtgtgttccaatagataatcttgcaaccatttaacgttagcaacgtccaaatgattagtaggttcatctaatagcaaaatgtcagctttcattaacatagctctggcaagttcaagtttcatcttccaacctccagataatgatcccacatgttgagagcgtctctcttcattaaatccaacctcgtttaaagctttggaaatatcctctctggaaactgaggccaattctggatcggaagcgataaaagcaacgagatccatgtcggcttctgagccttgcaacttatgttcaacaaagcatgttttcaatacagatgggtctggaaaaccttctaattgaccattggcaatagatctcatcagagtagatttaccagcaccgttacgaccacatagaccgtatctgtgacccttcagtaacctcaaggtcgtcttgttaagcagcattctactaccataagccaaagagaaatcggtattgacaatttcaataccatcatcgttttggctgacaacagcatcaggggtaaacagctgtctcagtttcaggacaatagtttcaacaatttggtctctggtttctttatcttccacatatgggatacatgccatcagtaaatattctttcaatgctttccaatcgttgacgttagagtctgctgccacaaccgtggtcatgtagttgaagataatgtcgtcattgattaaactcttcaactcgctaagatactccgcagtcctttccaatgaaattctaccgtggaactttccatcagattgctcggcttcagcatcttgcaaaacagctaaagcctttgcagccagttctctcacttctggcaacgaagcggtagcaatgacctttttaatgcctggtaataaagttggaatatatgactcaatttcacgcttattattgaccaatcttgtcaaattttctgtaacgataacggactgtctcaattgttcctgagaggatgacgatagtttcaaggacatatccaaaacgggaaccaaaagggccaaagcaggctcagtgacttcagcaacaaatgtgacagatgacaaagacttgatacatgctggaacctttcttgggtcggccagagtgtcaacaatcatgtcgaatctagtaactagatccaagttgtctagaactttaacaaactcattcaaggttttcagaccaactttagcaagttcgggtttgaagtctgtagcgacatcagtaagaactggcaccacatcgacgaaagtcatttccagcaaatcatttggagaatctctgatcaaattgtcaaatgttttaagacatgcaactttggaagtccacttggcagacgacttgagatacctcaagagctctggcaagacaacagagggcaaggcctcggtagggtacattccgtaaatggagtcaatggcagattgtgcagctctaacaacgcttctctctttatcactaaggcattcaaaggcaaattgcaaaagaggggcaaaataagcctcaaatgggacttgtccggcataatgtcgacttaatgaagaaagcaatagcatcgaaccttctctgaccaatggagggttcttgggtctcgacaaacttttcaacacatcggcaatgttccaatcgatgatggccgagatgccctcgttttgtattaaatcgacaattccgtcgatagcggaacggatctctgatatctgtgaggagcttttgagagcttccaaattgtcagaaattggagtgacttggagtttactcaaagcactattcaacgatgacaaagaggctacagaagctgcacgacttatgggagtactcataccgcttgtagcttctgagctcaacgccggagttgtcaaagcggactgaacgttacttccgttgttcgtaggcttaggacttgccaccctgttcaaggatcctttttgttttagaaattcttcataagatacaggcttcttctggacaggaaaaggtgatctatttggaccagtgaagtcttgctgatattgacctggaataaatgtacctgcattcgggttaaactttggaggaaccatacacttaaatttgtttaggttttgttttccagtggtttattagaactttaagggcagaagaaaaaatcttaaaaaaataaaatacagatgagaagaaaccaaaaaaagaaagaaatatactgcttatttcctattttaggtatacctgaaatatttcaaaggttctacgtgccccggttgggaggtttgcaagcgggcaggtatatattggaggagttactagactcggaatggtaaatccgaaacaggccaactaacagttaaactgtttctctgctttggacaacccacgggggtcatcgcttctcacgtccaaaaagaaaaatgttagtagatccagcacatgaccttacacgtgaccagtaattgtttatatcacagaaaccataaacaatcaagaagtaaacaaagatcaagcctcctacagttagtatccacgcaactatctccttgtgttatgacccaagaaatttccgatccagatccaagggtcaatgaatcggaaattatccaccccaagataagccggcaggatatttcgcaggtttctcagcctcaacaacaaagtcctcttcaacccaaagatctcaataaagtcaagccaggagaaagtagcaagtggcttccaacacttctaaggggagacgagtttaagtggacggataaagctattgaaaatgagtataatagttttgcctcattaaacgataagcatgttggcgatcaggaggaaaccagtatgatctatcacgattcagaagtgaatagttccaacgtcgaagctgattggaaaaagtacgctgataatcaatttcagaaaccgataaaacatactacaagactaaaatcaatgtttgatgtgtccccaatacctcatgaccactctaagctggggatcaataacgaatcatataacacatccagtagatttgacagtcgttttgataccaagcaacaaagtataaagtctttacccagatctccccttaaggtgtttggaaatcgccataatacatacaccagggtaaaaatggatggtctactgaatgacctagtttctgatgggactgttccgaagaatggtcatttaagcgattatacagatagtacgaacggtgatagcgtagagtttactccgtcccctaccaaaagaaagcacgtgtttggagaaactaacgacaccgattttcaggctactatgggctcagaaaactttgaagaaaatgcagagcgagtttatggcgggttagttgacaaaaatgtactgaacttcaaggactttgaaacatcgaatgactacacttctgattcttccgcctcaatcattgatcgtgatttgccaagctcagtgagaatacatgacgtggcaagaactgctgctcctgaatcccaagatgatcaacttggtagttcagggagtacagagggtacagagcaagaagaaagtgaagataatggcgaagaagaggaagaagaagacgaagaagaggaagctgatgcgacgctagacaacaattcttctatcgatactagtatatcagctcctaggataaaggctccaaattccatagcagaatcaaggggagaatggagaaaacaatctgatactcttgtggacagaattgatataaacgcattacacaaaagacccacaaagatacctggaatggtaaatataccaccagaggaactagaaaaacttgtttacaataaaaaacttggtggatatatcccaacaacaaccgatatctcaggaaatagtaacgactcatctcaagatcaacaagagttcaaagcgctggacgatatttccgacctcctaattgactcacgtcacaatactaaccaagcagccactaacaagatatccgtatcatttgccctccctccagaagaagaacaagaaagtaagacaaagcagtcgtccttgaaaggagtatcatccgcaaatttggatcaggatgatttgaatgatgttacaaatatatcagacgtgagagatctatcattttcccaatccaaggagactgttgttgctcttctcacagaaatttatccagatggcgattggacccagatgataactctagacatttcaaacaaagaccttcaacgacttgtacatctagatgactatactccggaattgctagatttgaatgtttcattcaacaagttaaactatctagcagacattcccaggcatatacgaacaatcattgcaagtcacaacctcctgaatgatatggctgtatttgatcaatgcagaaatcttcaatcgctggatatttcacacaacaacatctccaccttgcggcagatacggctacccaatataaagacactaataatcaacaacaacatgattactagcttgaatggtttagaagatctgaacacactaaccactcttgatctttcacataaccttatcaagggaatagtggactttaggaacatggattttgtgcttttagaggacctgaacttgtcagacaacgatataaaagctgtccaaggtctttcgtcgttgaagtgtttgagagttttcagtatcggtaataataatttaacgaaacttgaagtcaatgaaaggatgtcatgtttgaaaaaactagatcttaaaaataatgttgaactgctgtctgcaaatcttgaaaagtttccacgattgagatctttatgcttggatggaaataccaagttgtcagttactttttccaagaaacttgaaaagttgagtgccaagctatgctccaacgaaatgctgtttaataatgaggttgaaatgatatatttgagatggctggacttatctggaatcacgaatctggattttgacaggctgaaagagcccttcatcaatgtaaactatttaaacctctctgcagcatcaatgaaacaaattcctcagaagttcattcaaatgttccccaatgtcaatactttgaactttaatttcaacatgatatcagacatatcatcattaggcaaattgaagtatcttcgaaagttgtttttgataaataacaggatatcatcgctgaatgatatatacgagttgtcatttaaactgagaaaccaaatcaaatatttggatcttcgaatgaatccagctacaaaagagttttacccacatgtgttcctctcagaacaagaagacgagttaccaatcgaagaggaaaatatagaagatcttctaccgcaaacattagacggcatagatgccgtcaacactcagtacaagagtttcttgagtctaggaggagacgaagattggaattatagagattatcaatataccaaaaaactcgacaaaagctgggaacagaagaaggcagagtatcaaacagtaatactaggtgtctgcacgaagctgaagttttttgatggaaaaattgtaaccaaggatgacattaatgaagccatgcaaatgttgaaaaagttagatatataacagattatagacgaaatgtaattttgcattctattgtaattgttctggcccgaaactcaacggtaacaagtcgtctagtgtcattttcacaaactttgatccgtctttattgaacataaagatgggcaaagtaagtttctcatctgcaaactctctgatcacttgtctacaaattccacacggtgatgcaattgattccagttctgtggatactgctagggctttgaaggatctatggcccaacattacggcatgagttatcgtggttctttcagcgcaaatgcaagcaccatagctggcgttctcaacgtttgctccctttataaaagtattatcgggcagcagaatgctacatccgactttgaagtttgaataaggtgagtatgataagtttctggctggaatagtggttagtaagaatcgtgtttcactgtttcagcctaagatcgtaccttccagggccttggttttaagtgtctcaaattccacatcagtaagacccctgtggtcttgggagaatggtggctgcaggttattcaagtccaattgaggcatcagggtggagataggatagtgagatgccgtctacgtaaataatgcacgcgaaccatctagttatcgtgttcatgtttgtcattatataagcaatacagactaagcaacctgcttcttctttgaccttgccttcttcctcagctctctcatgtcgggaggcttctctatcccgagttcggatctcaatacatcgatatctttcttcattatcttctcccaataaacgttgatcagaggcttgcatattgttccgttctttactgcccatggatagtatacactcagtaacctgcgtctttgagaacttttaataggaattggagcaaaaagggcacccagaccagtcattggtatccccagattcataaattcgaacagcttcaaagcaatttccccctctcttacaattggcaatccggtaattgtgtgataaaagtcatgacactctctgtatctttggaagacaaaggcaagttcaggatcggttatatacttcacaggaactcttgtgtctggagaaacgccttctctttctaaccagagaaaataggacttgcccagtgaattatcgggataatttttcagctcgtctaaattcaaactctttgatgtcatatgaggcctctctttcaatatttgcctgccgctaggatcgtttagcatttgcgttcttagtctattcaacacccaggggaacgcagttgactcaccgagagaaacgatgaagttattgttcgtgggattgacaaaagctccaattgaagaacctaaaaacatgagtagtttctcaaagttgtacaggggaacatgtcctggataattgggctctggtctttggaacaaaggtcttgatgtgttttgggatttttcgaattctgttttagggaagtgtaattcaccatcctccattttatcagccaacctgatatccttgctaagataggataggccagaagagatcagggacgggataatgaaactccgcttctgaaattgttggactatcaacatgatagggtgaattaaactctagtgagcaagaagaaggagttttgttccagtctactcagtccactttctgtgagatgatctaagtttttttcgagggccacaatgccaaaggtaagtggaactacaaggaggccgtttaatggtcattttgacatactattgaggaaaactaagacaacaagacatccaaatgccaatcgggggagctgtcaaagataatggctagtctgttgtgttatctctccttgacctgacatttactgaattttgactacagtcgcggtttgccagacatcttatcagaaaaatgaccctctcaatccattaccaatgatccgccctttctttgaagggccaggatttttggtcataaataaaccgcctggtatctatacgcagcctccttcattcagacagggaaatagagacaaatccaacgagctgcttccgttgcttgagaaacaacttcagaccacattgcgtcaggtacaacgattggactatgagaccaccgggggcttggtcgtttcaaccaataaatacacagcccgtatgtttcacagaaatatgcaagccttgagcaataatattcttgatggcagacacagatcctctaataaaggttatattttaacaaaaagatacatagcactactaaataagccagtgacttcaatttacgaacagcttccgaaaacttcagatgggtggaggttgttggagacccaagatattgacgaatcaaatagttctagtaaattgctgctttcaaaagttcgtacaatagagtcctgtcgtccaatgcatgataagttccccttgatgtttgaactgatcaccggtaggaaacatcaaataagaaggcagataaaacaggttttcggaacgactattgttaatgacgttaaatacggtgctcaactagagtttcctcagtaccataatcagattgctttgcacagctgctttctcagtttgaaagtaggacttaaaaagtttcagttcgacattcctttggagtatggaaaagaaatgtggaaatatgctgggttgtctaatggaccatggaatgagctttgatttcgttttctgtatattccataagttcagggaacagctttcccaatatcaagtctagtaagttcattaccagctctttattgacgtctttgttcagaaaagagttaaggaagttgtccacatcagtttccgttaccagaaaacggacgtgtttcaaggagtctaaacttagggttttcagtaccatagctctgcatttttgtctgtattcctcaatttctgtatccgtttgaggaatgaacttttgttctctaataaatactgtatctccgggaaaatacatgtttcgaatggttttgatcccatttgatatgaatgcgtcgttcaaaatcgatttggctaataaattagttgccaaattatgcagcagtttatttcctctatccgtcagaaacgtaaatgaaagttttactattcccacaaataatggaattttactctcaacctctagaagcttattcaagaacggaaatatggcatagttggtaagggagccttgataatctcgtttaacattgactgaagttgagtacgccgcaaaatgagacagagacctaattgcgtttgatatccactgagttgaaaaaaaactgttatatctgtttggttcttgttccttattgttctcctgcttttcaataatcactttacagcccaactcgattatatcccatatcatgtatgcttcactcaagttttccacacagttctttaacaaaattccattcaaaatatttccgaaaatgtcttttgctaccgtggagtcccattcatcatatggtaatagtagaggggtaatgcagtctgttattatctccaagtatcgagcttgagtccttggatccaccaatgcagggtgagttgacattactttgaaagtatcagcccaactatctcctgagcttttgtcaaacctcgaagtggtaaccttcttgctgtactttatcttttccagatgtaagttgagtatcgtgaatgtatcatctaacagcatttcataaacctcaaatgaattgatacgctgctgtaggtttctagtcacatgtgctgtgatcccaactagctcgtgtgtaagctcagactgatctcctggataccagttgaagatgaagtttttgaaaagcagtccaatcaatgcatacaactgcttatctacatcagttgacgtggtcaaagcaggtaattgatcttgtaaagagcccacttgtctgcctctgaacagagatttaatcaagctgtccaagtattccggagaattcttatccagctgtttggctttaggctttaccacccttatttttttgaccttcgtctccatattgagtttatgaaggacggttgatgtaagacagcttgtttcgcggatatctggctagtcttactaacgtcaactaaacccaatgggcagctatttgaatgggacaattgtttatagcctataatcgcagactttgttaacccgtaggaataatcctaccactagaattagatcttccaaccatacatagcgtgtactacaacttaagctggtcctcttcttttatcattcgcgcggctctatctcatctacacctccattgaactaatggaaagcaaatacgccgaaaaatatcaagatcgattgattcttggagatgatggcgatgaggacgaattgtttgacgagctggaaaaagatattgaggatcaattcttggccaaatacagagcagagagaatccaacagttaaaacaggagattaccaagatcaaggaccatagttcaaacatcaacctcaatgaccacggtaacatgaaaacaatagatactgatgacgaactattgaaagaaactgttgatagcgaacgtgttgtgatccatttctttaacccatcgtttagcacttgccgtatcatggatgagaagctgtctataatcagcaccaaacatattggaacgcgttttttcagaattgaagcacatagagctccatttttagttgcaaagcttggtatcaaagtgcttccatgtgttgtattgtactacaaaggattagaaagggatagaattgtcggatttgacagattaagtaattctcagaccaattttgagctagaagctttagaggagttactcttagatagtggaattgtggaacgaagaactgtcgattttagcaacctgagaaacaaggtccaaaacaaggtggatcagtcaaaatcagactcagaaagtgatctagatatgtgatagatggcggatggcaggttcattctagtgtttcacgtgacacacgtgagcgtttaagggcacacaccctgactgacgcgcgaacatctaatctgttccgcatgaaaaaaaaaaacctacctcgacgaaattctcttctagacagtttttacattggtaagaaagaagcattcacgtattgccgacgaagccaaaatgcaaattttcgtaaagacccttaccggtaagactatcaccttggaggtggagtcttccgacactattgacaacgtcaagtccaagattcaggacaaggagggaattcctcctgaccaacagcgtctgatctttgctggtaagcaattggaggatggtagaactttgtctgactacaacatccaaaaggagtctactttgcacttggtccttagattgagaggtggtggtaagaagaagaagaagaagaactacaccaccccaaagaagatcaagcacaagcacagaaaggtcaagttggctgtcttgaactactacaaggttgatgacgatggaaagatcgagagattgagaagagagtgcgacacctgtggtgctggtatcttcatggccaacatgagtgacagacagtactgtggtaagtgccacaccaccatcaagctttctaaataagttaatctttagaaaacactattagttatttaattgaagtggttctcctataatgcatattgtatggtaatatttctcggtcatgctagaatgacaatttgtctacatgctaaatgattcttggttgagagggtactctcatgctgttttctgtctcttcctgacgggaatgacaatgccggtgcccagaggctgtttgtagttgccgagtttattcagttgttgtctaagtctgtggttgtccgctaaagaggcttccaacaatctcttaagctccatgttctcctcatggatttcttggttttccatggttgtgagattgagctttgtaagcaatcgattaaatgtttcacataagttcagatagttggtctttaggaagtcaaaactcttgagaaacttgttgtcactgatcttatctttctccaaatagaacggagacagctcaggggatagagagtccggagttggtactaattggcaccctacatcgtcatgctggtgcaagggcatttgggatcccagttcttgaagagtttttgagatcaggtcatcaatgttgccgttgctgttatcctgttgtcttgcaaaggaagaattgatcagagactccaacagcatgtccctagaatcctgcggtaaaaggttgtagttctcgtcgtctacccggctttgaatctctgtcattatggcaggatctgaaaaaaaaactactactaaaaaaaaaaaaactaatctcatcctagacaaatttctttttgcggatgctcggtataccacgtattcaaagattagaccctttttatggattgagatgataaatatcctttttaattatagtacatagctaatacgtcctttcctccccgtagcataaaatctatctacatgcaataataataacctctgaaaaacacctgttacaaactcttgaaaacttttgaaaaatcatcctctaccgaaaatgccagaagagatggaaactagaccttgggtgagatggcccaacaccccaacggtcttcacgcttacatctgagatagcaacgacagttttgtcgctaacttcatggagaacgtctacggtcttatcactgacctcattgatgacatcgacggttttgtcactcacatcgtggattacgcccacagttttgccgctcacttcatcaatgaacttgttgcctatatcgagtttctcatccagaagtttcaggacgctttcgaacccaatctttcccttctttgcgttctggtcaaacctttccaccgaccagtcctcaatcttgtcacatatacgtttaaacgtggcataagcggtgatttcagccgattggtaaaatgttgtctggttatcgggatctgactccgaaggtttgtaaacgcatgtttcgtaaactttcagcaggttactcatggtaaggttgcaggaacgcatggtgagtgtgcgggcacttggatctaccgtggatacctctctcacataggatcggttctgccctcccacaaaacaacgcaaccattgtgggattggttgttcgcaggtgattagacgttctgtgatcagcattcctgtcgtgtgatcaacttctctgcgaagaacgtcaacggcaacaacatgtgtggaaacttcgttgggatacttgacccaattggcagctgtaaccgaagcccaaggatactggaagtcgtgctgtgaagagaatagtttcatgcttgtatggtagcactaataatgtcttgttttttttcttccttaatgtcaaaaaaatggggaagaaaaatagtaggagatatgcacaattatatggaggaacaaaaaatagtggaaaaagaaagaaacccgcgagattacatacatactccgggttgacttttcagtgagatcttacgaaggttcagtttaaagaacatgtatccggtatatctggtaaatagggaaatacctgaaatgggatttttctattccaacaactggtgtcataaatagctactataaactatcttttgttaaagtgaaaaacgaagaagaaatcaaactgcatttctgtagacttgacgggtgagcttccctattattttattataagagagaacgatgatataatattaaaagcgaaaaatgtgggtttttgctgtgtatcggtattagaagtggagttggaagaatacttaatgcacattgaaatgtataattcaactccagaagagtcagtgtatcctgagaacagaataggaatatacaatcaatcagaacaaaatagaattggattatgtctcttatcttaatgtagagagtgaaaaaggtgcatacatgaaagaattagatcaagatcatataaatgatggaacttttatacgtagaggatgataaaactcacctaaaatgtctgaataagacggtagattggaaacgaaaagttaaatggtgtcagcctttattgaaagaaatgttttgtgatgcatgtgggaattatgaagagaactactatcaagaatttgaaatagacgcataatacatatatgctcaaacctgaagaattacatgttggaaactcatttcagtctgaattggcttaggtgaatagaccaagacatgggtctttatgtttttgtattattgctaggaggtcttgatctttttaccctctgtctgttcgtctgtattgcaaagttctttataggtgatacattgtgtggattaaatttccagatgcgaaacacatccttcatgctcaattgatgctctttggtaagatgaaggtattctcttgtggtgattccctgccaaataatgaccatgtggaatgctagcagcaaaagtggataaagtatccctagacttccataaattcccagaagaagtgatattgggcgcttagtggctccgccatcttgagccatccttaaaaatccaagcacaatcaaccaggaacagcacaggatggaaaatgctaagaatcgtaaaaaaaacccataattgtgtacaccaacacagttattcaaccatacacaatgatggtcgtgaacggaaatacatgaatcgcaagttccgcaatgtgatgtccttggaggcctccaaatgtggcaagttgtacagtacttgatctcaatcggatatctcggttgagcattactttctgactcttcttctgaaggagagaacactccgtctttgcgagctccaggcagacggatcacattatagtactcgggcggtgaatttccactttcgtctctgctcaagtggatattacgaggtacagttccagggtcggtaaatgctgctagcagaaaatttcctaatgctaataaccatgtgtatgcaaataatataactatagcgggacttttttcccaataccagttgctatcaaaaatgtaaaacagaaccgcaggcgtaatgattattaggcccacacctatcatccgggccaagtttgtggggtctgctgcagtcttcaccttccccccacaacataggatataattgcccagcaatgaggcctcgctactttcaaaatcgtccttatcggtttggtctttccgccattgaggaaatgacacgacccattccatttatcggttcgaatgtggtccacagatagaagttgaagaagggcaagagatgagacagaaaaatatttcgcggttaccatcagaagattatttgagcactggatatacgaatcgacccagagatgttcccagtgagattcacgataaaccggcttttggcccagaatatgacgattcggcataggctcggaaatctgggactgccaactgcaaaaaatcctcctttgataaattataattcgttcaataaacgagtggggatcataaatagagcactttccactccctcccacatctcatccaacagaccccaactagcgctcagtaaccagaacattattagaaatgtttcattgcagcctaagattcagacgagaggggctgctgcctggaaagttataactaatattaaggaattgaacaaaatgctcaagaaaagaaaaggtggaacctttagaagaagactgttactcgtattttgcatctatatgattgctaactttcttttcaacgttatgttttttttcctcagtataggttatcttaagacgctgcaggacattccttccaatttctccatatgggttaagtttaatatcagagaaggcttgatcaaagaggaaatcaacaaaaatgaaagggctgccaacaaagagtatctgaaagcccttaagaatgttgcaaatgataacaaagttgactcttttgatgaagactccccttacttcactatattacccttctccaagctcgatcagtacgctgaaaagaaagattaccattatatttccggttacgtcgacttactttttcggtatgcgttaacgaagattgatgatgatgtagaaacaagttattatctgaaccaggcattactaatcgttgaaaggtactcaactcctcaaaatcagatcggtgattataatctaaaaaacaacgtttaccgcacattggcccaaattctacagaattctgacgactttaatgcttccagtaaggaattttatacccaagtggagggacttttgaaaagctctcttgagttaattggaacgaatgagggaattcgatttcaggataatgaaattggaatcttacctgaccagtttacaatcgaaagtgagaatttattatcttcattgttagatctttcatggttttataccgacacaaaaacagacatcaacaaatccctgtcgattcttctgtccattttgaggtctctgaagtacgagtcctctcaactcaggattaaacaagaaagggaaggatctctcagcaacgacaagaggctgaaaagattaagatttgagctgatccccttgattaaatccaacataggtgaaatactatggttcaagggatcaagagaagaagctgtttcttggtgtagagaagcagcttatgaatcaatgcttgtatccaaagacaactatgatgctgcaaaaatatcgaagaactctttcaagattttggcaagaatgtacagtaaaatgggcgacgaagagagcaaaaagctttgtcttgacaagctaagagaaatagagattccaatcgtgggattggctgacggtagacgacaaactttgagagatgtcgtcttacgatactatttcggaacttttggtaagattctatttccgtagcgggtatattagatttgtatatagagaaacgacaatgttcacacttcctgaagggtattggagccaaaccaattaacatcatcatcactcttatagaagctcgaattagacgaagctattgtagcattcaaataatcgcttagactaggcataggaggtttcacctgactatcatttgctgtcctagaactggagcccggcagcgcattgagatgggagttggaaagaatagtatatacacccttaccatatcccttctccttctcgtgaaattcgtcaacaaattcgtcttgactatctgggggcgggttaccaaaatgtaacacaagatcatcatcatcaccgtcggattcgtaatcactagcttggctttcatcagtgttgccaagagatgaaatatcctcttttggcaactttgagctataaagattcgtaatagagctcgttattggtaaagtcactgttctactacgatctctatggttatgggtgtgatccaagtcccctgtgttattctgacgtctttcaatctctaccagaggagaaaatagccttgactcgagtttcacttttggagcagttggaggtattgggtcatgggaagaaggttcgggagaattctctgaaaatgccaccggtttcgaagattctttggaggcaacaaaatatgagacacaactagaatcatcagaattttcggattctgattcctcagattctgatgagtcatcatcgtcaccaagaaaagattttagtttatcaatatccaagctacctccccttcgacgattattagtctccctagaagtcctgctttccagttgtggagatgtgaaatttgattgaacatattcattgtagtccagcttgagtcttcttgtgtctatttctgtgtctaacaaaatattgaggtcgttgggatgagcaatggacagaattgaagctagcgtttcatcgtagtccttgagcatatagttgtatagatctagttttttgaagaatattggtacgcaaagggggatctcgttgaatatgggcctatctatcagtgtctgtaagagggtaaaaatcacggcaccgtgagagatcaccacgatggtggtattttcagggacctcatgttgagtgtaatgtttgttcagacttctcaaatagtggaaacatcttgtcttgaactctttcaacgattcaccatattcaccacacgttccaagtttgttatgaagccagctggggtctttagtatcccttagaagggtccctttcaacgggttgccgtatatgtagttattgagattgcttatcaaggagactccattgtcatttgggggcaagtaattcaatttgaagtttacgttcagccactcactcagtccctggtctaccctcaacttgcacttagtcccttccaatttgtccatcagtagctccgcagtttgaatacacctgttgtaaggagagctatgtattatcaggtttggggagtgtacgtattcattgatgctcttgctggctatcgatatctcctcagttgccatatccaaacacacaggagcatcgaaagaacttatccactcagacgtatcgatcttctcagaaggaatcttgagcgccgattccgtcttatctatcctagtacagtggcgtaaaaggatgagatgcattcttgcgtcagagctgaaggatcggattgattatcaacttaggaacaagaatagtctctttctgttagtgccttttctagtgtagcgagggagcttagttttttatacgaaggcatgtgaaagtgcgtgttcgaggagtacgtaataatgcgttgtctgagttgagacggctgatgcattatctgatttgggggcgtgctgagtggtatggctagcgtctgttgtcaggttctctctctctcgcccacacttaaaaaagaaaaaagtaggggatgaatcaacgataagactggtgggtagtattaatacattatgatcactatgtactcaggtaagtaagtgtggagtgcttctctatttaatctccaagctcttcaagttcttcttcgtcaaactcttttggctcttttggttcctgcgattctgcccattgggtcacatcatcagcgtggctcaagatagtcttaatggagtccgttttatcccgatcactgcagtccaaaggaagaaattggaccatcccgaaatcgtccaccaatcgtgcaatggctttgttcagacgttggaacttgggattagtactgataaagtccgccttgtttccaccagtagggttctcagataatagtagcgggtcggggttcaagaacctcttgagctccctctttgacacttgatctttgattaagtcacatttggacaaaatgttgatgtgtggtaattccaataggatcatagctgacatggcactcagtgtcccactgaagaacttggatcgatcagtgacaaacgaagcttcgagtaagtaagtggcacaaagtgaaaagttcagctggagttgcaagtgctttataatggttggaaggacgggaatatggttataaagttcaatctgtcctgggcaatcaaatatcagatattcatcttcgtactgtcccacctcttcatccagccagtccagattattcagaaggaactcaaaacaatacacaagcgctccattaggtcccaaattaagctcctcttgaacatcttgcagggaaatcaagtctcttatatcaactgtgaattcaaactctgtgggttcagctgcaggatccaggttcactatatgagcccttctccctattgattgcatgtaggctatcatagaattgcaaaacgttgacttgccgactcctgcggggcctaacgctagtattcccacccttgacataattcttccaagtgataaaggtttgtaatcaaaacttatttttcttttaaaccaatttttttttctcggtctgttacgtaatcaataatgtatgggactttattatgctatgaaaggggagttttatgactatgaggacaggtctaatataccttcttttcagctttacaatgagcatcttggatttcgataggctcataatttccttccatgtttgcccatactcggacttcatgatccatgatgttttctattacttctttattggcatgttttcccttgagatccgttctgacgtactttaaggtaaagggtggagatccagttaacttgaaaatcaactccactttatccccttcatgtataccttccaaataggagtctccggtggtcatttccacggagggaatatcataaatgacagcctccaggtctgctctgtcttgaagctggactaaacagtccttggatgaggagtctgaaatactggcaattgtaagttttccaggtcgataagcacgtcgcttgaaagtcttcttgtttacttcagctacttgggaaatgccatcaaattcgtaggatattttgaagggaggaacccctgacaacgaataagcaacctggtctcctacacagtattctagttcatcttctcttagggacttggaatcttttgaaatagttgaaatctgctcaatctttggaatatcattaacatgaatggcaaccatttcgtgttcagtgaaatcgctctgtttgcaacgtccggaatcagtcacttccacgatagacactacatggtttccaatgtccaaattagaatagatatcgtaatactcgacttcatgtggtaagtcggataggtaaacaaattcctcagtgttggatttctcgtgaaaaagtttcagtttaagctggaatggcgcctgtccagataaggatattgatagtggtctcaatagagatcttttattaaggttggacaaacatgtttgataaatgctggaccttctgaatgaggaaaattttttgtcagcttgtaaatgaggattgtgatgttcaggagcatctctatctgtaatgaagtgggcgtcaggcaaaggatagacatgatgatcaattaagactggttcaaacttgtaagcactctgcttttctagttcctttatagcagatttgaaatagacagaatcataaatgcctagtatggtataaacgtaatcacccccaatatctgatcgcaaactgatggaaaacttttttctggatgtggtgtctagcttgctctccaagaatcctccagggtgcttgatagcgtactcgatgaaaaagggggcttcaccttcaagtaataaatctaaatagccctttttcccttgacaaaacggtttcagtttccaggaattcgtattgtcacctactattgtatcctccgaaggtagcagtttcaacgatggtttcttcttgtatgaaatttcaacttcgctgtcgctagatataattccgggacatacagactcattgaatcccactaagcggtatatgccttgactctttacagacaatcctttgtttgggttcaagctagaaatacgtgtgtgtttcaccaatgaagggttattaggatcagtgattgtataatgaagggaaattgacttttcagtatcactcttcaacggaatgttcaagctctgaccttcaaccagctcaaactttcctgcatttccaaactgcaaatgtggtttgtgctttcgaacatttacctgggcgtgagatttctggaaaacaacattacaatttgactcatctttgacatcaagcagtttaatattatacgttcctccctgcaaaagatctttcatttcaatcctgtattcattgtccataatggagtcaaccgtaaagttctgcgattgattaagggggtcagatatctcatagttgactttgtatgggggttttccatcaaatttgatgaggacagaggcagagtcaccattacagacatcttgcagttttctatcttggacgaatccagctcgagtcctttgtttcaagtaggttgtatatcgatgcttccctttttcaaggcgaggaagtttcttgtaatacttgtcacgtatgccaataaattctatggcataagtaccctcagtatttggctcgtagttgaaaacttcattatttgactttgctatgatggttgaaacatcttttgtggttagcactctgttaggattttgcgaatccaatcgatagactttataatcaacttcaaatggaggggtaccaaggaactgaagatcaaacttataacctgttgttccgatacaggcatcaagtatcggattacttgaaatgttaagggagggggcaaatgcttcggtgacagtgagtatcgaaggtccaacctctccttgacaaaatttagatctgatcgacttgagggtgtacgtacctgggctcttaacttggaaaggaagtttattcctagtcacctgagatgcttcgaaaacctttgttattatgtccttagtcttcttgtcttcactggtgaactctatttcaactgtatagggggcctcctttttagcgttggagacatccaaggagaccaacagttctttcgggctaccttggaggataaccagttttttatctttctcttccagatctccttttattattggatgagcttcaaattgataaaacagattattgttcgccacttctgggacataattgatgcgattaccaaacccatcgatgacctgatgaagggtataaatatatgaaccggcttcatcaattttccctcttgacagaggcgctgtgaagctcttggtcctggcccattctaaagattttcttttatcaatagaggtagatattttgagagcttgttctttcaactccaatccttggagcttagtcaaaggagactcgacatcctcatcaatgatatcaactgagttagtgtttaatagcttgttgccaatttctgcatgataaacaacttttaagggtggcacaccgaagatcttggcacttacctcttgattttctcccacacagtagtgttcatctggtttagtattgtataattgagcagaagggcaacttacaatgaatacttcatttttggctatgcgaacccttttcaatttggaatcatagacttgatgcaaactgtacaatccaggctgcgtcaacggcacctcaataaatgagatcacgttggaatcgtcccggtaggaatgatacaaattcccattgaaagcatattcctttttgaatagttcagtagaatccctgttaagcattctgcgcaggtctttcttggtgtaatttagatatgaaacttcgtttgaaaaacttcggtattccagttgcacaaattcaagattactggtagaattaaatcttattggcatctgaatcttgtctgtatagatattcgtcatacaatgagattcataaaagggattgagtttagctgaagagtctggtaaatacttgatcgtagttctaccctttaaatggggagattggtcttcaaactctgcagttgggatgtaatcttcaagcagggcaagttctttcttggggaagaagagattccagaatgacattagtataccagccaatggcattgacatatcagagcttaatagaattgttattgcggccatcaacgttatctgtatcaacgttgtcaaaatggagaagtttagcagtggtatcttcaaaaccggaagacaccataaaaatagcccatcaagaactaagtacttcacgacaaaattcagttctggaatggagaagcttatccaggaatctttggacagcaattccctcaaactctcatttttcaagatcataatatcgtacactttccacgcttggattaatccaaacaatgagatcatgaacaatcgctgagaacccacatcaagtatatactccgggacaagtgctctctgtacagatctatgccttctcctttgagaaccaaagtccatgatctagggatattttgatatttgcctgagggagggatctctgctctagaagtggtatttatgtactagttatttattttgcatagaaattctcgatctcatcagtaaatctttgtagtgtgtatcacccaatctaaagatacgccatctaccatccatcatcccatcttcctatcgtccctgtcaccaagcaggcgcgcgcaactgtgtcagtcaaacttttcgaaattaccccggagtattgtttccctcttgaatactatatactcgccttgttggttctccgacttttcgttccaggattaacaaagacgtgctcatgagcttcgtgaaatcagttaccagagtgggttccaaataccttcagtttgtggggccgggactgctgatttctatttcctacctggatgtgggaaactactctgttgcagtgtctgcaggtggtgcttatggatacaagctcttatactccatcgttctatctaatgtttttgctgtgattttacaatgtttgtgtatcaaagttggttcagttactggactgaacctcgcggagttgtgcaggaagcatctcccccatcggttaaacattgtaatctatatcttagcagaatttgctatcattgcgactgacttggcagaagttgtcggagcagctatagctctaaacatattgtttaacatacctttagcatacggtattgtcatcaccgttttggatgtcgtcatcgtactgtttgcctacaaggacagtggtagtggggagaaagtttccctagctaaagttcggttttttgaaatgtttttgtccatattcgtgtttttgacttgtgtctgtgtctcagtgttattgtttaagattgagattcccgacaagcgttctttgtttgaaggctttttccctgtctctaaagacatattagaaaaaagggccgtatacttgggactgggagtcttgggggctacagtaatgccacactccctatatctagggtcagccttggtgcaaaataggctaaaagactacgatgttaagaatggatttgtggaccctaaggtggccattgatgacacccaagatgtgtctaacaagtacaagccctccatccatgccctaaattattgtttaaagtattcatattgggagttaatcctttctctatttaccattgcagtttttgtgaatgcagccttgatggtcgttgctggtgcaactttgtttggacaaccagacactgaagatgctgaccttattaccatttatgagttgctctcaaagtatgtctcttctgctgcaggctttatttttgccctgtcccttttattttcaggtcaatcatcaggtattgtttgcacaatgtctggtcaaattgttagtgaaggattcatcaaatggtctgttactccatgggtcagaaggctgataactagattattggctgtcatgccatgcatgttcatggtgttgtttatggagagaaaaggtatgtctgagatactgaatgcttcacaggtagcattatcgttgatattaccatttgtttccgctccgttactgtattttacttgcagttcaaagttcatgaaagttgaaatcaagaaaagtactatcgccgctcccagtgagaatacaactttattgcctactaccgagcaaactgaatacaaagactacacaaatggcccatttctcaagtacagcgctatcttgacgtgggccctgataacaatttttaacttcgtcttagtattttcatttatgattggtgaggatgtcagtttttgaacagcatatttacatagagttacgtagtttcttttcaacataatatcacgtatcaccctcaactttcacttggttattagaactgaaaattgctggatctaaaaagtaagcaccattgacggccttctttttcacattaggtatctttcccgtggggggaactctcggtctagtatttctctgcttcaagggcaagtcttcgtcctcaataagtagaatatcgtcgtcattctccggcattttctgtaattcattcaattttttcaattgtttgtagtgtatagtttttgatttctctgcaatattgtataaaaatggttggatcagtttaatatgttgaggaatttctctcttatatagttgctctttctcttcggcttgaatatcatcgaacttcaattgacttacttcgtgattggagttgaagatagagctgttcaaccttgaatgcaataagtgtaaaggaactgttgatgtcaacaaaccaaactctttctccaagccaagttctctgaacccgaagaaatcatccccaatttcactggaaaagtttcctgtaagaaattcatcactattgtcgttaaactgtctttcattcaaatcttgcaaccctgggcgtagtaattcagccaagaaacttgacaaacgcgacttcaaaccctcaagcttactgatttgtttaacaatattctcgttgtaatactcataaagagcatccgggctttcaactccgttctctaaaagtgaaagcaaaagtatgtccttatttgaaactttttgaaatttggcgtctcccattactttattaattgacttggactcaatgtggttcttcaaagttttgactagattaccaaaataattttcagcaatttgtgtgataacatcagaacagaatggggcagtggattcaaatccattggccattaatattttggaaatagatcttttcaaagaattgtacgagacatctgaatccaatttgtcacgattaggtaagttggaaagttggtcgatatcaatatcctgaatttcattgatatcgggaggtttcatttgtgtatgatgtagaaactgttgagtttgcatctgacgaatcaatgatatcttaaaacatattcgtcgtatctgttgcatcaaatggattatctcattgaactttttattcataccagtaggctttcttgcaaacccagattctctaattgagctttctcctttcattagttgatccaccaacatattgtcttcaaggtctccctcatctggtgatacaccagaatattttaatccgggaataccacctgaaatgtcgtattcaataaggtatggatcctcgtttccatcgtaatactgataacgactcatgggagtgttcagcacaatacgtacatcatctcccaaataatgcataaagttttccatttgataagtatcacggaaaatggcctcctcattgggttgaattttattttctttgaacagatttcgtcgtttctcacaaattttataccttacattggatgttaaactattccatgtttgaacttctaaatcatcttcatcttcagtagagtcttcttctaaatttgtgttatcatcatcatcttcttcttcgtcttcaactgcctcttgataatcgtcatccttctcagttttatcattcttttgctcttgtgtcgggacatcggataagtctttttctttctccttggtggaatcattctcggttacctccaaagccttggcaggcgagtcttgctccgccttggaaacctgagaagaatcttcacccgcaattccatcaggcgtttcaggccttgtgggtggttccctatgagttcttcctttcttaggacctttaccacctgctactctcgtagtcataggtgtaccaatggaacttgactgtggagtctcaacaacattttctacttcatctttttctagttcacttcgatctctgataacaatatctggtattaacggaataagggacagagttttcttttgcatcgcaacagcatgaaccctgataaaatgactgggatcagagttgtaagttaaacagttcttccagattagcatcaagtcatcaacaaattcctgcttgcttttgtattggaagcttttcaactttttcataactgtattgaggtccatgggcttttttattatctggtagtagtttggtgcttctcttttggaaaccctattaagaaacgctgtcgagtgttctgtgtaccctctgagctctaaaacaactttttcgcaggcttcataaagttcctcttggccaatcttatcgtcgctagcccatttagatctattcttgcgcacatccataatcagacttcgaagatctaaatcagataaatttagcttttctctattttcttcaactttggaaagtagatttttcagagataagttggcagctccgcccaactgcatcaatttattcacagacgaaggttgtgaagtcttttccaagttatttgagttagactcctcatcagaggtagaatttgaggatggtctatcttttggatcgttattatcctgatctaagaactgtttattgctgatctctagtttccttcgtttcaaaaaatttctttcatccttgtcaaattgatggtagatcttactgaaattcttgatcagtctagcctcatttcttttttccaacttggactctatggctgatgctgttcctagcagtgggtgtgaagtgccaatcacttcggaacctttcaactgctcaactgggtattcaggtttggatgttaccatagaggtgagcaaattgagcgttaaagacttggagagagatttttcatcgctgcataatctgataaaaacattgtttgttggctggcgttcatttgttaagggttcattatcttcagtcttgaaagggttcttacttgatgcctcctttatttcttcatcctcttcatcttcatcttcgtcgtcatcatagtcattatcaatctctctaacattctgaggtgtcgcaggtttagcagtttcctccttctcttcgttcatatcatcaacattttgaagcaagctgtactcctctgcgtcaccgttcatcgaactgttggtatacaaataatctatagcctgttcaaacaatagatatcgcagttttgcacacataaattgagaagtggacacgccatctttcaagtacagctcggagaattgatcatccaaggtttcctctcgtcctacattatcagactctgtaatgtcatggtcagcagaaggggggtctgagctgtgtccattctccttcgatacttctataccagttttatcatctgttcctttcacattgtccactgtatgttttgtactttctttctcatagtctcctttactgaattgcagtactaacctgcctttgataaactcatcccacactgtggaaacgaatccatcttcttcaattcgaagtttaccattatccaaaattacagacaacaactgaaattgctgtggagtaaagtaacagttgaagaaacccaaactgaatagcttcgcagccaggtcatataatcgttgattatcactggtgacaaaatactgtaaggctctttcatttgccatcttttcctcgatgcaatttgaaacacgtattcactaatagagcaatcaaatacgtttgactggttcagctataaacgcgtttcaaagatgggaaaaagcagatggattcgattgaactttccttaccaacttggtagacagtgtttcctttatggagggttttcggtgtgctcgaaattctactagctccagataatggagaactgaaaatgaggagaagtgtactaacaaataagaataaacatttatttcaaatagggagattacgtatcaccaagcttggagatttcagttgatgtatccattcagcttcagatccaagtttgatagtttagaagaaagattcaccttatcaatgtaactcaattgtgagaacagtttattatgcactttaaggctggagttaattgaaattattagtgccacaacgttttcttccaaaacttgtctatgatcaggtttcagttgagtcaggatatccttattgtcaattattgtacagagtaattggatcatacatccaagccaaacaagtgaccggcatccatactcgtcgtttataggtggcttcatcaatggcagtaaccttaaacccagggagatggtttccttcttggaaacatagtataaaatcaccatcgaggtcaacttctggtaatcttccgatgaaatcagatcgacctgtttacttctctgtgaattatcgaacagcttagcaattccttcgtcttcgataattcggctctcatccagaaggataggtcttgctggtttgcagataaccttgacctgggctcctttggtgtcagtttcagtgtcacttgcggactccacactattttcatcttcactaaacctatcatcttcttcatcctcatcagtgctttccaatactgatccatgtggatatgaaaaaatactactctctgaaattgaagacctagcagaatcagctcccgacaagtcattgaacttaatcgactctagcttctgcagacttcgttctttgatagtgtccacaaaaaattgtaaatgctttccatttgatggatccaacaaactacagaacaccctattatttaagatcagataagaaaatatttcaggggtagtggcaatcaactgtgaaatcttatgtctcttattctcaatttcttcctgcgaaatcttcttgttgtccaaaaacgtgttcaaatactccaagaaaacagtttccaaaacaaaactgcttctgatacagatgcaaattgtatagaaattcaaatcttccactttttgattaagcacattatttttcaaattttgataatcctgttgctcatctgtgacttgactaggcattaagtttagccatttcgccaacaatgacaagcaagtaggcccagtgaaaatttcatctgaggagctaaaagattgaaagaattttgtggtcggagtatcaaacttagttgatcgcatttcctttgtgcttgccaagaagctacgatcgtatgcagttagtttggaataatcaaaaaagtagggaaacctgcttgcaagactgaacttgatcagcttgtaaataattgagcggtagaactgaaaaatcaacacattttccgattgtgttatggtcaggaactggtcgtctaaaatattcatcctcaaaaggatttttccgagttcaaaaaatacccttcggtgagatacgatctctccatctggcctagagatttctcttatcacaaatgcatcaactgtgttatttatctcttcaattagctttattttatctgtggcagttaaacttccttttttaagccatcctgtgaaagcgtcacgcactaaagcaggagcatctgtgattagtcgagtaacagagtgaatgaacggaaaattagaagtcccatgttgtgttttagatggtttgttgtgaacaaaaatggggtataacaaatagaagagggcgtaacaaacaaagaagatcttgagtgtgtgaattagttttgcattctgcaatattgggaatacatgagcaaacggcaaggttgagagacctttcaagtcggaatcctgtccggcatataattgggttccaaccatccctgttaatccacctaaggcaatcttctggcccagtggtatagagttagagggaggataactggagaattcggggtagccaaacgtattgcccataggtatagactggccatgcggttgctgttgtaatgattgttgttgttggtgcgattgctgctgctggctatcagtctgtagttgttggtgctgttgtggctgtggtgttgatagaaatcttcggttgagctgccccggtgcttgctgcatataacctttcaaaattgttacttcatccataagccttctatttttgccctccaaatgcttgatatactcggtggcctttgtcaatatgcttgctttattgagtttggaagctggagtcaacccttccaagtcatcaatagtcaaagaattatcagcgtaagcagctattcttaatgacggtactgcatctctcaacgctataattttactattgatatttgtacggtatttcttttcaatcatattatgggttgaacgttccttcttaactttcttctcagccttaggctttacggatcgatttttggcactactgtgaccactatcggccgtggtcgtggttggagtcgtagagtaggaagacaaattaggatcaggggcgttggttgtcattgcagcatttgcaccttgctgttggttctcagctgatgtgtccaaagcctgaccgccattagaatcgaaagtgttgggtccttcggaagatacgttgccacttccgaaaaaatctggactggccacttcttgtttcacaggaagatacatttggctgtctatagcccgatttacatctccggatagcatcggtgaaggcgttgtgcctgtttcactgaacgactccccagatgatagatttgttaccgggttgagatcggcagcatacgggttcgaactcttttcgaaatatccttccgttttgcgtgtctccgcatcatcaatcgcatagtccatattcaagttgttggcattcacattgtcgttctcgttttgcagttcatacaactgagtctgatcttggttaagagcaaccaaaagagactccgtatcggggtaaccgtagttataatcctcgttcatcgtactggtgcgtaaacaaactgaactaacaagcttgcgtttatgtcgtcactgatctaaagtaaagcaaaacaggatgcaagttacactagttgcaaagtcgtaatttatttaactagggaaacagacgaattgtttccggagactacctacacaatttcgtgtcgtaaacaaagatgagcggcaacatttccaaaaagaaacgacaatctaagagacgagatgagtaatttcctggggatagggggtttccagtaggaatagggggttaattaattcctcgtgggctgttgattaagtgtgactgatcagccacgagagtgtcagctgttattcactgaagatagatgtcagttattgaactccaacaataacgagattattccaagctgttacatccgtataattttgtgcatggtcaattattattctcatgccggtaagtaaggctcaattgctaataaaacatgttggcagcaaacaggcatgaataacaccagcctgcattatcatgctattacccaaatgggctgccaatttcaattaaggttttagagtcgatcggcacattccaaggtcacgttttctctcagccgaacccctgcgtaagaaagctgttatcctattattcagaggtacaacgaacctgcagagacaatatctctatgaacactttctatagcttcttccattttggtctgtaatgcttcgttaccgatggtctttgcagctgtcaccatttggcgaatcatctcttccagtcgtttgaacatccggattagcgatccctcgtacacatccgtcatcttgcagatctgactgaatgccgcacccttacaccaagcataaactacctccatgaggcctgggttaaaggattccacatattctttctccaccaggtcgatctttgattcccgtgaaactttggcaatcttggatgccatgtcctgaagtgctttcaagggttcggccaactctggccttaaccggggaatctccttcgtccgttcttcaaacacgaaacaggacagaatgctggcacattggtacacatccagatcgttgaaagttccattgaaaattaactctgtcaatagtagctcatctccggtactaatttcacaagccactcttccctttaactcgatgatatcctgctgcgtagtgaactgtagtcgtcgcaggacacgttttctatgtttcaaatcgtccaattgaatgaccgcctgagtctccaataatttagccttgatttttttaatttcttcctgtttactcacttttgtagagtaaacattgtaaagctccgctaatttatctgttccagtgagagcattggaagctaatttcgtctctaacacctcaatcttccttatcaagactttgaaatcatcatctgatatacccatattctcaattggatccaacaacggaactccatcggggtaacgacgtttcaactcaacaattgtcttgttcagtgtcttcttggcctgggtgctgtgataatctttaggaatatacattcttatgttggagatgtcttgaatagagtccaaggtaattgggataatttctcccttagttgcttcatctcctctagcagggcggattccctcagggaaaactggattaaatggtttaatcaaattcactggggagtcaacaaacatggtgttaacgaatacattcacaatatacgattcgtgatcagagaatgtctttgcaggaccagttttggtagttcttttttggcattcgataacaacaccccaatcgtaattgaactctccaactttaaccttgatggctcttccaggttgtagaaattgcaacaggttagcaggatgcgtgatgatgaatttcatgtcctttctataagtctccaattgttgtctgatatcataatattctttgatagtcccctcatcttcgatttgaattgtagcttcttgactttcaagcaaagccagtttgttttccaaatgaggaatactggcagcattttggaactgataaaatgattgctgcagcataaactcaggagaaataccttccactctcattaggttcaaaatcatgttgtaaccaaggtggaaagcagaatccaaacgatcagcttgaccttttaccattcctttggcaacttgaggctccattttttcgtcaatcatcataatgacaattcctcggtcatccaatcctcgtcgaccagcacgaccagacatttgaatatactcacctcctgaaacccaacggaaacctttaccatcccattttctaacggaagtgaaaacaacagtcttggcgggcatgttcaaaccaatagagaaagtctctgtggcaaaaagcactttaaggaaaccttcttgaaatagaatctcaatgatctctttcaagatgggcaataaaccagaatgatgtataccgataccccttcttagtaatggaagtatatgctttatttgaggaagatctttatcggcatctggaagcaatccgatagcattttcaaaaattttggtaagagcagttcgttcttcgtcagtgttaaaatctaatttagacattttcaaggccaatgattcgcagtcacgtttactgaaggagaagacgatcactgggttgtatttcttgatccagatcatcttgacaatcttgtagatgtctgatttactgttatttggcccacctttgaagctttcgcctttctttcctttaccattaacggctccagaatcttccccagatttatcagaaatggtactcatagctttttgaaagttttcctccctgaagttacttttctcatccactaccaagtggattccatcacctcctgctgggaacaagtagtgttgcaacggagtaggtctaaagtctgtgtacacaacatgacatggttgcgagtgaatagtacaaatccattccgcaaattccatggcattgggaatggtggcggataaaaagacgtaatgcaccttgtcaggaagtaatatgatcgtttcttcccaaacaacacctcttgccttatcacgcatgtaatgaacttcgtcaaaaatgacccaagccacttctctcataacttctgaacctctgtaaagcatgcttcgtaaaatttcagtggtcataactagacacccggcatccgggttgatggtgacatcaccagtcatcaaaccaacatcaccaaactcagctaacagttcacgatatttttggttactcagagccttgatgggggatgtatagataactctttgcttttcacgcaaagattgagcaatagcatactcagcaaccacagtcttaccagcagatgtatgagcagataccaatacagattcgttcctatctatacacgagatagatgtgtcttgaaatggatccagcgtgaatggataagtcctggcttcattggtacgttcatgctgtccgatgggggtatatttgtaatctgttggaagggcgacttgatgtctcacctgatgtttcaatttcaaaggttgtgggccatctgtagaagtacccatcaatccagatgaagcggcgacttctcttgaagcctcaatttcgacatcatctgcaacgacgggaattgtttcatgaactttcttcaaaatcttttcttcaacggatgcctttattttttcagaattagaggaatcttcttggatatccaatttttgttcttttttgggctcatcttggttaccggactctgctgtgggtctctttctttgaggaaccttagataactcagccgtgacattgacagagtcctctggtttctctgtgaaaacgtcaaataggtcatccatggtgtatggagtgataacgtgaacaattggctagcaaaagaaaaatatcaactaggaaaaaccaattaagaaaattctatgcaaaaaaaaaatagaaaataatttcaaaaaaactgattacataagcagaccatgggtcaagatggtcgtgtgcaaatgtcagaaaacgatgggtagcagtagtgtttaacacagtttctggaagattcgagaattgccctaaatcacccattcgtagaattttgcaggcttttctccttcttccgattacatatcaaacatacatcagtaataatccatcaaaaaaaacttcgatgtcctccaaaagaatcaacaaagaactgatcgatttgggaagagatccccccacgtcgtgctcagctggccctgttggagacgatctctaccattggcaagcttctataatgggacccccagactctccttatgctggtggtgtgtttttccttagcatccatttcccaaccgattaccccttcaaaccacccaagatacagttcacaaccaagatataccacccaaatatcaatgccagtggaaacatctgtctggatattttgaaggaccaatggtcacctgctttaaccatctccaaagtgcttctgtctatctgttcacttttgactgatgccaaccctgacgatcctctggtgcctgagatcgcacacatttacaagtccgatagagctaagtacgaagctacagctaaggaatggaccaagaaatacgctgtgtaaataggggtatagatctaatgcataacggtggaacatagctgactggttacgaagtccatgtaggagtaagggccagtttgagagaaggctgtttgcggatcgtgtcttgtgatgatttcatctgcctagaaaagggtggcaacaaatgttacgttattatttgataagcaaactgctcgcgttttcgatgttggatgttgtggtttaaagtttatacggggccatttggtaaccgtgttgattagaccggaaactgctctagttgataaatagggcccactggagattaatcacggtgtttcggtggtggccatcatgataagtgtccgagtacctctatcgcatgagacttagcttgccagtatctgttccagatcaatgcattttgcatcgcactgcctagccttcaccgactccggatgactttttcactggatccacttttgctactgtgctattcagatatctacacagacctctgatctcccaacccgttggtattccatggtcaaggtctgttattgttccatgtttatcgtattccacattaggtaatcgttaatcaatttcctaatcgagatgattgtcatttgtaccaccgtagatccctatataattatttctgaaacctacgcaactttccacaaaagttccatccatcctctacaaaccctccataaacctgacatgagcgctgtcaacacatcgacggtacaaggaaacaagttccacgttcccgaaggccattcggtcactaaacgtctccaatccgaactggttcagttaatgatgtcccaaactcctggtatttcagccttccctgaatctgactccaacatgcttaactggaaaggtaccatcgagggcccaaaggcaaccccgtatgaaaatctgcgcttcaaaatctctttggaattttccagtaattatccttacgttgcccctgttataaaattcgtatcaccaatgtggcatcccaatgtggatatgagtggaaacatctgtctcgatattctcaaggagaagtggtctgccgtgtataacgtccagacaattcttctgagcttacagagtcttctgggagaaccaaacaacagttctcctttgaatgcccaggctgcccagttatgggatgaagatatgaacgagtataagcgattgctaatgctccgttacgaggacattgacgattagcgtttatcgctcgatacggggagacagagttcaagagaaaaatgacattcaaggtgtgcctattggaaagaatgaagggagagaaagggaagaggaggaaacctacagtaacagagcaatcacgacaaaatcgtgtgtattttcgttcttccttttggctcttccttacggatgagaaaaaaaaaaataacatacaacaggtgtatcagttgatccaatagtaaaataaataaaagttcgtttcccgtgctacttccgtggaacataatcctgttcaaaaattggttctgttcttcttttgccaacgaatggagtttttccttcataattgtaagccaagtaacctagacctgcgggaactgccaccaagaagatgaatacgtttcttgcagcttttctgttgaacttccagtaggtagctaggttgtctcttaactgtccatatctctggaaagaggcgtcctctctcaacactttgaaacgactgttagtaattcttgctgcaaaaagtttcgaatgtaatatagcacttacagtgtggtccgtggcctgccattatgatctgtgtgagtgtaatctactactgggcaaggtgatgatgaatgttttttgattgggtgagtgagactctataaagatcatttcgcggatattggggaatatggatgtcggatgtcgaaaaggttaccaaactaaaaacatatgaagagggatggcatccagcgccatggggagtaaagaataacggggactaggtgttgctaaaatacaatgtgtgtgagtcagttgatgtttgtcttggtatgggggaagttcttggaaaaataactgagaatgatttgtcagtgtcagtcgactataggtcactcccagtcgatatcactcgcactgacactcgctattatctccttcagtctttccaactcctgctcactcggctcctcaatcaatgtcgaaggtcttaggttcaacacgtctaataaatgtgctgcctttgtatcattaaacttatctctttcgctgggaactgtttctgttggaaggattgctgattttaactgtgttaccgattggtacaaattgttggtttgctgtacaaggtagaacaaggtttcttctattggagacaactttttcaaagaagatacaattttttttgacagtttatcatcattctggtaattagttgttaaatagtccaaacacgatctgtaactggttaaaatcttcaaattgcgtcgaagtgcactaatttgatcctttaaaaacttttgaattttcaattgtattgctatttgtcttttcaactgaaaaatctccttatccaaagcttcagtctcttctcctatcttttttaaaacagtgttgttcagtccttcatgatgcgataactttatccaatgttccttcaacagatcatcgggtatattcagtatatttctcactgtataaagctcaaaaatatcaaaattcttgtcaatgtagctttccagaagcgtttctaacttccccgttcccatctcgatctcatctttgtaagcttcaaaatgggtgtttaggtatttgtccaccgctgcagtacatttatacattatgtcgttaacagcattgataatgtcatcaattattgatatgggagggtaatcgaaatgctctgtgagtatcgagttggtttctattattgacatgggtgtgacgttgttagtgaaagaggagagttgatgtttactatatttcgctgctgatatattttctgattagataatctagctataatacatgagttaatgaaccccaagtcatgttcattccgagtccgatgattcagtttcgtatttgggtacttcatcatctccattcgtgccgtcagcctcatcttcgtcctttacctgctcgtcttcctcattttcattctcatgatacccatccaaattgatctccacggtggttgtggtcggagattgagatgaaggttctttaaactctacagtctccctttcgtcgaattttttatggaaactttttgtgactggtaaagagtccttttccgtttctggtttaagaagagttccttctagggacactaccctgccggcagtgtgaatggatttaatagtgaactttatttttccatccactgggttattatcttggtcgacccagtatcccagagatctaaacttctcggcaccattctcaccgaccccatcttcttcgtaatcttcatctacttcgtctgcttcgtggggtataaatctccaattggacggaatgttggaattccttaatgttgcgttgaaagtgtcatgaaccaatagacctatatgtgattgggtttgcaaatacgcccatccttctaccacatcacctacctgaggtctccatatcaggaaatcaacagaacaccacaaaaatgcaaatggggactcacctgaaattttagccacagcataagaatcctgcaaattttcaggactcaactggatattattgtaacttaacactatacctttagcttcagaaaaatatgacattattaaagagtccagatgttgttttcttatgcccttaaccggatcttgaaaatagcatggagctagagatacatataaatctgtggaaaacctgtagaagcattgtgacacaccattcttaaccggattactactatgtggaatgattcctgtaagtcttcttttgtttgaatcttctttttcgtcagttattggacgtttactcattagtagggtagtaagtctagtacgaagggaaaaaaaatttcactgttactcgcgatgaggtaagctatcttaggcagaagaaaccgttgcagaccgctagtgtcattggaaaagattgcttgcatttataaaccaagcaaactacactggtaccaacccaacggttccgcaaattaataacggatccgttagaacacaatatatctttggtgcttctgtgtatacctacgaccgaggaagcagaaagctattatatttttgatcttttctgtgaatctccttccctaggcccatataatgttaccattaggtcgtactatacgacctatactgaaccagaagtgcatgtggagcttgcaatggaaaccacaatctcttagaaccattataatcacccccaaaagcgatcactcttcatcattgcatgcatcatcaccgtcatcggttccaggcccagaactggctatcccaaagattttgaaacctatagccccaagcgatagctacatcagttgtactatttttgatgagacaggtaaagtgaaagaaatctccaaaaaattccccaagacgaaattcctcacagagaatggattgttcccaagagatttacgtaagattgatacgtctactgttgatgtagttccaactatagcagttcggccaaattgcatcttggtgaatttgttatatatcaagtcgattataaagaaggataaaactatgatatttgacacttcgaccgtgtccagtgcttcaaaactggggctgttcatgtacgacttggaatccaaactgaccaacaaaaattccagtcatgagttctacgagtttagagccattgagagtatcctaatcaatgtcatgtcctctttagagaccgagttaaatcaccacgtagacaagtgtggtaccatcttgttggatttagagaataatgttgatagggtgaaattacgagacctactgattaattccaaagcgttgacaacattttaccagaaagctcttctaatcagaaacgttttagatgagcttctagataacgacgatgacctactgggaatgtacctaagtgataccaacaaaactatagaaaacacggacgaaattgaaatgcttttggaggcatattataagcaatgtgatgagtttgtccagcaggctgaaactctgatcaatgacatcaaatcaacagaagaaattgtcaacattattttggacgctaacagaaactcgttaatgctttttgaattgaaggttacaatatatacactggggttcacggtagctactactcttcctgccttttatggaatgaacttgaagaactacatcgaagacagcaattttggattcgggggcattttcattctatccgtattgggagccatggtcattaccgttctgaatttcaaaaggctaagaactgttcaaaggttgacaatgatgttaccaaatggtcctgaatcgaggctaattcctcagcacacttcaaaaccgcccagatttggaagattgaaaggctggctaactcgtcataagaaaccactgtacgataaagatcccaaacagagagacatgatttggagatggctggtcgataagggcaagtaattcgatacacagaataaatatatagatctctatcaaatatataccgacattataaataataaactataacctcgtgttagtttttctgatacgttccaaattttatcagacatctcacctgcctcttttgcttgagtcgttttagctttctgtttttcttactgtaagctaaacgcggccctaccatctcatcagcattaaagttagcaggaccacttcctccagatgtcccagcaaggtgtagtggcaattgcagccgcggcagcatcttcgccaggtgtaaagaacactgtgctgcttgattctttagactgcaagatccttcaataccggtatggcctgacgaaattggacaagatgatacgagaggtccggtgtttaaaaatcaaggccaaaatgaaacagtttatcccgaatcagcactatatcatgcttttgtctggaaatgtctttaacgttcaggaacagctcttgacaaggctttcattgctggtcaatgatcgatcgttcaatagtaatcaagtcataaacccacccgttgtaacaaaacctatcaattatgatgttattgagaacttaaacgatcttaccgtatctgcgaaaccacccaatttgaaggactccttacaatcattagatctgtttgagaatctctgcatgaacgccgttcaaatttataataaaaagattgcccaagcaactaatgaacgcaatgctctaaggacgcctgacataaccggaactcctgttgctatggatattaaacagctggaagatttaatgctcccattagaactctccatcattccaaatctgatcactaccaataatagaacgcagacaacacaggaatcaattgacattgccttgcgaaattttgaaatttacttagttggccaggtagttcccgccattgaacgatctctcaatgctctgggcacatttattaaacagttagaaacgatcaaatctgtcaaccaactagtcaatactcctcaccatcaatatctcaaccacaggattttcatcacactattgagacttgctgatctctattcaatcatgagaaaaattggatctcgtatagctgctcataactatgagaattggacaactctgctcaaatacaataacgctttgaaaaaaccaatcattgaagccgatgtctttttcaaccaatccaagaagaacggaatattattgtctcttattaacagactaacaaggcaaggttgcgttgaacctgttcgtgtgagtactgcgatagagtattccaaatactctgtcgattgttacaatcttgtgaggagcgtctatttggtgttggagaagatcaatattcactggggtccgacggtagagttatctcgtaagaaaatcacctcttctccaattgaaagttctcaagttgacaacaaaaagacaagtggagttaatagtattacaagtgatttggagtcatcgagacttggatccctaaaggaaacggctgattctacccctcgcatacaagtctcagagcatttatcccaacctgattctgctgtccctgcaaatagatctagatcttcctccgttaactcagcaagctctacattaagtaggacgtcttccttaggtagtcgattgtctccacaattgcaaagaaatggttccatcaccagtcaaaaccgccgttcattagctgttcctgattcatggacgtcccccacaccatctgcaaactccaatcccaacaaaagtcccctttctagaagacattccgtcaatctaagctctcctagatctaaactatcgccgacaccgtctgcagttgttgcttctaaaagtgcaactttggccaaaaagtcgccttcaacgtctccaacaccttcaccgacgcggaaagaccctgttaaagctcccttgtctaaccaaatcaaggaacaagcaaagccgctgacggcccagcagagacttcaacaacacattctcaatggctcgaaacgaggaacaattcaatccaagccattcaatgaatattctcaaaattatgaccctaggaatcacaaaagtgctagcaatggtagcagaaacaattcattccaaagtgcattggagaatccgatttcaagcaggaatagttcaatccaaagtagtagaaacaattcgttgagagagaacatacaaaaaactccttccaatagtatttctaacgagcccgctaccacaagtaataatggaactgtagctagacgaggtagtatttcccggaaaccagatatacacattaccagtattaatgaggatacggtgcacgagaagtttcaagagaaagcatcacaaacagcaagcaaggctaaaacgacattaactgctacaagaggccgttcccgagctagttcaaatgtcagcaataaaagctatgaaacggttggtaacttggaggtcgtgaaatctgttttatctaatgatgatctcacaaacaagaaggtgaggtttaccggtgttcctgagtattcggaagcagaagacaagccatcagtaaaccaaaatcttaaacaatttcgccagtttgtttctagagctcctggacttggtggagtcagaaagaaagaaaagatgttgactgctcaggagggtctagctttcagaagacttcatggtaaagaagattatgattttgaaggtttcagcagaggtgcagatgcagtcttccccgttgacgctaatggaaaagtttcaatgatgagtgccattaaccaacctacaaaccgaaaatcaaagtttggtagattattcaagaaagggtccccagcataaagaaaaaaaagggaatgactataaagtacaagtattctttgtatactattgttaatggaatgtaaatatagattttactcaaaaaattttctagttttggagataccaaacagctctaacctaacagctggcaaggctccactagacagtaactttaatctttcttccaaagtattgtctacttcaattcgtccatcttcattaaccaagacaacaccaccagctaagtcatcactcaaaaactcgctttcggagactgcaatctgaacaggaaatttggccttttcttcgaattgaattgctgctttttcagctgcttttttggcaacctttaaatcctgttttctaacacgtacggtaaccaccttttcaaaaagagcaagaacaccttcttcaatcaggcccacaagaacttcttcatatgcagcggagtctttggaaatatcttttagtctagcttgtgtggtttccaagatatcatccaaaattttctccttctctcccaacaccttcagcctactcttatttgctatggtagactttttaatttgttgggcaagggaggccttcttgaatctatcatcatatagagaatcaattgcgttggcttccgaacgaacaatcaaagccttttcaatttcatactcctcgtcagccttcaatctaatttctttggctttctcttctgcctccttctttatgaatacctccatcttcttcaattcattttcgacctgagcaagaaatgtcagtatgattccgattgcataaaatctctgaaagcaatcaaacttacctgctcgtcactaagagctctgttggatgacattcccctggtaatacgatggaatacagttgtagatggagtctctcgactgtcgatcgagataaaagcagcaactacactggtgttaggatgaatattttttgctctatgatgagatcccagaggggagtcaacaggggcaattacgggaccatacggtgattggagccgatagttactagagaacgatacactcttgatatcagggtattatcaaatagttcttcccactattaggattaattgaatcggttcttagattgcccttcctaattaggcactaacccgtacgattcccaattagtacatattttctccatttttttttctttggaaatctagcatctgacaaatattcagatagaagtttatgattataaggaggttcgtaaggcatttgtccaccagtaaaagttcaattcggataaatgccgtgggaattcaacatttagctccttctcttcaaaaccaattgtttggtaagagtagtccgcggcttgacgaagatctgataaatatggcaaaaagacatctcaagtcaaacaaccttataggtaagaaatcctctttgaacgacccaattgagatacaactaccatcattgcaaggtaacacattagatgaacacttctacaagcttggatccgctagcttggaaccttataacccactgatagacgaacttttaaatttgaatatcatagagcctcagtttgaatttgcattccaatcaggttggactcgttatgctcctggagagccttcggaaaaggtaccttatcctttagaagattcgtattttttcgacgtggaaaccatgtataaagtatctcaatatcctgtaatggcagtagctttatctgataaagcctggtacggctgggtttctccatatcttacagaagaatcaacaactaatgaccatttaatccccctgaatacttttgagactgaaaaatttattgtgggtcataatgtatcctatgatagagctagagccctggaagagtacaacttgaaacaaacgaaagctttctggatggataccatggctcttcatgtatcagtttcaggcatgtgcacaagacaaagaggaacttggattaaacataacaagaaagagcaagagaacaccatgtctgttgccagtataaagtctaaagtgcagaatgaagaactacaagaattgcttgactcgactagcatagaggacccaatgttggaagataacccgtggataaataagagtagtctgaactctcttgaaagagtggcagagttttactgtaaaataaaattgaaaaaagatattagaaatagctttgcaacagaagatccggatgaacttagaggaaattttgacgaacttatgcagtactgtgccaaagatgtttttgccacaggcaaagtgtttcaaaaagtttatccaaagtttaaaaagttgattccgcatcctgtcagcttagcagctttgaaagatatttcatcctgtatactaccgactaccaccaaatgggaagactacatagaaacttcagagagactataccaagaaagcagaagaatgattgaaaaaaatctgcatgtgatttgcgaagagactgtcaagttgaaagatgatcctacgaagccctgggagaatgatccatggttatctcaactggactggacaattgacccaatacggcttaccaagaagggtgaaattcacaagaatcaaaagcttccagggtatcctaattggtataaacagcttattgtaaaaaatgagctgaagctcacgaccaagacacgtacttcaccattgttgttgaagttagcatggaatgggaaccccctttactggattcaaactcaaggatggtgcttcaaagtccccaagaataaaacagaagagtatgagaaacttaattttgttatggtttcactcaaaaaattatccgaagatccaggatttgaaagtatacgggctgaagatttaaaaaatttcacgtttgttaaagttcctcatcccgatggaccatcagctagagtaacaaactgcatgaccaagagttgcttaggtttttttgaaaaagggtttcttaactcacaatatcctcttgctaaagatgcccttcaaatggcagttgcatccagttattggacttcctcaagagaacgtatcatgaaccaatttgtagtttttgaagatgacatggggtacattttaccacagattatacctatgggaactattacaagacgagccgtcgaaaacacttggctgacagcttcgaatgccaaaaagaaccgtttagggtctgagttgaaaagtttgatagaagctcccaagggttattgctttgttggtgctgatgttgatagtgaagagctttggattgcatctttaattggagattctgtattcaaaattcatggcggaactgctattgggtggatgacacttgaaggtactaagaatgaaggtactgatcttcattcaaaaaccgcaaagattctgggaatttcaagaaatgaagcaaagatcttcaattatgggagaatttatggtgctggtatcaagtttaccactactttactcaaaaaatttaatcccgcattaagtgacgcagaagccaaagccactgccaatgctttgtacactgccaccaaaggaatttctggaagatatgacaagaaatcaatatggtatggaggttctgaatcaattattttcaacagattagaagcaattgctgaaatggcccatccaaagacacctgttctaggagctggaattactgcacctttacaaaaagccaacttgagtaccaataattttcttacttctcgtatcaattgggctattcaatcatcaggagttgactatctgcatctgttaataatcagtatggattaccttatcaaactgtttgatattgatgcccgcttgtgcataacagtacatgatgaaattcggtatctggtcaaagaagaggataagttcagagctgcttatgcgttgcaaatcagcaatttatggactagggccatgttctgtcaacaattaggaattaacgaagtccctcagtcttgtgccttttttagtgcagttgatttggattttgttttacggaaagaagttgatcttgattgtgttacaccttcgaatcccgatcccataccatgtggaaaatctttagatatttatgaactacttcagcaagaggatataaaaggggctgattttccccggacaatgcacctcaatgatgtgcattatcgaaaaagaactccggttatagaaatgtttgataaagctgtggatgacaagacgagaaagtttatggtctctctgcagattgctcaagataagacggagttcaccaaatggaaacgctctaggggagagttaattgtacattagatcatcgattgtaaatagaaatagaatcataatttattgcgaagctttctgtcttcgaaaatatctctgcctagcttcgtctagaaaatgttggtcatatgctggtggtaagagtgatagaagtttggattgtttttgatggagtagatcaagctctgccttagtaatctcttgcctgatgttgaggccaccagttaaggtagattcgaaagatgtatttggctgagagatgtggtcggtgggcacttgcagaggcttatcttggggattcggatgaggagattcctgtaacggtacatattctgttgatctttcgttctccctgtaatccagttgagttctatagaaggttaataatccttcggagcctggatctgtttctgtgttctcttgtgattttgatgctttatcctctaatcgttttatttcgtttttgtagatcttgaaacttgatgtttctatcctttctccaactgtactctctgtctcttttttcaatttgaaactctgtagtaataattgatcattttctctttgtttcttagcttccaagagattggaaatatatttactttcattgtttgatttgtttgcattggattgcctactgacatccggtagatcaatatcatagtttaacttcttctctaatctatccaccttcagagcattgcgctcattttcctttttcaaatgctctctcataagcttctcttcatctttatcttcgtcactgtcattctgcaaagcaaggacactggtctttttaacctttttgagcttcattacgaaggggtcaaaaaatcaagggagcttctgataagtcttagatagtggaataattcgcgacgggagtatttactagcaagacaataccagaagattctcccaaaaccatcgctgaggccacatccgaatatctcatagaattattcctttccgataacaaaaaaggtactgctctcaaaaaccaaaattcacggttcgtcaagtacatgccagggtttgattttttgaacgtgcctggaattcctccatcacgtgaaggaactacccctcctcctcctaatgtttccttcggcgcatccaatccaaccccttcacatgaaccaaaaccgaattccaatcctcggcatcaacagtttgatgcgttgtttgaccggatcaatagtagcattaaatcggaacaatctgctagcaaagaatcgttgaactcaatttcttcagcttctaaggatagtaccacccagggggtcacaagttccagagattcccctgatatagagaatgacgtttccgtccccctgtcgttgacagcaaaccagctatcggaagaagaagttaagacctacttacggtggtataatgacattgtcaccagtagaggcacgaaaactgtatccattgatgatgtgttcaaattcatgaacaattttcgaatagaacataaagataagatccgcaagttatttaactcttgcctcaacggtttgaatataggacaattttttgcgctcttgagacttatttctcatgttatattaggcaaatatcccttaagatcaatgatcaaagtaattgcgccaatccccaagccggtgtcaatccttgcttctcgcaagagacagcagatagaagatgaagaatcagagattgacgaagaaatggatggtcaggaatcactaccagataaaaattctaatagaaagttggaccttgacagctttacacagtttttattgactggagagaaaccaagagaagaaacgaaaagaaggaaaaaaaatgccaaatcagtaaaattttctgaccagctaataattcaagataatggacatcttaatgagggtgataattccaacatagatttcacgctaccaatggaacaattactgggtagagttccaccacaaaacgtatcgcattttcagcatacccatgacgaggatgaagaggaagacgaagaggaagaattaaaagaaatgggagactctatcaaccacttccagaatgttaaaatagatagcgtgttactagatggtgcacataccactctccctgaagttaaggtttcctctgaatctggagacgatagaccactctactttcctaatatagatactttgtctcccacacagggaaatttcttgcaaccacatttaacgggaagcgctcctaagcaagttcgtcaatctatacgttcacctccacctccacctccagtttcacgtcaaagatctaaatcgctggacattaattttgaagatagaactcaacgagaggcacatggtgcatccccacaaccaagttcacaagctcctacagttccacctcttccaccaccaagtcgaaggtcgcgttccaacgctgagatacaaatacaacagccacctactctacgctcacactcacatgttttggcacctcaaaatttcgtttctgcaagtgatgacaatttggcttatcgcaccaaatctcaagaggaaaatactactgacatgagacaggttctctcaaataacagctctgcggatattcttggagatttgcagtcgttgcaagccgagttagacaggataaaacaaatgactagaaacatataaggtaccgattatataagcattattttctttcatttatagatgaatctcgcgaagttcatttagtcttagatttcaattccatgacagatttctttcttagtaatgtttagcgtgttatccaccagggggctgctcaggtccaagacttccttttgtacgacatcagcaatatctgcgcctctagtgaaaggcttgtggaatattcggttgcaatctaccaaagtggcacttgatgaatatgagcagaaaattgctgacatgcttcaaaaagagtttaaccctacaatcctatcggtgagagacgtaagtggtggatgcggatctatgtttgccattcaagttgaaagcgcaaagtttaaggggataccgatggtgaaacaacatcgtctggtaaatgaattgctgaaggatgagatatctcaatggcatggcttgcaactaaaaacaaaagcttcctcctagacatttgaatatgctttccccaaagcatttctggcacaataagtctctacttgtacatataatagggcattagtcttaactttatttatttatctaatccacaatttcttctttctcttccagaatctcctcccttacttcctcgatcacctcaacatcttccttcttctcctcttcgtacagtcccagctcctttagatgagcttctacgaaatctctgtactctttccattctttgagcagcttctttcttctcataatgatctctctcaaattagcatcggcttccatagaatccagctcctcaaattgtgcgctatattgttccaagttctcttccactttcttcttgtcctcctctgtcaaaatagatttaggccttgctctccatgagaatttcttgaatgcctcaacttggtcctcgatctgaaggataccagcaaagttgtagattttaaaaccgttgtcacttgtatgtttccatacggaagaccatccggcaacgaaacggccagaatcctcccattgaagatgggtgattccgtgatatccgtgatgagctagttgtttgaaagaagccttcaccttgaacttggtgtcattctcattgcgctctccttcaaagtcgagatcataaaagtcaaggtctccagagcctgcattcaaagttgcagcaacaacaaaacgacccttaggagagaacacaatagcattactattcttccccccaatagttcggaaaggcctccatacagtctccgtgttgactttacccttggaaatttcaggagcatagaaactaacattcatcttgttaggagtggtaccttgaacgtcatcagttgtgatgataccaaacctttcactggtgggctcccaagcaaaagttgttacagcttccttcaattctaatttgatgacaggaatgtctttcttggtaaccttgaagaactccaggtacgagaaaatggttttcttggatctagtatgacggtcgaccttacagcacaagtaagaaccgttatcatgccagtatagtttacagtctgtcacgttagttaagttaacagttcgcacgattgaattagtaggcacttgaacgacagcaaccttagcgggcaagttaatttgctcaggcgaccagtacgccaagagatgttctggttcttcgcccttcttttgagtttctgttctaacacctgcaggggcccactcaaactcagcgacaccgggagcattgagaagcttcttgtttaccaattggaatgatggagcctcatatacagcaatcgcacctggaccttttcttgcacaatatttagaatcatatgaccacttaaccaaaggccaggtcatttttttctccttttccaggtcaggaggcaaagcaaatgttctacaaggaagaccggtttggaaatcccagataaccagcttgtttccaacatcttcctgtttgaaagggaaggaagcgcgtgcagggtggtttttagcagggagtgtaatcggctctggtgacaaagtaaccaagtatctttcatcgggagagaaatcaatcaacctaacgcctgggtggtagaacttgtgaatagacttgaagtcctctcctccccaagcatggatacctagcttgtgaacagataaaaagtaagaacctttgggagaaaactttgtgaaaagttcagtccagttgacccttggctcaacgacaggagttggaggaaatccatgcttgtaccaataaataccagcaatgttgcccatttccaaagaaaattgatctcttgcttgttcatctaataaccaagagtccaagactttggtgcttgggagtttgtaggtggcaggctctttgaattcatcgttgaaatcggttaagtactcgtccatgtcagaaaacttattgaccaacaacctgtgctgttggtctaatttttttccgtgcaacttcttgacagcctcattggcaccctctgctgtcttatatccaataaagagataccctttagtctttccgtcctccaaaggcatgtgtatggaatcatcttgcagttcaccaacagcactgaataacttcttcagcactttggttaagatagggactttcgattcaggggcaataggtgccccgtcgacaataatgaacttgttcatgtaagaaccatcatcctcaacggtgtatttcttttccaaatcggagaagtcgatgctactgatatcgatttctggttcgtttgtcattgttggtcgatgaaagatcgaataaaatttttctgagcataaaagtcccacctcgcggttgtgggaagaggaattttgcaaagaaacacctgcctccagaaacgcggaaggacggtagaagggttcgttgtgaagcattggattcagaacaaaagctccgaacttgatagagtaagaggaagctgggcacgcaagaaagtcctctagtatttcgtttcattcaagcagttctagttatcatactcaaaattgtaacgtagcatctctaggtgttcacactcttccccgacattagacctccgcgctttatcacaataagttgattaaacaacacgctgtaatcatgggggagctgcaatccccatctggtgaaaaggagatggcggaatcgatttccgtattaagtacacccactagaattggctctttatatgatggaaacaagaataggcgtcggtctcagatgttcaaaagacaagtaactgatgtctcattcacgaacctggatagtcaaaacaataacaatcaagacacagaggatgcggagacggatgacgaagagtttgaagaagaaggaaatctggcctttcatgtcggaggtttggggcaagatctcctagattatgaggttccttattcaccggtagaaagtgtcacagagaagttttcaaccatgtctgtgaggggaaaacggtcttccaatgacaatgaagtagacaaattgaagagggaaaagctaaactatcagttacagcttcggttattgagtgaatttgccagaaaggtgatcgagacttgtgaacatggtgaagaggtaaagcaagatcttatcaatacactcgagaatgagtttctgctgttcaatccacattgtgaacattgtgaggaaaagagtcaccaagtagagagattggaaaaggccaatgtagagctcgataccgaattacgcgccataattgatagctttgagtctcaacaggatgaagtacacaatctcattcaggctcaaaagagtgtaaacaaggtgatcaactcgataataggtttgtttgaggacaaagataaatcaaactttttaggcttgacaacagaagaaaaactagatcaattgtttcctttggttcaggcaaaactaaatgccatcaaggatgaaaaagacaaactaataaatgaactaaccattaagctgaaaaataaagaatcagacttgaaaaagaatgaagaattaaacaataaccatattcacaaacaatcattcaagcaagaagatcggatcgatgacaacagtcaatccgaggctgatagaatagtcacattgcaagcattgttagcggaagcaacgactagagagacccacttaaacacagaaaaaaaccaacttaatgaaaaactaaatcatctggcaagtgaacgaagtaatgctattcttaaccaaaagcatgaaattgtttggagatcccactatctgcaagcctgtaaactcaacatagacgcattttccaagtttattacgagtttcagtgaaattttagatggagaatccataaacgaagcagtatcccgtattaagcgtctgcaaagtttaacaacaacatcacctaatcatgcaaaaatatcaggtattacaagctccattctgcgctacttcaacgtagcgatcaaaactattgtggatcagcatagccagctactactaaaggaagctaatccaatagataatcaagttcacgaattacaagaagagaatagcgctctggaacagcatgttcaatctttcatagatcagtcttccaccgtagatgaactcgcacgaatgcgaattgaagagttgaccaagaaatggaaaaatgaaagagaagctcgtagttacgaaaacgaacaagctagaagaaggctaaaggaagtcgaatctgaaaacgacaaactcaagacaatcatagctagtttgagaaaggagtaatagaataataaattatccagaaattttattttggctcagtatttactattgaacttcaacatcttcatcctcttcttcttcatcatcgtcttcttcttgagcatactgcacggctgcgtcaaacagttcctgtggaatgaattcatgtcgcccaccagtttcactttggctgacccaggaaatctctaattcgaattctttatctttgttatcctcatgagccaaatatatgattctagcagcttccttaacaccatctttaactgaaatattaggcaggtccagtttctctaactcagctttagccgtctgccttcccttgccaatagcggtaccacaatagccccaataaactccacttggctcaatcatgtaaaggtgagcgccatcatcatcaacgcctccaacgattgcattgattccaaatggacgaacggagttagcgcatgtgtagttttggacgtagagaccaaccctgtctatcaagttaggaactttgatgggatctttatacaaagatttgaaagattgggcttcgtctcgtcccctgttaacaaaatggcggccatctgggataattccagagtaagccactccgatatgtctgtctatggattgaattcgtttgtttctaccagctaccaataatttagatgtttggattttttcaacggcaagaaccacaccgtctctacatttaataccaattgaggtaccagcattttctactgctttagaagcgtattccacttggaaattacgaccatctggggagaaaatggcgtttgaaagatcatatccagtaccaatagacgactgaggtggcgagtagttagtattggaaattgtcatattaaagggactcaatgaaccataccttcaaatcaaggattgcactagtcatagtccttttaaaataattgaacttaccatgattattcgttatttctcgctattgacttggttttagttaaggatcttgatggaaaagagtatcaaccagtttgccttccaaattgtttctcgaatattttggttcggctcgataccagtgcgatctagcttaaacttcgggattaagtgattgtctaaactccttactctcccccaatgaatgagatcagggtggttgtctgtggtgatgagggagtaggaaagagtagtcttattacttcgttactcaaagagaaatttgttgaaaacattcagcatcttttgcctcctgtgagcataccaagagactattcctcatctccttataccccagatataacaattctagttgatacagacagttcagatatcgccactttacaaaaagagatacgacaggctgacgtgatctggcttgtatactcggataattatagctatgaaaggatctcactttattggctcaacatgtttcgttctttgggtgtcaatctgccggttgtactatgcaataacaaatgtgatctagaaaactcaggcccagaagaaagggagcaagctattattgatgagatgattcctatactcaaggaatttaaagaggtggagtcttgcatccgttgcagtgctaaactaaactacaatgttgttcaagcatcctacttatgtcaaagggctgtgacatatcctatctctcccttgtacgattacaaagaaggagagttgaaatcacaggccatattggccctcaagagagtattctatctttcggacaaagaccacgatgaagttttgaacgatcacgaactggaagtactgcagaccaaatgttttcataaaactatagatattaatgagttgcaaaaaataaaatccaccgttgagggaatttgtgcggtaggcaccttccatggtcttactgaagaaggtttcctagctttgtgcaagtactatgcacaaacaggtcgccacgaaacaatatggggtattctgaggacatttcactatacggattctttatctcttagtgataaagttttatatcccagattagatgtcaacgtgcattccagtgttgagctgtctcccattggttatgagtttttggtcaacttatttgtgttgtcggatactgataacgatggaggcctgagtgatcaggagttggacaatttattcaagcccaccccaggcatcccagaactgtggaaggactcaaacttcccacgtaccgtggtgtgcaatgaacaaggatatgttactttacaagggtggttagctcagtggtgcatgacaacgtttttagactacaaagtgacattggcttatttgggatacttgggatttgagtcaccaagaggctctgttgccgcacttagagtcaccaaaccaaggaaaacacgcacaaaagatggaaaatcatatcgatgtgcgaccaacgatcgaactgtcttcaattgctttgttttgggggcacccaaaagtggaaagacctctctccttgaagcctttttggagagaaactttcatgaaacgtactcccctacaatcaaaccaagaatggtggtaaatagcgttgaagtgaaaggtggcaaacaatgctacttgatcttggaggaattaggagaattgactccagcagtattggaaaatcaaacaagactgaatcaatgtgacattttatgctatacctacgattctgctgatccagactcatttcaagaattggtagatttacgtgaaaaatacccgaagctagatgaattgccggtagtctttgttgctttgaaggcagacttagataggcagcaacagagatgtaagcatcaacctgattcctacacaaaatcactgttaatccaacccccattacatatatcattttcttggggttcatctctgaacgagttgtttattcaactagttgaaactgctgtcaatcctaaactttctacaccaggaattgagcaagatcaggagaacgactctatcaattcaattgctattgtagcgagtgtcataagcggagtgattctagctagcatttggtattacagaggaaaataacacggtccaaacagtccttctacggctttttctttgctcgtatgcagaagagtgcatgaacgttgaagattagattcaattattctccagaaatcgtaggtgatatttcatttcattaacttcacatgtttctgagtaagctacagcttttaagattgaaatgctgtttagccaagagaactcgcatattgtgttgtcaacagcttttggcacacatgaggcccctgcgcgtccatttttcgggatcctcgccttttattcgttctcgtttttcgtttctttgtcccacacaaaaggctacctttggaaggcatataatagtcttcaaaccaattttatgctacacgtgaccccagatccctgaatttttgagcacactagagccgaaaagtcctttaaattattccagatggggttaggagtagtaattaaaaaaaccccgatacatatgtatatatagacagccagttcgggtgggtgaaaatttcctgtaaacttaatcaataagccataaatcatgcaatccagatctttgattttgtcaatcgtttccagtctggcactggctaatgctgctcctaaggccgatgctgaggcccttgcagctgccctcccagctcctatcgctgaagctatggcccaagctcttgctcaagaggatttggcctctttcagttgccacgagtcttgtggttacatgatccttgcggccagagcatgtgctcctgattcaaatgctcctggtgttgattttggtccttgggacacagactgtctctgtacagaccaaggtgggtttgaagaattagttgagccatgtttggaatgtggatggtgcttgtgggccgactacggaaagtatttggtcgctcctttggaagagtgtggtcacactactcttccaactggaactctatgttctgaagtggcttcttctgctacagccagagtctccgctcaaatttcagccacattagccgccctttccttgaccacctatcctgtatctgaaaccggggttgcaaccagcaataatagttccaactcaacaacttcagcatcatcaaattcgacttcaagttccacaaccggttcaggatcaactagctccggcactacgactgagggtgaaactacctcagctacagacggtgctgctaaacttcaatatggtgcaggtatcgttggtgctattggtgccgctgccgcactcttgctataatcgtacgtagttaaagctgtattttcgtattattaacataattcaatcggtggtggacattctggtacagtcccgagtctaaacgcttctttaaataatctcaaagtctctgctggtaatgtctcttgatctgtgtaaacgtgttttggtccagttgggttggtagacggagattgaaggtttagagtattagaaccattgaacgatgaggtgcctccaaacgagttttgctgcggttgggcgctaaatgccgtcttctgattttgagaagatgtgattgctggtgagttcgcaaatgctgaatgctgtggattagatccaaatacattattattgtttgtaggttgggcgaaaggattctggtccgttgtagaaccaaaaggagaagagctggacgctaccgctggcgccgaactgaatgcattgtttttatttgcgatgcttccaaatggagaaccggagttaaatgactctgtctgaggttgagcagttgtcgatgcaaatggagaagctttggagccgaaagcattttgactattcgacgttgacggttgtgctgtggttccagccgccacagcgaaaggagatttggcaggactgccaaacccagtagaaccaaaagccggagctccagtacttccgaacccagtagagccaaaggctgaggatccagtgctcccaaacccagtagagccaaaagccggagatccactactcccaaacccagtggatccaaaagcgggagattgagtgttaccaaatccagacgacccaaatccagaggatccaaacgaaggattaggattccccgttgcagatgcacgaaaggcactcgtatttgttgagttaccagggtttaccggattcgcagcttttgcaaaagcgccaaatgctccagaaccccctgaagttcctccaaaggcagatttgccaaatgattgtcccccaaatgcagcgtttttatttgaactgtcaaaacttgtggagccgaatgcactatttgtagtgcgggcagcagctccaaaagcagatgaagtcgcatttgctgctccaccaaatgcgccaaaagctcctgtattttttgttgcaagtgagctgctagcagcagatgccccaaatgggtttgcagcgacattgttgttattagtagcagctgaaaaatttccaaagattcctccacctctgtgctgattctgattctgaccccaagaagtggagcgaccatccgtcaagttgacttcccaattaataataggactcaatgagttattttccttagactccagtacatatctcgctgccctttgagtatcagatctaactgtttgcaggcacctgtccatatctagtttcctagcatttagcatgtgctggtataaatccaaacgattaatatccctttgctggtaaaattccaaacgaagttcctcaaatgagtagtctctattgggaatgaggctgacagtaccgtagcccagggaggaacagaggggtgtcagttggaagttgctcgtatctcccaaatcattctcgatttcttgaacttttgcgttcaatgttgaactattgttggtcaatatatgagaaaagttacatgcatttcctttattacagcgtccttgttggtaaaatttacatggaggcttcaccattgaagattatgactttgatatgtaacaaaacaggcttcaattctgatataagatccgcgaaagaagatccagaaacttacttgagctgacataatcaattagtttaccttagcatataaatctataataccctaccaacagttgtgccttcgctgatgtgctgactactggggtcaactttcctgagggcttttcctccttggatttcccccaaaagagcagacagtccacctccaagagtggccggtggagtgggagcagatggagcagcaatttgtggtgttggaggtgctggaggtgcactcatctgtggtatgggcggagcaggaggtgctggaggcgctggaggcgcactcgtctgtggtatgggcggagcaggaggtgctggaggtgcactcgtctgtggcagaggaggtgccgaagggggtgctgctggaacgcttgtttgcggaacaggaggcacactacttccagaatggttagtcactattccaggttgagctggtgaagcttcaatctggggactaaatgaacctgccgaagtttgagggacaggaggaggtgcgatgccttgaggaattggtggcgcttggggaactggtggtgcttccgggataggaggaggtgagaaagtgtcatctgctgctccagaagttggcgttccaaactgagagtcagaatcggaatcagagcttccagcttttgatgtctcaattttagtaggctgtgcttgtgattctggttgcaaatttagtgtcgaggattgtgatgaagcaggaacctctctcttttcagaagagctttctgtggtaggaactttaggaaggctaccatttcggaacaataaacttgctaaatgtgctggtcctgaatttctagtaggtgcttcaccctcactagaatcgttgccatctgaatcaccccaatcgtcatcgtcgtcattagcaactgcacctcgttgagccaatcgttgggcctcaatcttaactggatccacaactggttctgattgttggggcttgaaaaatggatttgaagaggccacttgaattggagttgcagtgtctgttgatggtttggaaaatggattatgctcgcttgaagtagcagaacgtacgacagggactggttccctaactatttctttgggcttctcgggtactgatttaactgagtcaatattcactacagggacttgcgccggagtttcacgaggaggaggttgggttggaacttgagagggggtcttttcatcccaactatcatctgattcttcagccttcctcatttcttccatttgtttcctaagttcagccagttttgcttctctctcctgtttctttttcaacttcttctgcttatgctgttcttccagtcttgccttctcctccattagtttcctcaattcttcgtcattgtcgtcatcgctagattcctctttgtattcaggattctttgccgatacagtttcctttgccggggtctctttttcgggaagacgctccgcgttgttgtctgaactggtcgcagttggtttcttgataacttctgaagtttgagcattacctactggggaacggataggtgactgggcagctttgtcgtgtggggaagattggttcactggtggagatgaagaactctttgcttttcttgaaattccgagcttttgcagcctttcattcattcttttctcagcttgctctttaatatactttgctctatctgcagggttcttgtaggaagaataagaatccggagtcccatgtggttcagaggcaacactgctggatccagtagattcttgggagactggcactgaggccaccttggatggtgcttgctcagcaacaacatcctgcttaacagaaactggtgccaccttaggtttcgagtcattgagtagcttgatcagttctttgacttccttcgaagatacaccttgtcctttttcccatttctcaaagccaacttctgagctgacagattcctccagggagttcaatgcagaatctttcagatccttgatcgagttttgcacatcttcaatcaaagacctgccttctgtggtttgagccttaatgcgtacaacttcctcagccaacttctcctcatttgcttcaaacgcattgatatctggagctgtcttacccgtaagtgaagccatacgagatttcaatatggcgcgggactttgcatggcgcttatctgactccgtaattataccatttggtcctgtacctttaagttcgactccagatgggttttcctcctcaatgcgtagcctagcttgttcaattttagcgttctgaatttgttcttccacattaaatatctggtccattatgtgcgaaactttatcagaaagtgaatcgattctttgcctcaaatcacgcttcgataaaccaggagcattcgagtcaaatggctgcttttcattcagttcagattgtatgttcttgatcttagctttaagaatctctatatcatggcctgtcttttgggtaagttgatcagattgcttctgtacatcagtatcttgcgagtcgtaagcatccaggatgatttgtttctcatgaaccagcttctttaattccgggattgagagtttcttcttggaatggtcttgctggcgttcatccgatacagcctcttttttcgaactgtgccttgctctactaacatacccaaaatcgtcatcattgttcttgaatcgggttccatctcttccagattttgataaattattagaagagcttccaaagtttgattgtctaaatttacttttcatatcatttagactctccttcaagatcttggatgagggagggattagctcaggcggaagaacattaggaatgtctaatccgttcaatcttctataaactaagtgcattgcaactgcaaattcgtccttattcaactttcccctgttattttggtctgctaaattccaaatcttctccaaatcttgtctcgcaaggcctgacttgccaaaaatcgaaattgcactaggaccatcaatgtagcctttatgatcttgatcccattctttgaaaatcttatcatatatttgcttctcattctttgtgattgcccatggaacatttgtgttactttgagcattcattggttgttggagttgcgaaagctgagtggaagagttaggcatgaaatgcgactgcatcatatctaggcctgggagcccaccagttggtgtggcaacaaatccccattgacctggttttccggtcggcatcggttgcaaacctgttggttgggattgcagagactgttgaaagccggtaagctgagactgtaggggctgctgatatccggtggtttgagattgcaatggctgatagcctgttgtctgggactgtagaggctgttggaagcctgtgttctgactttgtagaggctgttgataacctgtggtttggttctgcaatggaggctgaaacccagttgtttgggcctgtagtggcttatagccggttgtttgagattgaagcggtgcctgatatccagttgtttggttctgcagtggttgctgatatccagttgtctggttctgcaatggtggctgatagccagtcgtttggttctgcaatggtggctgatagccagtcgtttggttctgtaatggtagttggtaaccagttgtctggttctgtaatggtggctgatagccagttgattgagattgaagtggtcgaaatccagtttgttgtgctgatagccccccagttactacaggtactaaactacccgttttctgcgcaggcacgggctgtagtccagtaggctgggattgtattcctatatttccaaaacttgtttgtggaagttgtggcacttgattagatgattgaaatccagtttgctgaaaagacaatggttggttttgttgattctgttggctcgtttgcgctgaagacagtagatcgttactaaaaggtgtattgttattctgagtgtcatcttcttcacctacaccaaaactgataacatccacaaaacttgaaacttcatttttcagtgtcgttggcaactcaaacggtaagttctcacctcgcaagacaacattacaaagatgcagcgccagagcaaattctggaaagagcagtttacctgaacgagtagtatcagataatgtccaaatctcggccaattgcgaggaaggaatgttggatcggaggaggatgtcccttgctgttgagccatcaatggcattttcaccaggaggaacagaagacttgaacaattgttcaaatttctcttggtcctgttgagtaatgaaagacagtctaatagcaggaatcttcagttcatgccctttttgagttggagcagccgatgaggttggttgagaataacctgttggctgactttgaataacttgagcgttaaatccggtttgttgagactgcagacccggctgaaattgctgctgttgaaacatagctggattgttttgcaaaccctgaggctgaattccagtttgttgagccaccaagcctacaccaaaggaggaagagggttgaaaaccagtgggctgcggttgttggaactgggcctgttgctgagcctgttgttgaggctgctgctggggctgctgctgtccttgataaacattctgctggaattgtgggattccattcccgtaacccccatttccatatggattgtacattctggacaatgaacaaaggaaagaaaaggtaaatgttgattgcaactctggatagatttgacgaagccactctcaacagtgaagtttcgcgaaatgaacactcgaaggaggaaaaaggaaaaagtgcataattcattagacaatcccgaaaaccgttggaataaaccgagacggccaaactttacacaacagataatgtcccaatttcgcccagtatattatccatacttatccttattctacacattataacttcaggcatgatctagaaggtttatcctactgaccaacccatctatgagaatactcttcagagtagtcgactcgataatagccaaatcgttcttagatttaggtgtacccgtaatgattctcaggttactaagaatattcgttagcttatctctgaccaagtggttgtcataggacccagatcccacagaatctgaatctaatgcgtcttcctcgtcactatcggagtcaacctgtacgaaacgttgactatatgtgctgtcaggtagggagttaaccattgttaacagggaaacgtaaagcagcaatgacacctttgtgttcttcacgtaaacgttggtatagttaggaagattgagtctgtcaataaacaaattgacttgttcaatgctaggagagccttcggataatgcacaaatgatacaacaagtaaagcatgctaccagatccttggatagcttgttggatgtaaaagtttgaatcagtcgaccacattcctgcaagttttccaaagatgtgtcaatcatacacttgatcaatttgcatttcagcaattgctcattagtggatgagagctgtgaagcatgtttaagatattgatctctttgttcttggaattcagaaattgttcgttctgtttgctcctcctgctcggtatcgtcagcagctagttgctccttcttctgcaatttgagtgcttccaattcaatcatcttatgaatgcaattctcaagcaaggaatcacataacaatttagagacttgttccacaaaatgtgttctattcaacttcaaatttggatacttggccaacaatgtgttcattgatttgatttcaaacacttgagcgtattcaaagttctccaatagatattgtgactttgagtcagttgctggaatttggttgcgggactggcgagcacatctccagtatgatgcagcaatataggatgctagagacgatccatttccatacaatgatagctgcttaaagtaaaacgcttgcatcatgggggcatatgggtccctgtttaacgcaaccgaaaggccgctggttgcaatattcaccagtaaagaaaagaatcctccttgtttaccttgtggccagtcaggtgattcattgttttcattggcaattgtcttttcatctttctctatgcacacagttgagctatggaatagtggcgcgataaccaaataaagaacataaatagctaggaatcccttcactattccaagtaatggtttcaacgccagcgtggtttcgtttgagttaaatataaatatgggcatagtcatcaacgacctactatcgttggacatatcgtttaacgtggaaccaccagctaagcaggccaaagaaccaattatcagcttgttcatcatgttacccgaaccagagtctgtcgcagcaccgctgttttgaattatctctttcagtttctcattctctgtagttaagaggctgtttctgtattccaagtgtttgatgtattcaacagacttggccaagatggtggctttgttcaacttgcgagcgggctggagtccatccaattttgattcatcatcagagtagccaagtccctcgtaatctttactaaattcatcaccactgttacctcctccattcctcgaaataactattctcaacgttgggacacaattccttaattccaagattttcgaattgatgttggtcctgtatttcttttcaatcaaattgtgagacgacttcatcttctttcttggtttggccacttttgagtcctttatcgattgatgcgcagccgaggctgcaattgcgtcatttctttccatatccaccacgggaagcaagacttggtccccaatggttgtgttaacagaagaaccaacggtgttgttggtgtctgcagaggatccaaaattgatcccatttagcattcccaagtcgtttaactcggtagagtggggtgagttgttttcactcgtaccgctcatgctgctactcatgttggagagctctggaagctccgataaagtgctgtatagatcattgttgaacatgttctcattgaactggttctcattatactgctcttgattgaagatcatatcaggggatgagtcaggggtgtatgaaccagccgatgagtagctcatcgttgaaagcctaggtttgactccctgcatctgtttggcgaacgggtcctctcggcggtttgcctgatctatgttctgatcaagactctccagcaaagagctgtagtcttcaaacttcacattaaccattttgtgaaataattttcttaagggaagaagtttacgagactcatccagtaagaaagtaagcagataggtaaaagttcaaatcacaccacttttgacagcgaggcgcgaaaccattagaaattggaccatactgatatctacgccatgtgcgactagacacatgcacaatcaataatagaaacggaaaaatagagcattgagcaaattagccagacagaattttacgctcatgagccgttgggttatcagcgagagttattgggtgagaaagcccgtacattcactacacttccttatcgttgggaaaggaagatgacaaaaatatacacaaactagtttctccatttccgtttctatccttgctcgtttcttaagtctgtccgaatccctggtgtgccaccttgttagcctcaacgtaggctgactgcggatctaaatatttgtatgctccaactggcttgaagtccttatccagtgtaatcaccagtggtatcgcgttgggaatattgatacccgaaatatcctcatcggatatgctgtaccaatacttgataagagcacgcacaatggatccatgaacggaaagaagaggtatctcagaaggatccttttccaaaagaggtactaatacgtcgtttacgtagggtaaaaatcgttccagaaccatttttaaagactcgcctcggggaagttcagatcggtccacgttcctgtatcggtcatcatgatcggcttcttctagcaaaggagggcatccttcgtaagctcgacgccattccatgtacttttctttgcctacttctttcaaaacatcggacttgaagcgaccttgcagcgctccataatgtctttcgttcagtctccaagacctataaatatcaatgtattggcgattcaattgctctagaataatgtttcctgtttgacaagacctggtcaatcttgaagtatgcagaactgttgggattataccagattccctgatcaatctaccagagtactcagcttgacgagcaccttcagtggacaagtggacatcttcccatccacagaacctgtccaaccgattccattgagattggccgtgacgaactagtattatcgtgtatttggcctccgtcatatatattttgctttgctagcagaagtccgcagaaatgaggaataggatgggtatatcaacggagttataggggacgcttcctgtccgggggtgcgggaatcatccggttccacgggctgcagattccagtgggggtgtgagagctagcgaaaaattactatgagaaacgaaaatgtgaagtgaatttcatccaaacttaataacctatcaataagttatagacataaatatgcagacgatacttggggcaaacggacaaatagctgaagaattagcaagggaactgcatagaaattatacgactgacatcaggttggtaagcagaaatcctaagaaagtgaatgacaccgaccaactcttccctgcaaacttactagacctacaagctacggaagaagcggttgcaggtagcgagatagcttacttgactgtaggtttaccaatggactctcaactgtggatagaacaatttccaactatgatgaaaaacgtaattgaagcctgtaagaaaaataaatgcaagttggtgttttttgacaatacctatatgtatgctaaaactagtgaaccgcaaacggaagaaagtccgtttgtgcctgctggacaaaaatcaaccgtgagggcaaaaatggcaacaatgttactagacgaaataaagaataaaagcattgaagcggttatttgcagagcacccgagttttatggcacaggaaaaacacaaagcataaccaacacgttgatttttgacaatatcaaacagggcaaaaagctgaaagttccactcaacgacaatacaaaacgaaccttaatttttacccctgatgcaagtcgtgcgatggcgctaatcggtaatacacccgatgcgttcgaccaaacgtggcacctgccttgtgatgacaacaggcttacctacaaagaattgatagatcttgcttcagaaatttcccaaaaagagtacagttattccgttataaagatgttcttttttagattagccagtttcttcagcaagcaagcaaaagagttgcaggaactcctaccgcgatacaatgcagataacatttttgtttccgataaatttaagcaaagatttcccgaatttaaagttacaacttttccggaaggcattactaatattttgaacgaacaaaaaaacgaacaagaactatgactgtgcaaattttgattgtagttaccagtgttgctaagtatgaaagcggaaagctgccaacaggcttgtggttaagtgagttgacacatatgtatcatagtgcaaaagagaacggctatgatgtgacgattgcgagtccgcaaggcggaaacattccgcttgaccctgaaagcttgaaatcaatgctgattgacaagctttcaaaggattatgagacaaaccaagactttatgaagttgttgcaaaacacaaaaagtttgggtgaagtcacaggacaacagtttgacgttgtttatttggcaggtggacacggaacaatgtatgactttccgaacaacactgttttacaaaacatcatcaaagaacactatgaggcgggcaaaattgttgccgctgtatgtcacggagtttgtgggcttttgaacgtaaaactgtctgatggcgagtatctaatcaaagacaaggccattacaggatttaattggtttgaagaagctatagcaggacgcagaaaagaagtaccgttcaaccttgaagcagaattgaataaaaaaacttcaaaatacgagaaagcttttatcccaatgacgtcaaaagtggtcgtggacgggaacttaatcacaggacagaacccattcagttcaaaagaaattgcgaaagtggtaatggaacaactgaagcaataaattatgcaattacgaaggtgaaacctaatcgtccaccttatccaaagattaagtggttccttaaggggagtttgctaaaacttcccgcacttcagcttttcgttttaacttttttgttatagtttggtaaccaaacgtacagtgcttaaattactctaaatatggatagtatatttgtgatttgctggtctacgatacttgttagctctttaaagacattcattccaaaggttaatccggtatgaatccccgatcactggtgggcatggtgtagagatgtattattctggtcacgatgcttggttatctctgtgctgtgcctaatcgaactgccttattgcacaatcattcaacgtctaaccaggctcatctctggtttccacgtaaaacacctgggccttacagttccatctttactcatgtctcttctccgctccagcatctcctcaacaaggactttgagaactgttttggccattaggaaagcttcaatcacctccgatgcggatcgaaacgccgttgaatttttctacaaagtacacaagaacccatcagtttacaaagctctcaatgaaacctcactagtattggccgaaaagggtattctcggcgggccggacctttccatgcaacaacaattgctgctggttgccgattcagatattcgaacagctatggatagggtcaagaaggaacttaaaaatgctgatataccagtgactctcgatattatcagagactttttttctttctttagggaaaagaaggagtatgaagttaaatagtgttcactatactctcgaaacaaaaattatttattctattcatgatatctggccacaatagcatcaaattgttcaaccctagcctcataatctaagagatatgggtggttggggttggattgcttaatcttttctctcaattcttcttgcttcgaagtatctcccttgaggattcctatcgtaatttcattggcgtacacgcttggatccagttgtattccgtgtaactgggccacttcatacaattgggtaacgatatcggcagattcttcaacatggtgtaattgtaaactaacaaccaacagtcctagtaaagtttcaatagacgtgtgttgttgagagatctcttcaaaaaagtaaaagctggactggtatagagatcccccaagtgtgaggttgacccaactttctgccaaattgtgtacaatgctatcttgagcccatctcgatgagatttccagttcttgttgagcctttttaacccgattggtaatcaagtataactggactattagggaaacacactctaacgaattttgatgcaagtgaagcagtgccagactttcctcaacacgccccaacttagccagatatattcctccaagaaccagactcagctctgaatgtggagggctttgtataacagcttctatcccagcgttctcagaatcagcacctaattccagaaagtcaacaaagtcttgaaaaagttgagaggattccgaatccagtgacaaatcacgggctttctggtatttcccaagtccgatgtaagctcttacaatgtactctagagctttctctctgtttgtctccgaaaaggataacaagtctgattcgatgacattgacgtattgaccagtgaaaaactgctgtctaatttgatagagctctaaaaaaggacgatgttagtcaaatacagttgaaaacaacggtaaacagtgctatcctgtcattgaaaagttaaatgaacttaccaccgctgtcagagaatgaatccatggttgttgtagttgaatggaatgagcctcaatacgtggcgcgatagaggcggtggcaggtaacacagatttcgaaggttgcgcaccaaatcaaacacaagtttgatcaagaatatactgaagggaagaataaatcccaaattcaatttagtgatatatagtctaaaggtattctacatgatcttttgcatatcttatagcatcagttgcagatgtaccggtaagtccatgctttacacgaacatgtcgagaaagagcatctccacggctaaaagtcttcttggagatacgagggggttgatctggaagaacgacccgggccaattcccctgattccgtaggaacactaacgaacttgcacccatcgtagtaggcgggaactctattctcatgtcttaaagcatccgtttcacacagaatacatcgaaaaatcttcttgcgttccgcatggatggtttcttgatgtctgattaaatcatagggtctagaaaactgcttgaaacatttctgaccggtggtaggatttacaagttgacactggtggacgtcttcttccccggaaggagacgatggaatcttgaacttgatttcttgctgcttgggggtgttgttctcagaaacattggatcttacggagtttgtaccggtagcctcctgggcttggttggagatgggggaaatgactggggaacttcggagtaattgtgggggaattacagaattgccagcttctgccaacccagggttgatgttaatcatgcttgttgtattgttttcaatgttgttagttctgttggtatcatcgttctcatcctcagaaatatcttcctcaaggaactctttcttgaggtcgaaatgattgatctcggccttgtcttcttcctcgggataaatgtagagtttggaggatgtgtcattcatttcaaaatcaaacggattacgccctaaaatttcgtcatcgggaaagctaagttgtggatcagctttctcagggaatcccttaaaagaactgagcatgtaattcttgttataatcctcaactttttgaaatggttcatatccataactaagagcattacgatcggcatatgcggtgaatggtttgacctcgtagtcataatcataaattacctcgtcatcatcaaattcgtcgtcttcatcctcaccattgtcttcttccaaagggggttgagccggatcattctgttgcaaacccatcatgcctgtcatatcttgatctttatcttcatccatggtatccggtatcgttaggaactcctggctcccatttatggagttagtatttgaccagtatgcgccagaatgggaaacgacagggctgtttgatccgctgcttattctgttgagggctcgggaataatcctggtacaggttcatttctgtatcaatattcgtgttgcttgcgtacatagatggttcggtcatatcagcatcagcggtcgctggaagatccggtacatgatacagctcatcctccattatgtctgtgagagttcgtctaagtttcggtaaggctacttgaaatgtcatggttgatgtagtttgtagtggatgaaaagtaagcaataaatcggtttggtagtaggctgtttctctattgagcgtgtgcttgagctcttgcaagtaaataaagaaagagtagagaagaaagttggttgcccacacttggtagcttgttaagtttggatggtaactccttgttccatcttcactattagtaatggaatacgagacgggtagtacactaccgattattttctaagccgaaaggggtaagaaaagctagaatgttctatacgagaagttgtggcgtgtctcatgtcaaacaatacaatatgaattacgaagtgcggccgagcaaggaagcaaggtccagctgtccaatgagaagttgttttggtgttttgaattccagggttcggatttagataaggtatttctcaaacgagatgagggagatgactcaatgtggatgcatttctgttttgagttatttatgggtggtttgataataatagatttgagacaccgtagtaggattttgaaacagtatgacaagataagcaatgaacctcaggaccgtgtgcttccgtgtttctcctctctgttgaaagagtcttccacagctgtctggtgcaggcgtcaattctgacgacaacttgcaccgttgaccacgctctgtacaacttcttttgcctcgtttagaggaaagaaggaagcctatttaccgtaaactcttagaataatttttcaattgtatagtcagacttgataaatctagatagtcaatcaccctcaaactctacttaatattcgtaaaaaaaactaaaatgtggcatccattgtgtagtcatgttcaatacctggggtaacactagaaataaacttcaagaatattatcaagtactgatcaacacgaattccttgctgggtagtgtctgatgtgttcacatcttcccattcatcattattatcggcaattccaagtttgtgcactccctccgtcactgagctagcattttgaatacttctttgagttgctctggccattaatactcgcattacgttggcatgcttgcaagggtgaactgacacagatgtggtattggataagaatggggctttttcaatggtagctgtcttttgtcggtaatccggcgaaatgtcctcaaacatgcggtctgggctcaaaggtgaaccgtcagcatcaaacccaacaaggtaaagctttggcactcgatacgaagttgagtacgtaatgtacaggtcgtagcttcgtttgttggcgttataatggtgttggtgttgatggtcattgtcttcattatcaatgtcagcagactcatctattagggcgtcaatatcgttattttcttccgaagctggacgggcatcagttgaatccgttccattatcatgtaaacgagatttactagaaagtttcttgaatcctacagcggcgttggtccagccatcttcctcgtcatcatcctctgtatctggaccgccaccgtcggcttgttcctcggttagttcagcagcccttgcgtaagatggaacacgatgtgtgactagaaactgcttatcatcgggaaggaagtctctctttttgttaggaggagccgatgaccattgccatgtggggaacttatacacgaggtaatcaccagcctccacaaactcttctggtgtgatttctccggtttcttcaaaagtcgatttatgagtcacgggggtaagatactctctccacgagcttagggttgatcgtagcattttgtatcggagattagtaagtgttctaagttggctgtgtttgatatgtgcggttgggggtaattttagtgttgacttgttattcaattaggttccctttttgtgctggaaatgatcaaataaacgataggatttattcttgctgcttcttaacgattgattgaataaatcttaattctgtgtgacctttgtactggtgtgtcacgcttagaggataagagagaggaagaagagaaatgtattagataaggaacgatgaggccgccgcgggatgacccgcgcctatcgcaaaatggcgactgactattatcttacctaagattattgtgttcaacagcaaatttgtctattcttcatactctcttcttgctgtctggttcagtagttttttattcggatgttctttaatcgaatcatactggccaaaagatttacgcatcgcctggcgtctgcttccccaagactacaaaatttgagaagtctacctttaaaaccattttcagaatttctgactgatacacatggaaggaaacataattacctcaggatctccattacagaaagatgtaacctgcgatgcgtttattgtatgcccgaagaaggagtagagctaacgccttccgaggaaactttgacgagtgacgagattattcgtattgtaaaattatttgccagtcaaggtgttactaagataaggcttactggtggagagcctacggtcagaactgatattgttgatctagtccaatcgatcaaacaagtgccaggaatcaaagaaatctgtatgacgtctaatgggttagcacttcacaggaagttacctgcattgataagaaacggaggtttgacgtcattgaatctgagtttggatacattggtggaaggtaagtttttattaattacaaggagaaatggattatccgcagtgttaaagtcgattaataaagctttggagttgggcgtgcctaaattgaagatcaatgtggtaataatgaaaggtgtcaacgaagatgagttgctgaacttcgtagctctcgccagagataaccagatcgaggtcaggttcattgaatacatgccattcgacgggaacaaatggtcaaataacaaaatgatcacttatcaagatatgctggacaatattcgagtcagttacccttcaattcgcaggattgcccacaaaccaggagatacagccaagttatttgaaattcctggatttcttggaacgataggtttcattacatctatgacagaaaacttttgctcgtcatgtactcgtttgaggattaccaacgatggaaatctgaaaacgtgtctctttggtaatgatgaactagatctgaagacacttttgagagagggaacctccgacaagaggatgcttgaggccattggtgcagcagtgaaacttaaaaaggcgagccatgctggacttggagaccttgaaaacatgcctaaccgtccaatgattttaatcggtggataatcacaactctctgacactaaaagtagtttattaacatactcaagataatatccgcaatatcaagcggaataattcgattcgatcgtatagcactctctcacacactgacaagaaagggaatgcccatatggtcgatatccacgaaaaatcgataactcatagaaaagcaacggcatttgggatcattaggttctccaataacgttgcggcatcattgattgaacaagattccaacaaaaagggtgatgttttgggagtaagtcgcatttcaggtataatggcagtcaaaaacacatcccagctgatcccattatgccatcccatcagcataaccaagattaaagttacattggagctagattccaagaataactctgtcacttccgaatgcactgttgaatgcgaaggaaaaacaggtgtggaaatggaagcattaaccggatgcacagtctccctattgaccgtttacgacatgtgcaaagccgtcgacaaagacatgatcattagtgaagtccaagtgaccgaaaaaaggggagggaaagctgattatagtagtagtcgtaattcttagactgaaatagacatccaacatcttaggtgtattttttgcgcggcctggatcttacacgcgttcttcatgctctctgtcttgaacgttaacaatctctcaactttgcaccgtgatgaagtttggggtttccgtatttttgacaataatctccctgtgtcaattggcactcggttcgcaggtcacatttgtgttgggagcccaagaccgggaatgttattacgtcttcaataacaaaccaggaagtaacatcggttattactttgctgttcagtcaggaggatcctttgacgttgactaccaaatcaaagcccccaatggaaagattattgtgaaggagaacaaacaaagacaaggtgattgggttttcaatgctgatcaaaacggagaatacgagttttgcttcagcaatggaatgtcaacgtttgctgaaaaagtcgttgattttgagatcaagttggaggacgatgatttcagggcagcgttacctaatgctccttcccagcaggttgccactgacgaaattcaccgtactatcaactctctggaagagaaattacaaactctcactcgggattaccagtattataaaacaagaaacaaccgtaaccagtccactgttaaatcaaccgagtctcgtatcttttacttttccatttttgatgtattgcttatgtgtggaatggctggatttcaggttgctgttgtccaattgttctttaagggttccagaaaacaattggtgtaggctatttttaaactaatggatatataaaaatacattacactacggtttagttattattattcttgcgagaacggttgactaatgttcgggctgctaattggacagtggggcagtaatgattccttagaagctcgttttcccagagaatagcacaagcagcattacttctttcaatgttatctgtctctgcgttgtagactccgttggctatggtatcctctgtcgagtagagaccggcaacatcactaaatctacctgatagcttttctatgaacttcagcaatgcaatagtcgttttctcaggagtatgtaacattgtcatgtaaagtcgcttggtgaatgccattacacgattagatgtggacgatctggacgcaaagaagattgaatctaaagccttcagaactaattcagccttggtagacacgttaaccgaaggtcttgtggcaggaccatcaactccggttaggggatcagctagtctcaaagatttgtgggaaaactctatatcagggtcttgagctaccaatggtaacacggcgtagagagtagtaacaaaactgctcagatcgatattcaccttatgttgagagtggttagataacagagcaaatgcagtcactacacaaagaagcacttgcctaatttcatcacctgttaagttgttgtctgatgaagtgctcagtattccacctgatagttctctcagtacctgcaaaaagtcccctaacatgtcaaagttgaccatatgaccgtatctagctaaaccttccaacactggagccattagagactctggtctctgttgtagcatatctagatagagctttaaaagtgttcttaatatttcagcctgaaatttttctctctgttcagcagtaactgcttcttctgcctttttcagctcttcatcaattttttgcaactctttgcgctgtttacgttgtgcattagacaaatgaactctgtctttcttctttagcttgggcttctcttccgtttccttgctcatgggatcgtagtctctcaaaatggatgcagagagaaatatgttcaccagtgattcatcgaccatgtaatttcttgatcgaagtctcttggataaaattcgaacaacgtcagctgaaatgtcacctctatcaatatcatcggtcaagagattttccaaagtctcaacacatttcttgaagacctgaagatctttctctccttgaggtttcctacaaacacgttttatcaggatatctatcaactccgcacgataattaaaaaatttcatcgactgggcaagttcgcaaacagctatacttgaacttctacccaagctaatttgatgtggagtggcgtttgtagtggtggagaatgttctggtagctttgtctaaaagatccaaatatgttttgaaatgaattaccaagctttgctcaaaatgacgaagtcttccaacgtctttggaaaccttctctttcttctccaaatctgtaagcggccttattcgatacgagggagccatgttcttgaaaataggtgtcaatgctagtaatgcaagtttcgatacggtggtgtcctttgattgtgccatctttaagactttagtaattgaatcaatatgttcctctgaatcctctaatagaagctctgctaattttggaaatttcttctttaacttggttcttcttttctaatgggtcaacagagtaggtcgtttgagatttggctacctccttggacagatcttttggatgttgttcttcctgttcttctacgttctcaagagaagcttttttagtaacctgtttgtctctcatttttctttcaacacgaccgtcttgtcgcttgatgggaagaccttcttcctgctcattagagtaattcaaagatctagactgcaactcgtagtcctgctcttcattttcccagttgtcatttcttggttgagtagaattgttacgagtaaatacacctagctttatctcaccgttaggattcggtttttgtcttttcttgttaccagacccggtagtcttctctcttcttttagccatagttgtatctagagcctggctcatcttaagagggaaaaaattattttaaacggtcgtgtactgtgtctgaaaaattagaacacacctacctaagtattttttttcctagtgcaagaaggaactcatctgtatagcaaaagggaataaaatgagacagaaaagagcaaagtcttatagaaaacagatgggggtgtatttacacgcctttaaatttagggagccgtaccagactttattggacgaccaaattatacttcaatgtcatagaacagcatttgatcttgaaaagggactgaatagaacggtgcaaagtgaagtgaaacccatgataacacaatgctgcatgcaagctttatacatgtctcgtgacgaaggtgctattgagatggccaaaaggtttgaaagacgtcgttgcaaccacaattacaaagagcccaagaccccatctgaatgtattgaggacgttgtagtggtggatggaaaaaataaacataggtatgttgtggctacattggatgagggacttagaaacgcacttagagtgattcctggtgtgccactgatttatataaacagatcagttatgatcatggagcctttgagtaaggctagcaaagcggtgcaaatagctgttgaatcaggcaaactgactggaggtttgaatgatgcgaagctcgctggtttgagacaaaaggatgatgggttggaggctgaaggtgctccaaagtcgaaaaaaagatctggtcccaaaggtcccaatcctcttagtgtgaaaaagaagaagaaggaacccaaacctctcaatgataaagaaaacgcaagcaagcctggaaatactgaggaagcgcagccgaagaaaagaaggcggaagcatggaaagagcggagaaaagccagaagaaaagtctaaagaaaaatctgacgaaaagtctcagcagaataatgaggccgatcatgtgggcactcacgcagaaacatctgcacaagcggttgaagaatttgagcaacattcccaagatgattaatagaacacaaatgtcataaacttgtaatatcagtgaaaacagtgctgtatcttgtagtatccattttccagattgcctggttccagtatcatctatcttctgcttcgcgattaccttccaccacctcaaattgagtactttctaatttagcgtcgcacgttgcttacatccaactatgttggtaccacctgataactatggtctggttgaggatggactctatagatgtagcaagctagatgcccttaattgtgcatttttggaaactttgagactgcaatcaatcattttgttagatcctgagaaaccccacaaaaagctcagacaatgggcagaggaacagggaatagttttgcatcaccttggtgggataggaaacagcaatagtatgaatcctgttcaagattttagtataaaaaaacaagactggatgcttttaaagccaacaatggtcattcgcatatttgaactgatattagaccaaagaaattacaatatattaatcgttgacaagactgaaactgttgttggtatacttcgacgaattcaaaaatggagtttttctagtattattgaagagtatagattgaatgctggtggtaaatataattattttgccgagaactttttggaactaatcactgttgagctgaagtcgtatagggaggaggtcccaactcaagaagatcccgaagctgaaacagctgatgacaaacaaaccaaggcttctccttcagctactcctgaggccgaatccgaagcaatatcgattcccagcaatcattacaggcgaatgagtcacggaaatagcttcaacaaatttaggaacagcttagaaaggaagctttccagtgatggtgcagataatgcggtagaagaagatttatcagagtcgttgggaaaaagattatcattatctgtttctcctcaaattcctaaaaatttgctaagacgggttgaacagagaaaacaaaagaagtacaaagcatcaagtgaatcagaatccgaaactgaagattaccgatattacaaaagtaataactatggatacattcaaaaggatgtggtgctaaaagttaagcttccacaggaagagtatcttcccgaatggtttattagagggagggatttgtgggaagctctcaatggtaacagtaagattagccgctcttcaaataatgagtctgaaaccacttgagctgttgaatactctccaaaatgtcagccttggcagtatgtgctgcctttttccttggtgcagttctcaaaagagctgggttgtgcctcttgcatacctcatagatcgtactgacgtctatcagacgataaaacaaatagtcgataactttgggaaattctctgtacataaaaaatttatccatatggatcgagtttccagccatgacaccagtgtttggttcgatatgctgggaaatatagctcagaagttctgactcgacctgcggtaaagttttagtagattcaagaactttctttgtcagaccactcgttccatgatgttctatgcaccattcgttcatcttactcatcacatcattatcgtaatgaatcactgactcatatccttcgtcaaccacctcaagattttggtctgtaataatacaacatatttccacgatatggtcattgtagatatcaagacctgtcatctcgcagtctatccatactatcggttgctggaggggggaacttgggagcttagagttagctgtattgggagctagtacttcctgggacacatttctccggaagaggctggttaaggaacgaaacgcccgcatttgaggtgttgaagtagtgtcaatagagaagagaatagtcacactaagataatatgcaaatgcgtctcgaatctgcgtacgggaaatcaacttcataacagactacatgatacttcgtgtagatgaaccagcaatatgatgtccattcaggtttagtcgttgtatcaaattcaagcaaagatgagataaaagtttatgaaaattcattggatctgaaatctagtttcagctgtaagcacactcaagtaaagatacatcatcgtaatgataagacacttttgctggttgtctctgagaagtctgttaagatcacggatctggatagttggtttactataaactgtgactgtacgctggaagactgtttttggggtgcaaacaagctactgtttttgtttttcaccaatggaacttgtgaaatataccagtatgaggaaaacaatctcagaatgatattcaagatttctagcagcacacggccatttgtacaattcaaacggcgaaaagaatattccattgcgagtctgctggtcagatttgagcataaagagacgattttcaatttcgttgatcgtttggaccatggtcaatctgaattgataggtagtttcccattgattgaatgtttggggtgtgttactttcgggtggataggaaatcatttgtacacattggataaatcactattgggtggaatacagttgagattgtacaacatatttggtcaatgtgctttcaattatgaatgtcattccacgtcagtgcctacagatgtgtatacagtgggaaaaagattagttgttactgatacgaatgggtcaatttacagttttgatacgatacttgggttgcaactagagtttgttcttgttcacgagaaattcagagctgaggaattggtctccgtatcagactttgtctctgaaaaatctccactagaatacgacacatttagagaatgcgtgtcatatctttcagtcacgattttagatggcttaacaactattatatcacaactgcaaggacatttcaggtacgtatttgtgtggtttggagagatatcaaggaaaattattcgtctacccgaagaaagccttcaagttgaacttgtgcaagattctaacattcttttgatccttaccctttctagtcttattataatcacaatagaaaagcaggatataaccatcaaggatgttattagccacgaagatgtgacatctttccaggtaatcgatgtcacgcccactgaaattgatttattactcaaaaaccccctgaagatggataggtacacagtttctgtacctgagcaagaatctacgctaactgttagacagcctgtatctatgcataacgacgacgaagaattcaaagcattccaattgatggacttggatcagagcattaaaatgaattccacactaactgtatttttggataagtagtacactatgtacaagagggcctaattaatctacaatgtcccttgcccattttcaacttttactttctctttggaatctttatcatgtcggtatcgtccccataatatgaaccattggctacactcaactctagtaatcttcgtttcttttgttcgtcttcaaatctggtgacttcctcaaacttcataacctgtctttcagttaaaaagttggcgcatgaggccatccaaattgtgtagtaaaacacccttccccgggttcccagccatctgtacattggcgacttccatctcagtaacatgtccgtgggaattgcgatcaacgaaccataaagggctccaatgaaaatgttcttgaaaataacttcttgtaatcgttctaacctttgagtgttaccctgttgactcatctaggtgttttcaggctgagtatgagattggtcgttgagtcaagtcggagccaagtgattaaataatcataaatatcgagctatcaaaacatatccctcacacaaagaccgaggatgaaacggttcatgggaaagaaaaaatgcttaaatatgttatcttcctagctataaatgatacgtaatgcttctgactaatgagtacgtagatggacggttctctaccaactgccttttacactgctgactacacctccattcagcggattgttctcagatgagaaattaagtaggtttgataaaccttgcaacctttctgggatatcggaaccttcgtcttgagacaacagttgggaaacttgttcaaagtaatcttcataatgtttgttaatttctagtagcttctctgccaagtcagagtctttcaataataaaatgtttgtgggtttctgttgtataaaatctgctatcaggttaacatagactgtgtttagtttgtctaaggtcaacttatagtagtacttgaactccatgtgactaaacatgggcatcttgagtaacaccttgagcaagaatccattcaaaaattcaattgattttgaaacatcatattcttgaggaggaagaaagttcaacatgtagtctgacaatgcttgaaaaaactcatgcaccagagcctttaccctgaggtatgtataatcacattcagtgtcaaccttataaggcaaattacacttgatgttttccaccttatctgttaacttatcgatgcaaacctgtacggtaactgtgggtgctgcattatacaatgcctcttgcacatcgggacgttgttctactagactttttaccagtttctgtaatgattcatggtccagcgtctctattaaagtattgagcggcaattttgtccccatgatggcatgtgttctgtgttttctacttgtgctgttactattgttgggatgaaatttggttctggatttcgcatctcccaaagtatctatatcttcctggattttcctcttattcttagttggtttcgaaattacagctttcttaaacccccaaggaaacgacgtctgtaaagatgacattctagattggttggcgttctgttgtgtgtgatttgggggcaaaagttttccttgtaagcagttgcgattgcagaaaaccgaggaaaaagagagtagggtatagggcaatttttggtcgtgtaccacaatcagattgccaaatttgacaggctttatcaagctttactatcctgatactgacctgatcggagaattgcgaaggactgtgaccttttggctggatagcatcgttttgtttgggtcgactattagagctatcagatgagttcttatcgggattttgactatggttctacagaccaaattgtaatgcccggtgcgttccctgttgacccaagatcaacccgcacagtaacaatcaacgttataaaccagttcaaatttcaacgcaggactcttcagagggagttcttgtatgttttgtcagtacttacagttatagaaattttagcttcattttaccatcattccagcattttaaggctgataataattgcatctttccaacttgttgcagaactaccagatataaacacaggaagatatgatttcactcaggattccgtcttcaaatatttctgtctggtattttggcattctttttacatggtaagtgatgggagaggtcatattttcaatatttatgacgttccattgagtgatttcattagtaaggtgtctgtccctaatcttcctccccaagttcacgacagcttatcagttctgaagtcctttataaacaaccacaataccaagttggcattataccactcagatgcttcctacgtctatcaaacagccaaaataagaactataaacatctctttaatcggacaattggctgattggagcagatatcaatttatattcaatgaattatttatcctagtcctccaattagtaatgctgacattaaataccaaaagttttacactagctaacggccaagataatagtcagagagtagatatagaaggttacgtcatagacggtgatgaaagaaccgatgtttttgaggatggttatcaatctaatgtgaaagtttatgaaataactgtgctcagtaacatttcgttcagtgagctaagaaattggattttccataggataaagtatctcagagagtaagtgtatctctaaattacatctccatttttaaacacttttccctttacaaagtccaatccttctccatcataactagttaaagcggaaacttcgaccagtgaatcctcggactccaatgacgccccattttccttgatccatttcgttgatagttttaggtaactctcacgagcggtttctgggctgtcactcttactacccggtgcatttttcagtggtgaaaactcttgtgcccttttgacttccagacttccaaatttctccaaaggaattgatgggaaaacatcgaatatgaactgctccaatttgattccgttagggttttgaggcttgatgatctctcctgaattcgaatctaaacaagcaatttttttcttggcaatgtggaaaggcagaactttccttgaattgatccaagaagggatttctttcgccaaagtagctaccttataatagtgattaacgatattggctgccttcaatgataaagtaccatcctcgtcccttttttgcgctaattcatctgaaatttccgagtactcaataacacacggtcgtttagtttcagaatccagagcaattaaaccaacactctcttcagggttggtctttcttactactttggtggcaatatcgtaatcgttggatgctgaccaaccaatgaatactggatcaacaatcttgaccatcacattgtcaacacaatacatatgaatgtgttcaatgccacgattattgaaatcagttaacaagttgttatcatagatcgccttgtaaagacctccattcccatctggggattcgcagattgatgatttcgactccaaaagaatcttttcccctgtctcgttaaaacatggtagggtcccttggttgaaaaaaacgatattttcctgagataatccaaaatagttgtggtctttgaaaaatttttcggtgctagctctcgtaggagccgatgtcataatataccatggaacaacagctttcgttccaaatttagaattagcgagttgtgtaatttttagcaacctttcagcttggatctgaaacaaggaatttccagaaggaagcccaatgtcgtagcaaccttttggcaaagaagagcctaatcttgtcccttgtccaccagccatgagaatgagaccaactttgccctcactgataagtttgaggccttgatcttgaaatttccgcacgcgttgcggatcagttttgtcatctaaagttgagaatgtagaagtggctggcagtgcttcaacttttttcaagcctgttgaggcactgaacttcaaggcatccttcactgtttcaactagagtgacgggatcagaaaactgagagagctgagccgagaacgatttctgggattctggactcaattcctcccaaaattgaaataggtgggattgcccggcctgtttatactgttcaagagacatttagtacctaaaggaacaacgtaagcttggaatgaaggttgggcgggagggagaaatcagacattggtccacatacaaatagaggaaggcgcgatagatcaaaatatcaaataggatctttaatggtaagcgagtcaatatacagtataattactacattactattaatagaacactctaagtaaggggaaatggcaggtgaaaggttcactaaaaacccagtctatttcttaatttcatctacagcggaagcatgagtagcttgataacgtccggaagggtcttcgtgacaaccccactcagattttggaacccaacgcataaccgtcttagcagcggcaggttgtgggaaaaattcatcaaacttgagtctgtaccagtatgcttccttggtctttggaatgtcatcaccccattcaggcttagggttagccaattgttcgtctgaaataatcttttcagcagcatcctttaaaccatcgatccatgagtatccaacaccatcggagaattgttccttttgacgccataagatctcttctggcaagtatggtttagtagttgggtcgtcagaagtgtcaaaggcctttctcaaaatgtatttttcaatgtgtccagtttttggatcaatcagtttgtcagctgggtcaatgttcatgcaaagttccaaaaattgtttgtctaggaagggaacacgggcttcaagaccccaagccatcgtagacttgttggcacgcaagcaatcagcaaggtgtaagtttttgacacgcttaacacattcagtgtggaattcaggagcggatggagcagcagcaaaatatagatagcctccaaagatctcatcagatccttcaccacttaaaaccatcttgacaccctgagccttgatctttctggaaagcaagtacatgggagtggaagcacgaatggttgtgacatcgaaagtctccaaatggtagattacgtcagagagggcatcaagaccttcctcgacggtaaaagtgtgttcatgatgaacggttccgatgaatttggcaaccttctcagctgccttcagatcaggagctcctggtaaaccaattgcaaaagaatggactctagcccatccattggaggtaagacgaccggtgtcgtcaacaccagtcaggacgtgggaagcatcaacaatgtcactattgagagcgttttcagctgctctttctgactcgcgggcagcaatagaagcaattaatgaagagtccagacctccagacagtaaaacaccatatggaacttcggacatcagtctctttctgacagccatctccaaagtctctctgactttcttgtaatcaacgggagtgttaggaatcttgttctcatcccaccaagatggttcgaagtaacgtgtgattttgtcagtctctgagtcgtaaacgtgacctggagggaacgaaatgatatcgtcacactcgtcgaccaaacatttcatctcagaagcaaagaaaacggttctaggatgagctgatgaacgacccatatatagagtagtgatcccaatagggtcacgagcagcgacaatgcggtcttttttcttgtcgtacaaagcccaggcgaacataccgtccaagtactttggggcatcgattccgtacttcttgtacaatggaatgatgggttcacagtcggagaaggtcttgaatgggtagtctttgaattcctctctcagatgaatgtggttataaatctctccattgacacccaaagagtagttgtcatctggagaaactattggttgagcaccagactcaataccaacgatggccagtctctcgtggcagatgatagtactgttgtcaatgcggtttcctgaccaatcaggaccacggtggcgaattctcttagagtaacgcaaagctttctctttgaacgagtcgacatcgtcaactctgtatgctgcaaaaataccacacatgtttgttctgggtcaaagtttctggtagattctcaggtatttatctaggatagcgatgaaaaaatttgagtcattatggacggacttgagaagtttcgcgcattgccttgaatacgcataacggaatatgtttacgagtatacacagaattctttgatttttagagctaaaaattcctttcggatgcgtcaaaagtagtacttggtccacaaatgtggaactcgtttgtctattgaaggctagaagtttgtttgtttttttttatacaacggtgtaatttccctgattgccctccaaaaatgggtctaggttccgaggtaggctgtcgcgagctttaaacaatttgatattcgggcttatctatctaatctgtcaggtgataaactgcaatgagatggcatttgaacacagcaagtaatctcgatgtctacgttgaatctgcgtcgctttcatttggcgtgggagcatagcttggaagttcctcagagtcctcgtcatcttcttcatcttcctcgtcatcttcattctcgtgcccttgagcattgggatcttcataatcataattctgctctctattctcgccgttgcccttggtgccaataacgagaccttccacaggagcgtcctgatcatcagaattctcatttctctcgtacatctcaatagttagttcatgggtaatgtcaaaacattcggacaatagagcatttagggttccctgcccctctggaatctcaccgtcaaccataaactttccatcaaccctgagattgtccaacgaagccagcttgagttgatatgggtatagctcacgcagtgaggaaatccctcccatcgtcttgagatcgatcaagcatcggcgtaccgttgtcagttggttgtgtaatggctgtaatgcttcactgacaggctcggaactttccagtaatttgtaaatggtggcgtaggatcttctgagcaaatacaaaagaatgatctgtccctttttgggagttgaaccgtcaggagcaacaaagtagccgttctggcgggcgttgtcaattgcatccaactgtttctgatattggaacaaatctgtcttacgcaaagtccagcggcttgttatcaaaagaccttccaagttagattttatctccaaaagagtattaaaaatctctttgagtgcagggtctactttatcatcgttgaataagatgtctttcactaggaccatgcagtcataatataaccctttcaggagcccttgggattccacgacaacttccttcgtctccggatcaaggaaatttccctctttgtcgatattttgggtcttaatttcattcaactccttctgtataacatgtaactcatcatccgattgaatgaccttggtatgtgccagtatactcattaaagctctgcggatagagatcaaactgttcaaaattggctccaaactctttgggaccttttcaagaaccttcagcaaagaattatattcgttcttgcattgtttaagtttaaacttcaatagttcgtgttcgtcctctctgtctgccaaactctggtccgcctcgtcctgcgatatgatatcttcaatctccttcaatctcttttcaatgggaaccaaatctagatgtgtgtatatctctgactcaccaatatgttctaacaggcgttgaacagtggataaagacacgtacgttgccggagcagtgcgggtcaagccgacggtcattaaacatagactgacgacctgaaacgtttcgtcgatcaaaagatcaactttgttaggaagatccaaatgttccaggtgcaaatcagccttttcctgtcttcgaataaccttcaattcgttaatagtggctatcatcttccggtatatagggacaatatctgtagatttcatgaacttggagtggtccatcttgagcgcggttagctgctcacgatattcaccaattttatcatatattggttgctctactttagggatttcattcgaattaaccatgactctgatacgtatgattggaagaaaaaagattaagtgatttctcctttctgtcgtagccagaacatctgattttgagcgatttgcttgaccccaggctcagctaaaagtcacgtgatggaatgttttttcgaagtttctgtgagatgtaaaaaaattaaatgggttgaaacttggtcatcttgcaagttactctatagcttcccctttttttgttgttgtttattctttgagacaagttagaaggatgatgatcaatcccaccagtagagctgtttttgggttgagagttaatctctcgaggtgtctgaggagccttccgagattagcttgccgatcatactctcagaaagtcgttcccttgactaaagagacttacccaagtactgctagaaaccaagcttttgcccgcttgagctcagatgatattggagaattcaagaagattttgtcggataagaatgtcctaactgatgccacagatctggaatttttcaacgaggattggatgagaaagtaccgtggagaatcgaaatgcgtgcttaaaccccaaacaactcaacaggtttcccagatattgaagtattgtaatgagaaaaagatcgccgttgtaccgcaaggtggtaacacaggattagttgggggttctgtacctgtcttcgatgaagtggttctttctttggcgaacatgaacaaaatcagatcgtttgataatgttagtggaatcttcaaattggatgccggtgtgatcttggaaatagctgatcagtatcttgctgaacagggttacattttcccactggatctgggggccaaaggctcctgtcatgttggtggtaatgtagcttgtaatgctggtggtctcagattgttgagatatggatccttgcatggaagtgttttagggttggaggttgtacttgctgacggtactatcgtggactctatgcattccttgcgtaaagacaacaccggatatgacaccaagcaattatttattgggtctgagggtactttgggagtcattactggagtctccattttatgcccagctcgtccgagatttactaatattgccttcttgggtcttgagtcctacgaagctgtacagcattgctttacacaagccaagaatgaactgggagaaatcttatcagcatttgaatttatggatgaagattctcaagatttggcccgtaagttcataaaacagacacatcctttggaggagacttatccattctacgtccttattgaaacttcaggatcaaacaaagaacatgacgacgccaaattggaaaccttcttagagacttctatggaaaatggtattgtgagcgatggtaccgtcgcccaggacgaagctcaactgaaaactttatggtattggagagaaggtgtcagtgaagcttcgacaattgggggtggagtttacaaatatgacgtctccattccgttgaaagacttatacggtcttgtagaagctgcaagggaacgattggaagaggccaatctcataggcgagaccgatgacttcccagttcttagggtccttggatatggccatgttggtgatggtaacttgcacttgaatgttgcagttagacgttacactaaggaagtggagaaatgcctggagccatttgtttatgaatggatctctgagcatcatggttctatcagtgctgaacacggattgggattccagaaaaagaactacatcggatacaccaagacggaaaatgagatcaagttgattaaacagctcaagaacctttatgaccccaacgggattctgaacccctacaaatatgtgtaaaaccagttagccttttatattattatcttctatatttaagcatcatcaggatttgctacccgtaacaccttcctggagtaatctgcttcatctgctagagaaccttctgacagcctccgccttcctaaggccacggggttcatttgatgatctgtatactcttggtttgggtcctcaaaagggttagtggccaacttcggatttcgtttctttgcttcgtcgtaaatggcatcaatagtggaagaggacgataagtctgatttgttgttgtgtatacgacgccacgtgaagaagaaagccagggaaaatatgatcagggcaccaacaacaccgcctacagcacctccaattaatgctcctctgttggatcctccaccgctatttccgctggattctgcacttggcgtagaaactgaagtgacatacactacagaagtaacaggatccgagcctgaatgtgttaccaccgaggtatacatttgaactgacgttgattcgtctgagttcgaagcagctgacgttgttgccacgctcgagcttgatgtggtatctgtggtagatgaagttgaagagcttgttcttgaactactggaggtcgattgcgaactggttcgagacgaagatgaggatgaagagcccgaactgccactgcttcccagcacgaagctatcgctcatagaatacacagtgtacgcgtcatcatcaccaccacagatttcctgcggatatccgacgcaaggaacggtacactcatcggaggtatcttcatccgctaatgaagaggcagaagacccacaatagcatttgttaccctcagttaaagcaaaaaaatcgtagttggcacaagtctttgcacattcacctgaactttgatatacgtattcgttagcaaagctaaatgatgagggtaaatcttcaaaacatccttgaagcttgtacgcctcgaccgtcataaaaattgcagccagggctaatattcgtaatctcaacatgacttcctgactctggggatattaaatgaagggatattatagggggatactatagtttcgtcaatagtcacaaattaagtactttgagctagagctgaatgctgaagtgctggagattaagttaggggtaggattttcaactgtttttttggtgtttgatgcaaagagaaaacctggtggaaacagaaatttcctacccttgcgctcccaataattgtacggggacgtgtaagatctggaaggagggacatagaatgaccaaaaaagtctaggctctgcacaggcgcgcactttcaggtggctggttgggttgagatgttactatatttagtttatggatgttcgagttccaagaagatggggtgccacttcttgaagccactctaattgcacgctggagacatttctggcatagcctctggttgtgtaaacgtattctatgtacatgattgcatcaagcttctttccaaataccatggaggatgggtgtatggcgatcaattgacctgtagtgactgtcctgtaagatcgatccggcattccaatcgctgtattgttgatgaaccctttcaaaaaagatttcagtatagaatccacgtccatgggtttgttgcttgtcgtgatacctagctcttcatcatactcctccgactcttgagcaagaattgatgcaccttccttcgaataaagattattcatatactgacgaagctgctcccggactcggagcacattcttgaaccctttgaaggacaaatctagttctttgcaccatctctttctctctgaagagtccggcatatccaaatacatatcaaaaagctctttcatcatcatcagatccccatatcggttacccaggttacatacagctcttctcctttcattaacttcatctcttctgtcgctggctgggttcaaaataagattgtcaacagagaggcaagaaacgatatcaatgactggctccaggcatccattctcgtgaccggtaatcaagaccgatgacaagtgtggagcaagaggcaaaacggtcatcttctcccccagatcggtgattttaccagcttcatcaatagcttgaagactgtataattgttgcagtgctgctatgagagcttcttggcctggattctctaaccagtgccagttcaaaatgtcatccacttgtaaccgttttaacatcaagacaggggatataatgtctgatcttactatctctggttccgtctgctcaatcaatttaaagtaatctgactctgtgtataatcggaagcattttccttcagattctcttcctgctcttccacttcgttgagtagctgaagctttggaaatgggagtggtcagaagcgtggataaacccaactgatgtctccaaaccttgacctttcttaagcctgagtccaccacgtacttaatgcccggaacggtaacagatgtttcagcaatattggtggctaagattagttttctttggtggtttttaactggcaaaaatactttggcttgctttgcagaaggcagagcagcatataagggcaatggcactatcctcggcgcttccttaggaagtaaaggtgcaagttggtttaaaacggcttcagctttatcaatctcttcctggcctggaagaaagcacaagacatctcctttctgttccccttgattcaagtgaactagagttttaacaactgtgtctacaatgtcatccacaggagctttaacataagaacgttccaccgggtacattttaccttcgacaaatagaatcggagcgtcagcaaaaaatttggaaaacttttcagcatccaaggtagccgacatgatgattaccctaaaatcggggtcatctttcctctcaacggttactaatgatttcagaaatcccataagcaagtccgtcaggatggtacgttcatgggcttcatctataataatcgtagaatagcgagacaaaagaggatctatcatcagttctctcagtaacataccatccgtcaagtattttagctttgtatcatttctcgtggcattgttgaaccttacggaaaaaccgacgtgggtccccagcacacaaccgtgttcctgagaaacacgagtagccaaattgatagcagcaaccctacgaggctgcgttacagctataccctttgagttcaatggcattaaaaactgaggaatctgagtagatttaccagaacctgtttcaccaatcaaaatatttaccttatttttcaaaagagtagggattagctcatccttagctttgaatacaggtaaggtttttctgatttccaataattcctcagctttttgcttgattttgcgaatattctccttagagaaactgctcttatcaaatgctaatcctttgaagtcgaagtcatcttcatcttcattgtcactgtaaaactctatcactttgggattcttaggaagttctttccctttcttttgtaagacttgaggcgaagatcgcagaatgggtctctctctttcgataatcctttcctcgacagtctcaatagtactactctgtatgaaatttggattattgccatttgcagagtctttatcggatgctatttctggctgtggggcaacttctatttcctccagtttatcaaacttgatctttttattctgtagaacggtggttttaactacacttgtgggttcgttaactactatagctgaatcattctcccgagatttactcttcttctttctcttgcttttctttttatccccattctcaacaatttgattaatatcaactggctgactaccgttcaacgtctcatctacagacatttgaactgggtactatctatctaagcagtctactatcaataatcttaaacgattttttttttttcatctaatctagataagcgcgattcagctgtggttcagaatgcttaaaaaagttggaaagaaagagtttaatcttcggagaacgattattcgttctgtgaaacttttctggaatgttttcttctccgctgtcgtctccttccggactgtttacgctttgaggaagcatctgcagatccattttgcccattatctaagtgtccgttatcgtaagacgtgtctggtttttcgaaagagaaactactcggttctgaaagctctgttgttgactccacgcttaaagagggtgtgtcttctccgatccttgggttgaatacgtcaataccctggtattgaccagaatctatagcctttctattttccttattaatgttgttcttcctctcattcattttttggtccaatttatcatttggaatgcttccaactatggttctttcatgctcaactttcgaatgtccaatgtctcttgtgtcagttctttctgccgctaaaatctcctcaagctcttttttgtagcctgcaatattcgggaactttgcgagatcaaattttgaccgtctgaacacgtcctcacattcaatcaaaaccttcattatctgtgtttcatgccattttgcttcacttgctagttcacttagcgtttccttaattgattcatctttacttgaagtcaatatttctactttctttgtatttgtccttaaagctgagaatgcttttcctaaatcggcatttgtacctcctaaagaatccacattttcttgcaaccttctttggttgtcaagaacgaatagatcaaaactggttctcagtctgttaatctctcgctcataatgtctcctataagactcctgaccctctgatattgtttcatacgcagttgctatcctttctaactcatttctctcttgactttccttcagtttgacgtcattcaattgcttcttaagatctgctatttcggtctctgcagtttctagtctattcattgcgtccgtaaattcatgttctaaatcagcaattttacgttcttttctacgtagcatggacgccaccgtgtcttgttgatacttggagttttccaattgatcggtgacagagtccagtcgtttctgcactgcgctatatttccttttatattcgtttagttccagattagactcttctaaactctgtgaataagaattgatctgttggtggagcgactcaatgactctggaagtccctgaagactttgtaggagacctcaatgagtctccaaaatcactcattaaaaataaactctaaagagatattccactgatgcacgaaaaggtatgtgtcactatgtagccgggtaatggcactgaattgctacccacatatacgatagtagtgtcaaactatgacaaatactaaagattaaatgagaccaacagttcggtttcgtgtgaagtatcacaggaattaatgagaacgtaatttttttttgcttattttgtatgtagatctgatagatctcacagagatcaaacgaaaagcggatgtaatttgattggaatcaaaaatataaatgctaattggtcagtatattatttttaacctgaatagacaagactataaactacaagttgaatcatgtcgatatacataaaagccagctgataatagtccaaacatagctttataacagtttgggcgtgtggcgtagttggtagcgcgctcccttagcatgggagaggtcttgggttcgattcccaactcgtccactttgaatttttgttttcatatctacgataacatacgattctgaaaccagtcctgatttaagcagcgatgcatgaagttattgacacaagttcatatgattattactgcatctgaaaattgtgttgcgctaataatttgtattgtacagagttcaccaagcccttcaaatgacacggtgaattctttttcgtagacagcaagggaaatgataattccctaagtgcgatcacctaatcagtttgccaaacgccgaggaaatattatcgtggcacagagattgatatgtaagacgattcccggagccagtcggatattcatgcgaaaagcctccgatcaataatagagtcaaatccaatatgctcagccacttaagtttatcacaaaaaatttgactggttgctacctaacattctgctgagacgaacactctttgatttacgtggcacctggtagttctcatatgatgttcaacccaaatctgatatctggtatcttgtgatgagctagttgcctgtgagtactattattcatccctgtatgtgaacaatctgcggaatattcccctttgggaaatgtgcgatggtgtgcatttgaaacgaaagaaaaaagtaaataagaaatttacgaaaagaaccatggtgaggaaactaaaacgacgattataaaccatagaaaccacccctaaaacagcagctaagattccctaggggtttaacgtccgccgttcttctttttattgacgatggctgtcactcagatattttctctccccgattttaacgaggccataactcagaaaggtgtagttgtactggacttttactctcccatatgtgctccctgtgaagttgtttctccgctatacgaaaagctctctcaaaagtaccctgatgcaaagttttacaaaataaatggctacgaggaaccaggttcctccatgcaggcatctatcaacgtcgtgtggtggcctacatttgtaatcctcgttgatggacaggagcagtggagggctaagatcccaaatcctccccaacagtttccgacccaggagttggacgacaacctcagcaagattttcagttgataacatcatgagatggagatttgcatagcggctaagtggaaagttgacacctagttgcatacgtaattagcataggcatgatctacaatattatattattatatcattaatagcttcatttaatccccctttgtaacaggaaggaattgcctctatttttcttttttcatctaagtgtgttcagcctctgtggaagttgagatacatgttgttccactcttgtacaaagtagtcttgattagtcagatcttcccaggcagaggtcagttgatctccaaatgtactgatattgaccgagttgaacgtagacacacccggtctttgagaagctgggtcggcttctaggccttgatccaaaagagcagtgttatccccttggtcaactttcattctgacattaaatgctttctctggttgcattgccggaatttggcttccactatcgcaggccagttttgaatggacattgacgtctgtgtgaatgttggccggtgagcttttattggcattgggatcgacactggcgttgatatgcgtatcattattagcgttgctaatgctttgatctttttggttttgttccgattcctcctccagtttcagttgtctctctctctgtcgcaggaattcaatggactgatttacgatgggcaacttatcggaaatcattgttccaaactggttgacatagtcaaaatataatgtcacatcgttgcttaccacaagattattcttcttatgttcggaatgaaactttgctgtcttatcagcggagttttgacgaggattgactaggaaatctactgaacactttttcaagtagttttctgtactctccttaccaccaaatacgcctgacaaattattaacaattcggtcacttgtatttggatcatctgtggtcctatcagcggaagatttgggtaaatgttgaagtgtcctctgcttcaaattactacagaaggagcttagcatgcgtaaaccagtaaaactttgttcaataatatcgggtctcaatataaaccccgattcattcaaaaaagtcaagtcttgcaagaacatattgagatcgtcaaacagaagcttttctgtctcatcgtcatgtatgccatcctttatcatcatcaacaacaccattccctgagtaacagatcccgtaaatgattgatgaagttgcgccaaaaacagtggattgaactctttctcggggcgcatggagttgttaaagttgtatcgggaacgaattcgtttgtatacgttaaacatgcactttgcggttgagacgcatacctcccaagctatggggatatccctttctaaataattttgaaagaatctgagtctatgaatgcatatacatgtgtgcaacatgtgaaattgaaacttaagaacttctggtgtgaaatctggaaggttactgtgcatgtccaagttaaaaaaccacggtaaatttgaaacgtaggtacaaagttcaatatccatctcgatcaggccccttagtatatcttcattcaactcgtgatcttcaattgaatctgctttaaactggttaatttcaaacataccattcaagattttcatcatctgggctctgtaaatattgaacgagttatcagtaggaatatcaacaccactgacttgaatgaaatcatctccaacatccttgtcatttacattagctggaagaggaactcttgacttgtaagaacgaatcagaggaggtctacctgtgcagagagctcggaatgtgtcgcagccagcaatgtcccaccacaatcgtcttctcatctctgtttccaagggggtcttggattccacttttggtttattaaggttgagggcaaaggcggttctgatggccgccgccaaaaatgaatccaaatggtcactttgcttcgttgcgtacaaataaagttgcaagagcgaaaagaactgcagttccagcaaacgtggattattatcatctctcacgtaggtaaacaattgcttggagatacttgcccatagtctggaagtaaacttgatggtttcagggtttgaaaatatttgatatatgggattcttcagataatgttgaggcagatgaattaatgaaagtgctaatagttgtagcagtaccaccaaccacaagaggtccatcttatcatattcggcagactctctaacacgaacgaattcatcaaattgcctattaaaggttgggtgatgcaatggatggtagatataatcaacatactccaagtagtaatctttcaaagcccggcaaacctcagagcttgggagtaattgtaaaattttagtcttcatctcaatctccacctcatggtttgcgagtgtatccagttcaagccggagaagcttcaggatagtaaatgtcttgtcaggaggtccctcgtgatagtaccaaggtaaggcctttatctgttcaaaaaagggtacttccgacggcgcactatgttgttgcaatggtggaggttgggagatttgtgaggtattatattcatccacatagtttgaaatcggaggaggtctctggccagagtcagcgccagggcccgaaatttgatttgggtaatggccatactgagggattcgactctgaggcggcgcagggggaaacggaagtggaggatggttggacaatgaatgttgagaggaagatcggatatggttcatttgagatgaatattcataccttgggacatcaccgttatgcggaacgcctatcagagtttcgggcttattgttgttttcgtgttgccgttcggctcctctatcgggctgagtaatcatggtattgtgaacttcaaagttgccaatagctgtaccacccccaactgtgccagacccttggaaaacggctgcatcgtggggttgtaaaggtctcggatccgttttccgcacacgcttgaatgcagcgttgggggccgttaattctttgaacttgtcgaacatgcgaggcgggtccgccaaacactgttccactctgttattcttgacacaacggccacacgggatatcatggtcacacttggtcttcaaccgcttacatggcccacacgagtagctcgtcttattacgtttcggcatgaaattaagtggtcgaaattgctgtacctctttttgcaagtgtgtttgtaagacttttcgtgcaccttccgtttttcttttccaatgtgtcaaacctgtcaaatagctgacattttgtcttattgttaaaatacgggggcgttggcgatttcctcatttggaatgtcaagtgaaattgtcagtgactttgcctcacaaagatgaacatggttttctggtagcaaagtgggctcgttttatgatttttctcaagcagatgtgtacatcgtgaagctaagcaaggaaaaacactctttcatgtacatcttacattacatttaacgcttgggacagttcctctaaattattacacggagagttccctatggggaaacttccgcgacaaggggtgtggtgtcaggctgaacgcaagcgtgtgcctagttacgatctatataacctggaactcttctctcggtaacccatccaagaagcctggagtgatcttatagtaagagacgaggaataccaattgctcaatccaccagtcctaagtttgaatatgcccgactatatcgtgggtgttgatgttggtgggaccaacacggatgctgtattgttggatccatccaagttcctaagtagcaacatcgatagtgttgtttcttggaataaatcgactactaccagggatgtggcacatgggatagaaaatacaattgagcaactattccaaaatgcgtctgaagtagacaaaaaagatatcaaactagttacaattggtactacacattttattaatgcaattgtggagcaagattcaaccaaactcgagaaggtagcagtgttgagaatctgtggaccttattctagagagcttccaactatggccgattttccacctcaattgaagaatgtcctctttggttacttcggttactgtcagggaggtcacatgattgacaaacaacccgtagacgaagtcaatgagaaggaaattgtcgaacattgcttgaaaatccagaaattaggcatcaagtccattgctgttgttgcaacattttccccagtcatcaatgaccatgaggtgaaagttttggaaatcattgaaagaaacttccccgattggaaggatcttgatatcatcctttcccattctctttcgggcttggggtttttagagagagaaaacttgaccattttgaatgctgccatcaagaaatttgcttttcagattctctcagcttttcattttgcagtaacgaaagtgggactggtcaattcatcactattaattactcaaaacgacgggacgctactgaccttagaagaagcgttagctattcccataaagacttttgcatcaggtgcaactaattctatgagaggtgcatcttttctttgcaatgccaatggagtggtttctggaggcgaacctatcattgtagtggacgtcggtggaactacaacggatgttggaatgctacttgccgacgggtttccaaagcatacgtcatctcattcctacattggaggggttcgtactcagctttccatgcccgaaattcaaagtattgggcttggtggaggttcaatcatatctattgacagagagaacccaagcaagataaaatccattggtcccgaatcggtcggtagtcagattacggagaaggctatagtttttggaggtgacacgtatacgacaactgatttcacgttagcaaatatgaatgaatccacaataaagaaatctaccaatccaatagtcgttcaggccgatatttcaaaggtaaatgacactttaaaatcgacccaaatttcttcatcatatgcgtctttgttgaaaagccagttggaaaaagttattgataaaatgaaagtgtctcctgacccgatcaaaatattactggtaggagggggttcatttattgttcccgacgatattcagctagatggttgttcagagataatcaagccgccttactatggtgttgctaacgcaattggtgctgctataggaaaaatctcatccactgtcgttgaaatggcgtccataaacgggctggacgccgcagcaaagaaagacaaactcaacgaggtaaaacaaaaggccattgatgacatagttgaaaaaggagctattagagaaactgtttctattgtcaacgtcgttaatgaagccattccatatgtgagcaacttatttcatattgaggtcaaggttattggagatgttgactattctgccactacttcgccctccgggtcaataccaaacaatcttttagatactgacttagtgattgaacagagggatagatcattccttaaagagtcgaaattgaatacgtccgatgatctcccgatggatatagatatccgcacttatagaccaaacgtaagagacagggaatggctagtgagcgagatggacctggagtttattcggattggaacctatattcttggatgtggaggaggaggggatccttataccaaagccttacaggctaaagaaatggttaaaagcggtcatgtgatgaagataattgatatcaaggatgtccctaggtttgtggatagactggaggacataaaaacagttcctgtagctgcctgtggatcgcctacagtcaccacagaacaactacagggatatgaagtactagatgcgtttaaaacattacagaagcattcaaatatgaaacccagtacaattttatctttagaaataggaggggccaacggtcttcaggggttacttctaggaggccttccagaatacaatttgagggtcattgatgctgatcttatgggaagagcatatccacttatttggcaagtatctccagtggccttgaaacagttcaagagtgaggggtccgagaataatcccttctttagcccttcctgtatcagtgatggaaatggtaacaatgtctacttatcgaaagtcaggtcagaccatcacgctgagaatattataagaagtgcattaagtgaaatgggaagctatgttggtttggcatgtagtcccatgaactaccatgatctacaacatgtcactattcccaattccctatctttagcatggaggatcggtagaggtgtgtgtttaagtaagcaagatcacaacccttcacaattgcccaaatacatatgcgactccattggagataactccggcaagttgttgtgctacgggaagattgttggtatagagaagaaacttcataaaggatttgtttttggagagttgataattcaatctgaagaaccacacgacataggaagaagaattttgattccgttccagaatgagaatctttatatcaagtacgaggacactccagaaaatgaggtcattgcatctgttcctgaccttatctctgtcatagatgctgaatcgggtgaagctattggtactcctgattacagatatggattacactgttttgttctcttacttaggcctagtacttcttggacaaaatgtaaagaggcactagaagtaggagggccaaaagcatttggtcttgacattgagtacgttcctactctagaaggccagtcattagacccaacgagtgtcattgatgagtattctaattgatatatattcttgagcgttataaaataatttaattataattacgaaactataatcatcaaatatatttttcttgtacctattgttccttattgtccaccagatctcatcatctcactgcgatgctaaagttgatacggagtttcaatcatcctatcagactgtattcttcttcaagcaacaaattcacctcgttaagtcaggcagtgaattacttgaaaaataattccgataatgttgactctcaatggtaccacaaacttctcggcaatgatgagttgatcaagagttacagaaccgacagtgaaagtgtacctgatcacttatacgaggaggttactgaaagctcgcaggaactacttaagataataaggcaaaatccggaattgaacaacgatgataagtccagattgttgaacaaaatactcagtaattttatccatattgactattctttgacacataaagttctaaaagaactggaaaaattagacaaaactcctgatgttgtcacagtaggacacatcgtcaaatacaactctggtagagtaaagacgagctttgaaatttataaagactttatgaagattgaagactttgagagccagttgaaaagtcgcaaggaagacagtgatttcttgcattctcagatattaaagaaagttgtatatggtgacaagagtgaagcagacgatggctacaaattgaacgaagaacgaatcaaaagagctttgtcattattgccactactgaacgaaaacaaaattgccaaggagatccaaaagcaactgttgacgtctagtatcgaattgggaacattacctgacttgttagaaaagactgtcatcagcagagagatactggagtcgtatattttcacgtcagacaatggcgagatatctgatgagaaccgggctcctttatgggttcagtatttccaacagctatcgaataatgatgagtcagttccagtggaaaacatagccaaaatcttgcccgttttagcaaaggccaaagggtttcagtcagaatttgattctctggttcaatacgtcggtgctaacgacctagacactaaatctacgtgggatggagttatcatccgggctaagctaattaatagtattggcatcggaaacaaagacttaattaaagccttagaatatcataccaagtatcaagatttgcgaggtcaacctctggagttcatcaattcagctgctattctggtgctaggttatcattctgttttgaaagaaaatgacaaattattgcccctgatgcatgcgcttaccccacctgagtctattccaatcaaagtactacaatgtttcatcttgacctatggaggactaggaaggacggatgaggctttggatctatacaatcgctatattggagaagtcagcaaggaaaacgatccaacaagccacatctctcaaacgctattgttgacagaatctgtagtgatggcacatttgtacaacaatgaccgagagtttgcatatctactgaacgatggtgtcattactaataaagttatagagggagatacctccattaaccgtttaaaactgcttttcaagaaatacggacaggcaatcagcgatgaaaaagacaccgaaacttccaaagaacaattaaagatccaacttctagacgcaatagagtcgctttaagctggaccctgactaccgcacctcacttcccaagaggatgattatcggggactggaacctgtctcactatggatacctcactccgcaaagtatcacgtatgagcacgtgactacatctatttttcaatattcgggggactgtctacaatgtatattgtacctataattcccactgaataatcgacaattcccacggagcaaaagaaagatggctactaatatcacatggcatgaaaatctcactcacgatgagcgcaaggaattgactaaacaaggcggtgtcactgtctggcttaccggactcagtgccagtggaaaaagcactatcggttgtgccttagaacagagcctgctacagagaggaaacaatgcatacagactggacggtgacaacatccgcttcgggttgaacaaggaccttggattcagcgaggatgatcgtaacgaaaacatcagaagaatcagtgaggtttccaagctgtttgcagactcttgttctgttgctattacttcattcatttcaccttacagggaagagagaagaaaagccagggaactgcacaacaaagatggattgccattcgtggaagtatatgttgacgttcctattgagatcgctgaacaaagagaccccaagggattgtacaagaaggccagagagggaatcatcaaggaattcaccggtatttctgctccttacgaagcacctgagaaccccgagctgcacgtccacacagacaagcaaactgttgaggagagtgctaaaatcattattgattatttattggagaagaaactaatcaaatagagtttgtagaataagatgatttttaagtttgtatttctagttcgtgctgatcttcttctccaatttcttccgttgagcgaccagcattttgacagcagttaaccatcggattaagtcttcttcatttggggcgcaaaacttgattcttttttccctagttatcagcaaaaaacaccatttcctgatcttgctcaatggctctaattcggttatatcaattatgtcattcagattgaaaacttgaaatggtttttcctccttggacttgaacattgacagcttcttgttagtcaagaccagcttgacagttttccattggttgtaagctttttgtttttccaatgttccatcttgaatgaatatttcgtttttcacagacacaagatctgtgtcatgatgttctttgatgcgtggcaaatctggattggcgaaagaacgtgcagtttcatagggagtattaggggaatctgaaaccgaactcaagaaatcgtcagcaccagagcatggaccgaaaccggcaccagactcagtggtgtctatcttcaaaccttccaggggcacgttatcaattgcttcatcagagcttgtagttgtgttatctagtaatttgtccagagcttgaatccagtcgttgtaagttttctcatcttgacaatagagtttcaatttcttcttgttgctgtaaatgatgaacttgaactttttttgcatcgatcctttatttcgcaaatagttttcattctctagtttgttaaaactcaccaaattattgatgctgatgacattgcgaggtttatactcttttgaatccttgtaccacgataactggcaatctcgtagcacaaaccaccgtttcttgtaattgtgtttcgtttttgactttttgtacaaataggaactcagccggacttcattggaagcatctaaagcgagaaggctgtcacttctccctcttgactttgactccactgtggtgtggttcacaatctcgtgctgtgggtggtgagccgagagctttggcaaatgtgatagcatgtttgatagtcagaataattgtgactgcaaaactaggtagggacggatgagtagggggtggagaagaagatctaaaaaaaagcttctcctcatttagaaaaacaagaaaaggagaaggcttatgtaatcaagcgcggttagcctttcaaaaacctgtgcttctattagtgtgactataactctttggactgacaaccaaaccttttcctttcatggctcctctgtagattgtttcaattatgtctatcatttcctgtttactttggagcacaaaattgagcttgttgttattgcctgttccaaaatcacacatcatatgtttgtttctgtgaaagaacatgatggtcatggggtcatagagttcatacatcgtgttgaaatctggcacctcatctatgttaacaaggtagcagactgcaaagtttttcacttcttcggtgacgcggtagagaatttcgtccatcaacatgcaatcagggtctgtttctctgccgaatcgaatgacaaccaggcggctatcctcggacaaaatagcttggtcaacatgcctatcatgttagtaagagatctatctgcagactgaaaaaaggacttaccatcctgtatgtaaatggggcaaaaagacgcttcccatagttagcgggtgaactagtaatttttctagttttttcttaggtgagatgcgattatggattatgtaagtactgggagtcgatatgcgtgtgctgaccgtattacattgggtctacatctgattggcgatacgaaaagagtaaacgtgaaaaaaaaaatagatacagaagcggaatccatctcaagcttatcaaaatatggctaccacagcaaaagaagtcgcaaaacggttggtgtccgttttggagtcatttccaaaggaaagaatagaacatttcgcctctttcaaggaggttcaagccgagagatttgccgtgattgctggattaccatccaaatccaaggatttgaagacaaccaagtcaaacaaatctatcgcagagattgtctcttctacattgagcaacaaaagtggtcccaaagatacattcaagactgacgctttaacgtcgcaggttctagagcagcagctggtttccgctgcaaatatttcacagaacaagtactctacatattatccaatcagctccaagctattgaaaccaaaaggtaacccaaattattacgacagattggtaggtgatttggagaaaggtggtaagcaaaaggagggactattgtccggaatgatgactgttataacgggaaagtattagggtctctaatttatacatgtacatatacctgcgcagcagtatttaattaatgatattcgactgctacttctttgcgtatgtcagatagcattcatggtttttgatttggattgtttggcccagtgcttctttgcagataacggctgctgactcttcagtaaattctattagtgcaagatttcttggtttcactaggttgatctctttaaggccctggaatttgtcgaatattgatttgatgtctgcagatgtcaactctggatccactttttgcagtaggagtaacttgttaggctcattgttgatcactatctttatacgtttagtcttttgttttggttcttcgtcggaagaggctcgtttcctattcttttgttccttctctactttcctctttttcaagtaatcttcaaactctgtcttgcccaacgtttccttcaacactgcatcgctttgggatgtagcatcctgaatctccaattgtttatcgaagagcattgttccttggagtgattgcaccgcatcgattgcgttctcctgttttgcataagctacgaaggcttgtcccttcattttcagattcttgtgagctgtgattgcgagaacatttccatatggcgaaaacagttcatctagttttttctttaaagtgttgaccgagactttttcgttcagatttcgaacgtagagactgtaatgttagtacctcattcacgatccgattatgcattaatcaggaaaattcacatacgtcgccatattaccactctgatccaagctttactctttctgtcttacagagtagaaccactggtgagcagctaaatccgaagaaaatcgactttcgacagaactatcacgtgaccagccaaattttggaaacgcaggaactggcctcagccagccccctctaaaaaataattggcgcagaaacagctggccagcctgcgcccagctatttcgtttttcgtttgcttcgcaccaaatacaaatggactccggcgaaccaaatgcttcgccaattggaccgcctgcgttacgtaatttcaatattttaagggttgcgctataaaaaagcttggcaaaggttacatcagagtctgaacttaattaattatcctgaaaagaaaaatcccctaaatagtggaatgggaagcagaactttgagcaaaaaaaatatgagttgtcgacccccgcttttagtcagagcttactcagcaggggtatctgatgtactaaggctgtgttaagtctcgcaatacgcatatttgttcaaatctgactgggtattgtgatggttgcagcagattaccgggaatgtccataattcctggagaagcctctcaaaaaaggataattttgcagattcgagagcaattataagcatgtttttttaggcactccttctaagaccgtccaccaaccccctagtgtcccataatttgctgatgatctgataactatcttttttcctttttttggtcttctgcgtttcttttcaagttcaactttgaaacactcgcattatccggaatttacttccctaaaaactttaaaactgaggcattcaattgcattagacgcagtaggattttttattcaggtcgtactgttaaatcttagcaaaatttattggacagtagtttctttttctgggttgcctccactcgtataaaaggcaacaagtccaaagagggcaccatctgaatcgtcaaataaaaatgtctgctgaatctgtgagtgataaaggctcttcaggcaccccaccagtggtaaatgaaactactgtcaataatgcgacaggcccaaagaaagtggtcccaagggtcgaaggactacgctccaacaatatccatcttttcaacctggaggaaaagacttatggtgtcaagagaattgaagttcttgctaaacagtacaagagcccacttgcttacgtcgtatttttcttctccatctttttggtcgcatacgcttacggtttggatgctacaatgagaggaactctgcagtcttacgcaacctcctcatacgctgaacattcccgtattgctaccgttaacgttgttagatctgcaacttctgccctggctcaaccaatttatgccagattgtcagacaattttgggcgtcttgagttgttcctggtatccatcgttttgtacgtcgtgggaaccattgttatgtcccaggcttacgatttccccagattcgccggtggttctgttttatggcaattcggttactctggtgttatcatcttaatacaaattatgtctgctgacgcctccactttgaactggagggttgcatgttcttttgttgcagctctgccatttattatcaatacctgggtttcaggtaacattattgaagtggcttctaccaactggtcttggaatattggattctgggctttcgcattccctttggcttgtcttccacttatcggatgtttcctgcacatgtggtttttgtccatcaagaatggtgacatgaggagactgaaggaggaggaccaatctgatttccgaaagttaggattcaagaagttcatggttgaggtattcttctggaagttggattttgttggtctgtttttgttgactttggttattggtctaatcttggttccaatttccgttgctggaggaatagaaaaccaatgggctactgctgatatcttggtcccattcttcctaggttgggcttgtattcctttctttgccgtatgggagatcaaatatgcccgtaacccattgttaccttctgatatggttaaagatcgtgccgtttggtcagcattgttcattggtgttttcttgacttttatttggtacatgcaaggtgatttcttgtacactgctttggtcgtttcattcaacgaatctactaaatctgcccagagaatcgcctccttgtactcgttcgcatcggttattacaggttctctcctcggtctggttttggtccgtattagaagattaaaaccattcgttttgtttggtgtttctggctggatgcttgcctttggtctattgatccactacagaggtgacactcgttcccacggtggtgttattggtgcccaagtcctgcttggtttctttgctggttttttcacctaccctgtgcaagcatctattcaggcagttgttgaccatgaacgtatggctattgcccttgcgctctacttgacctcttacaatattggtggtgccattggtggtgctgtctctggagctgtctggcaagatatcatgccaagagaattggaaaaaggttttgctgactttaccaacactaccttgtcagtcttcgcctatggatctccatttgagtttatccttgagtatccatggggaactccagagagaatggttgtagttgaagcttacaagtacacgcagaagatcttgtgtatcatcggtgtctgtttgtgtattcctttaattggggctgctttcttgctgagaaacccagaactgaagtctgtgcagtcattcgaactggatgtctcaaccaccactgatgaagacggtgaaaagtactatgagacagaaggctacaaagctgagaagaacagcttgtggcaacgtatgatgaaccttttcaaactttgagcacttaatttcggactcaaagtataatcataatatataattaattttatggacctccgtatttgacattattgcagtagataagtaaattatcggtatcccgactagacagtgtaccttaatatatataggctcgaatttgataaaggatctcccacaacaaaagattcaagcaactatacgataagatactacataacttttcaatggtgaatattcccgataaaccaatcaactctcacaagccagttcgaattgcccttctgggcccttcaaattctggaaaatcctctttcgtgcaaagagcggtgcataacacattcctagaaacttattaccctacgaggaacattgtgccagctgtgtttgaatttcgtccaaccaaccccacaagcagacaaatactagacttcaatgcttcattaagtcacatggaagacatgaatgctgattcttcgctacgagttggatatgctacatcagtgactcttcatcataatgagctaataagactctctgatcgtaactatcccaaaaattctactcacaacgaaatatataccacactctccaatgaggggtcacaaaaggagaatcgaacgtcgttcaaagctcaagattctgctttatctcccgtcccctctcttgtgtcgtacaatcctccctttacgacgcccattctgacagagttggtggacagccctccttacaatcgaaggcagactgtaccctttcttgaggcaagtttggatgccaaattgccctcagaatttcttcacagattggcgctagaaccaagaaaaaatattcaagttcaacctcttttagttgctagtggggctagtgaaatgaatggatcgatagacggatatctgtttttttattcttgtgttccttctctgaatcctccggaatattcagagtctcctgaaaccaaagatggcaaagctacagaagaggagaccactttcgaaaagcttactgaaagtgatgatccaattagtatactaaagtctatcaaattggctgtagtagatgcttggaaagactacaataggtataaaaagaactggctagatggagaagaatgcgatgtctattctctgtctaacactatcaaatctttgtggaaatctggcagcagtaaggtccctacgaaccctcctcgaattgaaaagacggaaagcggtagcactaccacatcctcagttgacgagaaagtgagacatgaactacagaattacagagacttaccacccgtgaccattgtctgcacacacgcagactctccattgaaatcaccggttttgatagagaaaggaaagaagctagcgcgagagtggaactgtggatttgtacttatgagcaatttatctgggtcaaacgctcaggagtgtttggccttgaccatcagagaaatagctgaaagaaacaaatccaggtccccttctaataacaaaagaaacaaactggttcagaaactgatgcaaatgaattaactgagcgatactagaatgggaacagtttttgatgtcatatgcgcgatagaggacgcgttaacgccccggttttttttttttgaaagatccctccttctcctgatttagaagtcaaaggaactccaataactccaaggaacataaacacacaaatggacagagagtccttgatgaccacgatccaagaggagaactcgggtgtggagtttagttttgagaaaggtatgtatcacttttttctcggttttccatttctgtatattcaagattagtatcactaacaacgttcaggagttcccaatcaaccaacgaaaactgaagccgatgaagtagtgacacctgttataaaatcatcaggaaagttgctgagtcccttgaatctagtaaattattcggagccaagtcctgcaaagtcaatagactcaatgggatttaagcatatcactcctttgaatattctttctgcagaacacgataaagaacataagaaggctctcaaagagatagaaattaataagagtggtgacagactttctgaaatacccggttcgtttccatatcagtccgttgatgaaattactaacgagaatgcagcagtggttgcaaatgagttggataggttgaaactgaaaaccaacaaaaagaattcaagtggaagcggccagcaattgggtcaggatgtttcctacggaaagtacagacaaagcgtggcttcctccttatttttcactgcttcttctgggtcttctagagcgtcatactctcaaaacaattcctatgcaaatgatctcgaaggatttgatgatgactcaacgagacataatgtgactgagactcttcattctagagatcatagtgatgcgtcaagctcagctttttcttatttgaaggcagccgaaattatcactgtttcgaaccaatccttcccttccaacccttccgcctctgatgggtccaagcgtcataatagatcagacagttcacctagtcattcttcaagtaatgatgatgactacggcttttttgacaacggactaatggaaccatcccacgtctttaatggaaatatgtctagccctatggcaacaacccctttagtcggaacattcaacatagacagtgatgagactccaagaatcaatcaagtaaattcaccacctcctgtaaagccaaacgatcgttcgactactgatacctttgaacctaaaggtttgaattttcgaaatacagctgtttcaactacttcaagttggtaccctccaaattccaatactaacgcacacagaaacacccaggatactataaatgaaaaactaaacgaaactgattctgatgatgcggatgcatcctcaaatcatgaaagctcacatagctttcaccctagtgacgaagaccagatgcgcaattcaagaatgagtcttcaactttcaagccaggaaactaacgatttgacaaagagagagaattcttccagtcaaatgaacaagattgtgagcaatcactcttctcaacagcctgagcttgtagatgatgattacacttattcttcattatatgttgttgcgattcataaatttgatgcctcaacactacaatcaggtaatgactcgtcaatttgcctctcctttgacaaaggagatttggtgtttacctatctggtagataaaagtggctggggtgaagtcatattactgaatactttaaagagaggttgggttccaatgaattacttcaaacctgcaataccggaaagcatacctgagcaagccaagagtctttcccccaatgcctaccttgcattttcaaaaaagccattggccagattgtttgtggcaagtgcaaagtttttactagagcctaccgtaaagcccatttactcgtcaactagcaaagaaataaaggggtattcgtttgataatggttccataaatggaataagagatggtgtccgcaggttattagaagatacgaattgtatctcgaggacaacggacgttgtgaaaagcaagccaatcattcgaaaggttcgtaagagtttgttgcgtgattggtacaaccttatggtaaaagctcaacaatatagaaacaccattgatattaccaaaattgaaattctgcaattaatggtctatcaagtagtacgcaaggccatcgcttttttggagatctggggtttggaatctgaatctattgcttctgaacctgttaaagtggaaaagatcaatcaggcccttcgatctgagaccatgacagctagcgaaggagcattgccgtgtttatctgaatcaccatttgccaaggacagattacagacgatatacaagtatagcatatcttacctatcattaatcatgggccgtttagacataattgaaaataattatgttggatgcaagtacctcgagaatttgactcatcaaatcatcaatttaatgaaggagttattgctcattggaaaaacgtgtcaggagaagcttacagattacagtaaccaccgaagtcaacttgtcaaacttgacaactcattagatacaattctgtcacatatcagtgaacttgtaacttccgttaaagtgttcatctcaagaacaatgaatcagctagcttcccaaggaaagaaacaattaatggacaattacaatcaaacgaatggaataaagaatctcgacaatgatgagaactactattatactattgaaggcggcaagatcattaaaacctgtagtaagatggttgtaaaaataggtgaagcaacagccacattgaagggtctcctagatatcacaaacgatttccagttacctggtgagaaacaacatatcgattttgattcggcaaaagtcgatgcttcagcctttatcaaggcatgttctgagagtttgatgaagaataaccaaattagcgccaaagtgcaaaaacatgttcaatctaataggtcagtttctgccagaaatgtacaagacaaccgaaagtcaaaaagattttcaatgtttaaaagtggagttcctggaggatttgacttgaaaccggaagcattggactctttgtcaaactttctgcctgatgtcacaccttcatctccgttcatttcgaatgatgaagagttcacaaagtttcaacacgcaaatgagaattcaactagtgatgagcttaaaggttacgagtatcgtagtgatcttaacaagtttcatgacatatatgctggagtggaatcagagattgtcagaagcaatgaagacggtacaattcttggtgcatcattcagggctcttgtttacatgctcacaaacgaagcaacacctccaaactatttctttatatcggtgttttttctaacatttagaattttttccactagtaacgatctcctggaagaattagtaatcaggtttgatattgacgacaagcagttgaagaatgagtccaagatggaatcagtggatcgaaccacagccgatactctcacattaaaatcaaaacttacttctagaagaaggttgatttgtaaaacgtttcgattatggatggagagttattggaaacatagttctgattatcctcttcttgcaactctcattaattttttcaatgaaggtataagtgaatacttgcctcttgaggctatgaaattgctggagatcgcttctaatctgatgagcgatcctccagttgagaatgacaaggaccgcttcgaatactacaacagtatcgctaataccaagcaattggtcaaacgaaaaattatcgatactcgtgaagctagaggcttctctggcttgtcttttttgtcatcaggcatcgaagatgaagtaaacgaattggaaagaatcgaaaccactagttccatctcttcaagattatctcaaaaatcctttgccttgccctcatccaggagcttagttacgttaggctccttactatccgaccaagataactctaagattcgtgcattatgtctgggttatagaagaatgttacaaggacattggcaggccaatacatacaacgatgcgattagcaaacagtttccaacaatcgaaacagaccaacaaattgaaatgtggtggaaaatctgccaagaaaggtggaaacttccagagacacctcttactctattaaactttaatattaatgaactggccaagcagttgacacttcttgaaagtcggttattttgttcaattaaagttgaagaactgctgaatcaaaactttactgccaagaaactggaccttaatctctctcctaatattcatagatcagttttgttcaccaattgtctttcagaatatgtgctagacagtatactaacaccaagtctcagctcaaaacaaagatcgggtgtattcaaacaatggttaaaggttggagcatcttgtctcgagctgagaaattataattcactggctgctatcatgacttccttacaaagctttttactaacgagaattaatgaactgattccctcgttgtctactaagaacaaggagttatacgactatcttatcacaataatccaccctgaaaagaattactccgtttatagaggaaaactcagggcatttttggagtcctcatcctccaagattccaatcgtaccctacctgagtttgtttttgcaggatttaacatttgtggtggatggtaatccaaactacagaaagtcaactagtaagctacttcctcaaaagttgatcaatgtggacaagtactacaaggtaacgtccatagtatctaacttagaagagttacaagttccgtacccagacattccacctgaacactctaatatggataacttattcaacaaactgcagggtcaggttgtaggaagaaggttttctgtgttctcccgaactagtaaagctagtggtattgcactaagtgagaatgctctcaagtatggaatgactggaattcttgagttccaagagcttatactgttagagatttggaaaataaagcagttaaacctttctgacgaagacagagcttggaagatgagctgcaagattcagcccagaggtgactgaaatattataactttctattgaatatttctctataaatacaggacactattaataaacactctagtctattgctgttccctcttcaatctaccaatatagttgatggcagatccagccttgaagaattccacttgatccttcgacatggtgtgcttacatggaacttcaaaagtctcacccgatctctttgtgactttgatgttaatgatacccccattgtcaccacccttctcaagcatatctatgagattggtagtttccaatttgtcaccagcagacagtttgtcgtaatctgattcgttagcaaaagtcaatggcaacataccttgtttcttcaggttggtctcgtgaattctggcaaatgatttgaccaatatagcttttccccctaggaaccttggagatagagcagcgtgctctcttgcagagccttcaccatagttgtgctcagcaacaacaatccatgggcggttttcatttttccatttgatcatgagttcaggtattccataactagttccatccaagtcatatgcggtattgacttctcctgtctctttattttgggcaccaatcaaagtgttattagagatattctccaaatgacctttgtatttcaaccaagcaccagcagctgaaatgtggtcggtggtacatttaccttcaaccttcaagagtaaagtggtagaaagctctttaccatcccaggcttcaaaaggttccaggagttgcaatctatcggaatctggggaaacttcgacttgaacctcaggtacgggtaccggctctaattcagggtaaaattcttcacggccagcaatgaaaccgttactggggagctcttcaccagcaggaggctggaacttgaattcatcgccgttttgcaatttgattgtctgtgtaagagggttgaagttcatgtctccggagtagatcattgcagtgacaatatcaggagaggtcaaaaagttcatggtgtttctgttaccatcatttcttgctctaaagtttctgttgaatgatgtgaatataacattggtatcctttggtgcattggcacctctgtcccattgaccaatacatggtccacaagcattagccagaacaatagctccattcttttcaaaggtttcgataagaccatctctttctatagttgccctaatttgctcagatcctggagtgacaaagaaaggaatttttggtttcagtccagctttctcggcttgcttcattatcgacacagctctagacatatcttggtatgaagagttagtacaagatccaataagacctgcagtaatgttctggggccacttgttctctttagtagtttcgctcagtttagaaattggagtggagagatcaggagtgaaagggccgttaacactaggctctaaagtgtttaagtcaatttcgacgacctgatcatactgggcgccttcatcagcagtcataaaaccaaaatttttgttgacatcacgggccaaatctgcgataggtgctctgttagtagctctgagatatctgtaatgagcatcttgcataggaaaggttgaagtagtagcaccaatttcagcacccatattacagatggtggccataccagtacacgaaagtgacttaacaccttccccaaagtattcaacaatgaatccggtaccacctctaacggtaagaaggccagctagatgggtaataatatcctttggagacgaccaaccactcagctgaccagtcagttttactcccaaaatcttgggcgctttcagttcccatggagtaccagtcaaggcgtcaacggcatctgcaccacccacaccaattgcgatagcacctaatcctccagcgttaggagtatgagaatcagtacccaacatcatcagaccaggaacggaaaagttctctagaacaatttggtggatgataccagaaccggggccccagaattgtattccgtatttttccccgcaagattgcaagaagtcaaaaacctctttgttagtagcgatggatgatttcagatcagacttggcaccgtctttaccaacaatcaagtggtcacaatgtattgagcccggaacagcagtgtttggcattccacatgtcatgaactgtagtaaagccatttgagctgacgcatcttgcatggccactcgatcggggttcagtttgaaatattcaacacctctaatgtttgcagtagatcctttgcccacggctagctcttcgggttcgaccaaatgtgagtaaagaatcttctcagccaacgtcaatggctgattattcaagacccttttggcgacagccaaatttttcagaagtttagcgtaaggaggagtacgagattcaaatccctttggtgcaactattgaatctgtatttatcgccgttgccaggcctctttgggaagcacgaagtgctcttactctactggcaagcatcattgacaaatctggtcaagatttttacgaaaacaaaaattttcagagttcttgaagggagaatgaaaaaaaaaaatttcagaaaaaatttactactcaaaccgactcaatccaatcaaactgtggatattgtcaatcagccgtaatagtcatagctttccttatcgcggatgtcaaatgtcagatgtcagattcgccgagatgtgagatgtgagatgtgagatacggaagtgaaaggaaaagtggaggcagctgggtcaaccgagataacccgaaatcttctattgtcgtcttgaagggtgcctgtacgcaatatgaaataggcagcataacgagatattgtgaacaataaaatagcgtgacacaactgtgagaggcttaggaacagaattcccgcccaatcacaaccgcaagaccgacccgacccacccctctaatctgatctcgtaatgctgcggaacattgtagaaacattctccccccgacatgatgctcacgtgccacgtagctattgttttattgctgttatcagaagattctgtttatctgtctcgtctcaggtcacggaccaggcattccactccaatcctcgattggttgtcaaactctaaaatgttgaatgccaattggattggcttttcgatattgaggggaagaataagcaatggtcgttccgtcgtcctcacaactctggcattttgcatgcttctgcggcggcacagagtgggatcttttgccaacgatgatgcacattttttctgaacgaactccattgaaagcacgttgacaccatgaataaacgccatttattagtatcccatcgattgagatgatcgctctaaatcttttccggtaattgctgatcttgacagcgccccttttctggacatcaattgtttggtgtaacactggtgacttcaactttcctgccctatttctgccatgcgatatgataacatcactttttggctagtacgtactcctttttcgggtcgttgttctcctggcaaccttctctcgcagggaagggatcaccaggttttttgagtttgggtcaaatcggacaaaattctgcagaggtctcaagactacgctcttttttttttgcttcgaaggaggagcagggtaaataataatggccacagcgcctataccctacatcgtaatattccttaataagtctaaaatcccccactgctgctgcaaactaccaacacactcaggttactgaatatcaaccagagaagaacagcttcccaaaagaatagtagtatccttgcttacagtcagagcgatctaccctcaaaccctttattacgtttaacttcatgtccaaaattatggggcttacaacgctttcactcggaaacaaccttcaccatgacccagacaagaaatcgttcaaagaaagaatatcatcaaagctccatctacacaatgaataccatcccaaggttcctccgttgtacgtagagacgtccacacatcagaacgaggaaccgacgctagtaagtggctccgccgcttcgtcgattacgccatccgtcggtgcagaatccataaataaggatccaaatttgatctttgaaagatcggttcaatctcctatcaatgtttcttcaccaccaaggacggctccagcgggctccgccaccaataacaacagtacagaaatcttgctgtcctctcctcgaaccgatgctccgcatcaattcctgagaagaacttcctccatttccgtgcctcagcattgttgcacagaggatctgacggctccagttttggatgccacagcggaaatcctgtcgtccaatgacgaagaagacctcaatgaagtcaccattgtgtctatgaaatcagctaggaggaacctcggcgagaaactgtgcaattgcatcagtagacccaacagcggtgcgacttccaacagtagtgctaataggtctccaaacatagcaacctactcagtaccagaattttctccacctaccttccgtagacgcccatcagagatactttcggataactttagatccaatgttcgaagatccacatcggtgatatcattcaacaatcacagcatcatccctccaccattgactttgagcaggacccaatctggaattgatcccaccaccaacagttctccgcaaaggaagaagagtatcagtttttacactttcaatgacatcctatctatggaaaaatcaacgaaagctgccagaccaagtactactgattccaagacagagcccactcccctgatcgacgagcagttggacgctgaagaggcagatccagagctcttcgacggttcgtctctaacggatgagcaacaacaacaaaaactttcacacattagaacaaacagtaactacagtatttacagcgatgaacagaatgatgatcagaattgcttcgaagatgagttcagaaatgaagaatccaacccaatgacaagctgctcattgagtgacttaatccgaagcaacactggagaacttatccgaaagtcctctcatttgtcccccaaataggatatctctatgtaaggggcaggaggaaagctattgatttctcctagctactattgccacattttttactagcgtttttatttcattatgaataaaacaaaatcctaaataaattttcaggcgcgcatactactaacccataataaaattttcgacataaagaacatttttttacccttagttctatctaactgctccatctaacgcctcattccctccaagtgtttagttgatgggttataataagacttgaaaagtatcttactgcctcatcatctcaaactacttaatgaatcacgatagtccgctaacgtctgtggttaatcaatccatcgacgtatcatctgaatcatcattgtcaaaacaagatctggacaaattgatcaatcagaactcggaaaactttgtatcccatgaacaggaaattctttctttaactgcattaccagaacatgcctgcaaatactgtggagtgagcaatccacgttgtgttgttcggtgtgatatctgtaagaaatggttctgtaatggcaaatcgggaaccacttctcatatcattagtcatatggtactctcccgtcatcatgaagtttcattgcattcggattcagatttaggtgaaacagagctggagtgttacagttgtgggaacaaagatccattcatgctaggttttgtcagtgccaaaactgatactatagttgtcattctgtgtcgaattccttgttcgcaggccaaggatagtgattggaacactgccaattggcaacccttagtggaagaaagatgcttcctagattggatcgctgattatccaacgccgttggacatggccaacgcccgtgccatttcccctcttgatatatctaagttggagagacagtggagatctgatgaaactgcaactttggaagatatcaaagatttaagtatggcagatgcttttgaacctgtgttggacagttatgttgacggtcgggaatatcaaaaaatcttttctcccctagttgatgccactgcacagtacgacaaacagctcactgaaagtcagggccttaactatatttctgtttcttggtccatgtctcctcataattatcacttagcaaaattctccttatcttcctacgattcatccaacctcaaaattgctgttggggacgaaatcattttacactacgatggtatcaaggaagagaaatggcaaggctctggatatgtcatcaagttgccagccacatactccgaaggattcacgctggaattgcagccatcttctgtgaaaccccctaccgaacataacgttgggttcagagcagaaattgtttggaaaggaatcagttttcagagaatgcaagctgccctgacaacttttgctgagaaaaaatccattagtaaagacctttatgatattctgttaggacataaagaagaacagccagagtttactgccaaacttccagaagccatatctgttccaaacttcacacagttgaatccatctcaagtcaatgcagtgaagtctgttttacaacaaaggctatcactaattcaaggtccacccggaactggtaagactgttacatctgctacaatcgtctatcatctggccaaatcaaagaaaaagaaggttttggtcacagcatcttccaacattgcggttgatcacttagcctccaaactggaagatataggtttgaaagttgttcgtgttacagctagaagcagagagaatgttgaatccgcaattgatcatctaagcctcagcagcttagtgtcaaacactaacaatcccgttctgaaaaagctactaaagaaaaaagatgaactgggaagcttatcaaagaaagatatgaatatctatatttcacaaaccaaaaaagcagaagcagaaatacttgccgaagcccatgtagtttgttgcacttgttctggtgctggtgataagagattggctaatataaaatttccttatgtgctgatagatgaaagtactcaaccatcggaaccagagtctttgatccccattgttaagggtgcgaagcaggtgattttggttggagatcaccaacagttaggtcctgttattttgcataatggagctgctaaagcaggcttaagacagtcgttgtttgaaagactgattaaactggggcatattcctattcgtttggaagttcaatatcgtatgcatccttcactctctgaattcccaagcaacatgttctatgatggttcattgcagaacggtgtaagtcatgaacagcgacttattcgcaggtcctcattcccatggcctgcacctggaatcccccttctattttggtcaagttacggaacagaggaaatatctattagtggaacctcctttttgaatagatcagaggcaatgaactgtgaaaaaattatttcaagattgttaagtgaaggaatcaaaccccatcaaattggtgtcattactccttaccagggacaaagagattacattgttcagtatcttttaatgaatggtgctcatccagaccgtgaaatctatcaagacgttgaagtcgcatccgtggacgcatttcaaggtcgtgaaaaggacttcattattttctcctgtacccgatctaatcatacaaacactattggatttttgaaagatgctaggcgtttaaatgttgctataacgagggccaaatatggactttttgtccttggtaatatcaagactctgcaaaaagatcctttgtggaatcgtttgttagtccatttcagagacaagggtgctttagttgaagggagacttgatagcttccagttatacacagcgtccttggaatcagccagatttaagtctactgctgagaataacggcttgaatcaaggcgacaataaaggtgacttaaattcaaatggatttagcaaccccaagtttactgcagaagatttaagctctacttcattctcatctctacatcctttcagggctaatgtcgacacagactctcggtttgcttccaatccaagtattccctctatgagtccctttttaaatcagccacagtggacgaatccttccactttccaactaaacgaacagattcgcccgtcaaccccagatggaccaccagtagaccttagatttattcaaggattgaacttggacgaacctataagtgagcttacaagtcgcttcaataatctttgatagctaattaacatggaataatattacctatttcttaccaaacaacttgcgtagagatgtttttctttcaagtcccagtttcaaactgtagatactagagcttttcttcaatgctccgccggagttggtagcagaattcctctctgtctttttggcgatagtctcataggactcaaggaaacgggccaaatcggtagaatctaggacatctgatttattcatcgctttcgcatagataattttattttcgttgtcaacaatagcattagcatgacattcttttgaatactgttgccattgttcggaggaaaactgtttcggaagttgtggggcatcaagaagagcctttaccgatgacgtcttcaacacgatagaagaagcttcactttgcagttctttgaaagaaaatgtctttctgaacagtaaactatcttcttctaaacccaggttgatgctagggcttaaggagccttgaatcaactcgtttttgtctgaaaactcgcttattccaaaatcttcttcaatgtcatcaaataaacttcccgatccatccccttctttttcaaattccaaaactccaatggtgaactggttgctgtcgttaatttgttgtattctgtgagattttttgagatcttctaatgtcttgggtttgcttgtaatcttatccttattatgaagatggatcaggttcaccagttcagtgagtctcaaatatttgtctatcaagtagggcatcgttggaagttcctctctgatccagtctggaatattcagaggtggtcgatcgacatcatcactcatctccaatacttttggagaaaagtccagcttcctgaatgtaatcttatcgtagtattgtataactttctcattgttttctttaataaaagtgttcaggggaagtagatgaggctctttgtgttctacaaaagatgatctgtttgctatagtgagcagtatcttagctatcaaagtcagtgtgcgtcctaccatccctacctgatgatctttcgtcaggtagaacagtttaggattcaataccgttgggcaaataaatctcagaaacacaaacgatgaaagggcatttaacggtgtctctgtatctgaaggctctaccgcctgctccactttgtgccgtaaatttttccactgctctttcaaaggcgtaggtatgtcattagttgtattataaagctggtcccacaaaattgagacatactcgacaaggtttttcatattgtcttcagcttgttcctgtcttttctgtttaaccgtttcgtcgtccatttcagctgacttcggtatctctatcatccttggatcgacttcgcagtctttcttttcctcagtaagccgtttgacaaatgaaccaataactttctctagatattcatggccaattcgaaggccgtacttttccagggatttcgaaaggatgctatttcctctaaatagggtgttgaaggcatttttggtatgtataagattttcggtatctgtggttccatttgctgtgtgtgcaattataatacggttgtttctagtgatagagtcgattggtgttagctcagattccattaaggcagcaaaccaggagttttcggttcctaagacttggtagacatcaaggactatgctggatatttcttccaaatcctggtttaatccagttaatggtttgatgaaatcgatcatttctcttgggttcagtctattcagaaccttctctacaaacttgaagtagcttggattcaaaatatagttcactgattgtttcaagttaatggagatcttcccaaactctttagagttggaaaatatggttaggcttagctgtgagtcgtaatgatcatctttcaccatatctggtgtaacgtagacaaccccgatggtttcatcgtgaggagagtaatcttcatatttacttttcttgatcagcacatggaagtactgtaaactgagaggaagattgagttgaaacaattctttccagaaaatattcttcttcgtttccacaatggcagttcgacaccatggtgttccccagaggattagttctccgtacaccttctccgcttttggtagttcgttgtaaaaggaggcatcaattatatctagagagacgtttctggatacccgcaatttgtcattatcgtagtctagttgaaaatattcccgtctagcaaatgaattgagggctacaaaccaatcttcaaaatcaatatggagtggaaattcaatgataattctattgatggtactccagcgagtttgattttcggaggtgattataaaaggatgggttttcatttttgttggaagtggttcagtagtcttgattgtgttctgaactctaagttcattaattcttcctaagaataaacagttttgattttgaaatattgaatggtctagttgacgaatttctgaactgaaaagctgcgtaatatcaattgaaaaaatgagggaaccgtcactttcagatagcagttcaagcgtaccattagcctttaaagcccccattgccatgaaccacgattctgtggtattactattattagttgggtatattgggacatgagggccttcaacaatgctgacatgtttgtttttggttggaactggaccaaaaaccttgaatctacaaactagtagctgattcttatctgacgtttgctcggccgctatagagcttgtaggttcccattttctaagaattccttctggcttcaaattctgccagacaattagatggtctattaatcgcttggtttcgttccaatttgcacacttcaagtatatatctttcgaattggaaaaagtggtcagtagtaactcgagtgagctccgaagttgcacggaacaggattgcaagttggatgtaattacaagaaacctgttggcgatcaattctccattagacgtgatttctacgattgtcaagggctcatatttctccccatcatacgaccactctagtgcagccttatacgatcccctgatggatgactcccgtctctggaggcggattggagaacttatatccatgacttctcgtgaaacttttctttctctgaaggggaaactctgtgatgtaatctcgactgtctagaaaccttccgtctggtgaaatagacggaaaaggtaaattggaggtaggtttaaagacttttggagaaaggagaagacgaactaggatcaacgagacggaattacgggttcattggcatactggaaaaaaaaaatgaaaccttaaaccgcttcgagaaaaagaaagaatagaatgacgggaaagaattatattgaaatcatgggtctgccaaaattgtaccggttttgttgatctatttcaaagagaatacgtgaggagcttcaccttctggaccaataaattccggttctctccaaggtccaatatcactcaacagtaatcctccttcagagtcgggaacctcagattcacctccaaactttacaggaaggttctccttaggaatttgtctaagtagttcagacttgtaagaagaaccaagaatgaaaatcttcgacactgaaactgggtccaggaagggcttgaatatcttgaaagcagtagaaaatccaaacggagcattgataaggtaaaacttacccattctctctggataatagttttgaccaatataggacacctccttgacgtaacccataacactataagcagatgatatagtgattcccttcaaatctaaaatagtacaggaagtttctatcaacactccactctttctagaacaggcaggtaatctgaacttaacaaaagactcgtactcccaaactaggttcttgaccatgcgttcctgtgtggtgatcttcaacatctcgttgatgttgacccttccaagttcctcatagtatacaggtcttccgtccttgtcggttttgtggtaatatgtagggtacatttgagcaaccaaaggtttctcctcgtagtggaactcctccaagatatggtccacgttttcttttttcctccatttttcacagttcacgaacatctcggttgcctttgctacatcaaactttctggcacgaaggaaacgaagctatgaataagttagtatttgaacgctcggctggcacctgtttcgattaaagcaatacgtacgagtgtggaatcgtccagtctttgagtgtatcctgcggctttcaacccttccctaaaagtttctagggttttcttctcctcgtcagttaaatgaccaggatagcctgtaagtcccatctcagaaggggcagtttcactaggataggaagcgctgttgttgttagtacgctagactttgagtactactcataatccatccaacttacatgattgtttcttcctataattggttagttggtgtcattttgctaagttttaagtgtttcaagaggagaacttacagtaacttcggacattgttcttagttgttgagaagagattatttttgtaatttctaaagttgagatgcctgggctgcgagggatctggtgcgcaatgatatccattatgtaatcaagaagcagtaccgttcgcctcaaggatcgacagggtcttgaggatcaaaaagaatgctggagcagcactggaacgatgaaggccatgtattgttctaagttaggcttgcggaaagaagtatacagctgcttctcttgtcgtgtttgcctttacaatgctacttctactccctccgccttggatgttggttggaagttcgtaaacgcgcatctatgcggacttctatcttttaacgcgtcaaggtcaaagagatcttagatcgttatgacagatttatcgttcgatattaagttcagtgagtcttgtctttcgcatgaagggaggccaaattcgaatgctacaatcacggtggatgaaacagcacctgcgtttgagctgaacttcaactcctcaattcttgcttcctcagctccatcaaccaagagatcacaagttataaatcaagaaaagactctgcatttgcagaacggtagaagaatttccttgaaaaggcgggagaaccatgcattagaaatcgaagacattgtcaaaaataagagcttcgatgttggcattaaggacatttatcaatccatggaacttcaaagtatggttgaacctactcagcaacccaaaaggtcgaaacgaacttctgctgaactgtgggccgaaaaatggaggcccagaaactttctagaggttgctggcaatgagagaactaacaggcaccttcttaattggctacgaaagtggagtaaagctgctcatggtgagcctctaccatcagaagaagaatcggtagatcctctccagcgccctcagaaaaagatactactcattcatggtcccccaggagctggcaaaacaactgtagctcatatcattgccaagcagcttgggtatgaagtagccgaaattaatgcttcagacgaacgagctggtccagaagttagagaaaaggtgcatactgtactcaccactcaatccttcagtaaaaaacctgtctgcttgattgctgatgaagtagatggaagttctgagcatgggtttatcaaagtcctgttagacattgtcaataacgatgccaaatcaactaaaagtttgcactattcaaatttgtccaaagataaaaaagccaggttacgaagcaaattattgactcgtcctataattgctatctgtaatgatgtttacactagatccttggataaattaagggcagtctcagaaattgtagcattccggaaatccagcatcagatctgtgaaagaacggttaaaactaatttgtgatgccgaaaaaattgatatttcagaaaggaatttaaatgcgataatagatataactgattgtgaccttcgatccagtttgaatttacttcaatttcaaggcgatcaactccagaatatactgggtgatggggataccaaacgcaaggattctcaactgagttggtttagcattgctttaaaattattcaaaaggaacactaaagtggagaaaaaagtacagttcaaggaactcagcacgttattggatacttctggggtatatgaaagggttgcaaatacctgtttcaactctttacacagcttgacataccaggatgcccaatttggtaagctagctgaaattgcagattggttatggttttacgattgcatttcaagtagtatctatgagcatcaagcacaggaaatgagtagatacggtacattgattccattgaaaatgtttttgaatttcagtgacgccaacaatacccatgaaaccgtcaatatgaagaataacactaaccagtattttgaaaagaagaaagccattaatgaaatcgtcaaatcaattcattccaatttggaagcttctttatttagttcactaaaacgctcagatatggcatctcaaactctcccctatgtttatcatatcatactgcctaacttcaaaaacatggccagattaatcagcctgaaacctgaagaaaagatcaaacttacggaagctgcaaaagttcttaaagagtttggcttcacgattgagcaagcaaaagatgaaactttcacttacattcaaaaactagttccgccaattgataccgtagtcaattgtcagaacgaattatcgcatcaaaagtcactttgcgcacgagctaatcagattctcccatacattgagattgagttgaaaaggttgaacatcaccaagagacacctaaccgattctgagcaagacttcaagaaactacaaggtacttcaaagagaagaatcacagggttgacctcccctagtaatcgacagtcgcgtgccgcatctcttcaggagggggggcagactcaaaatcagctgggtacctctatagattttttcgccaaatcgctttcccgagatggaagctcaggcagaacgacacctgcacctcagacgaactctcagagaggcaccaccggacgtatttgggtccgttataacgaagggttctcaaatgcagttcgtagaaacatcacatgggaagagctgtggaatttttaaatgtcctccataatttcatgcggaccttgcatagtttatataatcatactgtaccaaccaacatccacacaaggagttttcggcctcaacatattatcgaaaccatctccctgtcccttactcagatcctattttttcttactcaattgaaagaatttacactgctttttccactctctttttgcaactcgaagtcaatccatagaaactctttattttctttcctttgatcatgaggacattgacattgttggtctacttcgtagtggctgccttagctttcaccccgcagaccaactccagaatttttaaaggttacccaaagaaagtggtttattttgacgacactgccagcgttgtctaccatgatggctctgacaatgagatctattattccaaagatgatggtgtcacttggactcaactagatcttggtggggcgtccgctcatcaagtaattgttcacccttttgacccttctactgcctatattttgaccactagtgaaactcacttcgtcaccacagatagcggatttacttggaataaggtttcctctccagagcctccagtaaccaacgagtttccaacgttgagccaagagtcctcctcattgaccctgaattccaagaactttgagtatgttctgtttgcaggccaatgtacagacggatcagaaatttgcaacagaaagtactactattccttggataacatgagaactttcaacgagctcattgaagctcacagctgtttgtttgtcgatactgccgatgccattgcgggtgatcattccccaaacgctgttatctgtgccatcaccaaccctgacggaaaactgtctttggtgaaaaccgccaacttcttcaaagacggcatagactatgtctctagtggtggtggtcttattgagaatcctgaactgctgggcgcctcacacaactacatcttggctgttggttctcatcttttgcacaacaaagacaagtttgtatacatctcatttgatggttcgaacttcaacaaagtgaaactcaatggtaatactaatgatcttaaaattttggactctttaccttcctcagtggccatttcagcagggaacgctctgtttatctcatcgagtggctcgaactctctcaatgatgataacgataacaactatttcaccagcaagctttcctccttgcacgtcaaagacaactttgctgactatgaacttattgatgctgttgagggggtcatacttgcaaacacaaacgaaaatggaaatgttaggtcgttcattagtaccaataatggagactcttggaaaccacttgaattgaagagtggctcacctttacatttgcattctgttatacaaaggtctttatccgataacagagctgatcctggtaaatattattcgactcctgtcccaggtcttcttttgggtgttggtaatgagggccccagcttgaatccatattccaaaggtaatacttatgtttctaccgacgcaggtgcttcttggaccaaaactctcacgggaccgcatatcttcgaagttggagactcaggaagtttgataatcgctattcctcagtctggccctactgatatcatcaagttttccaaggactttggttcatcatggaccactgcaagactgggacagtacataactgctgatttcattaccactactccagatgctacttctttgtcttttttggtagttggtactaacaacgacgataaatatattgcccaagccctgaacttccgaggcgtttatgacactgtctgttcggaatctgaatttgaagattggtacccgattgatagtaaaggcaaaaagatttgtatcatgggacataagcaaaagttttccagaagaaaaccttctgctgcttgttctgttagcaaactttacctagaggcagtttctgttcaggaggactgcccttgtactgagcaggactttgagtgcgctcaaggtttttcaagaaattctcaagggaaatgccttgctgacaacattgaggctgagttggctttacagcgcaagttgtgtgtcaatggcgcaacatcttacgaggtaccatctggttaccagttgatccttggaaatacctgtcaaggaagttccgatttacaaactcctcttcaaaaaagatgccctgatgaaccaaagacagtaccggaagctgaaaacttggatccatcatactcatcatcggatgagaaggatgacaacccagacgaagaagaaggtgctcctgaggattcaaaagaaggtttcaacgatggtaaggttaaagcctctgtgtttacctttgacgggaaagttgaggaatatatctatttggaaagagacaaggaaaatccatcggaagatgaaactctagttgctattacaaacagaaatgaggcgtacgtatcccataaccagggatattcttgggagcaaattgcccctggtgaagatatcttaagtatctacctcagcaggtttgatcgtaaccacgtttacttggtggcagcaaaccagaaaatcatatattccagagatagagcagacaactggaaatctttccgaacccccagtatgccaattccaggtgtccgtcccatctatttccatccttacctcccacattacttgatttatgtaggccaagaaggatgtgattctcagtactcaaaatcatgtcgttcggttgcctatttttcgaaatcttatggtaagcgatggacaccgattcaagaaaatgtgaactcctgccaatttgtgggaggtcttcaaaagagaaaccatgataatctgataatttgtgatagaccagcaaccgattccaatgatttcaaatcgcagattttttggtcgaaagaccttttcaaaaccaaaaccattgcgttagagaacactatcggatttgtgcaagtggctgattatctggtcgctgctacaattgagcataatgatgaacttagagcccatgtatctattgatgggacaacctgggcagatgcttactttccgcctaactttagggttgacaaacaacaagcttacaccacattatctggagctaccaaatcaattttccttcatgttactacgaatcctaggcccaacaccgagttcggcactatactcaagtcaaattcgaatggtacttcttacgttctttctttggataatgtgaacagagattctaaaggatatgttgattttgaacagatgtcagggttagaaggtgttatcattgtaaacactgttgataatgcatctgccgctaaaaagggatctaggaaacaattgaagtcaaagataacctacaatgatggtgcacactggagctatatcaccccccctgcaatcgattcagacggtaacaaatttccttgtaaaggtaaatccctcgagaaatgttctttgaacttgcatggctataccgagagagaagactacagagacacgttctcctctcaatctgctattggtatgatgcttggtgttggaaacgtaggtgaacatctcgaaaattactacgatggacacactttcctaacgaaagatggaggtatcacttggaaggaagtgaagaagggcgtctatcagtgggaatatggtgatcaaggatctgtcattgtccttgtcaacggaaaggataatactaacattctgtactactctgttgatgaaggtgacacgtttgaagaattccaattcactgacgagcttgtcacagtacaagacatttccactgttccaaatgacaactccagaaagtttcttctattcactagagtgccattagctaaaggagataaaaccagagtattccaaatcgatttcagtcacttacttaatcgtaagtgttctttggatttgagaaatgaggacaccgatgattttgaactatggtctccaagtcacccattccagccagacaattgtatgtttggacatgaaactcaatactacagaaaactacctggaagattgtgctacattggaccaaagctaacccaacctcacaaagttgtaagaaactgtgcttgtaccaaagaagattatgaatgtgactttaactactacagagatgaaagtggcatttgtagattggtgccaggattctctccgccagatcattcagaaatatgcaactccgaaagccgtcctgttgaatactgggtacccactggttacagaaaaatccctatgtccacatgcgagggaggagtcgaactggacaaggttgaaccaaaaccatgtcccggacgggaagaatcgttcagggagaaatacggtggtttgcgtggtttaggtttagttgtggcagcactcgctggtcttggtgttgttggtttcattggtcttgttctctacaagtactatgattccaagtttggtcagatcaagttgggagaagaaggtaactttgaagttttcgaaagaggtggattcctatccgaggtaaatgccattgttggatctattcttgttaccggagttgcttccgtttcccaattgctcagaggaacgtttttgaagttaggggaaattaagaataaagttttaggaaatcctagagggaatcagaatttgccctccgcatacgttgttgctgatgaccatgaagatctattgaacgacagcttccatgacgatgaccagaatgaggaaatctccagagatcaattcagcgatgacgatatcatcaacagcgaagacgagcgtcaattataaaccagatcttttaactcgttgtatatatttattagacatggcatgagcgtaagtacatagattcaatttattctaggttttttggttcggtgctcttcttcctcttcctcttcttcctcctcatccttttcatcaacttcttcatcgctgacatctaattcctcgctagatgaatcaccttcaatttgaccagttaagcaggcttgagtatagtatttagtagagtaggggaaaatgtcttctaccagagctcgtgtcagttcttctccagatctgaattcttttccagctttcttacctgtccatgaaaaccatgcaaaaaaagttttcatcccctttctgtagtttttctttccctccgccgatttcttatcagtgatcttataggggtttatagaatcatactccttaggccattgaatcgtagcaggttcagatacaagcttttcttgatttgtttcttcgtctatttctgacttaaaatgtttggtcacaacctgggcagtgattttattgtctgaatcatcaaatgcaatagttatagaaaaatcacgagaattttccaaatcccagtcaacatagatatccgtgatattctcaagaaatcttaagtcgtctgtttgaatatattcagaaaagtcgtcatgctctgacaaaacaataaaccagtattttggaatctgcttagtaagttcttgacgtttcaagtaaacatctttggttttcgtagctttgaactgttcaacttctcgttccactttctccatggagttctcgcaggcggccaaatcggagaaaatttgctctaatttacgactattggttagtatatccaaactgaacgcaaaatctgtttgtggttcttactcctctgacattggggttctcttaggtggtacgtatcaatcgcttctagaagccatacactttgggatctcaaaatttattattggaatgtttcgagcatacttatttgtacaaaggctttctaaaaaatccgaagaggttcaggtctagtttcttctctttcttcttgtgatttcgggaagcttaaaaggtactctcagcacagcaaccttgtgagtcttcatttcagatctttttactcccaggacctcagcttcagcagccgtgactggcttgatggtgcaacccaagactctcaacaggttggagagtttcgatgattttaaggacagctcttgcgatagcgggggtatttcgatcataaatgaatcgatgtgcaaaatgagggccaaaatgtatcccagcaatttgtcctcgttctgagggtcaaccaaaaatgattggtctttgcgtcgaccaaagagtcctgcttttacaactgtaaaccgctttagtacgccgttaattaaagattctggtggatcttgtaatgcttccatgagggcttgtttttgatgtaatctcctgtttcggtaagtaccaagcaatactgatagatagtagagcaactggattgtcttcttctgtgtgttcttatcaagactaagtttctccaaatgtgaacgaatgtaatgcgagtcctggaagggaaacagttccaatctcttcttccagtctgtttctgcgagaattgcatccacacgtaaatatttccattcgagacttgatattataccctctaatggataaatatcttccacatgcgtggcatccaaattataaggaggtacgggtctaaattcgtccaatttggtttccaactcttcccgtgaaggaagttgttcagtggtactctttatcgaatcaacaatgtcaagagctgaaccttccaatttggaagcatccactttattgatctcattgctcgtgatggccttcttggcttttttagtaccaaatgcctgacccaaagcatttctttgtaatctggcatgaatgcctgcttgtttaacggctggacctgatgattttctctttaacttggagctaacttgtgacacgattaggggagccttgtatagctctacagatgctgaatcaggatcatagatggctatgcagtagttactgttatcctcagggtctgtttggccgtcgtacaatagtctttcattctcaccatgtataaggtactgtgggtgttttttcgatttagtttgatacaattcaaattcagtgtccgaaggtatactcagtccattgaaaaagtttccgatagcaacgctggaaccgtcgtcaaaagaagagacacgcaaactggcagaggaatccgacttattttcacccatagtttataagaagggggacttgaaaaaaaacttttctcgatctaaacttttttcagatatggttagataagcaaagtggaaacaacatcgattactacgaaagcacaagcacggacaagtgaatcatcgttagagacaattctggattcttcccttcaacgtattagagcactggaatatatgtacttgtacaagctgaaaaagaaaaattaaaagtttgaaaaaaaataatgaacgctatgaggttcgaactcatgcctcttacgagacccgattacacctgcgaagcgcaggaagtgataccacttgagtcgggcgccttagaccactcggccaaacgtccaatttacattttactggtattacagaatggtatatgctgtatttttttttattctttgggctcagttgtttcgtttctgtccaaatttcatatggattgacatatcggctcaatgtaatcccttaagttctaccatcgtaaactttccaaagcagttatagcttgctgtcacccgttgtctcgtaatatcactccaattgtaaaaataaagcatgctctaaactacgagccattgtttcgaaggaacgtttattgactaagtagattagaatctaattcacgctaattccgcttttgtcacccgattgagtctgtgatttctatttcccctcaaacgcatggcatattgtttcatttaatttatgaacaaaaactgtgtaaattagattttgctttcaggagctgaattggagcattcgtattgtctcatgaccagagaaactttgctgataatagtaaaattccgacgaaaagatgctgatacacaaataacctagagcggagattacccaatcgggaaatagaatataaagtacctgcattgttgactgtggcttgagttacgcacaatacaatgatagaagcaaaacgctccacttgcacgaaaattccatgttgattgttatcaacaattcttttatgtttggggttttacaagtaaatcatcaaacattagtcaaagtcgcttgtatttctgtatttactgagggtgtgcactagcaaaaaagtgaatttcacgcactcgcagttcccttgaaacctcaacagtggctgaactcccccaattggtccgacaagaactgaccggaaaatgatccaacatcgaatcttagattttaaacaaagttcctgtagagtcacgaggattgacgaagggtaagatctccgtctgagtttgctttaagagttggattaaaacctgacttgagggtatgtcgggttctccacaagaggaagagtagagactttgaccacagccttacagtatcactatgtggcaatcacatttcatcagttagatcaaagagtattccagccgtctcggctaagccaagtttatcgtatatctcgatgcagtaatttcactgcaatgactacatgccgaggtcactaaacctacatagaattgcatatcaaccgtagaaactattagacagcatactgccctgagttgccacaaatcaaaatcggttctgcttaatgctatcttgcctataaatacagctacctccccccaacctgccaagtagactagtgcgaagaaatagacaaacatttccaacactgaagtgactccaacaggtatctgcccagcttcttacactttcgcggttggtatctaacaccctagattagacagaatcagtgcactttctgctaattttatccctatccggacaacgtcaagtccctgattttcgctgtcactatttttttttttgaaagcaagttcttgctcctttcacatattccgaaaagactcatttgggtgtcctagttcgttgcaaatcaaaacaggaaagcctaattcaagatgtcttttttttctaaccttaaacaccggctggaagtgcccaaagatgaaaatggtgccagaactacaaacctccttaatagagatattatccctttgcctcccaaccgaagaacatggaccgattgggatttcgtcggattttgggccgtcattaacttgtccgtgttcacttggcaaacttgttcctccctattgtcactgggcctcagtgtttgggaatcgatggttattgtcataatcagtaaggcacttattttcgctgtagccttgagtcatggttggggtggtggtgtctggcacgtcggttaccccatctatggtagattctctttcggaatttttggatcctacttggctgtgggtcaaagaatcgtgcttgctatcgtctggtatgccgtccagagtttcaccggtgctatgatgttgaccatctgcttaagtagtatcttcccaagtttcaacacattacacaacactttcccagattcgttaccaatgaccttgaagcaatttattggcttcattatttaccatgtgttgtctattcccttcctttacattccaccggagaagttgaagcatccattcagattcgtctccataatatcattcgtcactatttttggtgtttctatcggttgcatggtgaaggctgacggtgctggaagtttgttacaaagctctggagtatcgatgtcatctgccgatagaggtatggcttggatgcacggtatcaacacgatgttcaactccattgctgtcggtcttgcaaaccaaccagatttttctcgttttgttcaaagacccggtcaacaagtcaaaggtcaaggtttttccatcctaattttgggtaccgtcgttcctctttttggtctgttgggaacttctgctgctgctgaagtttacggcgatgtcgttgagctaaatctttggaacccacctaacattttggaccagtggctgattgaaagctatacctccagaaccagagctgctgccttcttcgcagcattcggattctttgttagtacgttagggttgaacactatcgataatgccataagtggaggtatcgacttggcctcaatggctcctaaatggatcactgtccgtcgtggtgcttacatgataatgattgtctcaattgccatgaatccatggcaaattgtggccaaggcttccgtgttccttgctgttttgggctcgtacggatgtttcttaggtccgatgattggtgttatgacttgtgactactacttcgtacgtcatcagaaactcaagctgacagacctctacaaagccgacaagagttctatttactggttctacaaaggattcaactggagaggtttcgttgcctggatttgcggttttactccaggtattacagggtttcctagcgtcaaccccaacttgactggggttcctacagcctgtatcaagatgttctacatttcgtttatcattggttacccgatcggattcttagttcatctggcactcaataagctattccctccaccaggtcttggtgaagtcgatgagtatgactactaccactctttcaccgaaaaggaagcactgaaattaggaatggcccctagttccgagttggacagagtcagcaccgatgacccgatcaatattccttacgacgagaagtctttaggctaatgtagttaaatagttaatcgaaacaatcgtgtatcctctttatcgtaccagcgggattcgctgcttggatgggtgactcctgtccagttgactcaaagtagtcaaaataggcctggagacccttaacaggtcgatgagtagcctactatgagaaaacccctcaccacaactggactataaaagggcacgtcaatccccaaagcaactcttttctttcatccctactttattactttatcctttgatcttcattgaagaaaatctgaaacaattgtaagcagcaatccacacctccccagcaatgactcaatttactaaccccattgacagaaaatgtgagcatcttttttagatgtcatgatgataggtggagtattcttaattattgctttcagcaaaccggtgcccataaagtgtttcccattaaatcaatgagaggcattaaggctgagattaaacggttgaacttgaactagataattctagcggaaagaattgctctttttattacgtcgtatgacgctttccttattattgagaagtactaacatttttagggctcctaccgcaattgaaactcaaactcaaaccactccagctttcaccgaaccccaggttctgaagctcaagcagaatgttagaaacccagactctctggttgctaacgctgttaccccagcttttgactggaacacctttgagttcgctcccatccgtgagtcaaccgtttctcgcgctatgaccaagcgttactttgctgatttggacaagtacgctgaatcggatgttgtgattgtcggtgctggttctgctggtttgtctgctgcttatactttgggtaaggctagacctgatttgaagattgccatcattgaatcaaacgtcgccgttggtggtggatgcttccttggtggtcagttgttctctgctatggtcttgagaaagcctgctcatttgttcttaaacgatcttggattggagtacgaggacgagggagattatgttgttgttaagcacgcagcttactttatcactactctttgttccaaggttcttgctcttcctaacgtcaagctgttcaatgccaccgctgttgaggacttgcttaccagaaaggacgagaacggccagattcgtattgctggtgttgttaccaactggactttggtcacaatgcaccaccacgaccaatcttgtatggaccccaacactatcaacgctaatgttgttttgtcagctactggccacgatggtccgttcggtgctttctgcatcaagcgtggtgtcgagattggtgccgttaaaaaaatggacggtatgcgtggtcttgacatgaacaaagctgaggatgctgttgttaagggtgccagtgaaattgctccaggattggttgttgccggtatggaggttgctgagcactctggttccaacagaatgggtcccactttcggtgccatggctctttctggagtcaaggccgcagaggaagttctgaaggtcttcgatgagagaaagaagcagaaccagcaatgctatggtggactttccgcttaagcgtgcttcttttttgtttctttagttgtttagtttttggcactggttttggtcgaccttttgttttaagtagcctatatatgcagttaaatgattgatagtttgatttattccgtgcaacttaagggattgtgattgggcgtggcaatctacctacattctatttacctgcaatcttaggattgagattgattcagattctcttgaaggggaagggttagactatttaaaattcatacatacagttcattctctatttagggccaatcatgttttctggtctgacccattgatcaaactcttcctcagaaagtacgcccagttccagagcagattgcttcaaggtgaggcccttagcatgtgcattcttagcaacctttgaagccgaatcgtaaccaatctttgggttcaaagcagtaaccagcatcaaagactcgtgcagcaattggttgattctgtctgggttggcttcaataccatccacacagtgcaatctgaaggagttggcaccatcagccaacagtctaactgatgataacaagttagaaatcatcactggcttgaacacattcagttcaaattgaccagaggcaccagcaaaggtgattgttgaatggttgccgaatacttgagtgcaaagcatagtgacagcctcgttttgagttgggttaactttaccaggcataatggaagagccgggctcgttagctggcaaagacaactctccgtaaccacatcttgggccagatcctaagtatctgatatcattggcaatcttgaataacgaggtagctaccacgttcaaggcacccgaagcttcaacaatggcatcgtgtgcagccaaagcttcaaacttgttgggagctgtatagaattgcagcccagtcaaacgcgtgacttcttcagcgaccttttcagcaaatcccttcttagtgtttaaacccgtaccaacagcggtaccaccttgggcaagaaatctaagggactccaaagatttctcaacacgagaaataccattggtgagttgttgaacgtaaccagagactcttgaccaagagtcaatggtgtggcgtcctgtaagtgagttctaccaattttaatgatatctttgaactcttcagacttggcttgaaaagaatctctcaatttggtcaattcaggaatcagactattggtgatctcagtgacagctgcaatgtgcatgacggttgggaaagtgtcattagaggactgagacatgttcacgtggtcattaggatgaactggctttttggaacccaacttaccacccaaaatttcaatggctctgttggagatgacctcattagcgttcatgttggactgggtaccggaaccagtctggaaaaccaccaaggggaaatggtcaattagtttaccctcagcgacctcagtagcagcctgttgaatggcatcagagagctttggatcaagaactcccaagtccttgttcacaatagctgtagcctgtttcagagtaccaaaagctcgaacgacaggctctggcattctctctctaacaccaccaatcttgaaattctgtgaagatctttgggtttgggctccccagtacttttcatcaggtacttcgatttctccgaaggcatcactttccgttctcttggcgatgacagtagaggagaaggcacgtactgcagcggccgattgtgggatcaacttggaagaggagtttctgagcatcgttaaacaaaaaaaattgttttcaatgaggaagtgtcgtcggcggataaatgacgcttcttatatgaagggaggttcaatggaagctgtgagggttaccccgggaagaagtcgtgtagaagcgggaacgcggagaatcgaatccgacgcggagatgagatgttagcgaacatctggcatcctacaaatggtgtagagtgagtgcgatgaaatttaccaatttcgtcgtaacgggacataagttgatttagatggaattctgacggtagctgcatttacgagtagtcaaggcaggagtttgtcaagtactactaattttttttgataaataaaaccaagaacttcattcctagatgcaaggatgtaagagcattaccgagatgccagaaatccgctagtaaacagaagaaagcccaccgtgggaatagtgtttgagatttagttcaatttcctatctaataggagatttgagcaagtttccaggattagttttaccccatgtgcagtggtcctggttctcagccctaaagggttattgaaaattcgatgaaaacttcaaaacctccaggagatttttcgaaacagtagcgggtggatcttgacctttcttgccagtgactttcttgattttactacactgataccccagtattggcttataaatattttagagttgtaccacgcattccccgtccagggaggtcaatcttggcatactcccaactagctcgtttgcgcgccccttccagcaatgcactacgtactacataccatctccagccgcgcaggttacagataaacaattgccaactatccatactgaatattcatccagggaatgctcaaagacgtttcagagtcgaacgactcggagactcagaggagtaaccaacaagagaacaagaagtatgagtcaaagaggaagaagtcctccaacataggccagcttcctgccataatcaccaaccctttatccaacatttttctggagcaatctgaagatacgggtgtggcagaggaaagggctggaaatgatgaaggaaatgagatatcgcacaaggagaagcctcatcaagagttttatgacaacgaatccaaacaaaacggaagaaaaactcggccgccttcaaagaaacctaagccctcctccaagggagaggaaaatgacgaaaacttggataataactggattcaaaagtttaaacacgtcagaactcccactcacttgagtttcaatgatcagttgatatggaaggaattgaaaagaccattcaaaagggataagtcagctaaggtgttacctaaacgacagcaaaacgatcgtggagacggctttcgtcaggaggaggaagaagaagaagaagaaaatagagataccagaataagagcaaaagcgatcattgattctttggctttgggttctccctccgtattattagcagctagtgtcttcttgagagatgagcatggaacaaggcgagctcccttactacttggcttattgggttttaagctagttgatgtgacaaaatatacggtcaaatccgatgaacctctttctaagaacagaacttacagatttgatttagagtacggtgttggccccaccaggcacaagtggtcagtgaccaagagcatcaaagatattgctgctcttcactctcgactgaaagtatctttttttcaagagaacgctctaagaggtacaaaagatgttgagttacctaaatttccaaaaattagcaactacatccaaaagttcaagcagacacagtaccaaagaaagaaagacgaaaggcagcattccagaggtaacagtccttctcccaggagagcttctcattctgtagaccagcaagatgtaactagtgttaattccttgagctctctccgtacaaattcaagcgcaagagaactgttcaacaattttgtgacgaggatgtccagtgctgttcatcaaacagatcaaagaagtttccccttagatttatcttatacatctgtatttgaggagtacagggaggcgcttgatgattacctgaaagagttgttgatcgtattaactttgaggcctcagagtaacaaacttttccagttttttgaactttcaccaataggagaacttctagtcaatgattcaggatttcacggaaaacaaggttatcttcgagtcagttcaagtgccagaacacaaggatggagagtaggtcatttaaaggtgaaggaatggaaggccatggtagagagacacacagccaaatggtttttgatcaaagaaagttacatcatgtatgtggcagatatctactcaactacaccactggaagtatttcttgtggattcctccttcaagtacagcttttctggagatcagcatcaccacaaattaatggggccagttactgatacactagaggattctgattttgatgacgtttctttgcaagagtttacaacacaaaaaaaccaacgagatattgcccctagactggctatctcagttgagaatggggaacgtaaaataaagatgattgctcaatccgaaaggcagatgaaactttggattcagtcaatcgtgatgatggaaaaaaactcgaaatgggctgaaaagcatcgtttcgatagttttgcccctgttcgaaaagattgctacgctcagtggtttgttgatggtagagattacatgtgggcagcttcttcggcgattgaaatggcaaaggatgttatatatattcatgactggtggttatcacctgagttatatcttagaagacctgcaaatggtaaccaacaatggcgtattgacagattgctacttaaaaaagcggaagagggagtcaaaattttcattataatctaccgaaatgtgggtacctttgttgttaccgattccctatggacaaaacattcatttctctctttgcatccgaatatatatgtactcagatcacccaaccaattgctacagaacacatatttctgggcccatcatgaaaagttgcttattgttgaccagacaatttgttttcttgggggaattgatctttgttatggtcgctttgatacccctgaccataccctcactgatgccaacgagaaagcttttgaggacggaagtgaaacttatgacaaagaccctctgtcctatcaaatgttccctgggaaagactactcgaaccctcgagttaaggacttctatgccttggagaaaccatatgatgacatgtataatagagaagaagtacccagaatgccatggcatgatgtgcatatggcatcatctggacaaatagctcgtgatttgtctcgtcactttgttcagcgttggaactatctattaagacaaaagaggccttcaaggtcaactccgttgctattgcctcccgcagatcttactccggagcagttagaatcttcacgattcaaaggtacatgcgagattcaacttttgcgctcctcctgtaattggtctttgggattaaaacaacacgaacaaagtattcaaaatgcatatctcaagctgattgaaacttcgaatcatttcatttacattgagaatcagttttttattacgtcatctgcctggcagggagttgtcattgaaaatacaattggagacgccattgttgatagaattattagggctcgtaatgagaataagacttggaaggctattattgtgattccattacttcctggttttgaggcgaaggtagacgaacctggtgcttcgtcgttaagagtgattgttacttgtcaatacatgtcaatctctgtaggtccgacatctatcttcggaaaactaagaaagttaggaattgatcctgaggagtacatccagttctattctttgagaaagtgggcatgtatcggcaagaaaagacgactagtcacagaacaactttacgtccatgctaagactatgattgtggacgaccgttctgtgattattggttctgccaatatcaacgagcgctcaatgacaggaaccagagattctgaagtggcttcaatcatcagggatcgtgaaatgatccaaacaaccatgaacggggaaccatatttggctgcgaagtttgctcacactttaaggatgaggttgatgagggaacatttaggagtcgatgtagatattcttgatatgatagaaagaaggttcaatgacatcgagaaacttgcaagaacaagtctcggtaaaaaagctgcaactggaaaattcaagaatgaggaacatgaggtaatgagtgcaatggttgaacttgctaccagagatgtgttagggaagaaggatggaaccaaaagatggagctcatatttcagcactataaagagcatgaatggcaattcagatttaccaagtaagctccatgatgctctggagagaataattcaaggtgatcaaattgacacagactctgaatcagaatcagaaagctatgtcactgaacttcctcatcctattcgcagatcttttaacaacagggcaggacacgagaatgcaggtctcagggatgccaaatcttactcaacagacccaagaatccaccataatgattctcataaaaaggacatcaaagggaaggggcaagatagatatgactcccctggtaacaagaagtctcgtaagaggatcacacaagttttgcaagactgggctctcaaagccacgtcagaattaccttattccgatgatgtttttgttcccaatcatgagcaagtgatgcaatttttgaactcaaaagaccacgatccagaatcagaaggcggcgaggagacaaataactggaagaatatcgaaagatggggcctactcaaacgagtagcatacttacagagattaatggccaaacagcagaaggacaaggccgccgaaagggaaaagagggaagctttgaactcaaggtccaaaaaacaaggtgtttcgcccgcttcctccttggaccaaaatcaaaacaccgcacccaatggctctgcacagacagataaagtgaaagtgtcaggtgttgatagtgctgtagaattaggtgagcatcttaacgagaagggtcgaactgatggaaacgttgctccaggattaaaccattcggggtctcttggttcagatgaaatatcgaatgtgaaggtaattcatctcgaaccctctgaagtgaaggacatcatcgagtctttggaaactaggggtatatctaaaccaagattcatagatccttatgcatttgaagatcctctagatgatgatttttatgaggatctgtggcatgatacggcttttagaaacactgccatcttcagaatggtcttccactgtcagcctgatgacgatgtgctgacttggaatgattataagaatttcagcaaactagacacagcatttaatttggcacagaaaaaacgagaaaatggattgactcgagtcgacagtagttccgaagacccaaacaattctcaggacaccagtatcagtatcactgacattgagaatgcaacgagctaccaacgcgataaagtattacaaagtgaggaagatgccgagaaaccaaaacgtcagccattacatgggaagctcaagaagagtgttgctggtggtggaagaaaaatgtcttactcctcggagcattcacaagatagcattgtaggcgacagctcagatcaagagcagccttcagaagactctaccattgagcgtatcgatacagaaattgatggggctctggacatcaacactgagaaaagccgcaagaccaccaccaggagaagaagattgtatccttcccgaagagtcgtaaggaacataaggaacagtgtgtttgactggtctacagcagagctattgttgagctacgtccgtggaaacctagtgctatttccagtagaatggctcatggccgagattgaatcgggcaacctgttctaccgaaccgatagactgcctccaatagaaatatatgactaggtctaagtacgcattagtagattatctaggaatgaggataaataagatcacaccaaatcccgtctccgcgaattatcgccctatggatcactgataagataagagagaaggtactgtccaatttgtgagattagctgtaaacagtatacaatgagttcaacaaatccagtgaattcgccgcactcatcaagtatcagtccactcacagagaatagctccacggccacgacgcctgagattccaaagcagaaagctaatccaggaggaagattcttcaacgagtactccaaaaagatacctggccccgtgcatggtcatttacagaggatggcatcaaccggaaagctaccgctgaaggatgtcagcgataaacgcagccattacatgtcatcattgtactctgcgaaacgtcagtttggatctagagacgaggcaaccgcccgatcgagcagaggttccctagttgttccttatgatgagcatgttgtgttaccagcgttaataaaccatggggggaatggcagatctgaacatagcctttccaagaaaataactcctcctcttggatctactcggatggtggtccaaagtgtaggggaacaagttgatggcttttcgacttacttcatgaaaaatcgggtgaaattgagctccaaaacagcagaatcgtcattcttatctgattatgaagacaggcaagatgacaagacaattggcggtttatcgtcccctcaaacgacaacttctgacataccaggactttcgatgttagacaatctaatgaccaaaaatgatgtgatcactcccgagatttttttgaacaattcaattcaaaactcgaagacagtattgatagccgaaattggaaaagctggtgaagcggaatcgacatttcccccattaaagaacgtgaacctaggaactcatacaaccaggactcaacaaaaacaactagccataagggatttattgtttaacgaagaaaggcaaaatcgcaacaattcagagcgctctggaacggacattatacattatctgaccactagttccaacgatggtacttcgaataattggaagcacattggaattcatgaacgagtacagttcgaaactatttccaatgaattgaggaagctggctttgtttaaccaacggccgatgatcgatgccgtacgaaggaattcgccaggattcaaaccaaaaagcactgatcgttcggcgagaagattttctaacgatgcagaatctaaacgccaattgagagaaatgtcacttaagatttggcaaactggtgttagagagcattttactgacaattcaagtgatgagtcataaatgatgagtgatgattgataaattatgtgcgatgtatgaatgatagcacgactggctacgtgtcttgtgtcccctttaattgtatagtatagtataatttcttatagctatagctgtaattgtaataaggtaaaaacccatacgcgacatttgacatcgtttggatacatttgattctaaggactgagcaccaagaacagagcactccacagaatcgtatcagcaatggtggaaacgactgacgcaaaggatccggctcaatccaattcaccaaaggactctttgaatgtgcctcaactggaaaaccgggagacaagaaaactcacagatgatgatctctccaatgactttctgaagcgaaagagaaaactggtacggggaaatgtgatccccaatgaaaagtattctgcattttcgttgagtagcagagacaatgaagacggaatagaaactttgaatgaagaagcacccaaagtagagctagctcaaaagccagcttggatgaccgaggacgcttatagacagcacaaagaagacgaaaaatctgtcaaacaaccagtacgacgaagaaggcaaaaactatccattgaagaacaaaaaaacaagccgagcaaagaagactgcaggaggagaagagggaggaaaaggcccaccaacaactaactcaagcgtctcatgagatttcaagtcattcccaatattcgcaaactcaagatattgtcagaagtcattataatgctaggacccatcttgccagaaaagaagatcgtaataagtcacccatcataaaactgagacaatttaacaacatcattaaatatatgcttattcttatgttttcaaaacctaacatgactgttctcgacttaggatgtggaaaaggtggtgatttgtataaatggcaactggccaaaacctctttgtatattggaattgatctttcagatcaatccatcattgaagctattcatcgataccgaagaagtagaaacgttgacttcagagtcgcttttatcacaggggatgcttttgaaacatcggttgaggaaatagtggcaggtcaggaggaagctgagctaccagtcgatattgtcagtatgcaattttgtatgcattatgcctttgaatcagaagccaaagctcggaagatgttggagaatgtgtcccactcgctcaaaagaggaggttattttattggaactataccttcttctgattttataatcgataaaatcaaggatctccctgaaggtgagaagaagtggggaaatggcatgtattctgtggagtttcagaaccctcccccgagagatggagtattcagacctccatttggaaacatgtatacttatttccttcaagacgccgtagacaatgtcccagaatatgtcgttccctttgaagcatttagagctcttgcgttggaatatgatttggaattgagatactccaagccattcctagaaatgttcgatcaggaattccccaaatggaactataaacttcctcaaagaatctctgcagctctaagacagcaagatggaagttaccaagtttttggggcggagagagaggccatctctttctacaaatcatttgctttcgaaaagatgggtatgtaaaattctatgtaatagtgtatcttccctttgatttatctttagtttcctgtaagagagcttctatcatttttcctttgaaaagagacacggctttatttacagatgcctcagaatcagcttcaataagaaggtaaagtttcggatcctcaccctctgaaggtgccttacctgtagggtagaatctacctttagatgtgattgaggcgttagaagcttcaatgatatcggatatgttcactctgttggtcatggtccagcgaacctgttggggtaagtcgttgatttcaatcgtagcatgaaattgagtagtaccattacctgatggctcgctaccaaatactaccttgaattcctccacgggttgatccaaaggaggtggagttgcagttgcaccatgtgtgttttcctttttggggtctgcagttgccacttcatctccatatgtagtcttttctagttgtctttttagctccctttcttcttgtagcttctcaagacctttcccaccgtatccagaccctcttttagctgagcctgtctttaattgttcaataaaaacgttggctacagcctgaacattgtctgggactaactgtttactgactttaagagctctagaaacatcataggcagctctatagtcttttgcggttaaaaaggtcaccgcctcacctgtacttccggctcgaccagttctaccgactctatgaacataatcttccatgtgatttggactatcatagtttattacaagattcaatctcttcacatccaagcctctagcagccactgatgtggctaccagtatatcagaatttcctgttttgaaatcctgaataataaaatctctatccatttgttcttttcctccatgtaaggactgggcgttgtagcctcttttcagtaagttagtcagtaagacatccgcagaatcttgcctctctacaaaaactaatactttaccagtgggatctttactcttgaatgttccgagcaattctaacaatttgctaaaccgttcttgtggatcaatcacgaaaactttttgagtgatagtgtcagctaccacagatttctctccaacaataacctcgaggggattattcagtactttttttgctaacgcctccatcttaggtggaaaagttgcagagaataccaacgtctgcctgtcaggtctcgtattaggaatgattttcataacttgaggttcaaatcccatgtcaaacattctatcagcttcgtccaagaccagatacgacgtacgactaaggttagtgactctcccactattagcagtaaggagatctatcaatcttccaggcgtacataccgcaaaatgaacccgtttttttatgtcagatatctgttgactaatggatgcacctccgtacacacatatacccttcaagttcaaagatttcatgaacggtttacattctttgaatatttgaagggcaagttccctagttggtgttagaataactccaataggaccttccccagattctggatctggctgagagatgatctgacgaaacattggaagtaggaaagccagagtctttccagatcctgttttggcaattccaatcagatcttttccggacattaagttcggtaatgcttccgattgtattggcgtaggagcctcatattttaaatcttcaattactgacatgaactgttgtggtagagccagctggcaccattcagtaattgggcgttgaatatgcttgcctcttatttttatattatgaattgctcttattgcttgaacatccgtctctggtaaagaggaaatactttcaggctccgtgtaaaactgtttctcaaaaggttcagtacttggttcaatgaatttgataactttcttattcttgttcttcaacgtttccagtaatgcttgagcatcatcttgggaatcatagaacgatgcgtcatcttcttgtgtctcttctatgatgacgttctgcgtcttttgatttttggtgacaagtttatgtggattagatttcagctcatctaagagagaatccagatcagtctccggttctttgtcatggttggagccttttttagaattctgaattccattgacaagcaaaggggtctttttctttagttcactctcttcaccctgatcagtaaaaagcctcaaaccttttgcgtttctcttaatttgtctcgctggttgattgtgctttttaatagcaaaccccttcactttctttataggaggttcctcaatttgggaattttttacattcttttcctgctcttccttctcctttttcttcttccaaagagccaacttctctaacctctttcttttcttttcttccaaagaaagttccatctgacctctgtactatagtctctagacacatgaaactttatggttttaactactcttcgcgctctctctgtgtttttgtcgtagttcgccatccgacatcctcgagctctcactagacaccattaatttaatcttctgttgcatctgatattcagagataagggcccaaacacgttaatctacagccaaaaagaaattcactgcagctggctctatcttaccataacatttccttctcagcatctgtcacacagcctatgagtccggagagaacgccattgttgccgttgaccaaaccaaaacctcaccaagagacagcaagcgtttcttccaaagctgaagatcataaactcaccacttttggtggtgttttcatccccacaacgttaaatgtgttgtcgatcttgatgtttcttcgattcggcttcatacttggccagatggggattctgggttgtctgttgctgctagtaatgagttacacaatcgacttgctaacaactgtttccatttctgcaattgcaactaatggaactgtaagaggtggtggtgcttattatatgataagtcgttcgttgggtgttgagttcggcggtgcaattggatttatcttcttcatcggacaagttttgaatagttcactgaatgttgctggtttcatagaacctctgatggtaaatttcaacactgaatctggactgctaggttcttttttacctcctggaaaatggttcgaatttgcctattgctcgctcttcttgttaatctgtacctgtgtggcattgattggatccagttccgtctcaaaagcaggtacgtttttatgttttgcgttgttgattgctaccatctctgtacccgtctcaacattatttgttcaaccttttgaggtgccatcaatgaactccttttattcggggccctcattgacgaccgcaaaggctaacatgtttcctcatttcaccaaaggtgctgctggatctcagataaaaggcagagaaacatttaatgatctttttggaattttttttccagctactgcagggatttttgcaggtgcttctatgagtggagatttgaaaagaccgtcttattctataccaaggggcacattgtggggtcttgcaattacgtttgtttgctatgcatcagtaatcatagcgatgggcgtttccattccaagagatttgctccacaaagatattcaggtcattcaaacagtaagcatgtcaaaacccttgattatcctaggagaattatccacttcactattttccgtcattgtgggaattgtgggtgctgcaaaagtactacaagctattgccagagacaaaatctttcctgggatttcactatttgctaagggacataagaaaaccgatgatcctactattggtattttattcacatgggtcctgacgcaactttttctttttgctgatatcaataggattgcaacgtttattaccatggctttcctgatgacttttatagtcaccaacatagcttgtttgttgttgaaaattggttctgcacccaatttccgtccaagttttaaatacttcaacactgcaactgccttttttggcgctgttgcttgctttttggctatgttcattgttgatggtctatctgcatgtctgattttgatctttttactatttctgatcctattcatacattatacatcacctccgaagcaatggggtgatgtgtctcaatctctaatttatcatcaagtgagaaaatatttgctgagactgcgacaggacaatgtcaagtattggaggccacaagttttattgctgattgacaaccctaggacctcttggaacttaattcaattttgtaatagcctgaaaaaaggaggcctctacattttagggcatgtcattattacggagactttccaagatagatacagagaattgaagcgtcaaaaactaaaatggacccaatttcgtgattttgcatccttgaaagcttttgttcaaatcggtataggtcctaacttagcctggggcgtcagaaatgtgtttctgggatctggacttggaggaatgaaaccgaatattacagtattggggttttttgatctgagtacttatgctcaacaacatcctgatgctttgagaacttcgagtaaaagttatgagcgtaataactatgagtataatcatcaactgcccgatcacatccagagtttgcctactgattcgtgcaaagctgagcagagagtcaatataacagaatgggttaggataatcgaagacctaatcattttagaaagcaatgtagctgttgcaaaagggttcccaaggcttgaaatacccgaaaagaattcacccgagaagtcatcacaggagaaaaccttcattgatttgtatcccatccaaatgagcgctcaagtcacgaacaagcagacttctaaaagtgctttaactaccaacttcgatacatatacattgatcctacagctcggagccattttgaacacagtccctcaatggaaaaggtcacataaattgagagtagtagtgtttgttgaataccaggaagatgtcgaagatgaaaaacatagactaactcttctcttggaagctttaaggatacaggcccagattaaaattttggtactaagtgatggtaaatacaaagtgtatgaatacatcaccaaaggtacaataacggacgcaaggattatggaatcaatttcagaagcgttgagtaaagatgactggtggagctcggtattagaagcaagaaagcaccggagcatgacccgtaaccttgtggccctcaacaaaaccgttactattccgttttcaagaatgaccaagagacggttgacaatgtcaaacctgcaaactatgggtgtctcaatgagcatgaaaacaaacaatctgcctggaccagaaatttcccaattagaatattcagatgacgatgactactatagtgaagacgatatgtcactgtattctaacgctatactgccaaatgcctccactgttcctgatattcccaatggagctgggccaaaaggttttaacgagagctctagaaatatgtcgtctgcagccgctctccataggatgaaaggccctggctcagaaagttcaacagcaattcgtaatcactcaaagcccgacggagtcatgttgaagcctaaactatctaagtatggatcaacatcgtcaatccaaagtggaacaatcacacccaaaaaacctatcaagtctgcagcgttcactgccagtaggattcctgcagcacatgtggtggaagatgctgagggtgaagagccatcgattatgtttgttcctgaaactgaaacaaacaagccaaaacaactagcagtgagagcccctacgaccagactcaaaccccctagcgtgaatagatcccatgacgattcttcaggaaaggacacgactgaagtcagcgaggaagatcaggaatctaactcagcacaagagttggagtttgatgaagatatacacttctcgttcaatgagataaccacaaaagctcaacatttgatacttaatgagataatgaaaaagatttccttgaatagttctgtcattttttcgaccttacctaccccagaaattggatgtcataattccgaggctgattcattagagtacgtacaaagtttggatgtttggtgtgacggtctacctcccattttgttgattaatgcccagactatgactgtcaccacagctttataattctatagtataatgctacatatctaatataattatgacagagcatatttcaaaccagtaaatcgcggtgatattcaaggtttctttccgacttttcccaggttatcaaacatgcctagccttctagagtcacaaagattgtctttggaggaacttgatcggattgaattggaaatagccgagagaataagacggaatccagatatatataaggcttacttctctcataatttgttaggaggggttaagagaccactgaaacaaactttactccagcagcatgaaatcaaacatttcctagatcaatatagtaagaaaagccaacaaataaaccaagaggtaattaaagatggagaaaagttattccaagagattcaggagataaaactggatctttctggtagttttaagctctttggccagaaaattgaacagttgaaaaataatcataaaatgcatccaaaccagccactggatgaactctcacagctatattcaatgtttagcagtcaatttgagaatgaaagatatcccaaaaagcgaaaaatcgtatctgcattttgctctgatctgaggcttgacagtatcttttctttggaagaaaactatggccagttcctagacctttcaaagttttacactcagtggcaaaatcttccgggaaataaagaggccgacatcaatcttcatggctatatttcaaatttcagtaacttcaagaaatctttttcttctgttaataagaactctacggaataccaagtatatttgacaagtctctacgcatatttgtgtgatttttggatcaagattcaaccactcaatgagcctgaaaaaaacatattggccataaatgcaaagggtgttgagttacagaacaagagcgatgagtctattcagttgaaccaagacggatcagtgttctgtaaatcatgtcagaagtcatttgcaaaagaaacggtatacaagggacatttaacaggtaaaaaacatcttaagaacctgaaaggaaatggaaaagcaccagagacaacaaatcaagttccaatccttgaattcaaaatacgggaaatcagtgtccttttggagaaacaaatccaggagactatcaaaaacgtagaacgaaggtctcatctttccgaaagagaaagactaatggatatcgaagctcgccaacaagagtcggaagatgagtatgatttcgaaggaagcgacgagatatcgcacggcaactcagatgaagaaggtgtcgaaactttggataatggcttaaaggtagcaatgggccctgacggaaaaccgattccctactggttatggaaactaaacggtctttcactggaatttaattgtgaattatgtggaaatgttaagtatcatggtaggaaagaattcgaatctcattttcaagagactagacatggccatggattaaggtgtctaggcatcaaacctcagtttttttcttggttcaaggatatttctggtatcagtgaagcaacagaactatggcagaacattcaaaaggagcatgggatcgttaaggattcggatgaaagcaacatagaaactgaagataatgaaggtaacgtcatgtcagtgaaagtctataacgagttgaagaagcagggtttattataacttctgatagatgtttgtatattatataatgtaacctaagtatattcacctggacagtattttttcaagtaggaaagacactcagctttcaaatcatctagatctgtttcctgataaagccttctaaacaaattgattgcaatgtctttcagcggaggcctgaacataataagaaattgcaatgaaacaaagccaaacttgtaacgaattggatccaaacaaatggatttgattttctccaccatctgttcgttcagagatgggagctcagagagtaatcgcaggaagatttttctatcgctattctccatgaatggaattatgttatccaaaactttggatccccaagcattgtacacgggtgtatccggaacttcattgtcctctttgcgatttctagcaacttcacaaatccattcttcgttgagccaatcaatgacaacatctattctgccacgaatatcggcagtaaaatatgtgaagatggcatctctaaccaagtcattaagattctctacagttccatcttcgttggtgtgctgagcatcacataatccacgcgtagctaatctcgttaagaagaccaaccacgtattttccttccacgatgataaagcaacaccattcaaagaatcatcattcgaaacatcagaaagaattggctgtttgtagtccaactgcgccaattccatgaactggctaataatttttagaagttgctttttttgatctttgaatgtcatataattaggtaaaggaagttcatatacgagatctgggttgtaatcatcctgcaaatccttgtcatcctctcgcttcactgaatccgggacattcgcaatttgtatatcctggtcctgggagatggtgtagttttgttgaaatttcattacattctgaaatctgtcagagattatttctagtccttttactagttttctagtagttgtattttgtaaagaatatgcaatcatgtcaatcaaaatgttctgtggtagttcactcatattgaagctagccagtttattgtttggcgatattaatgagtataatgatgagtaagacaaatcaggcgttattgggcttgaattgtagtaaaaaaggggtgattcggaagggttgttctgaagttgctcttccaaactttcatttccggtaatttttttcttcttaaattcagccctcttttcttctctcttaatttcatgactatctggtttcaacagacccctcttacgttgatcttcaaacatgccctggtagtaagtgaatttgttctggaaccttttgagtaacttcgtatctttcacaaaactcttatttagacaatatcctatcattactttcagaatacgatcgttgaaccttcgaataaggcgcattttcaactggttcgactcaaagagtgggtcttccttattcattgattcataggctatcatgaaatcaaacagtttgacgcttactaaacctggtcttttcttgaacaatgttaacagacggtttgtaatgacacaaaataacggggagtttattatcctggaatcatttaaagcatcaaagaggacgtctaaaatttgtcttccttcaacctccagacgagtcatgttaagaaatttgtgatcacttgggatactcactatagatagatcctccggtgtgttcttcaattttctagccctagctgctcttggatcctttggtggagcaatactaagtattgacaacacatttgtgatgaacataactagcgttatgttagatctggttgagcgactggcgtccgattcaggattcagtgggagtaaaggatatgcagtaccaaatttttgaatcaaattgtccctcaaactctgtaattggtcccatttggactccaagtcctgcatctgggggctggacagacactttttgaaaatgatcggatatatatggttggtcaattgaataatcttgacaaaattagcaggtgaaggggcccttggcaattctagatgagactttgaggaaattaggtaactcaaaggttgaagcagttcatcagccagctgaagctgaagctctttatccaatttttcatccacaaaagattctttgagaaagtcaataaccaaggtttgtaaagtagtattttgattgtagatgaacggaagaaggttgtgaaagatgtctgtatacagttgcggtttctggaatgcaacctctctagcagaaatcagactgctaatctgagtctccatagtgctttagtttttagggaggcgaaagaaagagaggaaggcgggtatcgaatctaatccaagttgttccgttcctatgccaaagaggattcaccaacgaagaaaaggcagatttcgaggttgaaagaaaatgcttacataacgaaattttaaggagagaataaaaaactacttaagtactaattgtccttgttctgggcaaagaaaaagttcacagcaagaagactcaaggaatttttggcagcccagtctgagacaccagagcccggaattcctgtaccccaattgggtctgttctttggatcagggccttctagagaaacaccaggtttctgcttatataagaggaaaacataacgatgcagtcctgtctttggaggcggacctggtccgaggtagggaaccagtgttttagaatccgattctggaatggtatcaaccttcaagtcggtagtaaaattcacctgatcctcagcgtcagtagttccggactttgtactcaatgacaagtcggagacgacataatgacagaattcggaccacttgttatcagtacgagatggagcgtcagggtccgtaacaacaagagtgaacttttcgtcaaagaaactagcaatctcctgttcctcattgagattaacggtgaaagttatcttaggaattgattgagcatcctcaactttaagagtgttgcccaatacgacttccttatctggacttccataggaaatgatcaacagacctttaggaacaaaagatttgtccttgataacatccggaatgacctcgtgtttgatgaggttttctctgattgagtctgaaatggtgacaaggttcatgctctgtttaataattggagaaagaaataggggggtaagcaaaggtcgttgaaacttgtagcggagggatctgatggaattgattggactctttctagtaagtgtatggaattttgggaatctttgaaatcccaataacatcaatcgattgagctggtgaagactcaaaaagaaaaaaagtgggaagagaaaatagaagggaaacagcaaaagcaagtttgcaaattaattattagttcgagattatgtgtttccccataagatcgaggtacttatgcctcaccatgttctagaaaaatgacgctctcaccccttttattctccctttaaccgttgattataagaacttagatttattccaatgttcatcctgcacaaatgaagttaaagctttagagcccgtttgaagaagtggatggccggcaatcacctttaagaactgttgtaaaccctgtctgcgctcctcaatgaagtcatcattgaagcgatggtagttgaagaacgatttctcaggaagtttagggatcacgacgttatttgtctgggactctagtacctttctgaacgagtcaaaatctgagtattttctccgcacccttgattccttaaatttaaacatcggtatgttggtctgtattgttagtaattcgttctttatggcaattgagtttttgtacttactctgcaaacgatttcatagtccgtgtacatgctagaacctgatccgtgtgttatggggtttattacttcaatttcaagaaagttctctggttcgccgtagagctcttgaaaggactgcgtatgcttagaaggagacaggtttgattgaaatgactgaaatggactgggcatgtttaatgggatgtgtgtacgaaaaaagctatcagccgttgttaggacctttgcagtccaaggtgttgatgaaaggggaacaagaagacagattaccttttttttgcccgttgagtccgcagtttcgtgggcggtaggcggaggatttaaaacggacgggtctttccttttctgcgtgtcctgaagctttagccttggcacaccttccctaatagccgtcgcgaacctccctatcaaactcttccatccttcaatccccacagggagactctatactcgttgattaatagaatacaatgcaagagcaggagtactacgaagagtacgagcagaacgaggaaaacgctgccgaggatgaccaatcagaaggacaagaagaagaagaggatgaagacgatgagttcggagccggcagtgccttccagaatgtaggtcaagggctgacaggccgatccaagaacatgatgatgcaatattggcaggaaaccatcaactctattgaacacgacgatcatgattttaagaaccatcagctacctttggccagaatcaagaaagtaatgaaaactgatgaagaggtgaaaatgattagtgccgaagcccctattttgtttgccaagggatgtgatattttcatcacagagctaacaatgagagcgtggatacacgcagaagagaacaaaaggcgaactttacaacgatctgatattgccgcggccttaaagaaatctgatatgttcgattttctgattgatattgtgcctcgagacgaagagaaagggaaacgtaccaagggaatgcaaccccctccgcattcgacgctgcctggagctgcgcaaatacctccaaatgggcctcatgaaattgaagccatggatgattcaaataactaccagacttttctacaggattatcagaacgataatggaggcacagtgccagatcagaatttactggatcaacaatatcacatccaacagcaacagcaacagcaacagcaacagcaacaacaacaacagcagcaacaatctcagcaacaatcccagcagcagtctcaatctcagcgcacacagccagaagatcctactcaactacaacgtatgtataatgggttttaaaaactctgtgtaatattactttctcttcttccaccctatttttgatgcattgcgaaaatatcaccaaactaaaaataaatacgggaatgattacgtaacaccgttctgatgttcagatctgaaacgaattccgtcgattcatatctaaagataactaaacgtgttccggcgccctttggttattttcaaatgtcactatccagagtagcgagagatgctaatggagtgctctacgagacactgctctcagctgcaaagagagagacagaggacttttcatcacaagacaactgcgtgacttgctctgacgtgcctacgtgccctacatgtaaatccaacgaaaaatgtgtcctaacggctaggacgtgtagcacctgtcctgagatgtcctgtgtacatgatgaaaactccggttcatcttcgagcctcagctctgctgccacgggtggtatctcagctggtgccgtagtgggtgctctggttatattttctctgatgggatttttgtattttagatacgtttacaagcccaagaagatgcgccaacaggatgaggaagctaacaatgtgaaagatatgacagatgacaaatccacgctgtcaaatactcaaaagtcaggggatattgacttggaaagacgaaattcttcactgacgctctctactatggctaataccatattgacaaagacatccaatataatcccaatagcgtatattcctggtgttatggtctccaacagtggcaggtccaactcaacttattctaaaagtatattgtcagacgacaacttttcatccttccatgaggatgcctctatccataacgagaagagaaatgatagtaacacaacaacagctataagagccgtaccaagactagtgaatatagccgaggaagatgattccagctctattgttgaactacagtccatacgtctcgcccctattcatcggccttccatgcctgtcgcacgcctgaatatggatgatgaattacaaaagaccacaacgggtggaaattcaagcgatgcccaaacctttggtgatgatgagtctacggatctcgcttcttcagatgaggatttagactatgaggatatacaaagagagcatgagaaacgtcaaaaggctaagatcgagaaagagcttggatcgagtaaatccaattctggaacaacttccttcaaaactctgttagactcttcacaaccaggaacacttggaagcgctgctgttacaaatactttgcaaactggaaggagggtagagccaaaggaactcgatggtgcggatgacaataccaaagctgacgaccccttagacaactcagatgtggaaatttttctcgatgtggatattgaacctatgaataagaactcctttgaagaatctgaatctggttcagtatccccatttgatgataaatatggacttaattaaatatcataactctctgtttttcagcacagtattcatcggaatgccaaaaattggatgcaacggctcaatgaagttggctggatcttcttggggatctttaattctctccacccgatatgcaaatgcactggctcctaacttttctgtcattaatgcagggtcatgtttggccttgtgctgacaaagcgataggccacataagacgtaattggtgtgatagaagtctggtcttttccctggtttatctcttagtcctccattttcttcttgacaacatattagtatgtaatttttcagggcagcacggtcaagtaaatcgcattgggtagccaattctaagaaggggaatatacctcctacccaatgactatagcatccatccaccaatttgtttgtgcgtccattcatgcctccctccaattgaaactgtctgttaactgaccactttaccaaatttttcaaatcgcaatgtctagtgattatttcctgaggggggccaagtatacttaaagcagccacagcacagaatgaatagcctccatgtgcttcatctcctgggaccccaccaaacccaccttcaaatgtctggcatctgcctaaccattcagctgtaccagccaccagctctggggttaatatccccagaacactagcaattaccagagcgcaatacacagctctagtatctacctctcctcctttatacatgcaaaatgagccatcttcgagcttcaaactgagaagccattcataggttttctgtctatcaattttgtccaaaacatggtgatcatttgacaagcagagggccataaccgctgcgtaactggagactacatgagaaatcaaccctgcccctccaccaaatcctccatcttcattcaaatacgaaaggatgttctctgaaattctgttcgacatatcctcgtcgatcttcccgccaagtaacaggaaggagttgactaaccagaaaatcatccaagtgtgagaggcatccaaagctataaaaccagctggtaagttcgtttctaaaaaatatttcacaaaggagcgatgctgagttgtttcaagtgtgggtaattggccgtcatctagaattgattcatatatttgtcttatatcgtcctcaaccttaacctgctgttctgtcgttagagtcccaactttttgggatccagatcctttggagcttaacattatctctaaagtgtcgatctgatttgactgtgtttctgacttgaccaccatctcttccactattcttcgtgatcccaagacagtcttgtaccaatccacttttttcttggaattggacattttagtctttatatgcctaaaagaatagtgacggaggcaaactgtgtatcgttgttgggtactgttacaggtaatagttctgaaacacttgatgcaggttgaacgggtgcacctaaagtttcgagctccacagtatatctagtctctctccaggattatcataatggatcatgcccaacgattgctagaactaagtttttacaatcaaagtctgggcaaatcagtgatagcaaagaaatacagaatagaatcctctcgatatttgaatgaacaactggacaagtccttgacaagagataatgatctgattggattatgccgtatagcattagacaacaagttgaccatatcagataagattatatggatgagctctcaagttgaagacaacttctttccgccagtttttcaaggcttgaagacgtatattgatagcgacgagatttatcaagagaaacttttaagcgtaccagcggattttgaaccaatagttgaatggaagagttgcacagagttgcccaatgaatggtcaaacaatggtgtggacaatttatttcaggattctttagatgactgttcgtttgtagcttcatttctatcctgcaacaatattggtatccctctcatggataaagtcattccccacaaaaactcgttcaaatatgcggttagactgactttcaatggttgcgaaaggttggtgtttattgatagccgtttgcctttgcttaggaatacttccaagactttacgagtgtcaagtttttctaacaaagatctcttatggcctagcatcatcgaaaaagctttcctgaaaatgtgtgatgatgggtacaagttttcaggatcaaattcagccattgcaaactatgctttgactggctggatccctgaagtcattaaaacttcttcatgtacaatagcagatattagccgattgcatgaggattttcggaacggaaacgtagtactatgcttgggaacgggcaatctgaccgagcgagaatgcaaacagtatggattgatccccaatcatgactatgctgtcactaaactatcatttacgaatgattcagaatacaagtttgacattcgtaatccgtggactaaagggcagaaagcagtgacaattacagatctttcaacctttgaagttatctacgcaaacagaaatcctataatgttttcgcacatgaaccagctaagcggtatctgtcaaagtcaggttaatgaagagttcatagatctaattcttaaccattcgcagtataccctaggcaatgacggtaattctacaattgatgtgattcttttctttgaaagacattcgttaagaaagaaaatcagtgcagagtctcgtattgagattttccaatcagaaggcgaaagactaatctccagaagaaataaagcaagcaaggaatgtgtttctaataataccaactttcatttcataacaatcgaactgaaaccgttagaaaaggtaactgtggtaatagatatcggcgagtcttcgattcgaagccatccatttactctaaaggcttttgccaatgattcaactataactttgaacaaagcactttctagacctggttgtttcaagcaaatggacctagagctaacgcccttaaactctggtgggaattgggataattatgcttattacaaaaatccacaactcatagtcactcttcacggagattcaacggatgaagctccatttgaatctgctgttttcagcaaaagtgataagaccctatttacgtatacagtgttttggaaaagtgacgatccagactttcctttcatcactgacgcaagcaagaacaagctcgtaagcacagacaataagtataaatacagatcatgtacaagatcaagagttgtttcttgcgacaaaagctatttgttcgtgctgagctcctacgaacctgatgcaattgagtctttcaaagtattttttcaatgttcccacgatttttctatagagtgggctgagacgtcgcttgggcttttcacaaaggaagaaactttctcctggaaggaccaattagtcaaggagttcattattcaagtctataacccttcaaagttgaaagttcacgcagtaaacaccaacaacaaacgcagatcaaaactaaattgctctctctcattccaaaacacattaatcagctctttgcaagactacacagacaatctctatggatgctttattagcgggaacttggagattcccggcaagtatctattacaagttcataaaaacattatatctaacgaagaatgtttggtcgaaattggatctagttcgtcatttgagttatgggaacatcattaaacaaacttcttatctaccatctctgggtatttttcaataacatagtccaagtccttatcacctctaccacttagattgaccaaaatggtttgatcctttggtagagtcctggccagcttgatagcataagcgatggcatgactggactctaaggctggaatgataccttctaatttggacagcatgaagaaagcttcaacagcttcattgtcagtagctccagcactcttttcggtacgaccgatagaagaccaaaatgcgtgttctggcccaactgatgggtaatccaaaccagaagcaatggagtgaactggagcaggctcgttattctcatctttaagcatgatagagttgaagccatgcattataccttcagaaccatatgagattgatgcagcatgtttaccaatagtagactcaccagttccacaaggctcaacagcatataacttaacagattcatcatcaatgaaagccgaaaagatacctgcagcgttggaaccgccaccgcaacaggcaaccacatggtctggaagatcaccagtttctggtctcgaagcgaattgttccttagcctccttaccaactacactttgcatgtctctgaccatggcggggaaaggatgtggaccaactacagatccaatacagtacatggtttcatcagcagtagagacgtaagcggtgaaagcatcatcaacagcttccttcaaagatttgagaccgtgcgaagcaggaatcacctgagcacccaatatcctcattcgggacacgtttggagcttctttgatcatgtctatttctcccatgtagacatcacagtccaacccaaaaaatgctgcggcagtagctagaccaacgccgtgttgtccagcaccagtctcacatatgatcttcttctttcctaattgtttggcaataagggcctcagcgagacagtggttcaacttatgggcacccatatgatttaaatcttctctcttcaagtagatttgagccccacccaggtagtcagaaagcctcttggcatgagaaatgggagtaggtcttccctgatactcatttctaatcttgtccaatgtttcaagatactcaggatcgttcttgatacgctggtattccctggagataatgtccatttgttcctgaatgtttgggggcacgtaagagcctccaaactttccgaaaaacccattttcgtcaggataattttcaaggtatggtttgttatacgacattagtagattgttggagattggattaaggtgaaaaaaaccggcaactagtcatagacaggcgagtgaactaaagcgcgcgtgggggagaccaggctggagaagactacgctggaggggcccggagattatgggggaatatgaacagataaaaagattcgcggaaagaggtcaagcttttggatggggagtataacaggtaatacaattaatgtaagggcagcagttagcagcccagacacgatagcagcaagctgatgttgacagtaaaagtgtcaacaaagtcacttccgagattgtggagatctactatctcatagatatcagctatcaggactttttccgatcgcatagattacgataaactgtaagaatacaattggcttgacgccacatgatagtctcgtaatcagcaattcctcttgccgatcggataaacttgatcagtgtttgcttgtatcccaccaatagtgattttcctcgccatcagttacttgtgatagcggcttggttatcagattaagccttatcacaccgctgcaatctgtttatttgagatgatatagcaatgcctatctgccgctcgcgaggaactgcctccgatatgcgatatgcagcgtcagcggctctgaacgaacgccgtgcggttaggaacgcgcaccggttacctccacggtctgatatcgggtcttcttctttctttctttttcgattaccttgataagaagacccagatgaaatcggttatttggagccttctatctttgctagcattgtcgcaggcattgactattccattgctggaagagcttcaacagcaaacattttttagcaagaaaaccgttcctcaacaagttgctgaattggtgggcacccattactctaaggatgagataatcagtctatggaaggacattgagctggatgtacccagggaaaagatccaagaggccttcgataagttcgtaaaacaatcaactgccacttcccccgttagaaatgaatttcccttgtctcagcaagattgggtgacagtgaccaacaccaagtttgataattatcaattgagggttaaaaaatcccaccctgaaaagctaaacattgataaggtaaagcaatcttcgggatacctggatatcattgatcaagataagcatcttttctattggttttttgaatcccgaaatgatccgtccacagacccaatcatcctatggttgaatggtggacccggctgctcttctattacagggttgctattcgaaaagattggccccagttacatcaccaaagagattaagccggaacataatccttattcatggaacaacaatgctagtgttatcttccttgagcaaccggttggagtaggattttcttactcttctaagaaagtcggtgatactgcaactgctgccaaagatacatatgtgtttttggagcttttcttccaaaagtttcctcagttcctgacctctaatctgcacattgctggggaatcgtatgctggccattatttgcccaagattgcttctgagattgtgtctcacgcagacaagacgtttgacctttcaggagtcatgatcggtaatggtcttactgatcctctaattcagtataagtactatcagccaatggcctgtggaaaaggtggctacaagcaggtcatttcggacgaggaatgtgatgaattggatagggtctatccaagatgtgaacgtttaacgcgggcatgttatgagttccaaaattcagttacttgtgttccggcaacactttattgcgaccaaaagctactgaagccgtacactgacactggcttgaatgtctatgatattcgtacaatgtgcgatgaagggactgatttgtgttacaaagaactggaatacgtggagaagtacatgaaccagcctgaagtgcaggaagccgtgggctctgaagtcagttcttacaaaggttgtgacgatgatgtcttcttaagatttttgtactctggcgatggatctaagcctttccaccagtatatcacggatgttctcaatgcaagtattccggttctgatttacgcaggtgataaagattatatctgtaattggctaggaaaccaagcttgggtcaatgagctagaatggaacttgtctgaggaattccaggcaactccgattcgaccgtggttcactttggacaataacgattatgcaggaaacgtacaaacttatggaaacttttcctttctaagagtatttgatgctggtcacatggttccttacaatcaaccagtcaacgcacttgacatggttgtcagatggacacacggtgatttctcatttggttattaagtagaagctatatccatatcgatgtccgatgtccaatataagatttcgctaacacatctcagatgcgctggaagttcctccacccgcatttagatcagacttgtagaattctctccaatgtcggaaagtgaccagacgatcttctcaagcttggaggtaggtgccttcaaacaagctttacagctagttaaaaagaagcagaagaagttccccaattcctcctactactatgccttggaaagctacgtactgtggtcaagtggggacatcaccaaagcgattgccgtagctgaagacttagcttccaagattcccagtgatccagatacattaaggcttttgaaggaggtttacaagagttctggtcgtgacttcaaccttttgtatgagaatgctttgagaaaatattataatgagaaccttttagagagttggtttcattcaaatattgatgattttgatatttcggggttacaaaaggctggaatgctttatggtaaacaaaataaaagggagtctaaactgttgaatgcattcacattactattagcttcagacttggataggatatctccagcacataaaaggctattcccaatgttaggagttaaagtcatggaggctctattccccctcggtaacgcccaagaagtattcatttacgccaagttggccatgtcatgcagaatgtataatgaaacagccaacgtggtctcatcattcctggccaaagaatctgaccttgaactgcaaatcattttgcttgaaagtttacttctcgctgaaaactggcaaggtctcttcggcacaacaaaaaaacacattttatcagggcttgatgattggaatgtttggcaaaaatttgttgactccggtttgaagttggggctcacggaaaccgtggctgaaactattggcggtttcaaagtatccaggaatacccttttagcaacgatctatttgaacaatacgttaggaaatgatataacggatgcaattatcgcctattcacttcattttattgacaagagttccttctttcctgacctgaaaacctatgcatcctcatcaagattagacctgactagagttttcagtcaagtagaccctgatgatttaaaagcagataatgccagttcgttgattaagctggtgaacatcacaaaactgaaacttttaatgggggtgaaaccccctacatttcaggacaacattagttccttttcaaaatttgccaatttattggacaacaaattggacacagattattttccagcggacgagtttttgttattaggtgttcaacaactgttgtctgcagatacgtcgctttccactgtcataaaatgtatcatcatattagagaacaatgttcagatggataaacatgaattccacctccgactgtggctaatcaaattgtattcagcaatcaattgttattctcttgccaaaacccactttgatagcctgagtacaaagtttgtccaattggacactcttggccattatttaacggaaagagtgtcagctctgaatcccaacaaatctggagctgatgatttggaacacttttgttccgtttattatcaggccgaggtccaaacggttcatttcattaaagatggatttgaaaaaggatcatataataaaattcagggaatgatagaatttgctgcaagattgaataattcattaagctttctgttgagcaatattgagaaagcaaaacttgcacgtcttctagagaagaaaaatctacttgagcaatcactaaagcatttgaatgaaaaattaccactcttgacacggtctgacaagatcaatgatgttgattgcaccatttctgataacagagattttaacactctttgggactttggaacgcaaaaggttaatgatgacattgttcaaaatgagtttatattcggcaaacatcattctgtcaagtatgcacatattttctcacttgaagagctcatattgtctaagaattctgaagaaattatctcgcagcatctcaggcaattgtgtttactacttgatgatgccgactaccttaccgaattgacagaagatgaattgtggtcacttaagtttctcactagtgccattgactacgtgttgaatcataataacaactcattcaaagaagcagagaaattggttcaaaatatcccttctcagtctgaaagcttacttaattggaaatttaatcatcaccacgttgtcatactgaatactttcaaggctttcaaaaattttacactaaaacataaaactataaaagaggtaaccctgaactgtcagctacttctcaaaacactgaaacaaaggatagaccaacttagagaacaggcactgtctttgcctacccgttctcgtgcagaaactaacgcattagccgatgaagcggaggcctgggtcaatgattcatgtaaggaacaaagcttctccacggatgccaagaagattctaaataacatttacgaatccaactcgaaagctttggcatgtttaagaactctataataatcagttagatttactaaatgctacttcttccggtaactgaaaggatatacaaaacatgggtttagtaggggaaacttttctaaccatatgaaaatgcaattcttcgaacgaaatgttgaacgatagcagccttttgatcttttcatgaattctacggtgaagctcttcttctgttggctcttcattgggagaaaatttttcaaaatgatgaacgttgatggttggtaataagtaattgggtaagcttttaacttcatctattgatagctgcgggaaggctttcgtaaacaaaccgacataggcatctacaaactctatggcagaatctggcaagttcatgatgtaatggctgaaaaagtttggtatgggcacttttatttgaggagtggtatccttactgaccctttgcttttttctagaattcaaggtcagaaatttatgtgtattggagtagttgaaaaggtcattttgagcttgggttatgaaatcccgaccatcagtattgaacactttgacaaatttgtttactttgtttcttgaaacgttgatatccagatatttaaagctctcaggattcaagtcattggcaaaaacaaaacattccttcttaccactagggacagcaaacggtcccacgcccgccatgacatcacaaatagctgtatgaggcttgaataggtcaactaaccgcttatgctccgtgtgaagccttgaattccaatacactttactgaaatcaaaggtaaacaggcaatcactttcccgttgttcaaccatgaaattgggttctccagcgatgactttcattttgaatgtacgaaatgtcgtttcaatcgagtccactttatccacaacagtagtaattgaggggtttttatccattataacttgtccaataatttcagagtaaggtttatactcttctttcaggttgacatgtgcaatatgccctgttctagtaaatccacttggtatctcctcttccaaattatctggtaatatagccttcaggatctcttcagatttccagaaatcgtaatccaaggttaataggtgttcttttaggacacctttgttggcttcaataaattcaagagtcgaaggtgctagactggagttgatttgagataaggattgtatagattcgttcaagagaactaatttctcctcttggctgtctttagcttcattaaatttcacaataaacggaacattagggactctcaaagcgtcctggcgacatttgctcaagaataacccaatcttcttagggtctggaaaataaactccaacaactgggaacgttttggaaaagaatgatcgatctagaaccctcatattccgatttatcggagggtccaaattgctgctaataggcttattaatactcataaccgtctctgatattttggccttagagaaggtcctcttaaacatagagaagggaaggaagaaaacttggagcgaacattgaaaaaaaaatattgtatgcattcaatatgttactgtccacacgttatctgtgcagggcatattcaattacctctaccaaccaagtgttaaaggtcaaagaacgattagctcaatcccaatggagtaatactgattactgtatatctggatatccagctactcaactttattggctactaaaatcaagcctgtcgagaaatacgccagggagacaaaagcttggaaatgtgttagatccgttgcattccacattgaaaggagaaggagagtttaaaaggggtaatcaagttccgtttggctaccacttcttgtattgtaatccactatctacagataaagagttaggtctagacggctatgataattatgcatccccagcagaatttaccactgatggaacagttgcaggtcaacttttcaggaggagaatgtgggtcggtggaagcattttaaatagtggaatcccattttcggttggcgaagaggttacgctaacagaaagggtaaaacgaatgaaatgtctgggtaaggatccttcaagtttagattttaaatcaatgactacaaccagaagggagtttcgaaacggtcataaagcacttatgatggtggaggaaaggaaacttgtgttcttcaacgaccaattccgttccactatccacgaaaatacgttggatttacccactcctcaatttcggcatgttttcacaccatcattgttctcaaatataaaatacagctcattgattagtaacactcataaaatacattatgatgcgcggtatgctcaagatgaaggatatccagatgttttggtaagtggtcccttcattgtaaatctttgtcttcattatttttcaaacgttgcaagcaatttgacgataaaggagttcaagtacaaaaatataagtccgatgtttcctggtaaagagtaccaaatatgtcttgccaaggatgaagataggaagtatcaaatatggattcaaagccccaaaggtggtttagttgtgtttttccatggtacactcaccttggaaggtgtcgataacattgcttctcaacaatagagttctgcgaataaagattccaaagcgactcttcctgtttcttccaatggcgatatttagatggatgctttttgtcaagatcaattatggtgacctttgtgtcatcgtttgcaaaagagatgtaaatggttatgtccttcaatgccattgaacgaatcagctcttcaggcacttcgttttcgttggtaagcgtacctatcgtctcgtgaatatcctcaaaatgctgcaaatcatagagaatatggaaaagatcactattcgatagaaattgtgtcaaggattccgaatgctgttcattcaagcccaatttatcaacccaattcgtaatgagattgggactcagcaggtctaaggtgcagaacaactcttcgtctctataaaaattcaaggcacagtttctgcataagcttgtatgctgcggtattgaatacaaccatttgggtttaatttccacagttaaatggttttgaacgggatctgtatatagggagatgtgtttagagactctttttctttgctctggtagcccgatcaaaggcataataattccatgagtatccttcttaatggctataccactttcttgttccaatgtcgtcaaaaatctactagagactggaatcaactccattgcaatgagttgatggagttgagggcggaaagaattcacgaactcaaaaatttccttcgagagaacaagctggtcagccaatctcaaacgaataacctttccctttgtaattcatatcatttccaatgtatttaaagatagcatttgcttttcctttgttcaaaaaagtccagtcctctgggttgtccatgtgttcagttcggctcaattaggagcttcaaataaatgcttcgcgatatgtcaccaatttgcatgcaaagaaatgaagtttatatccagctgtactagcctgcaactagagaaaatatgacagctattactatatattaaatatagcattacgcactatcgatgtgtaacaacggtgtagacgtttgattttttatttccaagtaattacataatagataagcactatcagcttcgctaatatttttttcggctttgttcttctaactaatcacctgggatggaaaacttccatcatcctttcaaaccgtatgacatccagactcagttgatgacagcaatatatgacacaattgctggtggttataaggtaggattgtttgaaagtccaaccggaacaggaaaaaccctatcaatcatatgctctgttatgtcatggctgagagagtataagacaaagaatcctgatcaagggagccagcaaaatgaaacagaagttagtgacgatgaaccttcatgggtcactgaagcttatgagagtactgttttgcccaaaatcaaggaaaagcaaagggagtacgaaattgtccttgaaaaggtcaaatctcaaaagcgtggtaaggtggttcataaggtcaaggaaagagaatttaaaagggttaaaaagaacacggaccaagaagagcttgacgatagtcagtttttgttaaaagattataatgccaatgaaaaaaatgatctagattccatacaagatgaggtaaatgctttgcttaaaaaaataagtcagaaagactcaaactcggatccatttcagaatttggaaagatcgcaaactagaatcttattttcttcaagaacacactctcagttgaaccagtttacttcacagctacgattaacttcctttccttcttcattaggagctgtagaagagcatataaagtacctcccaataggatctcggaaacaattgtgcattaacccaaaagtgaaccattaccaatcgttaccactattaaatgaagcatgcttagaggcccaaaaggatagcaattgtaaatattatgatcaaccaaataacccacagaccatgcaaaggatgcaagagtttagagattatacctacagtgaaattcatgatatagaggatctcaatggcataggtgagtcgttagacatttgtccatattatagtatcaggaaatcaattccactttctgagatcatttcattgccgtatcagatgcttctggagcgaaacacaagacaaatattgaacatagaccttaggaattcgattgtcatagtcgacgaggcacacaacctcatggacaccataatggctcttaattcaacgagcctttcctataaagaactcatcgatatgagaaaaagcttaaaatactacttacaaaagttttcgacccgtatgaattcgggcaaccgtattaattgtttgaagttggtcaagttgactgaattgttgttgacttatataaagagaaagaaagaaactaggatcaaacctggggaaaagcttgatcttatggatattttccctactaatgttgatatcaatatttttcaattggagacctacctcacaacatctaaacttgcgttcaaagttgaaacgtacatggagaaatgtagtggaagacacgccaaccacgcatctcctcttctcttcaaattgaagaagtttctgtcatctttatcacatccctcagataatggctgttttttctttgaagtggcaggcgatgatatttccctcaagtttttactcctagatccaagtgaaatatttcaagatatagtcgatgaatccagatgtgtaattctcgctggaggcactatggaacctatggaagactatgtcaactttctcttcaaacacacaccaaggaacaagatcaaaatgttcagttgtgaccatataatacccaagaacaaccttaaggtttttgctcattccaacggtatggagggtaatttattgaacttttctttttcaaatagagaaagtcctgccataattaaggatttaggaacgtcaatattgaaaatagttcaatgtgttccaggtggaactgttatttttttccccagctataagtatctagaaaaagttgttgagcattggaaactaacgtcccctctgatgtggtctacacttaatcgtttaaaggatatcttcaccgagccaacagattcaggtaaggtggaggacgttttgtctgattactcccgaaagatttctgaaaaccccaagagaggagcaattttgttttctgttgttggaggtaagatgtcagaaggtatcaattttcaggatgatttagcaaggggaattataatggttggacttcccttcccaaatgcattctcaggagaattaatcgctaggaggaagttcatagaggattcagttttgaaggaaacaaactcaaggaaagcaagcctccaagcttccaaagatttttacgagaatatttgcatgaggtcagtaaatcaaagtgttggtagggctattcgtcacatcaatgactatgcagtcatttttctgcttgacaatcgttacaataacacgaatatccagcagaaactctctggttggattaggaaacgatttgcaagctttactatgagcaaagctatctccgagactgaagacttctttagaaacagaaaacttcaccaggtcaagtagactgaagactaaacttatgccatatggtaaatccaatggtgtttggatgtaaatacaattgtaataaacgtatcgaaaaaattcaaaacaagacagatttcctagcaatagattgatcccatcgagtaagacaatgccttctgtcgaagacaaagccctcgttggaggcaccaaatcccaattgaaagaactgctggtttcctcacgcaacctgccgaaaactctcaccgatatcagtcccatccatttaggactaagtgccatccaaagaaaagctcatactttgaggaagtacaaggatgataatcagcgctacaccagggcacattatctacttgcaggaagtggtatttctgcggaagaaatagagacggacttacttgaaatttcagttcctcaaactttggatgttgctatggggcagaaaaattatgctgacttgagcaacggaattgacacttatatcgaatctaagaaggaggagaatattttggctgctattgagcaatctttgactatggctgccaaggattttgatgcttatgtggctcaaaatatatctatggattggaatcaaagaaaaaaggagttaagagaaagttttgacataatattgaatggcacttccaaagagcccagcaacgaattagttgaatatacacagtttggcaatgcttctaagaaattcaagtcggatcccaacttgacctggtctgccaataaaccaattttagccaaccgagttgaatttactgatgtcgaagtttcttctaccctcccaactaacgttttaaatccaagcgtgtcttatgctttgagacaaaagtttgaagagtatgctcaagcaatttacgaattgaatgccgcaagacaaaataataaaccctatgaactaaccaatgtcttcgctcagattaccaaacaagctaacgatatcaaatccagacaattgtacgagacatggaagatactctatcatttggtcgattttaacgaaccagcagcttttcaagagagaaagtttgtgaagggccatgacagtgaggtcttagactcttttgaggccattgctttgagaaagagaatcatagaaagaagcaggtcatacttggagcaacaatttatggattatattgattccatatacattcgactcagcaacaaagaagaatcgaaattgaacacaccagagacaccaatagtggataatgttacgaaagtaaagctttttgtcgaacacagatacaagaaggaagatacatggaagattcaaaacctcctattcataaacggtttacctatttgggctatcattttttatttactgagagctggttgtttagatgatgctttgaacttaactttgaagaacagcgattcctttactaaagttgagcggtcttttccgacatatttaaaggcctatgtgaattcatctgacagaggtttcaaccaagagcttcatggtcggctcattaacgaatttaaccagtttttcaagcacatgaacaaagaagcagatccctttagatatgctgtatacaagttgatcagtagatgcgagctttcaagaaagaatcttccctatatcactctaagtgtggaagattggttatgggtccattttacgttatgcagagagggtactaacgatgatgatcctatttatgaaaggtacagtttactggacttgcaaaagactgtcctcaagctaggccctgacaattttaatggctcattcaataacccactatatcttcaaactttgatcttcacaggattatatgaacatgcggtacagtatttctactctattagtgagattgattctgttcatttagccattgccctttactattgtggactcttgcgctccaccacagacaagagtaataccactcagttactcacgtacagaggggaaagaaatattccagaaataaactttgctcgactgattggaacctatactagaactttcaagatttctgaccccagagttgctgtggaatatctgatactgatttgtttaggtggagatcttccagatggtcgtggaaaagagcagattgaattgggactttccagtattagagagctagtgcttgagaccagagagttttcgttattgcttggaaagatcgacagagagggattcagggttccaggaataatagaagagagaaaaaacttattgcatcttcctgacaaagaatcgttcttgcgcaagatcacagaacaggctgccatcaaagctgatgatgagggtcgtgtattcgattccttgttactataccaattaagtgaaaactacgatactgtgatatctttaatcaacaaactattgggtgatttactggcatctactgaccttgaaacagcgatcgatacgcccgcagaacgagcagctgaaggaagcatcatagcattagctgaaaggttgatgaaacaatatagtagttcaacagagattagcggaaaagttctactaaagcacagagaaacttgctcgctgctcctcaaaatggttgagtgccgtgacctttttgtgaaacaggaatgggagaaggcgctgaaacaaatcggacagctagatatgcttccaattgtggcaggagttaatgttgccgtcgcccgaagtaaagttgaagtttttaacagttatgatgaaagtgtggccaaaaacgttcctgatctattggttatgactttaacatgtattgcacaattaacgtatcaacttacatcgagcgagttcaatggattggtcaagagtgacaagatcaaatacctcaaagaagttgcacgaaattgtatgttgtatgctggaatcttacaatataaaatgcccagagaaacctatagtatgctggtcagtttagaaagtatgctatgataaagggaagacaacgtcgcttcgaaggacccatttgacaccagacttaactaattctgcttcgtgtagaagacaatcatctccatgtttatgcaataaagccatacctttcgaaggatggacgttgagttcaacttgctttcgagattttgggtcgttgtagtgaaatactgttcctcctccttcaaattctgtatctccagttaaatatattagaagtgtccaccgacttaagcctttcactttttctttagaatccatgaatgcagtgacagagtcatcatagtgtttaccaaaataatgtcccttaagatatcgataaattcgaagctgaggatttaaacctattgctctctggaattcttttttgataaagcatgtttcattatcatcctcagactcgtaatcagactcgtaaaagagatattcttgtaagtacttccagagtatttcagatgccccataatctgttttcaaagccctatcattgactctagcagcgtaatctttgctcttgatcaatggtgtagtaataatgtccaaacctgactcaaaactaaccattaactcctggcacacttgtggggggagaaacttcgaaatcaaaatcacctggccaggaatggggcattcgatagatggtgtgtaagtcaacttcttgattgctaattggttaaaattgcttggaaacgtgtacgatccatttaccttagccggaactcttgtgcttgatgaggatggtttcttctttgccatatgacttatggtcaagattaaacatacgaaaataataagaagttacgtaatacaatacaaatactattacctaatcatgatactatttcattactgtttatgtacactgtgtttgtggggatattttggttgtttctcgtaagcattagggcttgaagatctcactgtactctccttcgaatttttcttttgttttctttttggtttaccgtttgagttggagccggggttgccttcgatattggagtcagagtccgagtccgagtcagatccagatccggattcggaatgacatgaacaatcttcgtcatcaaacgatctctgcgggtgaaatatacagcagatctttgacttctttctgttgagatgctcgttatccacagtgccctcttgccatttcactcctctacgagtctttgtagaggttgtaggttcttcttcaacagtttcgggaggcggagaccctactaatcgtatttccccggattcttccctctcggttacaacggtggatgctgttcctattccatggacaaccattttttgttgcaatctatataattgggattgcctttatagtaaggccgctcgatgagtgatgagaggtgaaagaaagtggagttggtttacacacgaccatctaattttaccccagaagcataaaattagtaagaagggatagatctatttaagtttcacaagagaaacaaatctgacctactactgtttccaatgtttcacgccagaaggcccatttgtgcaagtaacgtccgctctggatgttaaagaacccgtgaacatctctgcgctcataaattggcatcaaaagtggaaaagaacactgtgagcttgagttgaagtttgctattaattgacagtcaactgaaacgtcaaaatataactgctaactgaaaaaattagcaggttatgaatattcaaaatcttcaacagaaccctgtaattgctttttacgccaatcaagtgacattttcagtgcagaatagcaattcgcccactatccgtatatcgaaaatacatggtttacggcttttgtctgatagctcaatcaagcaggtggttcctgactgcggttgtctttatcacttgcaccgtatggggtatacctgctagggtgcagtataatcaattcatgcacgactatcagttggaaacctattgttttccacaacaataagaaaatagtgcaccgaccaaaccagccagcaatatacttagccatcttctccttcaaagccaaaagtatcttttcctttctaaacaacaccaagaaactaaatataatggcttcattcacttttacatggcctgctggccccaatgaggtaattgtcaccggaacctttgataactggcaaaaaacccttccattagtcaaaaaggctgaccaatcgtttgagttgaccgtcccattccccaaggacactccccccgttagttacaagtacgttgtagatggcgaatggctcgtgttgggaagtgcaaaaagcgatggaaatgacccttcaatcagaaataactatttcacagctgaagacctggacgacaatgtttctgtcgccggcggcgctattcctgaatctggtggtcttaagaccactgtgatgccttctgaagagggaatccagaagactttaggagaacctggaatagttgttccacagaatcctggatcaattgcagcattcaaggaggtttctacagttgaccccaagtccttgaacaaagaggagcctgcatctgcacctgtcgccaatgacgttgttatccctgaggaccctagtgccgttgctgctttcaatgaagtctccgacgttgaccccaagactttgaaccaggaagagccagtcaccaatggcaagaaggttaagaaggtgaagaagctagtcaagaagaagacctccgaagaccttaaacctgacactgagcctgaaggaaaggctgccactgagataaaccctgaccgtctcgttccatccgacgaagttgctggagacaagatcaaagacactccagctgaagatgtagctgctgtggacgccaaagttcctgaggtttctgaggaaccagcctccaaaactgctccagagactaccactccatcgaagaaggctgctgaaaagcaggacgacaagaagcaaaagaagaagaagggatttgctgccaagctcaagaagattttctcctgattgccggcatctcagttttaacatccaagaggacctaattttctgtcccttattaatagatgtctaatcttttgtgtattattttatactatgtacaatttcgaaaaacaaataccgagcttacccaagtaggttaatgcagcgccgggcacctcctgggatgactgcccaatccggcatcggattccatgtcacattgctagaaatgactcgtggacattgccataaacctacacgggcgcgaatgtgctcccataatctgttctctccggaacgactgtcccctctgtaaaaaggatacgatagaactgaccactatacaaacttctagtttgagaagaattagtacagcatcactggaggtaagaattgacaactgttcggaaaaacaaattgatcacttttagaagcttaaaatatcaaaaagcccttacaaaacagcaagcctatatagtactctaatacgctcctcacccgaagtaatcatacaatatcgaaaaatccttatccatagaagaaaggtttacagttgtcatatcaacaagtaaccttactttccacacatatacaataaacataccaatcttgttgctagttaaatctgcattgatatcctgacaagacaggtgacaacctacaacctatttctaaaatgcctcctaaaaactctctaaatttatctccttctttcgctctcctctcaccaaagacagtccaactttacattttcaaaggatactgcgcagagattcttgactccgattccaagtagatcacagcttacctgggcgtccctgattttactaatttgaaggaagttttattgaatctgcatgttgttgaagttgatttgggtatttaccacaacggtaattcttcaagcgactctagccagcgccgacctatctttttgttcaacacagaataccggctccgattcgtcgtattccttgtatcaatcaaatggtctttgcagagatacctgtaacggccaaggagcatattttgctgtcttgtcaggtagtgaatgtttctgctccaacgttgcgccgagtgagcaaacgtcactttcagactgttcaagcagctgtcccggatatcctatagaacaatgcgctggaaacggctattacggatacattcaattgagaagtggcgccagtacgttggcgtcgagctcatctactacagtcagttccgagaccgaaactgatgggactacctcgtccgatcctacgagctcatccgggacaaccagttcttcaacttcctctagttcctctagttcctcgagctcccctactagctccaccagttctacatcgagtacaagttcaacaacgagctcaagttcaagttcttccacaaggtcatcaagctccgtatccccttcaacaagtagtgaatctggcacttcgtcatccacagcatcaactacgtcaccgccatccatatcaaccgtttactcagtgaccaccgtcagtggaacagaccgtacgcttattgtatcgacacagtacatctcaacttttccatcaacccccacagacacttcaacagacagtgccactgatagcagctcaagaagcgcaaactcaaactcgttttgggattctacagggaaagtggccggcacatttgtggccgttgcggtggttgtaattcttctacttctgctcataggtttactactatacaggcgatactccaagagacacggagacgaagcagactcggcttcaggatccaacatttcgtctctaatgtacctcaagaacggtacactagagaaaaacaacaatttccatactcatactgcatccaatggtgacactttagtccccatcaacatagcagaaagtgacaacattgtcgaccaaaggctggatccaggtcagatgtttatgaatctgaacaattccaggggttctttctcagaccatagggactacacgcggcgtgtacttcgtgtggcaaatccagagaatgacctagatccgtctgatctagagaccccaggaaataatgcctaaaaatactttccagcgctcttcttttctttttatttttctcccccgttactcaccatgtcttttttgccgaccctgcagggtttcccagcttgaattacgtaatttctataatataatactaattccttaaacttttcgctctcgtgcactgaccaaaaattggtatcagaatcttggcatcagtcaatacaaatagcccactttaatgaccgttaacttttttcctccaagcctcaataatacaaatttcttaaccccaaaggatcatgtttggaaacacaggcttgccatcaatctcctcaaatattgcaagagcggacaatgaacaaagaacttccaatacaacttttaacgttcacccaacaacttacctgaacccctccattgctaacaacacagccttaatagcaaataagttgaacggaattcaacacgactttaacgcttccgctacgtcgtcttcgtccaacaacgagtccgcttctcctaattcagttgcttcatacaccgactcctctgtccagtcgccctccgccgccccggaaaaaccagagtttccgtctttgaagtttcatcctaggcagacaacaacaacaggtcctcttctctcctcagacctactaaatgttcaagcccacaatcagaatcagcagttcaaccaccccacccaccaaaacttgtatcccttggatggaaatgatttgaacgctccttggaactcatatgactcgcagcgtcccagggcatcctctatgaatactactccatttacagtccaaacctcctcgttaatggctacaggggtaggaaagagaaaaccccgcaagcagaaactagacgactcaaatgggccattccagtgcaagtgggaagaatgtcctttagtttttgacgatgccaaggtcttataccaacatctatgtgacttccatgtgggacgcaagtgcaacaagaacttgtctttgaactgtaaatgggacggttgtgacgtctccactgttaagagagaccatatcacttctcacttgagagttcacgttcccttaaagccttttggttgcaatctatgtaacaagaaattcaagagacctcaagatcttaagaaacatgttaagacccatgctgatgacaatgaattgcaagaaattactcctcctacggaatatagtgtacatcatcaaaaggttcctatgagtttcccagattctcggaagagggcattcaatgatgttttgtcccaaaattttggtacattctacgaggaaatcaagagatccaagattcaacccatgtacaatagtgatattgctaccaagctgaacagcttaggtaatatgattcctacaaaccaacctttccaacaacaacagcaacacttgcaaccagggctgccttatcacggccattctgcttacaaccattctaatcatggttcgttgcaggatcagcacatgtctctcccagtacctcaaagctttcctcctaccaacaaagtttccaacattccaacacaacacgaactctttgaggctaatagtttctttaatcaattgtcgaataccatggatcatacagctcatcaccaagctcacgtacatcctcagcctctcgagaatgctcatgttgatgctgagaactacattgaagttcatgatgatcaccaccatgccgcccacaatcaagcattgtatccaactattaatgtccctggaggaaactattcttcgttctacccccagatcagtaaccgttatgagactaattccaactcaaagaatagcagtatcagtgtgaaccagaagtcatctgtaaatactcttcgaaacttgacaggattgctggacaaacttgacattaacgaggctaatggttctgagagttcctcagatgttgaagattctgaactatctactacctcctccgatgaggaaaccgaagatatcaacatcaacgatttccttaaacataggcagttggtacagctcattcaagagtacattcaagatgctttgaagcaatccaaggctgtggaacaatctgctactacgactatgaaagaaggcagttctttatatcctactattgttgtttgattacagtttatgtatatgtttttttatttctttatttttgttttctctttctggttctagtgagggtaatgtgttttagctagttagtattttgatggatagtaacatgttttctagttgatagtatctttacaaatgttttatcattgggtactccctagattgtaagctaagttgttgttctagcttaagttcctgttcatccggataagggccgaagtcaccttcatatacaacagctccactctttcttcgaagctctactaattgacattcaaatgtgttcagaataacattagcgtcaggcctcatgcttgggttcggattaatcatcattttcactaaggtatctagaataccttcgccatctactaaaaactctggagcccatggcgggacaccaagctttgactttactttggaagaatatgtcgtgtttgtcgtaccagacgatgaagtagtggctgccgatgttggatggtttaaaaatgaactgccgctattgttatcatgagtgaaaactgaggacattatggatgtgtttggtgtcgtatgatctttctgaaattgaagaagttgcctgttgaggtcggtagatgacagcttaccggcatcagaaagatcccctgaacgaagcttgtgccaactcaatccgttgtccggtaatatgatattggcagcaatttcgaccatgataagtccaacagagaatatatctgctggcttatcgtaaatttgatttgatattatctctggagcaatgtactctctatctccttctctttcaaaaaaaggaggaatcggtagtttggaagccattccgaaatcaccaattttcaagcatccctcaaatgttataaatatattagcaggtttcagatctagatgaagaatcccactattatgaatgtatcgtagacccattagtatttcaactaaaattttccacactctccattcatccaacctagtaattttgccattttctaagaggaatctatccagagatccattctcacaatattctgtcataatgtagaggtagttttgatactcccaagaatcaatgaattgtaacgtgtattcagagccttcatagtcatcaggtacattacgttgcaaagtctgcaaaatttccacctcctctaaccttcgtaaacggcttttgggaccagccagcttgtttttatttctcttaacagcatatttgactccctgatattgtacttcgtagacgattgaaaactcgccagagccaacaacagaaccatttttaaaccggctaaagagatgctcatccatagccacagaagtctgtgtttgttgggtgaaaaattcattcgtaaagtcattataagagtgtggcagctgttcagatttatattgattaggattcatatttctctggaccataggtgtggggttggttgtgttataagttccgaagctgtctatcgttgtgttgaaaagaggttcaattggggttcgtggagtggtatcaccattcatgctaatgttggttctgtcggctacactgggactgttcttggagttcatattgttgcgtttcattaaagtaactcccaatggcatttttttactgctggattgatgcaacttggtaggggtaggcggaaaattatccagcgcatcaaagccttgaaaccctgtaaaatgctcgtcgtccaaattgctcaaatcaatgtcctcatcctcatgatcttcatccatgtctctctccctgaaaattgaactgttgttttcaccattgtagaaatcatcaaattcgtcggcaaaccgtaggatacagctttgtaaatcagaggtatttaccaccttctttagcttcgatctacgacccgatccagaagagttagaagaagaggttgaattcacatgcgactgtgcaaaaggagttgtgtttgttacaagaggtttcaacggctgtcgtatctttttgcaaggcgtctcgggcatagtcttagacgcttggatggggcccgcattcttcttgcttaataaacctgtagattgaaaagcagaaggaagtggcttaacagagttgaacgttgtcgtgttgagtaggttatcattcctatcggcttcatcctcttcagattgagatttacgatgggccgaaagtaataatgatccagtgcttcgtttcaacagaggttttttgttttcgttactttcgttaaaatatcccgatttgcttgatggcagcggagtcgatgtgaaacttgttatgcttgttgtgggtgactgaagggaacgctttcttgagttagaggcgtcattcacggagccatctttcttcttgcggattcgcaagattctatttttgtctagcataagtcaaagatgattatgcaaaggggaaccagaccgtgcgaccagagaaagctgttttcaggaactattgaggagttaattcaaagttaacaatgtttcgaaggggattgttttgatttctttggggcgcgtcaagcaagaaaatacaggttgattacataagactttaagaaattgggaacgagaacctttgcaggaggcagcatggtccgcctagttatgattggtcatgtgatcaagcataaatccgtgtaatttatttataccaaacgaccttcgttgataacgaatccttcaagggcagcaatggcagcgtacaatcggttctcggcctcggggaacaccaaagaacggtcagagtagaaaacttcgtcggtcacttcctctttatgacgcggcaagcagtgcatgaatttccaatccggggcagcacctgaagccaagtcactagagatttgaaaaccttgaaattgagccaattttgccttggattctgcttcttgtcccatagagacaaaggtgtctgtgacaaggacattggcatctttgacagccttctttgggtcatgagtaacttccaaaacagtgtctgtttcctgtgcaatctgttggcctttggaaataatttcctcatccatttctattccttgaggaatggcaattgaaacgttaattccagaacgaatggctgcgattgcaagatcattgatgacattgttggaatcacctacccaagccaactttagacctttggtgaagccgaatgcctcacgaatggtcagaatatctgtaatagcctgcaatgggtggaatctatcacacaaagaatttatgataggcactgtggaatgttgagcaagttcttggatttgagaatgtttatcaacacgggcaaagatacaagacgtcatagaggagatcactttcgtagtgtcatagaaggactcgttgactccaagctgaatatcatccttacctagaaacatggggtgtgccccgaaatacactgctgctccctcgctggatattcttgttctagtggatctttttgtaaaaagaagggctgcaacttttccaaacagcgacggtgatacctgagaggagattttgcctgacttatattgtgtcttgtggtatgctgctctttcaaccaatgaacttagttcttggttacttagttccaagatggagattaaggaccttggaggtttggtagtctgagctagttttctatttaggcttggaaatccttgagataacactaacttagggatcttaaacatgctcatttttcagttgaggagaagtatttgagtaattgttcactttttactcatccaagcatcgttagttttccgcggtggaaaaatttcctttttcagtcacttgcagctggatactaaattaagggaaagaaagacgacaaaagttcagatcccaattcattgccagctactctaaagtaatctatcatgaagccaaatctttagatcattgctcacacttttaggactttctgtgttttttttgtctttcaaggcgaacttgacactgattaatgattggaagatggcttgaaagacaaaaggaaaaactggcggtagtttttgttactgttagcggccaagctgtccatcttaattgtgggtttgtattctgactacgcttccgcgtggaattgaaatatacccgttttaatcacagtttataacgttcgaatggaacaaataaaacaattacataagcataaaattctttgctcattcactactcggtttggtgcttacctcaaatgactcttacttgaaaataacacccatgaacctgcctatagagccattggtcctgtcagaaaaagaaagaaatgaagataccaatgaacttgtgacacaactaaaattggcttccttgagaaccaataaacagggtaaagcccatcataacgagtttacgatatttgacagtgacatcacccttgacggatggcgttttaatgagtttgattatgctaagaccaagatcagcttaccaactaacgcacgagggctgtttaccaagacatacaaagatggcacttcaaagattattactcgaggttatgacaaatttttcaacgtcaacgaggtgcttccaactagaccagactggattttaaaaaacacgataggtccatacgaagttacgcttaaggaaaatggctgcatcatatttgtttcaggtctacaagatggcactattatcgtctcttctaagaattcgactggagatagaactgagttatcaaggaaccatgcaaaagttggtcaagaatatctattgaagcagctaaaagagaatggaatagcggctgaatcattggctaaatcactttatgaattgaacgtgactgcggtcgcagagtattgtgatgatgaatttgaggaacatgtgttggagtatccaaaagacaaggccggcctcttcttgcatggtttaaatgtcaacaagcccgtattcaaatcgtaccctatggagcaagtctgcaagtttgcagacgcctttggttttaacaaggttgaatatttgatgaaggacaactcggctgagttgtttgagtttctagatggctgttcgactaccggaacttacaatggaagagagattgaaggttttgttattcgttgcaaactgaaagattccggtcgcacctttttttttaagtacaagtttgaggagccatatctattgtatagacagctcagagaactcactcggatgttaataaaaggcaaatcggtccgagaaatgcgcatcaccaaacataagaaagtctctttggagtatctttctttcattaaaccactattagttgggaacacaaaactatctgaagagtttctgcaaggtcatggaattattgcattgagaaagcttttcctccaacattgcggtatgaaagggtatgaaatagctaacgaggaggacacggaagacgaacgaatgaaggagttggaattgcaactctctaatatatcactaaccgatgcaatttacaaatttgtcatagtaaacgtcgcagttattggttgcggaaaaacaaccacatcaattatgcttagtaaattactccctaagtgtggccatgttcaaagtgataatattaccaaacctgtaaaggacaaattaactagaatggctcttgaaacattaagggaccatgatatggtaattattgacaggggcaaccatcttcttcgagagagaaaacagatatttgatgagtttgaagatctatatcatgattacctcccaatcaatacgaagttcaagtttgtctgtctgaattatgtttccaacaaaaactcgccagaactttggaacctaaccaggtctcgtataattgaacggggagacaaccatcagactatcaaagcggaaacgcaaggggttaagtttgcagaatccattatgaaagggtttattaatcggtttcaacccgtcgatgtggatcacgaaccagactccaaattcaatgttgtcattgatttagaagtccatcccaacaattcttcgaaaagtaatgctgtgaaggtcgtcaatacgctcattgagtattacccagaagtggtttctccggtatccgatgagaaaattgagcatgcatttcaggacgctttggatcataaaccggaactgactataaaagttggaaaagcaaagacgaagaaggtaaaacctgcttatgttggcattggccttagtgacaaagataaagctagactaatggatgcgattgaacaattatttgctaggtgcgcagcagaaaacaatcaaccagttgacatgtcaacatgggtcactcttaaacaactaggaagaatcccagagaagttgcatgttactttggcacatattgcgtcaaccagggataagaagcttgggaagatatggaatcgatacacaaatgagtacttttcaaaatttatccaagaaatgaataaaaagctgcctgatgacttaaaagggtctctgcagacattacctaatacaaaagcgcacattcgtttgaagtcgctctgtatctctgaaaagctagcctgcgttgaagtggacatcgaaggcattatcaacgaatcccagtcaattaccgttgaatcgaccaacaaataccctcacattactctaggtacagtggatcaaaccattccagctgtggagtctaatatattattacaggagttaatctcgcatcgtggatcatcggaaacccccgaaactccagacgatccagccaaaactcaaatctcaactgaagaagaaagttgcaacagaaaatatctctatacatttccacctgacatcctatttaaggatctgaacttgtttctgcagttctagagcggtacatacttaatcttgctatattctccttcccccccgccccacttcgaatacatacttgctaatcagcaaaaagtagcgcccagccggtgtgtgtagtgtacccaccactaggcatttcaaatcctctatctagatcctcctctttcagtttcattttgggtaataagttcagctcataattcctctgttatccattgccaattagaccttttgttctactgattcatgattaatgtcgcaaaatatcatggaatttgacaagagtaacacgaataaccctaataatacggttgttactggccccaaccgcaaaatgacggtcgaaacagagactgtggataccactaatttgaacaagcagcttcccttgcttacatccaatccaacaagcacactagaaactccgatctcagaaatctctcagatcagggcccaagagaacaacagtaacacaatgagtagtgatgtcgctccagggaataacgactcggctactaagaagaatacctcaaacgaacctacgataatcaataccgatttgggagatgctgatctaaaagctggcaaggtaacatcaaatgatcagtccaatttaaataccctaggatcccactctagagcggctatttttgctgcgaagatccaagacgccatcacaagacaagacagcacacagaacgtaaatgaaacttttgtgtatgagagctctgttcctattgtgtccaatgcggatgatcaaagtcagcaacaatcaagtatggatacttccacaaacgtgccagaatcgccccagttgctctcatcaaagtcatcgctaaagctcccacagaaagattcacagttacttgatgtagaacccatgaccgaactgggagcgggtccagttgcctctactagtaaaaattctccattaaagtcgaaaactcactcagtcaatggaagtttagatatgaccaactcacaactcaatagatcaggtcaaaagaaaacatcatctcaacccaatctacgaacaattacttccaggttatttgaatcaaagaagggacggccatattccggactatctgatctctttgacgacgacgatagctacacggaggaattaggctttaacagggatggcactattaccggatctttagattcaggtgcagagttattatacactgcccgtcaacattcatttgaagatgataatcctaagcctagcaaatctcaccacccaaaacagggctccattgttgaaggatcccataaaaatagcaccttcgatgggaagttagagcaaggattatatgactatcctgcatacggttatcaagaaccgcttttgttagaccatcatgaatgtcccttggaatacggttcaacctccgtatctaataacaatagacataaattaaaaagacacagccagaatattaaaccagaccactattattactcgccgcatgatttcacatctaccaagatgacaagattacgtcaagtaaaacatttttgttacactgcgagcttgatatcagcgtttctcataatggggtttttatttgggttttttatcgccatcaccaagcctttaacaaacttcactgtggaccggatagacaatatcttactaactaaggaagagatagttttcagtttaacggtaaaaggattcaatcccggatttgtcgccatagaaatagatgacgttctgattgatttttttgccaaaagttctcatcttaacgatggaaacgaagatggcactcctttcacttttgatgaatcttccttggacacagtgcttctgggctccatcaatcgtttacctgttccactcgtatttcaaggcggattttttagtcgaaatccagacgaagataccacagagatcaaaattttaaacccggctcagaaaccactcccagaacctacagatagcacagtaacaaccaccactaccactaccactaatacaccagcttcagttacacccacaaaatccattattacaagcattatcaccgatacccagaccgtatcaaccacaaatagttctactataccgagaagtttggaagatgtgaccaccataagtttgctgccgataccggaactacaaagaagaagtaagtctcccagtgaagacaataatatatgggaaattatctcaaaatacccattcgagttggttgtcagaggggtattactctataaacttcccttcagtccaggatacaattctttgtctataaacaaggccataatgatagatccagacaatctaaatggttctgacccttagtggttgtcgttatgtaatctttcaaaataatgttgtacgaatgctaagggatcgttcagttcagtcgattttccactacctgcaccggccgagaagctgataatcggcagtaccaatacatcactgacaagcttgggctttctcaatttggagaattctttccaagtaactttggtatagatactactttgaatgtagtcattaaaataggtaaatatggcatctgtaaaaataccagtacccgtccattgcataatggacaaattcttatcagacaggccgccttcttcgctaatgtcagctagttccagtgagtttgactcggctcgttgcagtgtatcctctgtgattttggcgattaattctctcaagattgggtgaccaggcttcgcttgaatacaccaattggaaaattgtagacgatgtacgtaatctttttccaatctggattgttagcatcgttttgtattccaatgatcatcccgatgctttttggggagacattttcaggaatccagtttggtacaggctgaagaggcatagtatcaacgtctgcatagacacctcccttggcgtataaaaccaaatatctgaagaagtccattttcaagattatgttgggaagcagctcgtatgctttgatcacttctggaacattgatatacagatggtgaataaacacaccggaagtatcatcgttaaacaactcatgaacgaaaccaggattcttcgaagcccactgagtttcgccttctttgaacttttctccaaaccgatcgtcattcaagccatacttccatgtttgccatatataagcagggaatttgccgttttcattataaggaaacagataagccaatttttctcttaaacttgatcctgcaggggggttccttagaaatctaacctgttccagtagatctgcccgttcagcttcgagcttgctaattctatcatcttgcttcgagagatacttcttttgaatctcgtccagctttgaagcgagttcatccgttacttttctgctattgtaattgatcacgtcctgcggtaaaatattggcattcttcaatactttctgaaggtctgtggcggtggacttgctggatgaaatctttattattaccaatatcaccgttatgagtccaaccgtgagccaaattacttttctaaacagctgttgttgcattagggggtggtgttcagggtgttggaagggcgagtttcaattgaatatctatatctgtttttggtctgaagggaaatcataccgaccgcgatcgcgctgcaagaaaatcgccaacaaagaaacttcacatctttcgtacatcttggacagtaagagagaatcgacaagtaaaaaaataccgagacgtgcgacactcaacaagcacctagccaattaccttcaaggcaagtttgattatcgaaccccaacacaaacttataggtttctacctacacatttataacacaatgtttagaccactagcattgaagccttcctgccgtgccataaacagaataccagtttgcaggttttcgacgggactcattgcacagaaacccacattggctttaacttctggttcgatccaaggcacacaggggatccagaaggattcagactcccaagaccaaagacgtgggaagaaagcagtgaaagcgctctttccaaggccaccaaatggtacctactgtctgagatctttagaggcctttatatcactttggaaatgtactttcgtgccccatatacaatctactacccttttgaaaaaggtccagtttctccccgtttcagaggagaacacgctttgagaagatatccatccggagaagaacgttgcattgcctgtaagttatgcgaagcagtttgtcctgctcaggctatcaccatcgaagccgaagaacgtattgacggttcccgaagaacttacaagtacgacattgacatgaccaagtgtatctactgcggttattgtcaggaaagttgtccagttgatgccattgttgaaacccctaacgttgagtatgccaccgaaactagagaggagctgttgtataacaaggaaaaattgcttgctaatggtgacaaatgggaacaggaaatccagtacgctttagatgccgatgctccatacaggtgaagagccgtgttacggcctacatagcaacaccatatatttatttttgatgacagtctagagtaccccattaaatggaaaattatcattactatttataaagaaatattacttattctactttaggcaatatttggtcgtacatcccaaaattatgcataacgtccaacttactaagtgggaagggtttcccactatctacttcttctacattaattttttgactccatttaatctactccttaatttttttttgggctcacggggaacagaaacaatttagtgatccagtaattctaaagggaaaagtgtaattttctttgaagtggtttttttttactgacagcatcctttatttcagtagattgacagcatatcaaatttgtgtcgggacccgtttctatttatagccgatcataaaagaatcaagattacaacaatctatcaatgaaaattcttcaggtttcgaagaagaaccgatcccggaataccaagaacctgttattagacctctccagccaacattcacctcctccgttgaagaaagtcacgattactaagtccgccacagaactggagtttcccaagcgaaaggggcttccaataattcccaaaggaaccttacggcgtcgtagaaccacgttagcactgacgatcccttctattgatgagaatactacccccaagatatcaactactaatgaatccccttactcaccaaaatcctctccaacaaataataacacatctacttccttttgctttggaaacacagtgataaatcacaatgccagcaagaagacagtttcgaacccatatgacagtggacctgtttgtgttcttgaacccaatctatatttatattcagagccaacccttgaccagctagatcgattcgacgttgtgatcaatgttgccaaagagataccaaattaccagcgagaaataaggaataaggggaaaacatactactttgttccctggacgcacacatcaaatttgtgtcctgatttaccactcttgacctccgtcattgaaaacagtctttcctcgggaaaagcaacgctgatacattgtcaatgtggagtttccaggtctgcatctttaattgtggcgtatctgatgaagaagtatgggttgaatttgaacgatgcttacaaccgtttaaaggtcaaggctccgtcaatctcccccaacatgaacttaattttctatctggctgaatgggggaaaactttagaggcaatcagcctacctgcatcaccttacagtacataggtgtcaagcttacatataattgaacgttgtcgaacgtaatgcgagtcttttaatctgcttgttgtgctcttatttcaatcttgagacagacggaatttcactctcctccacgtcaaaatctcgtggacagcaggtgtcaatttttccttcgagcctttccaaacgagttagtagtataactgttttccaaagattcgctcactaaacgatttgcttcctccaacaagaacattattatcattaatgtcgtcagcggatggacatgtgtctacaaatgactccgcatctattcggccatctttaaatgaccaatcgaatggatcggacgaggaaagtggtcctgtagtgtcttcgaggagaaatactccagggataaactcctcagattcagaagcagagactgacatagccgattctcccccaaggccttccaagagagggcgcagattaatacggaaactggaatatgacaagtcacgtaatcgctccaactcaaagagttctgcaaacgcttctgtcacggtagcaaaaaatcgaagcacaccttcttctagatctatttcacccaagaccagtaatcgaaaagtgtcgttaagagatgccaatggaagaaccaaactacagaaagcttgcgaaaagggcagattagcagaagtaatggcatgcttaacaaacggtgcccgtgtaaacgataaagattatgcgggtattactgctcttcacgaggcttcattgaatggtcatcttgagattgtggaattacttttgcagcatggagcattcatagatgcactttctgttgataaagatactccattgattgatgcagcagcaaatgggcacgttgaggttgtcagaacgttattgaagaaaggtgctaaccctcttattgtgaacaccagtaatgacacagcgctctcatcggccgagaagctggacactccagatgccaaacgtattattgagatcttaaaggaataccatgagaaacaaaagagtttacaccaagacatttcagatactacaagaaaggttgttgatgtaggagtaagttcttggaatctgaaagacaaactattaaaacaaacctacattggtaatgtcgaatttgttggcaaagacctcatattttccgatcaaaaaccagaacaattgtccattgcaggttatcggggccacgaagaagtaatttcaattattctgggtgtatccgggcctaaattcatcaacaccagggatgcagcaggattgactcctcttatgtacactgttggaagagggcatattaattgtacgagaatactattggaacatgctgatccaagaatgacagatgaactgggcaacacattgatagattatgcttctaatggacccgtagttgatagtgatgaaatcaatttgatcaaagtaagtattgataagcacggggatggtactgaaaaatagatagtgaaaaaggaagagatttcagcaaagagggaggcagattcctccactaccaggggggtaaagaaagtgaaaaccaactctacgatagaacctaaagctgattctccaacagcccgatcagctcaaaccaactcaaccagacgggaatctgatactactggaaaaccaattttacccgggtctgccgccaccataagaaactcaccaactagtaactctaaaccaatacctaaggatgattatagtaaagcaagagcaacttccgttcaggctccagttttatcatcaagaaaaacatcccccgtggtcccttccaaagactctgcgatttcaagtcccaaattatcggcacataaatcggaacctgtgtctgttattcaaacccctagagaacttgcgtcatcagtcattcaatctcctgacattcctgccaagattgagcttacgcccgagcagatgaagcttaaactagagaaggagaaagaggaagctgcccaaagagaaacgtacaaacaacagcaagaagaaagacggaagaagaagcaacaagaaattatgaatcgcatttcagaagcacaacaaaagaaagagtacgatagaaaacaagcagaggagttggccaaattgaaaaaacaacgcgcaaaagaagaagcccagagagagcaacaagaagcaatgaaaaagaaggagaaagaaaccgttcagaaggaaattagtagaagaaaggaaattagacaacactacccagtaggcttgagagcagccaaatttggtaacaattatgacccccaggcagccttacattacttaccactatacctcactgatattgagggcgaagaatggtgtatagacttacaagttatgcttctttttggcaaagaaggtttttaccagcagcagcacttttctgatattaggctcattggccatgaagataagcctaaggtatggaatattctttttccaatcattggttacgaccataagaaatcttactccattgaggagaagatcaatctctatgaagatggtgagaaactattcaacaatctgaagctaaattgggttaaaagctcccagattttccactttttggaacactctatctctgaagattcaatagtaaagaaacatttgactaaagttaaattttcgttgagtaggtctcggccttcagatttgtcaaggccttcaattgcaaatagtaccgacagcagtcgaactaatggaaccactgctacacatacagggcaagatttatcttcagttccgttttcatttcgcaaaagaccatgtgttgaaggactgttacatgcccctccaactttgtaacaccatttaatatttcctgtatactatgtatctatattacctaatactaattaaactgaattcagccgagggtgattattacatctaaaatactttaacacgactactgagaaaacgaaaaatgtcagagataaggtaggtaactaggttctatacgaaactcttcataaactaatgctaacctgttagagtatcaagggctcaactatgcaatgagtctgaagatgagtctttgtcagagacagagtatcaggctcccgatctagattttgatatagtagatgtgaaccaggaagatgaacctgccaaagagaaagaaaacaaagaagttgatgaagaatttgcatttccgctattttctattaccagttcaacaaccgttgaagaacgaggcaggagtcaagaaatgaaaaaggtttcattaagagaaccttcagaagatacagttattcaaaaaagacccgatagctattacttcgtccagtacgatgacaaattaaaaaaccaattcaaacaggttgttgtcactgccgaggagattattcaaggatctaaggacatagtattcagtaagaagagactggtagatttggatcagtttaatcgtgatattgaggaagtgctttccagaaagaaaaagagacatagacctggtaaacgaaaaagaatgaataagttggaatgcgataaaaggaaagaagagagaaagattttggaagaaaaggagaggaaggaaaagtttgaagaaagacaaaaaagaccatttcaggcaaaatcttttgggtctcataatcaaatatccagaatgaaacaaaagactacgttcaactcaaaatcatacgaaaaaggctcaaagagcaaaccccaatttagaacagaataagtttataattagccattcaataccctaatagcattaatcatcattgtaacaggaatactattctcggtaatatcatctccagattgaatgattccattagttaaggccagcttgtattgctgagagcttttcttcaacgccttggctacgggaccacctctgctaatcgtttctctgaattttggtccgataaacaaagctacttgcctccagaaatgcgtaaataggtcgctgttgtagttgagtttctcttggcagtattgatcataagtttgtgataatttgggaaagggtgtctcctgcatgtatttagaaagatggtatatcgctttggcaagatgtgacactttctccatactgctcacgatggtttttggtgaggtcagagttttaacgattgcttgtgaggatttggacgtatagtcatccaataatgactgaatacaatttaggaaattgttatcggcaagagtggccagcgtgaagcatatattagcaatactctgtttggatgaatctgctgtaatttgagatagaagtgtagatgcaatatctacgataaacactgttcgttttctatgcactggttgataatctttcactaattgaagtgacattagacttgaagcatcttggacgtgaagatctaaattggtggaaatttgtgtaaatttgacaagatcattaaatggaggtttatcaaactcattttggtcgaagatggattccagttgttgaagcaggaaaacataataacttgcattcctcagaaggtttgatgtggcatgaatcctttttaaagcgctatacaatttcagtgcgtcgtcgtaggggattataaagtcgtttttcaatcgcttgaaacttgagttaatttgacgaacattcaacccctcgtgtgtcttctttaattcagaaatgtgcgatagctgtgtgaccaagcgtgtgctatttgaagaaacaaatcttgctagtaagtcttgtaactcctttatatcgaagctcaatcgtttaggtgaagtcaaaatgtccagattatcgtcatcaacgttatttgttgccaacaaaaggtcattggcaaatttctcagcaacaaaagattgactcaagaaaccgtcaaagtcctccaaagacatctggctcgtggtttctgaaaatgtaaaagaaacaagacagagtggaggaaatggaaatttatattgcaatcttactaggaatctccttccagtatactcagcaaaggtctttcgctaaatacttatgtagagcacttactgttacttagacgaatcaaggaacgaggcacatctgtcaatctttggacctgataatgcaagtcaagagaccgttttctaatctgagagtctaggtatgaagtgaaatcaaccacggagcctccaactccgaaatagatatcttttgctgccactatagttttggtatttggagcggtagtagtcaactcaattagaatctctgatatcactggtagcatcttaggctggtagattgtttctgatgtgatgatcaatgtgttttgaatgcttttgttcagggaaagtttcacaagtcgaagaaatttctcactccatcctcctgagatcaagttaagtgttacgtgatgagcggtcaggtcttccaagaaatttcttattatgcctctagaaagaaaaatctcaccatccctgatgggttcttcaattatgattccaggtgctgcttctgtttttgcttgttgtaactccttcaaccgtgacggttctagtttctttaaagcccagttaattatcaagttaggcaccgtgacaagacgcaatactggtgcattatagtcggtgagggtaatgttagtttctgtgtttgacgtgtttagtaagtcttccagaatactgcaggttggcagagaggttccacatccaatttcgatgacgttcagcccattagaactgggaaacagctgattgtcttcgttcttgataaaatcgacaacgtcataagcacattcccatgactttaagcctccttcgtaaacattagatcgaaggtcttcattagtttgccctaacaatatttgaacctcttcgttcgaagagtcgtcttccatcatgagttgatgtttcacatctgagaattctcttctaaagactttgtagcgacctgatatgtttacttcttcatatgtcagtcttttcccaaccaatgactccaacagcagttccagatcaactagctctggctcgattgcaggctcgtaatttgagagagcattcgtttgatctgatgccgaaatattgctgtcagcttcctcatcatgaaagttgaaagaaaaagacatcaaaaagtccgaacttatcccaaaactggatgatttcagtcttctaccttctttcaggtccccgaataatttttttttctacgcaccggctcaagatctgtcacctcgcacccaaccaacagccctcactagaactcgcagcatcccccaaatgtcccctcccacgcaccatgatttgatactacaatttacgtatcttatgcatcaattcgaataaatagagcttatcctaaacttataaaaataccaagttatcactttgctagtattgaaatctactacaatacgaaacttccatcactttgtgtgtcttctttgtgttcacatctatttcgattgaatttgagagtaaccggtgaatggttcagcattcttagatttcaagtactcgtcggaagcagcttgccattctctgttcatagtctttggaacgtttctgttgtaacggaacgcaccgaagatggtagcagaaataacaattccaataacggtaccccaaaagatgtataacttgtcctccttagtgtgcactggtcttcttggaccccattcaccgaaagaaatgtaccaagcagccttcttctctgataaagtcagatctttccatggcaacttttgtctctcactaagctgtgagatgatgtctttctggtcagtctctggaaggtcttcccatctcttttctaagttggtgacagtagcgttagacaaagctgaagcatatctgattcccacggctctgctcagaggtttggctgttagttggcgaaaggattgtctcaacattagtgttctatagggtggttagtctacgattacgtgtggaaagaattctttggttgggaagagttgggtcacatgatcgccagaaagtaaaaaaaaaacactgtacgttgattggttgtaatgaaaaaatcatgctaccaaaacctattcttgggtggtgcacgttaagcattcctgcaaagcaacgtagtggaaatgtaattgacgatgagtgattgggaaggctgatcttttgagattgcaccaaaaccttaaacattggggaaactttgaagaagcacttttaattggcattgaataagagcaattaatgttcatgtgaggtaataacctttgagaaaaaaaaataagctttaaaatgctcaatttggaatgacgttaagagtaaggcattgcactggttatctgcattcccaattagagtccctttaggtctcggaagaccactgaacagttttgggtcgttaatgcttttcttccctcaaaatgaaccaatcatacgtcccagaaataataaataactagcaacttttgtgtcgaattattgaactaaatttcatttgaattccaacattgacatacacccttaaatctctttccaaccaattgaaagggttctaatacttactatattgatccagatacttgaatactgtttacaggtaggtgaagatttggacctcgagggcattaccccaaagacctagtcgtgttttgattaatgttgtggatcagcgataagacctgtcccagcatcacctaccctaagtagataaaactaggtagttaagtacaaccatactacaaactattgagtcggtaagacaatactctttttctagctatataggctcaatcaaagcaccgtctaaaacttcgcttctgaactttttctcttatcttacttccatctttaagaagacagtttttcacggatttggtttaggtactctctgtaagcagtaccgcctccaacgcggtcctccacaagatggctgaaacaccataagcgtaacggagtgaggtcctcttgaatcctatctggtacgcccgttctttgcttactttgaccgatgacaatttgcaagttctggtaggtaatcctatctttgccttctctaacacgattaataacatttctaagacgttcgttgaactcgttgttcagttctggtagctcactctttccatatttaatgtaacctggattgtcaacaccaaatacatctaatagtaattgcggaaccgattcacctccaacatataagaacaagtcggtgcctgaatcgatcagatataatccataaggagctaacaacgtggatgtgtcattaataggctcaggtagaacaatgtctccatcgatgggttcagttacctcttctccagcctcattcacgtatgtttcttcaagctcctcaggcaatccgcattcatcagccatatcgtgaagcgaataaatcgttggatagataaatttaatcagtctttgaattggacttgaagccaacaaattcaaagcataagcacgatgatcactgggcactttacctggacggaaagcaatatactttgttaaagagtgcaacagcaaaggcaacattttcaggttgttgcacaattgaagaggggagctggaacccagatttcctgcaactaattctttcttgaatacttggaaaatatcaagaagagatctatttaagtattcccgagcatcaattaatgaagacgataaagctttctccacagccttatgggtgaagtagtttgtgatggccagttggtctgcactggcatagatctgattcagttcttttcctataggaacctccagagtcatcacacggattcttctttcaccaaaagatgtagtgtgcaaaacggccgcttggaaagcggccaagggtttagtgatgtgctcatcgatgctgatctcaatcaaataggactgatctcttgggaaagtagggaaagaacacaagtcagaagacctgttgaagaagtttccgtagaaagcattcatcctcaagcctgcagatcctctaacccttaatacagcttccaagttgatgttcattgacagatgattagatatctcctttgaaagtttggtaatatcttcctctctggcagcggtccatgcaggataaaagtgcgtctgacctgctgtatacctaggcaagttggacagagtggccacatcttggtatgatgaagaagctaaaaacatatccacggtgacttgagacttattacactcaacagcgaaggacttataaaatgagtcatttggtgacagtaatgcacttgattccttggccttgccgctatgagcttcctcatctctgatagaaagagctccaattcccttattaggtaaagtggaagtgaatacaatcatttttcctccgatgttgttaatcaagcgatgaccagctttaagtgcaggacctagtgcaaagttggggttgacattattctcaaagtaactgtgaaaattgttgagcaaattctcaatattctgacgagattgctgcaagggagccagaagattctctgctgcaggaactataacatcatccaagtcagaaacaactaacattgaagtttcttgcgcatcattctcgtcctctgaatcttgaggaattgtgaaaaagtgcaaagaagagtccacaccaatgaaacctactcttgcacgtccgtctttgtttggaatttgatcaagtgagtctaaaatagttctggcaacggtggcaaggtagccattttgaatggcatgagtactcacatccaaaacaaataggtaaaccaatggctgtggcaagcgcaccatgtactcctttggagccacaaattccacaacgctatagttcaattcgactctggccattctatcaacacgttgttgggtatccttgtcaaaatcaaatcctgatggaacatcgtttgttagattacaaagattgcatctccatttggtgtttctatcaacaaatgtgattaaaggattgatataagatcggcaacgacgacatctggatatgagcgtgtcttcgacaacaggaactggctcatcctcatctctgagacattgatatgggtttacaacaacggcaaggggcagcttcgattttttcagtaatgaattgttgtttgggattacatttagtgtgcacctgaagtattctgggctggcattagattcaggtttgcccgtcaaggaagctccttgaggtaagacaattggtggcggcggcaactctaagtctgatattggtggaggtagctccttcaaaagatcagcagtatatagttgattgaacggaaatgcagcttgctgaggttgctgttgatcatacgtgtttccatatggaggacctgcgtatccaagttgggctgattgttgttgtggagcaacggcagctgggacaccataaggaccagctgcctgagttggagggacacccaaaccagcacccggattgatatacccctgctgttgcgaagggaattggtgaacaggttggggttgttgatttggctgaatattcaaagaggacatgccttgagctaactgatctccacctggtgcaccatatggagctccctgtccattcaaatttggttgagtggctcccggtagttgctgacccgcaattccagctcctggagtaaactgttgtccataagcctgagcgcctggttgttgaccatatccaaaactgccacctgtggccacaggttcggtggcaggatattgcatcgatggatacgctcttctctttccagacataattgtgaatttaacagttaattggagctgtggagaatagaaagtgacaggggggttctcttcaccaaaacgtgttgatggattataatccttgaaaagtgatggaacagacagatcaccttcaacgagggccctttggaaggatatattcgcgattcttcgacatcttttatcctatttagtttttactatgtacattaatgaactcgagggacttgtctagggaaggagatttattgtcatcttgagactggtcaggggtttctgtaacttctggcttcttctccttcttggggagtttatcgttgctcacaaataaactgataatgaaagccacgctggcgcatcccaaaccaaagtaaaaagttgctcgaagactctccatcagtttctctgttaccagttcctgaagattctctgggagggaaagtatcgcttcgggggaatttagaagtactgaatcaggaattctgatgatggagttctctgtgtatggtcggattttcttgctgaaagtaacagaataaatagtgttagccaaattggcaccaattgcaccacctattgaccttgaaaaattgaccactacagtagtcaaaataaggccagaagcttgctttggcgctgccagttgagcagaaataagcactgtctgcatctgtataccaagagagacaccggaaataataaacagaccaatacgcttggacaaaggtgaatcaacatctagcagagtcattaagcctccacctattggtcccaatattgtcccaataataattacaggtttcacctgtttcgatccttgaaccaatcctgtacttattaatgttgcaaccatgaggggaatgatcaaagctagggtatcaataccggattgaaaagctgatctgttcaaaatggtttggaagtataacgttccgtatatgactaaggtcataaagttacaaaatgtgaagaagtagaccaaagtacaaacaaatacgcctggaactttgatgacaaaatatggaatcaaagggtttgacgaaaatttgaaattccaaatagagaacacaatcaatgataaccctcccaatacaaaacagcagatcacagcagccgaattccatgggtagtttatgccacctaaggacattgctaataaaatcaggacgattccagccataaagctggagattccaatgtaatcgatctctctgatttttgaccaggtaaatttaggtctaggggggttgaatgcatatagtagcaacgctgtagcaaatccacctaccggaagattaatgtagtagcaccatctccaagtgacctctgtagtaaatacgccccccaccaatgggcccaaaactgaggagattgcaaacactatcccaaacaaggacatgattgcaggccttttgttcatatgaaccacttcactggcaacaaccgtcgttaagctctggattcctcctcctccaataccagcaataactctggccactatgagcattgtcatgttttgagacacagcacacagcagtgaccccagctcaaatagaaaaatagccagcaatagggagtatttccttccaaacacaatggagagtttaccgtagacagttaccacacttgcgcttgccagcatgtatcccgataccaaccaactaatcttgtcaaaggagccaaagtccttaccaacttccgtgaacgtcgtggaaacaatagtttgatccaaagcaaccaagaacaatatcagcatcaaggaacaaatgcaaagaactagtttttgacctttcaagaactgctcttcccgagtagtaccgtcccccgcagctgcctcatgataagccataggaagaggagcaaacggtcaaagtagttcgagaagatctgaaaaggactagcaagagattcaagattataagtccgaaaactcccattaacaaggaacagtgaaaacaaagggaatattctgcaagacggctaaatgtctaggctagaatgaagttttatgaagggaacttgtatctattctattctaatttattttgaatgaaatcggccaactttttctcaccactcaagattgcttgaatagatttcagaatctcatcaaaggactcaaattcggtatatggaactttctctttttcgcaataggtgatcagttctctaccctttctggcaaacagcaaatcagtctctcttgctgctgaaagatcagagacaccgtctccacagtagaatagagggatcgacctattatcagcattcttatcgaggttgtgcttgtcaagtacttccaagatagatagggccttatcgtgaccaaaagatgtgtcatctctatagacaatatcccaagagccatcatcgttgatcttgacatcgttggagataatagtaatgttgtccatagcatcctggccaaccaatttcaccaacaaagtttcgatgatgggcttcattcctgatgaaatcacatagatgggaacattattggcataacaccattcataggtgtctttgaagcctggatcgagctcaatgttcttgagcagaaaatcgatacattcgtcgaatggcagttttactgattgtaactcttcagcaaaaccagtcctgaagtccacttcgccattgagaatctgatttccaatagcaacacgggactctttacccatacccaagttgtctgtgaggtagtcattggaatctaaaagagtgacagttccatcccaatcggtgaaaacgacggccttaggagatgacattgtagtggttggggtagaaagaatagattactggaggtcttgaacgtgtttatagggcagacctggcgcgcaaaattggttacgtcatatccacctaacgacagtgaaagacggatagcctgcgcaggtgatgtttacctggaggtgaaaagttgctgccaaaaaaccacaggcctcccacctggggcttccttgttttggtatgacatttcggatttagtaatgccatcactcaatttggtatcaggttcttctagctgacccatgtatatcgtaacaaaacgagaatgtccccgcctacatgagtcaaagatatccttccagcacgtcaacctaagggcaaggtataatcccttcgcgatagattgtcttccacgcaaccccaatcacaaaaaaaaataactagacctctcctcgcgcttaggcttcttctccttctttaaaacgccaccaaatggactcagataccacttctagatttgttcccgagtacagaagaaccaacttcaagaacaagggacggttccagcaagatgagctaagaaggcgtcgtgaaacccaacaagttgagcttcgtaaggccaagagagatgaaaccctagccaagagacgttttcttgtgaatcctggagaaggatccgtcccacaagaagatgactccgagaacgaagatgaaattaatgtggaggacaaccagttttatttggagctacagaaagagctgcctcgtatgatggagaagattaactcaaacgacatggagagtcaggtggaggcaaccatgaagtttcgacagattttatcgcgcgagtataatcctcccatcgaacttgtgatccagagtggagtagtcccaagactagttgaattcatgaaagatcaacaggaaattctacaattggaggctgcatgggctttgactaacattgcttcgggttcctccgaccaaactaaggttgtcattgaggctggcgcagttccattgtttgttcaactgctcaaatctccttccattgaagtacgtgagcaagccatttgggctttgggtaatgtttctggtgattcatctgccttcagagattacgtgctgagctgtaacgtcatgggtcctgtactcgagctattcaattcctcaaagatttctttgattcgcacggcgacttggacattgtccaatttatgtcgtggtaagaaaccacaacctgactggaacgttgtttctgcagcacttcctacactggccaagttgatctattccactgatattgaaaccttgattgacgcttgttgggccatttcatatctatcggatgggtcttcagatgccatccaggcagttgttgacgctcgtattcctagaagattggttgagttgttaggccatgaatctacagatgtacaaactccagcgcttcgtgctgttggtaacatcgtcactggtaacgacctacaaacccaagtagtgatcaacgctggtgtattgcctgcactgttaccactactagactctccaaaggagactataaagaaggaagcatgctggactatttccaacattactgcaggaaacccagatcagatccaagcagtcattgattgcaacttgatcccacagattattcgtctcttggtcactgccgattacaaaacaaaaaaggaagcatgctgggctatttctaatgcatcttccggagggcttgttcgccctgatcagatccgataccttgttagccaggggtgtatcaaaccattgtgtgatctgctcgctgtagcagacaacaaaattatcgaagtcacacttgatgccctggagaacattttgaagatgggagagttggataaggaagctcgtggagctccctacaacgagaatgctatgtatattgaagaagctggtggcatggagaaaatctttgactgtcaaaataacgagaatgagaagatctataagaaggcataccagatgatcgagcagtattttggtgaggatgatggtgacttggaggatactgggttacagccagaagcctctggtgacgcttttacatttggagtaaattccgctgatccatcgcaacagcaaagctttaactttaactagtctaagtgaccaaacgctcctcctctcaaattgatccccatacctgccatcccattcttacgtaatatgtaatatatatatatcatccaactaacttacttaacgagacaaccgccatcgacctctttaccacctcggcatttcgcacatggattgcctaattctaacctaattgggaacaaaacaaacccaatcgagaaagcagttccaaaataacgcacttgaggacacgaccttcccatttccgcaaccaataactgtgccacccaaggcaaatccgcgccatttaagtctccgaagcgagccggattggatgctcgtgtctcgtttcttccgggcagaatttcaaggcaaactggccgctacaaaaaaaataccatcaactttaatttccttccttctactacaacatcaagaatgaagttttccactgcgtttgctggctttgttgccctaaatgctgtgtccattgttgctcaggacgaggctaccgatgctcacgttgtcaccacaactgtgaccaccgcttccactgagactcacagatggggaagattcgacaagacttctccttctacaacttccacttcttcaggtactcacagatggggaagatttaacaaaactccagatcctaccactaccaccatattctcgtacgacggtgttgttcacagagaagttgttattaacggttcgaacagctctaaccactccaacactaccacttccagttatgaaggtttggctgcctcggttggtgcccagttcggtttagttggtgctgctggcctcggtttactgatggtcttgtagagagataccatagactcattaatatattcctgttaacacttagaattttttgaactttatttccctttctggttgctttctttttttttctgtattatttattatgcggacccttaagtttccaccgaattctgacttaaaacatcaaacaacacaagatgcaatttgccagtttcttggtgagcttgtttgcaatcaacaccgtcactccgaccgccgattcaacagccaccgatgcccatgtagtcacaattaccataaccgacatgtcggtgtccatctttacaccctggggaagatttgacaagactacaccttactcttactactacaatactgtgggaagttctggctctactagcaccagtacctggggtagattcgacaagactacgccttcttcaacaacaacttcctcggggacgcatcaatggggtcgatttgataaaaccacaccgacgaccaccacacgaactctctccacaacaacaacgtggggtaggttcgataagactacacccagcgtgacgactacttctagcggcactcatgtttggggaaggtttgataagaccacgcctagcacaacttccgaaactaccaccactcgtacttggggtagattcgataacactcctgaccctacaacaaccacactttatttgaatggtggtcaagttgcctctgctcaatggggactagttggactcgtcggcggtgctgcgctcatggctttataagatatcattgtagattagcaagcctttttaatgtgaacagagtgataagcaccgacttctcttgtattgtaaatatttttttccttgcattgttttcacttgtattcttcctacacctagtatgacgtttactgacaaattgcagtatgcctaccaccatccacagcatctgctaggtcactcttgggtggacctgtcatccgttgcaactgctgatattcttgacagcggggaacatagtccaattccaacaactgaaggctccttgtctaacccattaacagacagtgaacaagaagacatggttcaattccccccttatccgttcaggaaggaccctgaacagcctagctcgtcggatatggcctttcatttgagttgtgcaggagtcatcattgtgagtttcagtttcacttttggatttgcattgggaaggcacatttaacgcaatttgatcttcgctggagttaaggccagctgctttaaccatagactcatcttggtcgctataaacaatgctatcactgcaactagcataatcttacccgctagtttgagtattctttcggtcaatccaggcacaagaatacattgctccacgttgatttgatactgtatctcatcgagatattgtttaaagttagagtttctcagggcaaagaagttaggtttggcctcaacaatgagatatatcccaggaatcgctccttgcaactcttcaattggggtgtccactgtgaagttttgtcgtatgtcattatcgttggatgcctcgctcttttccaccacatagctaagactaaaatcaacaggaaaaattgcactccagcaaagagaaacaaaataagttgaccccttttcaacgtttaaccgatgtatcgtcttgattggcggaagagtccaagaattatgcaactcaattggacaagggtttccaggacggtgcaagtagacgtcacctccataaacttggctcaagtttagggaacatggaattgtcgtcctttcatgagaattcagatccccataatcatatacttcatacgcaggatcagcatataccaataacgtctcagtattagcgttcacaagatggataactcccagcagccaccataaaaagatcatttttcagacgatgtccaagagagtaaagaagagaaaatcattaaattactttttcgctatatcaatcaaccccaggattccaatttactttttggacaactctctcatcaaaatcttcgcattatcaagaaatgttcctattaatgattcataatcattatttcctccaatacctttaaaagcgtctaataattgtttagaatcaatttcaagctccatttcaaaattctcttgtttcgaggttccctcatagactttggtcaaatcaacttgagttgcggagggtttatgaatatagctggtcctgtgtttcctcctagaaaatgatccttcaggtatcaactcgtctttcggtatattctgtggcagttccagtgcgatggtcagtttcagatcgtatctgcatttcggaagatgtatcactaagcttgatttcttgtccttttcaataacgatatcaccgcgttttgtcgttgtgtcctgtgttactcttaaacgagtctttttgcctctagctcctgtatgcgaaaagaaccgatcaatagtatcggttcgtaaggctgttactttgctctccttgaggagttgtttgaaaaagtcctccacactttgatgatcaactggttccaaattaatattaaagtagcactcttgcaagaaaaaattattgttcaatgttgtctctgtgattactggtaattgtattcttttatctgttgccttgctgacaacctctcccaccttgatttccaactccaagatatcctcaagattgggatgcttttcagaaagactattcaaattagcatataaccaggtagttactgatctcgttaaatcgtcataaggtatcacaccagtgaaagttgaaaaccgggaacttgaggtggtaggaccattattaaccaaattggagaaagccttggaatggttatcttgagtccgcctttcgttttgaacttttaaattgactttggggacaaagtctctggcccagaccggtttgactttatatcttcttggtttcgatttttttgtgtagttcgaagtatcggagttggcattctggattgcttccgttactttgggttttgctactgtgatctctccgtttgacgtttcagaaactcttctagataaatctggagtggagctactgcttatgtccacgtcttttgggttgcagagatcaagaacgctattccttgatttcagtgcaggaagctctgaactcttagttggattgatcagatcagtcactgaaactcgcgatttcgtcgagatcacactttcagtcctctctctcggctgctcagataatccatcggctggattatccaaatctaccaagttcatatcaacaacccagcagcttatacttcaagtgaagaattatcgaagcaaatcgttttcgcacactcccatctccatcagatagtattcgcgcaaaagtactctcacgcgccagaatctgcgttgagacaatacagtgatatctgtccccaagaaaacttctcgaagcttttttttggtttctccagattctctcttttcttttccctttttcatctccattccgtgctgtattctactgttgcaaattcaaaaaacgcaatgactgacttgaaaagcaaagcagatgccttgaaagataagggaaaccaagagctcaagcaaaaccatttcgaaaaggccgtcgagttttataccgaagccatcagtctgaagccaaatccaatctattattccaatcgagcccaggcccaaatcaagttggaaaattatggtttggctattgctgatgctacaagtgccatagaactggatccatcttatcttaaagcttactatcgaagagcagtggcgacgtttgctattctggactacaggaaggccaaacttgacgtgaagatggtgctcagtaaggtgccaaatgatcctaactcgaaaaagttggctgcagagattgatcagattatcaagagaatagcttttgaaaaggctattgctgtagacgagaaagagtcagtcattcaagaattggatttcaacgcaatacagttggaaaatgattatgatggagctcctttggagatcgaagttacaggcaagggacaagacagaaacttgtccgttaatattacccaagaatatctcaagcaaatgattcaaagattcaagaatggtaaaaagcttccaaagaaacacgcatttgcaatagtagctgccgctaatgaagttttcaagaatgaacattctttggtagagtttggatttgacagaaataatagccaagaagaagcactaccagacactgtgaagacaatcacaatatgtggagatacccatggtcagttttacgatgttttgaacatattcgagtccttcggtaatgtcggtcctaatcatgtttatctattcaatggagattttgtcgacagaggaagttggtcttgtgaagtcgcattccttcttttcacactcaaacttttataccccaagtttttctacttgaaccgaggtaaccatgaaaccaacagtatgaacaaagtctatggatttgaagacgagtgtaaatataagtacggtgaacgccttttcacctgtttttctgaagccttcaactccttgccttatgctactttgataggtcaagagtatctggtaatgcatggaggactattcagcgatgacaagaagacccttcaggacataagaaacattaaaagggtccctaatagacagccaccaaatgaaggagtggaaatggaactactatggacagaccctcaggttatgcctggacgttcgccatctaaaagaggtgttggaattcaatttggacctgacatcacttacagattctgtaggagcaacaatctgaaagctatcatcagatcacatgaagtcagaatgggtggttatgaggaagaacatgacggtaaattaattaccgtgtttagtgctcctaactactgtgacactcaaggtaatctaggtgcagtcgtcaacttgacatcagatgaaaagaaagagtacagaatagatttcaagactttcaaagaggttcctcatcccgacataaaaccaatggcatacacaaactctggaggattttaatctacgttacatagcaccttaatattacattaatgtatgcgtcctggtaaggaaatccttcaccaatggtagcagtgattcatagcgtcaaatcttcagtacctagatgaaagctccagctaggaggcctattttttctcggttaagttgtagagagtggcgatctaaaaacgtcatcaacaccctacaataatacgtaacctgaatacaacaaagagaggaaaaaaattggaacgatgctggtcttatataaagatctttgtggtgttggggtgtcgggactggtttatatgaagcaggtctctctgtaaggcgtattagtttatgaaaaatgagatagtactgggcctgttgtttcaatccagcaaaacgaattaccccagtgttgaacgaccaagcaaatatttctgtacatcatcgactgtttccttcgtcgaattttcgtctgtactgtttcccttttgattacgtaatatagtggaacccaccaacggtttcaatagtacttaaactatcccattttactcatatagatttccgttccccaatgttgtttttgtggttgcttttaccagcagcttttgcccatcaacttagcgggagaattgaaatagatgatgtcgattcttctagaacaaaagttgagctctatagcccgaacgtaactatcacaaccagaattctccatgacgggtcattttccatttcagatcctccgaccggaacctacaaacttagtctgcaattgcaagattacgctctaaaaaatgatcggtatcgcgttgaagttacaaatgagaacatcactgcccacaaatacgttacgaatcagaattggactgagtcaggctcgttggtcgagttgcccctattcgtcccctttgaaaacgtggttgccagaaaatacattgaaatatccagtggtggtatactagctaataatagttggattatatgggctcagcagaacccgctgatggccctaggagtcttggttacagccgcaatagggttgttccctcatgtgatgaattactttgatcctggctttaccaagcgaatcttggaggagactgtccaaccaaaaccggaatcaccagaagatgcaaacaggagtattagttccaacagcaatgagtcaacgactactgcaaggggaagctcccaaaagccgattcgaaaaaggaagtaaccaaaatttagatttgttcgacaacaaaaagtcggccttcgtcatcaccacatagcagtttgggcttagtatgaagtctagtattctctttatactcacttgaaagtccaaaccgaatacagcatattttatttgcttcatccatgctaatggttttcaatagccttatgtcatatctattctctgtatggaatagtccgtataatttggcctcagaaacgaatccaacggcaagtacgcaaccaggaatccagtactcgtggttgatttgcccctctaagttgaatagatcgtcattcctgcgagcaaaggatatacttccaacgtttccgcttcctatgaggctacttgaaattgactcaccattgattgtgtatagtagcagctcatttcccgacaaacaacccacaaagccggcatggttatcaatatcaattagggatacgggaagctcctcacatattgatctcatatattcaaacttgagcaagtcccacataaaacaattcccctcctcgtctaggcttataagagtgttaaaaatctgggagactttaagatcttttattgcgctttcatggcctctaagaacttctttcagctctaatggttctagagttttcgaaaaatcagttgaaacaatcttccaaatatgtatcacaccactcacatctccaactgcgatactggagtcaccaaccatcactaagcaggttattgagtcgttctgtaacccctcaacaatctcttcattgatcaatagagatccatttcgtggaagtggcataacataatgcaatctatcgctgcagactgaagtagggtatcctatgaacttcctactattttggagattcgtctttacaatgcatttgatgggctttattcgctttaactggctaaccaaaccattgtccaatgcttccaagtcggctctgctaatgtgaatgttttcacgtaagtctcttggtggatgaggttttgtaaatacttgtagtggcgtttggccaaagttatggattataccggtcatagccttcttctcaacctcttcttcaattttatctagatctaccgctccagagtaactgagatgatggaaaacgttaaaagcttcgactgcgggctttcctctttgcttgaaaccaaacacaagatcaatccattcatgcaagtgcgcagatacgtatggactttctaatgcttctctatttttttcgatgaatagttttggatctcctttggcccaaggaggtaattcaacgttatcgaccttactcccactttgcaaagttccaagatcaaatttgtttgagttcattaaaaattcaggcaagtagaaaaactcaggaattagctctctcacatccgaagtattatccgctgaagaagaattccaagctttattgatggaataaaacatccgatcggcatgatcaaactttccaccttgaagtagtaaataggattgaacaaaaggttctagccgaatcaaaaaagatgttactatcattgaagaggaatagtgagtaccgtaatgaaagggtggggcatttgaatcttccaaactttgcagagcctcatatctttctttgaacaagttcaatcgcttttcagtctgagcacccataggctttgttaggtctcgataaaccttgggatcatccaagtctagtgtatcgctcgtataatcggacaacacccacgggaatacaggatactgagtcaggtctttatatgtcctgcccgctaacgtgttaactatcatgagataataaaaattagaaatctctccccttcgccacttcttggtaattgttaaattgttcagattggtaccactaaaagcacttgtaagcttgaaggtaaacgagttattatctaagtgggcagtgcttgtagctgctaaactaaaagcttgactcaagtcttgatcgagcaattgagttgtgtaaccttttagcttgaagtggatgtagtccctcaccgaaggggaaatacatgttatcagaaagctactcccatcggcaaaaaataattccaaaccaacatctcggaataggaattgtctcttagacaccgaagctaatatgttgagtttccagttggtagttgaatgtgacttgaggtccttctcaaaattatcaggacgtttttgacctgttaaaagttgcatgtatgggtctctatcttctaggtcagcatcttcgatatcaataatctctcccttgggagagtggtaatagttttcaatgagatatatatgagaggcaccaaggatcattaccgattctgtcgcttctagaccatggacctggcaaacattccatattgcgttcactttgtctcctggatttaaacttcgtaatacttttcggttcttatcctcctgttgcgcttcaatatcaccaggttcttcaacaaattcaaaagtttccccatcttgacttgaaatactatcagtatcatcaaagtttttgatatcaggcgtatcttctttaactaattctgtcttgtcatcacccgatgttttggcataatctgtgttcagcttctttgccaatgaattatagtcaggtaagatacgttttctcattctatccatcccttctgacaaatccagcatcattacaggctttatgttaccaacttttaaggaaacagacgttcttatctttaacttattgtacatgttaatgtagtaaagaacatcatctctatgatcttgattatgtcgatgatacttagccaattctgacgaaactataatttttgtccagtaactgcattctgatttgaaagattcaacagcagaccgcttttgaaggacacttttatcaaccaatttaagtagagtggacgtgctatctggagtcgaattgtttagatgtttcaaaatattcattttaagggtgaaattcttcaaaaatgccgtccgtacagatggaacagaagcttcagatctcagttcgtcgtcagtgatactaagcatgccagtgaaaaaatgaatgacgacgcctgcatcatcggcaattagctcagcgatatgttcgaagtctggttgcctaaccaaaaagcaagttttcaaacagttgatacagagattgcttatttcagggtcgttgatgaaaatattcttgaaaaggataacacagaatgttgccagtttttcattatccagcatggtcttgagtagatataactcttggtgaaaaatgaagtttgttgcaattctttttatgtttgactgggagtcttggttattagattccatcaaagaaactgtagcctgtagaagttctctgatcagcagagagcacaaagaatcaccgatgttttgtagatcatttttccacctccctttatcatcgcaatgcagtctgaagatttcaagatagtttgaactactttcaataaaggttatagcttgaggtcctgtccatttgctaaacctttcttcatttaagcagctctcgtaaaacctaaacacattggtcaaagtagatgatggtttggtggttaattcttgtaaatagatgcaaaattcctccaagtgttcaagaacgtgcggaaaaataaaagcatggacaatagtaaatgttctagaatcagcagtaacagaacccatgaaagaagaaaaggcagtcgcctttttgtcaaaaattttcttaataaatatttcactcagcagcttctcaatagagattcttatctcatccatttctggtattgctttgaattcggtagacagctcaaaaagcaaaagtatgttcaacagcatcgccagccattttttatcatttagaaagaaagattccaaagatgacggtttcccgtatgttgtaactatcatataaatgaatgaattggcaaaggctaagaaattgagtgattgcatggatgtagatgcagataaatctcttgaaagggtttcaattgttttgatagcagatgctttgaataaatttgcaagaagaaacaagaattccggcattgaaatgcgaagcttggttcctttaggagctaaattgttgacgatgtctcttagattacttccaaagtctcgtgtttgaggaaacccaaatgttccacagaatatcgtagaaataagctcattgtcataagactttgattgtaaaaaagaggtcaggatatctaatccggcatgagagataaacttctcatactgtgtgactcgaagcatagtaaataatcttattagaattttcaatgcatttattgaaactttaatttcttcatctgttaaaattaacaatgcccatttcacacttaaagatttgactactcttctgtagaataggggaggatcaagggacgttgctgacgttgatgtatcgcatacaacggttgttagtgcatctaagacacaagcacctgcgcttctttgaatcaatttttgagaagaactcaaattgttattcaaagaataaacaacgtaaagggacaaggccctcaaaatatcagcggcgggattggcttttattagcactaataacgaattgtgaagaattggaagtatactggattcaaatgagccaaatttcaaggcctggataaatcgtttgattatcttcattttggaaagttgtttgatattgaagtcgtggtacttgctgtcttgtccgaaaacggtgaattgaaagagaagaaacttgaacgattcgttattattcttggatgatttccaaatctcaaagtcaacgataagacttttgtacgcctgcacgttgactaaaatcgatttgaagggagattggtgatcgtagcccacaaaatgaagcactgaatccaaagttttaatgccaatcatatttcttttcgttttcaaaattgtagcaagaatatcatacccattcttaatggtgaactcgtagttataaagccagctactctctagaatttcaaaaaggatgctgagattataaatcagctgctcttctgtgctggaagactcgacaaaccttagcagcatgagccctccccctactgcatatacaagcttgtgaatagatgaaggttgatagagcaagcaagcaccatttgaactcaaagtccagttttcatcgggtatatcaccatcagtgagttgattggttgagcaagtttttggcgcaaacattctgtctccaactttgaaaatcgtagttgagtgtatagctaaaatgatggaattaggaggtaacttgaaaagacctctttttgtcgccaagtgaattaaattatttgttttcttagagccattctcgtgtagtttggtaactttcagcctatcttggttgtaatatttcctaagtttgatttcgaaaaatgccctgttacggagtgaaagcagtttggtcacctgtctatcttggaaaaatccagcatacttgggaccaagccaataagataattggatccattcataaggttgaacattatttatcagcagaaggcttgaaaggctgatcgttctaaaagtttcaatgtttgagatagttaattgaaaactgtctggtggatgatggaaaaggttcggaatgtaaatagtctgggcaaaatcaccatcgacatataactccgctttggtagggcgacccttattgtcgccttgatttactatggttatgtggtacaatttgttgagttcaaaaacgaaagattcaaaaatacaatcgtcatcgtttctcggtttgataaatagtctttctccaactagtccaatctgaaataattctctgtccgctgtgcttatttgaaataaggagatggattctgctcctaaaatagaggttatgttagttcttccatctgatatagatatccaagcttgaaaagtaaatccatgatttggattctcaagggaaagctcattgacgctaatctgagattccatagggagtaccagctgaggtaactggtcccgtttcagatatttcagtaatagagaagagtctttgttggagaaaataacatctttatgatattgagacacccacttcatgtcaatatccgaatctgtcgactctattagacaatcatccagtaagtgactaggaatatcatccctcctggccctcctgaattgccgattcaaagactccgagcaaatgagcactttgttgattggatagttatgcatcagattgtaagtatattgtaggatcatggtcggaaacctagcatcatcgcccgtccaatcttggatcagtatcaaatggagtaatacagcaaataaagaggcctgctctctagacaaacaggtggcgcctgaatttgaatcgtcattgatattgggtaatacgttagagtcgcttaaagcaagcgtgtccaaactctcagccagctcttccacctgtgaaacactccttctatataaaaccaggagagttaatagcctgttttcttcgaattgagcacttttgataatcaattgcgcaacatggaaagcatcttgatctcgttttcgatctattatatctgccaattggtcacaccaactcatgtgtgaagactcttgcaaggtaacaaagtttgtaccctttaggcagcggttcgtttagtttgaaggctgatagataattctccctattgctaagccgaataacgcgggaggagccgctgagtggagataggggaaaaaattcccccctccaggtattttacgtccatctgacatctgctttcctgtctattttcttccgtcatctctctactgttattgaacaagaggctatagattaggcaattaaacctttgatgagtacgggtgtctcacaggagagaaatattgatgagacagactcggatcttaattccggagctcaaaaatctcaatatgaaagtataatattgcaacgtcaagttgtgcagaagatgttggacacttacacgatgaaagaaggtgacgttttttgcttagtgcctaaagattggtatcaaaggtttttcacgttcacttatgatccaaccgacaacgaaatctttctcaaaattgggatcattaatattgccgaattgctagatgctaatgggttagtaaagaagcctgacggcgaagattttgtggagtatgagatcctcccttacacagtctttcaacagttggtctcttggtacgggttgttctctggtcttcaaccaattcagaggatagtgatagcccgtaaagacggagagttggaattagaagtgtatccttgctatttccgtttgcatttgatggataacgagcgcaactccctggacatcaacaacttcatcctatcaagatactccactatacgtgatctcaaatatcatgccacagaaagattcaacaccgagttctatcactctcgtttgtggttggtagacgatcctaatatctccaatctacccttgacaattacggtgtcctcctttgagaagatcaaattcaaaaagctactagtagagaaaatagaagactttgacaagactttagaagaagccggactgaacagttgtcatcttgttgtggaatataagctgaagaaagattcagaatggccgtccgacataacctgtaaacctgcaaaattgagtaccggtttagtggggttaaccaatttgggtaacacatgttatatgaattcagcacttcaatgtttgatgcatatacctgaactttcgaattattttctctatgatttttacaaagaggagatcaacgtcgataacccattgggtaacggagggcgcttggcaattgcatttggaagcttgattcatacaaccctaggtccaaagaagcaaattgttacctatgcaactcctaaggacttcaagctcacgctgggtcggttcaactcaatgtttttaggctatcatcagcaagattctcaagaactgctcgcattccttctcgatggattacacgaagatctgaacagaattttaaagaaaccttatttggataagccagaattgaaagaccacctagtccaagataaagaagctgtccgacaacttgctgaagactgctggagtcaacacaaaatgagaaatgactccataattacagacttattcgttggattatacaaatccactttggtatgtccagtatgccaaaaaattagtattacatttgacccattcaatgatctcacactacctcttcctgtagataagaagtggtatcatcaaattatattttttccagagacaggttaccccaaggcgttggatgttgaactggataagtcatctactttcgatcatctgaaaaattacgtttcatccaagctgcaagtcccaatcaacgacctaattggtgctgatatatttaacagtcaattttataagaactttgaggccaatgatccagatctgaattatcttccaatcagtgacttaatctcttcaggtgataagacagtattttatcaagtaaagcataagccaggagacttggtggttccagtctttaacactctttctgatgatggtggccgctatgcaaagccttttggccttccatttcttatcacaatttccgaggatgaatcattttcctttggatctatcagagacaaattggagagaaaatatgaccagttatcaacgcttaattacttcgaccaaatcaagcaggagagtaaggaaatacacaagctcgctgattttcccacgttaaacaagaaataccaaaatgattcacccaacgaggataactctttatccgatgttgattgcacttcggacatatcgtttgccaatcctaagatctctggagattttgcttttaatatcaaactgttcgattcaagcagggagttcaaaccaaggtataaccttggtgccaggcacattgatatagatgagaatgaagacgatagcttgtggcttccacaaaccaataacagctttggcaacctacctattttgcttgacaaattgtgtgaaaagaaaagagctttttacacgtataaaaaatttgaggctgaggaagaacttgcagatgaagatgactcggaaagtgttaatgtcaacgttgaagaggtcgacgaaaacgacaacaacttagatacgcaacaagacgagtccaatgatgaatctatgatgggcggtatgtttgaagagtcaaaaaattcagctcccgtttcacctccctgttctgaggttgctactaatacagagtcaaatgcttttgagcctttgataaaaacaaggcaagccttagtctgcgagtgggagcaagattcctttggcaagttttttgttggtttaggagatgatgacgataaaagtggtactcaaacttgggaaactccggaagtaattccaaacgaagaacttattcaaaataagaagctaattgaagagaaattgaacaagaacatagccttacaagaatgtttagacatattttccaaaccagaattattaggcgaaaacgatctatggtattgtccaaattgtaaagatcacaggcaagccaccaagactattgaaatctggaaaacaccagatatcctaacgatccacctcaagagatttgaaaatcagcgtagctttagtgataaaattgacgctgtagtggatttccccattgaagcattggatatgtcagaatatgtggtgaacccagagactggtgatgaaatttatgatttatttgctgttgataatcattttgggggattgggaggtggccactacacttcatacgttaagaatcatattgaccataaatggtactattttgatgatgcgagagtatcagctgcagaacctgagcaggctattaaaggatcagcatatctattgttttacagaagaaggtcttcaactccattaggaggggaataccttcgtcagatgatgacacaagtgagagaacaggaagaggttcatagagaaatggagaatgaaatccttagagattatgtcaaattaaaagaaatgcaggatgctataaccgcttatgaagagaaatgtcaacaagtgcaggttagcgaggcagttgagagtactctggatgaacaacaactggaatgtgattccgatagagaattagaaaatgctggcaacgttgaggcagacgcagaatctagtcagtcgatcaatcaggtagagaaagaccaaaatgagccctcatcaatggtatcttcagcaaatggggctaaaaggaggaagaaacaacaaaacaatttgttaatgagtcgtcgtaagcaatacttggattccaaagaccttcaaaattctcctgttttagagtatgctgatgactctattttggggtcgccaatttctgatgacgataggtgctcttcttacagctcttccgttggagtgcccaataataataacgacagctcttgtggttcacctgaaaatcaatgactttccaacaacgatatcacgtcttcatattggggaatcgattcagccgctccccgtctctgaacggtcaaagatgatgctgcggtagcaaatcttatagcctcctcaattggttctttctgtgccaatttcactaccaacgctccgaggaaagtatctccagcacctgtggtgtctacgatcttggaaggttcaacttggagggaagggatgtactggctctcaatatcggttgcgtacactgagccttgggatccaagagttatcacaactaaactatatcccgattctgggttcaatactctgtttaattcttttgcaagaattgtgtatccatgtactaaatttgagttgatcttatccttgatctcgctgacggaaaacgagttcaattgttttacacaagtcagggcttcaccctcgttaacaacaagaacgttcacacaactccaaatccttttgtccagcaaaatctcctcgttgaatggggacgggttgtaagtaatgatgaggtttggcctatgactttttatccagctgatacagctaacaggatcgggttgctcattttgaagaataacaaaaccaggatagtctcggtctttttcgtcttcaaaaacggtttcaagctcattgtcagtaagaattagttttccattggctcctggagtgcaaagaattctattttctccagactcctgctcaacaataatcgtggcaattccagtacatacatccttctcggttgaaacatgactggcggacactctattatcctctaggtactgcttcagttctttaccgaaactatcattgccaattttgcctaccattctcacaattgtctgagaatctggcgccaaaagctttcccgctgatatggcttggttgagtccttttcctccgtagtgacactcaaagtgatttgacaacacagtctgtccagcctctggcaaaacgtaagtgtatgtaaccatatcgtagttcagcgaacctataattgtgatggaattcgacattctaacggtaatcagttagtgagagagattagaagtggtgtgaaatattgtaccttgtttgcgcgaactttcctactaggacgagtagaagttaaatcataaatgcgagtttgttaggaacgaaaattatttctagcactcaagaatggaggaagaacaaccagaattcatccagtttacccccaatgttttttccagaattgcgcctgatatctacctggaaagaaatttgaaagaggggatcaggccgaatctgagaaagtacgaagagttcagaagcgttcaagttaataataaagggtttggaagatatgacgagtcaaatcctaccaagtcatccgttctcggttcttcggtggtcaaggtcggtaagaccacagtaatatgcgccataacaggaggaatagtatctgatgacgatattttggatcaggccactacgtcttctaatccgtttgctactgtatatccattggtggagattgcaagaggtagatcgggtgcatgcaccgatgaagagatgattatagctcaaaagttatatgaaacactcaaaagctcaggcattattcgcaaatcagcgctaaagatcaggtatggatataaacatcgaacgagtgatgataaagttgaagtcatatttccacgcaacggtccacaaacagatggtactaatgacgataatgatcaggtgatggcagatggaaacacagcagaaacaatacccttcgaagataaacaatactcattcgttctatacgctaatttgcaagtgttctcgcgtactggacctccctttgacatatgttggacagcgttaataaaggctctgaaaaataccaagctaccatatacattcctagacgaagacaccacaagttccagaacagttaagtctcggtcaggggctaacgctacaattgaaagatctcagttgatttgcgatccggttttgaattatccgattaagctcgaagagaaaaaaataggttattcttcaactttcggactggtcacgattccagatggagagaagtcccaagaaattctactggctgatatagaaggcgaatcagaagagagcgcatctacatccctcgtgcatgtggtggtagcgggagataagttaacttcacttaccatccacgggggttcaaaggctggaggaaatggatctcgcataaccaaagactttatcaaaaaatcgatagatttagcacatcagcgttcattacacctatctagtatataataaatgcaaaggttgaatcataaatatttggggtattcttttttctgttatcttcctcctcactgctcgtcttttctcttagttcatattcttgatcgttaaaaattttgtccttaggccagcacaatcaggccttgcgagagcgcaaatttctggtcacaggggagctggaacgagaggaagcaccggatgccaactgtttgtcttccaaaagaacatactcgttgaccttggcagcaacaccacctctgacctttttaacgtatctggactttttaccttgttttctgtagacttcaatgtagaaggcaatgaaaaggaccaagtaggacgacagaatggcacaaccagacacagcggctaccatggttccagcacagtcaccacagtatggcagaacgtccttgaaataagtgtaggcaaacttttggtaactggcaaaataaacaaatccaagatccaaaataaattgcataatttgaaatctagtgacccattccttccaccatacacggatacctctcgaagccagaaagtaataccagtacatgacaacgtggacacccagattcagggagattgggacccaagagatggaagtgacaccaaccaactgagtgtaacatagcaaagcagtagcaccgtggtggtaagtgtgtaaaaatgtcagctttttctgtttgacaaccaaaaagaatgtgtcaataaactctacgaacttgatcaggtaattcaggtagtacaaagtgacaagctcttgagtccaagccctagtgttgcaaatagcatagaaaagtccatggtggtaaataataggaacgagctgttcaaccatcaaagttaacagcaccaaagaagcagtagttaaaaacaagttgtgagcagaaaacaacgcatttaaaactagtggctttagctccagcttcttaataaaataatagccaccgaagacgataaagtagtacgcggcaatgctgtacaatactggttccagagtggataaaggcagttttccagcaacaaactcaaactcggaaggaacaaaagcaccgtgggtggctttagaggcaaaagtatcgaaaatgggccatagttcgatgccaaagggcttatcaaatgagagaatggacatcttgatagttggtgtactaaaaggaaagaatggtacttggcttgttgttgttgtcgggaggggaaaacacgataattaaattttcggaaaacgtcccacgtagataatgttctgttcttccctttccacatgcgcttgagcaggcggactcaaaaattcatgcagctatatgtggtgtaaaggtgtgttaatccgatttggtagatccagattatctaatagtgctatttcattatctgaggtctattctatctacgacagtataaaggaaaggcctcacagaaaaataaatcttaggctggcagcaaatagtttctgagtcaaaaacaatgggagtgctcaaacatgtcctttttatctgtgcagtgtctgtgagtgccgcttttgttggggctgaaacgcaagataataagaccgttggtctcaatgctacgggacaaaaaccacagatagagtacactgcgtcacaaacacaccaatcgataatcttgactgaagatcaaaagatccacatcaaatctttattaggagatgatgttttcgcaagatctgtacttccactcaaagagctgactgaggtaaattctcaatctaccaagctaggtaaaatttggaaatggctcttgaataaccataatggcccagttgtttttgaaaagcaattgatgttcaaggacagtgtcgtgtttatgccagatggaagctccgctcccgtggatcttcaaagtattcaggaggtgcgggactttttcgaagatgaattgaacaaagtcctgaggtattgcatgtttcggaggcagacagagtacgaaattctggaagccaaagaaattgtggaaaccacaatatccccgtgtaccaaataccaatatggtagattctttcacaaagagcaatacgttgttggaagattagagatgtatgaagatgctgtagtaccttcaacatatgattccactattatacaagaccttattcaagacgaattccggttgtctccacgattgtcttcttccaaaaagatcaagatcaaatgtcctatcacacctcaaactccgttcggatcatccactgcagtaatcaagcgagttgtcgcaattgtaaggaaaaaaacagtgtacttcaataactgcgacctattccctcgtattgaagaagattggagtcaacctcgtaaactgtttttcacatttgacgaaaacgatgtgcaactcacctgtcaaacgagcgaagatgattcaatatgcggaaaagacagtaatcccctctcggataacatattgctcatagattatgaacttaaatcatggcagctaaagttcaatcgtttaataagttcataatggaaggtacctttgaatgtggaatagtctcttcagcttcctgcacttgcttcttttggtcaacgttgccggtgtaaaatgtgctgatgtgtggcaaatcataagttggagtttcattttctgggctctccaccttgggagtagttatttcaacttgatcaggtgtcttcgtattctctatagtttccaaattatcggtaacagtttgatattcgtcgtccttcttggtatcctctctcatctttttctgatagaaatttttcaccatggtagaagatttgcttttcattatggacgatatcgtatcccacttctcgccgtgttctccaaacaaaaccttgaacatctttacttcttgaacactccaatagcttgataaatgtggcttcttcctttgaagttcttctgaagtggttgtttgctcttgtgctcggttgccacgaggcttcttcacctctgaaccattcaacgacgcagatgatgaaattcttttacgtttcatgggttcaggtgttagcttcacatcactatcttcttgaaatgtctttgctttcttttcaagcacaactttatttcgacgaggaggtttgcctcttccttttttcctactagccaatacttgtttgaaattagttttagttttctttgttcggtaataatgtaaaacacattcttctggggttcgcaaaccacccaaagcagcagatatacgtccaaacttcttaggatggtgaatataagcttccacaaacatttcatgctccttctcagtaaaagtatcaattgggtctgtctttattctctgggcccaacgatctttatctgttatcagattatttgtatttatgaaccgtaacgtttctctttcaattggatccaatatcatctcaggtatgactgcagcacctttttgagccacatacaaaggatctttttctttttctctctccaggctttctaaaatctcttggaattcggcctctgtaccaacaaaatctccatgacgggatctcctcgagggtttcagctctcttgatgtatccggttcttcttctctttgtataggaggagcagcttctttggaatgtagtttattaagctgttcgtccatcttatgacgtctttggcgccattgccttgcccttgaaaagaactcctcggttaatcgagctcttttcttcagaactgatttgtctttaatttgtagaaacttttcgatagttggactgagtacgttaatgtgaagtagcaagttgtcaatataaaagggatactctgtaaagttttcaattttcttatcattcaagtaccattgatgctctaagaccttggctttgggccttgtttgtaagctccagaatttatcttctagtttgttcattgggaatatacatccctcgattttggggattcggtaaagtgtttcaggctgtgtttcaggttctttgtttatgttggtgttgtcgatcttgatgtcgattttcaattcggaagtaatgctatcaaccttgggctggagagtctctgtttgagcagaagtagtatccgtcggctgagtaatatctatttggtccaaagtcttctgacaaatgtgctctgatggttttattaattgatcctctttggtggtatctgtttgtgggatatcaggtttaacatccggattgacctcaagtttaacctgctctagaataggattatcgatctctgccttttcatccatttttactggttcttctacagccttggaaacaggtgacttctcgttagcatgctctgttgatctaaccttctccagagaaggtttttcagtttcttcctcggttgtgggtatcactgtcttttcttgttcctcttttatcgcctctttcctagtaaccttcgattcttctttggtctcaagttcggaagcgcttgcaaatgatggacgggtagatagtcttggtgtagaaacttcagaggatatgggtgactccaaattcttgtttgttaatgtgttcaacttgcccgagtaagctccataactgggactgtctgatgacctgttattcctttcagcgtaagaagattgtggctttttcaacgcaccatatccagaatcctcattataatacctagaagacgaaggcaccgatgaagatattctctcagtagagccggctctgttgttccagtagggcctgctatcacgataatcccttatcatcggttgttgtctatatctggagtccttgggtatgcgatcattagaacggggtttataagactctccaatagacctcctctctggtaagggttccctgtatctgttgttgtatgacccgtagtaaccattattgtaaccagagtacccttggcttgagccgttgctggtgggtctgaaatccttctttgaggggtaatatccattactcccacttcctctgtggtagccatgactatccctttctacgtaactagagccagaatgctttctgggcccatttgaactgactggctcactttcatattttcgcctgtaatcacgaggtgggttgttgttcccacggttggaatccagcggaggcatatgagaagaaatgatatctgaagagttctccactgatagcagaatacgagtgctcgtgaagtggataaaaaaaccttctccttggtgttcaaaacggggatacaggctagattttaaggttggtggttgttacaaaagaccattgaaacagagaagatggggttacccggtattcgttgggaactttttacccgtggttcggggggtgggggcgggacgggcgtaagacccacaccgtaccaggttcgaggtcgtattggattgttatattaaaagtctattattgcctattactttctatccattcattatcttctccaaaagaggcaaattctggatactggatcggatctcatgctctgcagttatacaagcaacttttgagtttccaacattagataatctagaggaattgttccccatggagataactccatgactttccaacatcgataggatgtcgatgaactcagtcttcttcaacgacccagtcaatggatcaaaatcaatttttgtcttgtagaactcgtataaagagttaatcgtgatgcttttgttcccagagcatttgctcagagcacatagaatagttttctgttgtatgtttagtttggccagaaactgcttaccttttcccaagtttgaggcattgaaggccttggctatctccgcaactgttatgggaggaatttcatgcagttggaggttggcaaactttatgggatccatctttctttttgctgaagcctctgctaactctatcgattggtagaggacatcgaaggcttttctcaaatcacctgtgcttgaagaggccttacgtgcacataattgcagtgcagcaggatgtataatctggtttgtgtttctgtgaggtagacattgtatttttttggtgatgatcgtctttatctggtcaccattatatgggtgaaattgtaataagtttggactgatgccgttagtcttcaacctcggtataaatctgtcagtcaggtccaacgcgtttgctatccctattagaatcaacctgggaccacctgcacccgttaagtgagaagcccaggagaatagttgaaataagacccgttgattcttagcgatcaagttatcaagttcatccagaacaatgatatgcatatcggcgacatcctcatcacttaggatcttctcaagttgctcggatgaacatttagcgtcatggaaaatgttgcaactctgaatttgtcggtaaatgctgtggtagatttcgtctggtctgttgatagtcatgcagtttattttggagacagacagtaatctgctgatcgattgcccgttcttttcaatttgatacgtgttgaaggttccggatttctttgggaaaagataggctagcacggcattgagttgagctgtcttacccgttcctggaggtccggagatgtacaaggaattgctttccaagtccgcaaggcctttctccaagaagctctttagaatattggcctcttttgatctgccatggagagaatatccgtcggtgtcgatgtctggtaaggaccctctctggaaaacggttttgacctgagagtagacagtagtggcatgtcgctctttgaccttcgttctctttggcgtgggaagaccattgatctcagtaagaatacgcttcttctgtggagtcactggaggactattcatgacgagatgaaaaattgagcgttaagagtaggaagagagaataatacaagcccttgctcttcttcaccttagagaaacacggtagaaaaaagattaagtagcagaccgcgttccattctacttgaaaattccgaaagaggaaattattcagatcgtttttaattaaactcgaaatagtaattacctaatcatcattaagagttcaaaacttgaactccacaattccagctgttcagcccacccactctcaaataatgctacatttgcgtttctttctgtccggtattattgccaacccatcttgatcgtattcaacaagttcttcccgagagtttcctgacgttgagctaacatccttaccccttataaacatgctggctcgcttggctctacttagccgtctgttactcctattgttgtcattatcccctctggtcttgggcctgctgttactcaaacagtacgacacagcagcatcaaaaacgatattgacgtttgaaacctccttcgcagaacactcgatgttcatcactgcccccatctgccttgccaactgcgacgaatcctggggagatacaaagtgcggctgactcttctgatgacgccgcatatcagatttggtacctaccaagatgatcggtgtgtttggacaaaaatgtgccacttctgggtaccatttgtcggccacattatgaaaggtggacagattgtctatgctgtagcacagcaagaccacgtcaacgtcggagtagcttaggggtctcaatctgtcgtactcttcttgccctgcagtatcccacagagtaacggcagctatctggccagttggggtcaccaatgtaataaccacattttctatgattgtggggacatacgcctcaggaaacgttccagtggcaaagacattgagaagacatgtctttccacatccaccatctcccactatcacaaccttgactggaattggtttgggagatcgcgctattctgatagtcgattgcgttgaaggatcgaatctgtcgaacttgatcaactggaagttttcaagttgctccacagcatcagacgacattgaaaattgaggggatgtgttttggagtatgctggtgacaatgtttatctggtgtgctattattggaaaagggcaaaaaaagatcgcggcaacaggaattcctgggcggaactcgcaagggagcctacggcccagatcgcgacttccgtccgctggttgtgatgtgatgtttattatcaaatactgtatacaaaacatcaccttgatctctttatctgtgtgcctctaatgcaagtgagagcacacaacatcccacagactcatctagagacgttaccggttcccgctgctaaagatctctctcatacgagttctgtcgatgccgggtgtcgtccatctgagtactaccgttcccggttgtcccccgtgcgatttgcttcccgtcaactgattctatctctagtcgagaaagagacagaacccttaggaagatggcaggcaaaagttaggacccctctgttggacgcatatttttctcttacggcaacgcttgggagtcacaccttttatgtgttaatgctgccgatacctgtctggtttggctatttcaagttggctcgggatctggtgttcatattaggattcggtatatatttttcaggcctactgaaagattacttatgtctaccaagacccaaatctcctccgctacatcgaatcacacgcagccattatactgctcaagagtacggctgtccctcaagtcacagtgccaacgccatttctgtgactctaacgttggcaacatattggtaccattatagttacacttacagcacactgttcaatacagtcagcattatattcgggttgatttaccttgtttcattggtcctgggaaggttatactgtggtatgcacggttttgtcgatgtcgggtcgggactcgtaatcggcatatcatgttttctgataaggcatctgacttctgatatatgggatcacatagtctttcaaacaggttggtttagtccggttttagtgttagtgttctactactcacttatctattttcatgttaaacctatagatgattgcccatgctttgaggatagtgttgcctttgtgggagttttaacgggaatggaattaggacaatgggcattgtttcagacttcaaacgcaattacaattgaggattttgatttccgatacaatgtaatcgtccccttcagctggactcatctaggcccatttttcactttggctcggttagttatcggtgtttccacaattgtcatctggaaagcgatatctaagccgcttctcacgcggctgttgtctcccatcacgccgcaccgcgcttcacaccattgcaaagcattacaatcccgaacacacgtgtatattttcgttcggctagctgtgtatgctggaatttccacactcacggtttggatgaacgtattgtttaccctttttggactggactcttctctatccggccctctagataaatatacttgagaaataattgtacaacttatcagttctctatcacgtgacagtggactttccgcagtcacagagcattgctccaaatggattcgagcctttcggagggaccttgtagcatctacgcggaaatatacgggcacagagccttcgcgaagcagtgaccacctaacaccacaattcttcgagctcgcaaaacgtctgaaaaatttaacctatcttcaacctgttagcttcaactacaactatacaaaatggaaaacgacaacggtgaattggtatgtatcccgaactacacgagaaatggtgatgtgtagcataaaatgaagctcagaaaatctgtagccacagtgaagttatacggccatttgcgttgttagttggtcaagttcgaaaaatactaacatttcaaggttgaactttacgttccacgcaagtgctctgccaccaacagaattatcaaggctaaagaccacgcctccgttcaaattaacattgctaacgttgatgaggaaggacgtgccatcagaggagacaacaccactttcgctctctccggttacgttagatccagaggtgaggctgacgactctttgaacagattggctcaacaagcgggtctgttgaagaacgtctggtcctactcccgttaagcactcaaaaagatgtttttgtacctttaatttagcccgtcaacattattagtgtattacaccaggttgtaaaatgcatccatacaccgtagtatttgcgcgcctcctcctgggtgttttctcaactgccgcccccaactcgcccccccccttttgcacttcttgccaccttggagatcagagattgtggaaccttgctcaaaatctggcatgcacactacctcctcaaaaaaattttccttgccttgttgcaaggcgctcaaaaatcaaaagtttttctacaacttttgttcccaacaaatcacctttttacttacccattatgtctgaaggtattattgaaatcgacactaacttaatcgagaccaactacgaccaggttgtcagcaccttcgatgagctgaacctgaaggagcaaatcctgagagccgtttttgcttacggttacgagttcccatctgccattcaatctcgtgccattttgccaattgttgctggtcgtgatgtcttggcccaagcccagtccggtaccggtaagactgctacctttgccatctccgctttgcagagattggatgagaagctgaaggctgcccaagttttgatcttggccccaaccagagagttggccctgcagatcaagaaggttgttttggccctcggtatgcacttgaacatctctgtccatgcctgtatcggtggtgttgacccagctttggatgtcaaggccttcaactccggtgttcaaatcgtcgttggtaccccaggtagagtccaagacatgatcgaacgtggagctttcagaactgagaacgtcaagatggtcattttggatgaggccgatgagatgttgtccactggattcaaggagcaaatctacaccttgttcacattgttaccatccactacacaggttgttcttctatccgccaccatgcctcaagaggtgttggaggttaccaccaagttcatgaacaaccctattcgtatcttggtcaagaaggaccaattgaccttggaaggtattaagcaattctacgtcgacgtcggtgaagaacaatacaagttcgactgtctgtgtgatctgtacgactccatctccgtcacccaggccgttatcttctgtaacaccagacgaaaggtcgaggagttgactgagcgtttgaccgcccagaagttcaccgtctctgctatccactctgagctgtcacaaaccgagagagacaccatcatgcaagagttcagaaccggttcttccagaatcttaatctccaccgacttgctggccagaggtatcgatgtccaacaagtctcattggttatcaactacgacttaccatctaacaaggaaaactacatccacagaatcggtagaggtggtcgtttcggtagaaagggtgttgctatcaacttcgtcaccagcaaggacgttgagatgatgaaggagatcgagaagttctactctacccaaatcgacgagttgccatcttccatcactgacttgtttgagactgaggaagttaatgagtcttagattcttgtcttttaaaaattttccaatgcaatgatattatgtcttgctacgtgtctcttattttgttatatacttagtcaaagtaataaacttttatcttaccgttctccagcccgctggcaaacctagtatcaccgagtgaaacacaagatacacttgagtcgttactaccaaaggtatgcatacacttcccactctgtaagtcccatactttgattgtcctgtcgtgggccccacttacgattctgaaagtatcggcagcgatcgaccacactccctcgatatgaccaaactgggtccttacacattttcccgtcttgacgttccaaagtttgatggtggtatccaacgatgacgttagaatatgcgtaggatagtttttttcctcttctgtctctggagtggctgaatcctgggcttcccttgtttcgtctgcaaagttatctttctccagatcttcaacgatttcatatttgatatttaaggggatcacacactgaacctggccaacgtgtcccttattctcttctccgccaaaaactttgatacatgagtttgtcttcaaatcccacattcttattgtggtatcgtcagaggcactgaagcaagtcatggactttggatgaatcttgacagaattgacccagtcagtgtgtccacgaagggtgtaacatgtccttgtttcaacgtgccacactttaacagtttgatctgcagaacctgaaactatagtctttccaataaaatctaaagatacaacatggttattgtggccatggtatgtggagatgcattcgcctgtatgataattgaaaaccttgatcgtgccatccaaacctccagtgatcagtttttggtcgtcaaatgccaaagtgcgtacgcctctggtgtggccacctaacgaccgtattaacgcaccagtttctagattccaaatcttgatagtagagtcatacgatccagtcattaatattttgtaacccagttgcatgcatgttacgccatccgtgtggccttcaatggttcttactttgtatacaccctttctccaatttctttcaaccttgtaacgttcactgtagactactttccagggtcgcgttttcctagcagcgggggcgacttctttactaacagtagtattggtatttgtgttctttgatgctttgttggtgttattgtccttgacatcgatagcagtggtatgtggaatttctttactgacctcatcgggaatgtgcctggcccgcttcatagccaatagaggtaatccccatccacattgaggacatttacgatcaatgtgttgttcacacatatagtgccaaactcgatcgtcgtctgccagtctcttccatttcctggacacctgtgctgcattgcatagcgaagcacagtctagataacataaaatcttgagcgataattcggtcggtaaagttgaaatgaagtccagtctgatcaaagatttaacctcttctgagatcatcgacaattgaggaaaacaacactgtgacaacaacccacggagaatcaaagacctgtgttggtacggcgcagcagaaaaaattgaccatacatgcgtgattgcttccctatctctgggaggaatcttctccattgcatcttgtatttcatccatcttacattggtcagtgttcttgttacacgtcacatccggattatgcctgtaacagtacttgtggaagttatccctgggaatcatggattggtcaacaacatggtgcgtcagaaagttagtaacgttgttgttcttgtctgtgttgcttgataacttcttcttgtcggcttttggatcagtattctgctccaaaccagccttgccctctaattgattggccattcgaaacacaaccttgtcgtctaatctcggtttctttgtacacctctcggtgtcctcgcttacactcatcgtataactgaagtagacaaggaaaaacggggcggattaggtagagttcaatctatataatgacagttcacatcttacttgactgtggctcgtccagttcgagaattgagtggtacaggttccttttcatttcccagacctcagccgacccgactggggaaaaaaacgacaggcccttccagagtactatgtattcgcggagaatacctaaagggtccaggagatacgcctaggcgcattgagtagtcttgactggatgggagagagagtccaattggttgaataacaactgactctaaacgtggctgtactccggagggttgccgaaaaactttaaattcaaccattgctgaacccatgcttctttcggaaaaaaagatccgccgttatggcataggatgccaaaagtttgcgaatccttgataatatggcgtaacctccacccaccggagtctgaaatatgcagcacccacagcagttcgcgttccctttccagaaagtcacctggcacgtgatttagtcacatggtagatcacgttgaacattatttttctattttggaaagagaaattttataaactaagaaaaaaatatcccagatacgcagattttctgtatatacataaaactcctttgcagttgaaatcagacggaggaaatttcccgcttgatgcaccttttgaaaagatctgtgtccattatttataacctccgttttcaaagttcatttttgggatcattttacacaatgtcatcggcatcacttgaacctatcagtttaccccagaagagaccgttaggtcgcccagagtccacaaaaccccccaagaaaatcaagagaaagtacaacaagaagaagaatgtagatccaacgtcgcctggaggagttttgggatttgaaattgaacatctttgcaaagagcatggtttatcactagctgacatttccaatccaatggatgttatcctgaatgacagctcgatacagcaaaaatatcatagaatcgtcgacgaagtgaacgtcttatctctcacctcgaacggtgacggtatagctctcattgatgggcctgcggaaacaaacaccaagaagcaggtcgctatagtgccgtttggcctgcctggagatgtagtttccatcaaagttttcaaatctcatcccttacatgttgaatgtgatcttcttaaaatactatccccatcaagtatgaggaatgactcgcttgtcgattgtaagtattttggggtatgttctgggtgtcagtatcagcccatagaatatgcgcaacagttactactgaaaagagataccatcgttaatgcatacaagttctttgctcctatactgacggcgagtggaaagctgcctgacatgggctctaccgtaccttctcctctgcaatacagctataggactaaactgaccccccattttgagattccaagacgtaagactcaagattttcagaaaccttcgtttggtttcggaagtaaaggtcgtcctaagtttagacccgaaattgtagatgttaactcatctattgtcgatattgaggaatgtcttattggtaccagcatcatcaacactggacttagtaacgaaaggaaaaaattcgaatctacctacaacaattacaaaagaggtgccacgatccttctgagagaaaacacaactcctgtagcagatccaccagttgagacaggcgaaggatcaagggatggcactggtgaaatatcaaaagctgaagtggagttacctgatggctccaagcagttaaaaacatgtgtcaccgaacctcgtcaaattgtcaccgaaattattaacggaaacaagttccaattctctgcgggagagttttttcaaaacaacaattctattcttccagatatcatcaagtacgtacaggataacctgaagctagatcccaacggagagaactacctagttgatgcgtactgtgggtctggacttttcagcatatcttgtgccagctcagtcaaaaaggttattggagtggaaattagtgctgatagcgtcaagtttgcaacacataatgccgagttgaacaatatcgaaaactgtgaatttatcactggaaaagctgaaaaaatctttgcggatattcaacttccgagggaccaaacttcgattattctggatcctccaagaaaggggtgtgatgacgtttttcttactcaattatcagagttcaaacccaagaagatcatctacatatcttgcaatgtccactcacaggcaagagacttggagtatttcatcaataatacctccaatggattccaatacaggattgatagcatcagagggttcgatttttttcctcaaacccaccatgttgagggagtggcagttctttcattgatatagtaaatagagtaaggcattaagtggttagggttctgtagattgtctctagaatttctggaaaaaaaaaactacaaaaaaatacaggggcgagctgggaattgaacccagggcctctcgcacccaaagcgagaatcataccactagaccacacgccctgatattgaaagaagagtgtctggaaattatatgacattaaagactcaggaaatttttagcaattaatctctgggagtatggcccgttatatagtattctatggcagagtaatgcttagaaactcacttagcatttttatcagaatttgaatatccttttcagaagtcattgcgccaaaacttattctaacgacacctctatgacttttcttatcctggtcaacaatatcattttcatcaccacatataaagttacaaacttgagcttctttgaaaaattgggcatcttttgtccccaagtgttgtgctagtccaccgtagttacacatggctcccactctcaaacatacgttgtttttgaaagcggccttctcaactttggagtagccgattggttcgcccgagctgtcaaacaagttgaatgcaatgataggaccatgtaagttagcatctccgtaagtttcacttccataaaatctcaccaaggcaacaccgttgtcgtgaacgagattcttcatctgagcgtacgcttcagctgtaatgtggttgacatggtccgagatattaaagaaactcccgtaaagagacaagaaagctttgtacgaagagattaaagcagctaaagtatgaattggtagagtgccctcttctaaaatagagtgtaattcaagattccttttggcataatcagtgtacagagctacctgttccacggtaccacctgagaagtatttctttccactgaaaacgtagttgccggctgatttcttacaaactaatgccccgatgtctgggtaaccgagaatcttgtagagcgatagcacaacaaaatcaggtttagcaagagaggtaagatttctcaaagaaggtggctttgatgttgataaggaagcggcgtcaagtagagtgtaaactttaccacttatcgacttgaagagcaaattgtactgcgaatttggaaacctttcaccagtgaagttggattgtccagtccatgatactaatactggacgttgaggtgtttccaaggagtactcttctactactgaataaggatccttgaaacatttgaaatgtttggccacagttctaggtccaattagggaagtatgcgagtcaatgctgtagacatagtcaaaatcttcaaaggtgtctctgaaaccttctaccaccaactttactccctgggaagcgttggccacaaagatgacatcgtattcatcagcgtcagcgtccagcagcgagtacactacgtctcttgcctcttgcacgatatgggtgcttacctgtgagcattgagagatggaatgaggattacccatgcacgatccagacaacaatcgcactgtctgctggagggatgaaacaggataaagggtagtacctgcatggtccaggtaagtcaagtcttttaaataagggtactgggaccttctgattcgatcaaggttgggctggtaggttttgttagcgtcatctggctttcgagtgggaggaaacttgtcaaggtggacttttgggtaaggaatgactgagagtgcttttccaagagatacagtgaccattggcagtcagaaaatgagacgacaagaaggtgaggttgttgaagaagggaacaaacaagttgagcaagtgagttttaggatggtacaaatgaatagggtggaggagatgagatgtgaaggcgggttaattttttttacggaaaaaaaagaaacgcgagacacgttaggcatccagatgacaacaagttggcgataaatctgtcacagtcactatttgtctttacttcaatacacagctgaatcgagcccatgtccactgatactaaggaggtcgtatgtgacgattgccacaccgtattccatattcgaacggcaagatcttactcggggtccagtttgggaggctccgtttcgacgctaaagactcctcggatcaaggtaattggaacgggaggaactattgcttcgaagggagagagcggatcgcagacagctggataccatgtagacttgactattgaggatttgttgagctctattccggatttgtcgaacgtatgtgaattggaatacgaacaaatcctgaatgtcgactcaaaggagtttggcgagaaggagttactgatgttgcacgaagctgttagtcgaagcatacgtgacgacagttttgatggcgtagtcatcacccatggtacagacaccatggaggagactgcattcttgctgcaattgacagttaacacatccaaacctattgtaatggctggatcaatgaggccttccaccgccatctccgcagatggacctatgaacttataccaagcaatatgtgttgcatgcaataaagagagctggaacagaggagtgctcatagcgttgaacgatcagattggatcgggattctacatcaccaagtccaacgccaactctctagatacattcaagagtgtgattcaaggatacttgggcaacatagtcaacaacgaaatccactatttcttccctgcgtcgaagccaactggtatacagtactttgagcttgctccgtttccgaaagtcatagttctctacgcccatcaggggtttgaccctcaaatcgtgcgtctctgtgcatcacaactaaatgttcgaggcgtggtttttgcaacaatgggggctgggtctttgagcaaagagacaaatatagagttgtacaaggcctggaaggagtttggtacgccaatagttttttccaaaaggtcaatggacggaatggttcccatcgccaatttaccgagggagcttgagattgaaggcaagacggtgcagtttgacggatgtatggctagcggatacctgaacccccagaagagccgaattctattacaactgtgcctcggtgcctcaatgaaggaccgacagattgcagatatcttcaaaacgctttcgttcggaggctagttagtatttttccaccaaatctcatgcacgcagtctcagttcgcgtatgtgaagtaggtacaaaaacctaaatagcgattaagttcgctgagttccagaccaagtgaggcaaggcgatcacatcacctctccccctttttctaaaaataacggtttttattctatatctatataccttactaaaccaactgaacagcaaaccaatcataacccatacctcgtaataactaaataataatacatttgtcacaacaacattcagaccgtttcacgagtattgttctgcacctctctaagaatgttgatttttctccttctagcgtttatgaaccagttgctcaactgttgactggtcagacccgtctgctcaatcagctctagtttttgtcttgggttggggtatggatggttcaggttgttgaccagccagtctgaaaggatggttgtggttctttttggcaggtttgacctgcgtttcttactgtctgacacagtggatccgacaagaccgggcttggctatctttttctccgttcttgggccaggtgatacgggtcgtctagcagttgcagtggacgaaatggaagtggaagtggaagaggggggaggggagggtagtgatgccaccacagaccgttccaatggagaattgacggtgctggttcggcaaagagatgattgcggctgagggcttgctggaaacacatgttgctggtacgaataagcgcccacaggctgtagaactaccatcggagagcttgtggatggagctggaagtataacaggcgagggagtgtaggtacgtggctgaaaataagatggttgcattcccaattgcacatcgctcagcatgtcatgaatggagggaagcttcacattggcctcggcactaggttcagagacagcaccctttggttccacgctggcaggtcttaggggcaactggtaggtagttttcgttgctgggcggctgaccaaacttgatatctccatcttctacttgcctttaataaatttatacgagaaaaagtgcgaattccccattttatattaatgcatgaaagatccaattttcacgtcaaagcctgtttgaaaacttgaatgtgccgtaagtgatgatatcacagcacctgtccacaggtaatttcctaaattggttgtcaccgataacgcgcggctggcactacatagcgtttatagtagggaacagaactctttccagtagctatattactaatttcgagacgtgtgagtaaaagtggaatacctggttatctacctaattgaaggagtggggattttccacaccccgtttcgtcctcggatgaaaattttattaagtgggcccaccgttgaccaataacattatctgaaataggttaagtagtgttgttcatgtcatgcatttcatcccatccaatgtcaagatgtttctcgcctttccccttcatgttttgatcgtttcagcccctacattgctcctccacttttgaacatttctttttcttcttggggaggtttcatcgtgtctcaaaaggacacatttgacaagaaacgtcccaaacgcacatgtcagttgtagaggtctaggtgatggatcgaaccgcgcacggtggttgcctttttcgctctcgcataaatgattgcagatttcattgggccgatcgggccgtatctgatataattattaaagatactgatgaaatccttctcttcacaagttcttgtgtatgtagtgatcccttcgaagctgtttatgcacagtcaaaacattttggatccaattgccacacatttttctcggtgtgcttggcattcgccgaaaagtcggcttcgtagcgacccactctagcctatcagcggactcctacaaatgtgccatctgtttgtgtggacacgacctgcgtcatttttctgaatgaaattttttgatgacacaacataaacgtccatcgaataaattactgcagctgattagcaatctggacctcatttctgattacatgctccatgtatgctacaagtcaacgtcaagcatctcgctacccgtttgaaaaatttcagctgatgatgtaaacacccccttaataacgtcagaagtaaattttcttgctgcatatatcttagcattccacaatcttgcttccaagcttccaacaagtgcggctaaataatacgaaaacaagaaactgctgccgcctacgggccaatgcttgatctttttcctgttgtcagtgtcgtcgtttcacaaattagtaagcttgcgtggcgtgccgtcgtgcataatcactatcacaaccctaaagggacagatgcaccaatttcaatttcttgtttccaatctgtcggctcctcatcctatttgctattattttatggttaattgattgagagatctccaccgttccccacctgcctccacttgttaattggagttcgcactaccacatatgtctaagccacaagtcgggccatcccactttatttctgtctgatcaggaaactgggccccgctccgtacctttgacaccatcctccagggaagaagcacggtcccttcctgtcaaaaatgtcattcaggcaagagctttattcagatttgccaaaggatgtaccctccctggatgatgatcttcaaagttctcgtttggcaaggtataacaaccccaagctgatttcggacatcaaaaaatggctttttggccagatgctacggccgtcaggcaagtccataccggatgaagaatttatagacaagactgatttgatagagttactgagagacggtgtgtacttgtgccaattgattgatgttatagaccctggaaagatcaagtataaggcatcaaagatgccatttgtgcagatggaaaatatcgcaaattttcttcagtatgcgagagaagtgattggggttccagaaaacgaattgtttcaaactgttgatctttatgagggtaaggatccttaccaagttgcgatgacaattcaagcactttctagacagttgacaatcaaggataaagagagatttcccaattcaataggccccgaattagttgagaaacgcaaaccgcctgtaccgacaaaacctacccatttggctggctggagtaaacatgaatatggctacatcaataaagatgtggagaatgttgttttcagtggcaagagagacatcaccggacgccgctaattgtatatatattgattcactgtttcttgaatagaagttgagtcacttggtagttcaactacgttttgaagaaagttattgagatggagattgacatattcttccaagtcaaaagtcaactgttcattatcacttgaagtcttcgttgaactcggcaagaaatcgtgcaagttgaaaatgttataagtagctttaatgtgcttcaatacgtggaaacaacctattgcagtgcctgtctcaatgactttgaaggagagaccagagtccacctcgttctctcgtagaaattcgtccttggctattgtcggcgccagcacaaacacgacgtctttggtatttttgaggatctcctgtataggtaattgtattgctagtatactctctgagacgatgatggcgactttttgcctcgtatatgatttcctctcttggttgatgcctaggttgataagagatgagggtttgtcggacgttataaaactcttgtaaacagagtaccccagtcctagtgccccaagggctgccaagccaaaaaaagtgtttctctttgtggatttcatgttgaagaagggagagtattgaggagaggagagctgtagaaagaggtatcatgtaatagtgcatatgataacttggtgtcctgtggaagtccgtccaatttcgagatatctcctctgccagactccccccagccttctccttccaggctatgatttccgttgtgggtaagccaatatattccggatctccttgtactaaggatcaactcaatgagctcacatgatctagtgtttttggccactactaatgcattgagccatatctcctcggtccttggatgcatcgcctcaattggcaccaccgccaaagtcacgatcaactctcacggggtccatttcacggcgtacaacgataatcaaacaattagagtggccttaacgttagccaagtccttatttaccagcttcattctgaatgcagaccataatgctcaggagtcaaatacccaaatttcagtgacccaagattctgaccagctggaagagtcagaaatcagcctctcattggatgtgcagctgtttgtggagagtgtcaacatccatacttctcatcaaactaccttcggcggtaacaacgcctcaactaacacagataaaaacgaaatagagtgcacattctcttatcaaggagatggccacccctttgcggtaatctttgaagataatgccatcttagagagagtcgaattccaaacttacgctgaccaagaagatttcgaagaaaggttcagtcttgatgaaaccgaacttgtattgagtactttgctgagcggctctctcctttatgatgtcatgaaagatctaaaggatgttaacactgacgctctaattgtctatgtcaaagataatcccataccttctaatagaaagttggtttttatttctcaaagtgaaatcggccattctaaacatcaatacccaagccaaaaaatttacctgcaagatctttctgtttggaaaccgcaaaagatgaatgataaccttgagtttaatcagacgatctccgactcactaacatgttattaccggtttgaaacttgggccaagattttcagaagttttaaaatatcgaatcgtattaagttgcagaaaagtatctctggattgacctccacgagtcttcttgtacgtaacccccatgatcagtcttatactggttccgtcatcgattttcgattttgggaaaacgtcaatgatgaagagattgataacctgaattgggagtattgttacaataatacccatgtggagcagttagtggaggatgatcaaaacatcaaaatcatccaatacgccttgtccaataatttagatccaaaccagataacgctagatgattatctcaagagaagagagaccagatctcatgccagacctcaagccactgaaacaccattcataatcttagatgacaactcccacaaagaacctgagcccagcaccacaagaagaacacctgcaccatctacaattgacataccgttatttctataatttaaaatgtcattagagaaaaaaaaactataaagactaattaaatccagaaaaaaattagttgctggaaaagtagtccaaaagaacgtgacgctcctcggagtcttgaccccagtccttgatgacaacacaagaagcaccaacaacctttctggcgttaccctcacggtctaaagtacatagaccagcccattcacctaactgcttggcgtcagagaccttgatcagagggatcttctcctctggctcgttacaaagagcttcaaccagcttgatgatggcctcgtcagtgacagagtcacacaggacacacagttgggcagcaccagaagacagagccttggaagcctctctcaaacctctggccaaaccatcgtggaccaaagaaattctcaagaccttcttgacggcatcttcaatggagatggatgctgaggtttcctcaacggcaacctcaacctcttcaacgacttgttgttcaacgtcagacatgttttctatgattgtttcgagtagtagacttcttccacagatgtaatccggtcagtactatgaatgaataaaagaagatgaaccaacggtggaaaaaaaatactttagtgtcgcggtagggcattagccctgatcacatgatgaacagcttcaggtgttccttgatggagtgcgaaaaaagagttaggaacgttaggaacgtcagctgttggcagcattaacgccgcactgaacgagcgccgcacaggtattactcacattgagtatctataatattagaaacatttacagtacagaacatctatcgggtgcctcaaagtacaaaatccatctcgtcattgaacttttcgcccgcgtcacccatctcttcatcatcgtcatcttcttcgtctacaatggcaaactcagaacccacagacgttcctctaaattcaggccttgatgtggggagagagttggaagtagtcgtagaagttgcattgccagctgcttctctttcagctgcaacttcatcttcgtcttcaaaatctacgtcaaaaaagtcatcatctgcaccaactatcttcgaatacaagagtgtggcctcagtgacagcaccatcgtaggaaagttcggaagaaggcatattggagtagaaaataccattatctggagcgtctggatcgtatttggaggatggcgattcagtgtcaaagtattccttgtgtacgacaccaaacggtacgacatctgtgaattgaacgaatcgcaacttgaaaacgtactgaagtttcttagacggaacgaaacccatgaacgactttccaagttttacagagttcagaacgggaactcctttatcatcaaactgaaattcagactcatcaacatcaaactcactttctctgagtatagattcttccattttattcagcgcagcctcgaggtctttgcctgctgactcctcaggagccaaggtggaaaggtaccacagacactgaccttcaggacatactccagcgccagcacctaaaatcaccgcttgtaccggataagcattgttagttggtaagcagttggctggaaaaacaacgatagcagcactctcaccctccgaaaaccactctttacaatctttagtaacaccagcaatcaatctagtgattgcataattgcgtttgagaggaatgtttttagcattttctggagcctgagtaggagaacaaatcagtttctctttcactttgatttgagagccatcagagaaagtagccgtcttggtatttggatcgaacttgcgtaacctagtgttcaacttgtaagtggtaccagccactgcagcagatctacaaaatccctgagaaacctctccaggtccaccaaacttagagtagagtacagggaactttccgtagatgttgaaggaggtaaggtatcttcttattcttgataaaccttctttagtgggaatgttgggaataggtgccagtcctaatgtgaagaccaactctgaaatttgttggctttccagcttgaacgtttcattagtgaattctgttagaggtttgtcggcataagaagtccaaactgagagactttcttcattttggtcaaattcgaatacaaatttgagaaacttcattaaccgctttttcgatatcaacgataacgattggtcggtaaatatttcctgcttcgaagtctgcatctttccaaacgagtcatcttcataggtatggaagtttgacagcggttggaactccaagtatcgatgaactcttgatttaatcaacaaatcaagcaaatcggatttggcaaacaaaatctttggtgttagatcgattccataattacgggaaacaatcacattgggtctgggaatatacaatgaagcagttgagaatccggggattttgtggtcgttaacctggtcgacccatactttgagctggtcaatagttaaagtagcacaattgtcaccatagtacgcgttactatccacatgaagtacactagagccttgccatgccaaagcggcagccaagataccttcaactagaccggttcccacgattacgacgtcgaactccgaagcaatattggtttccagcggtttctctaaaccagccagttctgggatgatagaccctcttcgacgatcagaaatgctctgggagtagcgtctctcgaccacagacggcctgcgttcagcgacggtaggtttctgcttcgactgggcagaagcactcatatcgatgggtaatgagtctttttgtgggtacggaaagaaatgaagaaatgacacaaaaacacagctgttaaggtcctaattcgaaattgttggaccgccgttcacctttaaagaagaatttacacgaagttttgaaaaactgaaaagaaataattgagggagcaacacttgatattggatgtttgggttcgaagatattgattgtaggttttgtgcgaagaattttttttttctgcccggttttttaagcgaagcggtgagtcgttcgatgcactgttacctgaaaacggtggttaaaatggttatgctaaatgcaattcaagatttacgaggattagcgtgtgagaacttgatagtagaccaaaattagaggtgaaagacgtcagaagcgaagagaaggctggtgtttgacaattagtacggagaaatatgtcatggatgggtttttccagtttgggcatgccattaattgggagcaatcacgtgctagacggaagccggtaattgctgggcgagctgggagcccttccgcctccgtttgctcctcccccgacaacctccccagactacttcctccacaaaatatcgtaccccactcaatatccaaccaatcacgctctgcaattttttgattatcaaaatcattctcactaaacctcttctctctctcactacaccaacatcatcacccgttcatactaatataccacaatgtttgtgccatgcagaacccagatctcccgatctttggcacactcagttaggtacgcctcaaagcaggtggccacttcgcatagttactcgtcagaccttcccaccgacatccccgtgctctctaaacgtcctcatacaaaccttctggactatacattcacaaccttcgacaagatgaaaaactgggctagaaaatcgtcattctggccaatgacattcggtctggcatgctgtgccgtcgagatgatgcacgtctccgcaccaagatacgaccaagatagattgggtattattttcagagcctctccaagacaatcggatattatgattgttgctggtaccgtcaccaataagatggccccagctctcagacaagtctatgaccaaatgccatatcctagatgggtcatttccatgggttcatgtgccaatggtggtggttattaccactattcttacagtgtcgttcgtggtgtggaccgtattgttcccgtggatatttatgtcccaggctgccccccaacttcggaagctctgatgtacggagtgttccagttacaaaagaaaatgatggacgggcagacacacagaatgtggtatagatcttattagccatttattttatttatctattttctttctttggtggttctctcttcctgtgtcatatttcccgaaatctggttacgtaatgcctcaaatgggctctttttgaactgttcatcttgaaggatttttctgaaacgctgtgtttctgcatcggtgactgctcttctgcttttcagagaccctgttgggtttggtccctttcttgctggagcctgtatgaactgagcactttctcccgtgaagccatgacccggttgagtacctcttatctcatcacctccgggcagcacatctaataattcctccagtttgggttttaacctgtcattataactgtttctgtttgcaattttgtcatagtcggccttttgtttcattttctgtacaaagcctaatgttttatctaatcttttctgaaccttggtagttttattccttcgcaaaaaagcattatgatcgtttaaaagagaactcttttgaacctttctagtggctccaaccaccctactagtctgcctagactcaaccttatttctcaaagttgttctcttgtgtcctgccatttgaagtgttaaatgtaagggctaatttttttccattaagatgccattacgtaatgaatgattttcgcaagaagcctcgaattttttcaacatttctctgtcttcttcatccttttccatcaagtgccctccatgtcaaagactttcacaattaccgccttagccgcattgggagccaccgtcggctacgcaatctatttcgattaccaaagaagaaacaatgtctcctttcgtaaaactttgaagaagaactccaaaagttaccagaaaaagttgcaaaaggacaaagaacaatccaaaaagcaaactttagttcttctgagaaaacgtttagagcaagctttgaaggaggaaccggttttgagcgacgtcgctgagaaggaacaatacttttacaaacacatcactctcggtgagcaactctcaagcgtccccaataaagagattgatgccgctatcgagttctacaaggctctttctacctacccaaacccaacttccatcttgaacatctaccagaaatccgttcgtgaggacatttatgagcttgttgttatgttgatcgcaattcaacccccgcaggccgtggtgaacattttaggtgagtcttcactccagtcatctcacggcgatgatgtcgagtagagagaattgatgttgtttcctgtttagtagttacttccttttttttttagattttgatatctctgtacataagtattgcaatctactctacgtagcaactaagaactttccaacttaaccggcgtataaattctcctctgttgatactgaaaagtttattcaactctgtcttcacatggctagtgacgttttcaaattcatcggcttcaatgaagttcttgaatgtctctttgccatgtttaagatattcttggtcgattgcagacaatgcttcttcttcagtcctagcaaaaacaatggagtttgaagggtcctcacgctcatgttcctcccattccagaaactccaagttgagctcatccatttctccctgatgaatccccaaaacatcctgaacaaaactgttcttgctatcacctttatccagttcactaaatagtttgccatgtatctcattccaatttttagtcaacattttattacggttctgtgccaaaaggtcctgttccacaagattggcagggttattttctccgttgtccttactgaccagaatattttgatacgcttctttacgccgattaatctcttgaatctttctatcaatttccaatcgcagtttgtccagatttattttttgactatcatcttcaacttgagagttgtgaaggcttacaaattggtcaagttctgcatttagatcaatttttaaatcaggacgctgagttttcacaaaagtcagtaacttgatgaaactgttgaaccattggatcagttgcatgaaaacctgttcatcgtcacctttcccatcattcatgtacaaattgtggataaactctaacaaatagtcttggtacttggtcaatacagcaacaaaatctaaaacaaccgaaccattttcgttgatcatggagttgtaatcgttatggtatctttttattaggtcaattaaatcttcgatgaaagatttaaagataggaatatacttgtggagattggctttagtgaatatgacaatcaatggttggaaaaaaatggcaatcagctcttttattagttggatcaaatatggtgaatcccacaactcttttgataagtccttgtctcttctccgaagttttgtttcaaatagcgttctcaaatcaatataaagtttagcttcatcagatcccagatcgtcattactccatttcttataactagcaagaacttctaccaatactttctgatcaatcttcgttttcaattggttactgttcaacagcaaagccaacactaaatcaatattgtacttgtggcaagttgctttgatatcaataataacattgttatcctcctcctccatgtactcatcaattttggcgaccaaaacgtcacctccggtatacttactggtgatgttcttgttcaggaacaatagttccttttctaaccgtttcaagtcatcgttgaggatatgtgtaaagacgaactgcatcagagatttcccacttcctaacggctgatacaagaacaagtctatcatttttttcattattgtcattgggttagtgaacctcagaatggtttgaacaatcttgtacgggaagaactggtgaatcttggttaacagtgtaaaattttcaatagatgaatctgaagatacaaaaaaatcataaatagtagatgcaacttctaacttgaacagttcaataaaactctgcaattgtggagacaactcaaccactttggtgttcatttcgatctctttgaacaagaacaggagtccctgttcaccagtttcaccattgccaaaaatttgttctttcaactgatttatattcacttggagattgttaacggaattgacaatttcctgttgaaatttcacttgctgtatgattaacaagtcatccagtttcatcctattcttaatctcttcctcctccttgttcgatagctcatgatagcagtcttttttcaaaaactctttcaatatactgcagcttctaacctctgggattcgtatcaaattctgaacataacctctaagtgcaagtctaagtttctctctggggaagctctgcaagatctcttgtttagaagtgtttccatttaaattgaaaagattaccagattgggcacttttggaaacagaatctttgaagtcagaaagtttcttggtgacattttgaacagggtcattcgattccagggatgttacatcaacgtcatccgcatttgtgtcgtccatttcttcgtttaactccgagctcatcttgattttggagggcgcagagggaagttgttttccaggaaaatggcgcaataattggctatctaagttcttaaaatcagagtaccttcgcttaacgtaatatgtctctccagtagtctcatcttttactaagataatgaacaggtagattgacttcatggtgggagctgtatcagagtaccagtatgacaacgggtttatacttttaatcttacttttcatcttgtccttgacaaccccgcagacattgatatataaaccattaatgtaattctccctattgtgcaagatttcttcaacgtttatcaattcgttgggcaagatcttctcaatatctttgtaggcatttttcattaaacggccatctgatgtttcagattccgaagggtttttgaagtattcatcatctcccgataccaaaatagcagtattgtacatcatcaacatcatcttgacaatcttataaatcagtaacttcctctttgatagagaccctctgtcattggatgtactgatcctcttacttttccaaatttcgtaaaactgctgaactttgttgatccataattgctcttggatagtgcttttcttagcaacattgtggttctcgtagtattggagaaagggaaacttttgtaagaaattggtaaaaaagaatctcaacagagggaactcttcgttgtaaatttcgacgttctgataatgcacctgcaacaattctgacaggttcttcgagtcaggagcattgatggggtcgtatggagcaaatggagggccaaacttacgcaatccagtgacatctccgtagttaggactcattgcttgaatctccctgagaagctctttctccagaagctctttcttcaggtaatgttcctgagtaggactaaacatggggctgaaagggacggaattggcgtatctcagagagtacgatgattgttgaagcccgtaaaagcgagagatgatgcgctgtgatgttcattacataatcctgatatcctatatacattcaaagacacgccatactaagcctttgccctgctacaacagggtctctgcatctgaagcatcacgccagctgtctataatacagatctactttattgctcgttcttagttctttttcttttttcataaaacaaatcacttctggttgtacctatgttcaagatccgaggacagccatctctgtctttttcagtcataacacattctgagcaatagtaggcatccgtggtgctcttgctgccacataatatacattttccctcacctttattactgacgaacgaacactcatcacatatgtacgcaagttcggcttggttcacataggagtcacatgagggacatctcccatcgcatttatcacatagccgagctatcgttgtccctggctgtttaaaacattggaccaaatcatactgatgtcttgacatttacacagagggagggaactggagtgattatttctgtttaatgaggatggtagactatgcttatataatcgggtatatcaaaaagtcaaaaaaaaaaaaaacgaaggctcacactcacacctaggaactagcatgacagagataataagtataagaaaacccttgaatccgaatgctgattcagacgtggagtcttctgatgaagagatgctcgaagcatctttggcacctaagaataataatcaatcaattgtgactccaggagaactgataacagaggatcccatatggatgagaggccatggtacctactatttgaacgaaaaaacatatagttccgtagctgggaccatttccaaagtcaacaagcttctgagtgtggtccctttgagaggaaggtatcagcctgaaacgggagatcacgtcgttgggagaatcacagaagttggaccaaagagatggaaggtagatattggagctagacaagatgctgcattgatgctaggctctgtgaacctacctggaggagttctgagaagaaaatctgaaagtgatgagttacaaatgaggaatttcttgaaagaaggtgatttgttgaacgcagaagttcaatcgatttttcaagatggatcagcttctttgcatacgagatctctcaaatacggtaaacttagaaacggatatttcgtcaaggttccttcatctctgattatcagacagaaaaatcatcttcatgagcttcccggaagcattacgattatcattggagtgaacgggtacatctggatctccaagacattgtaccagcatcaaaaatctctgccgtctaccacaggaaacaacgcattagactccactgtttcttcagctgcagccaagagcaacagttacacaccaggacagggatcagtatctataaccagactggaggaggaatcctcctgggaaatctacagtgacaaaaacgagcctatatcagttgccacgaaggacactattgcgaggtacgccaactgcgtgaaagcgctggccaaatgcgatatcggaattactgaaactcgaatcattgcagcatatgaagccagtatggtttacgagaatgcggggttgttattggatgaggagaccatgaagagcattggagaagatgtgctaaatagggaaaggatgagaggctagcaaccgcgcagtcgcgccatgtgaatgtgattatgtatcgattaataggagcaacatgtgcagtaaaatgattaggtaatctaaaaaggagggatagagttagaacaggggggtaagacagaggggagtcaggggggaaggctacaagaaagtggaatttaggcaacaattggaggagagttagaggggatattaggcaaactagaggggaactggaggggatacctgattaatttgacagcagtggaggggaagcctgaaacgacactttctggagagcatgattttttttgaggggatttcggggaggcacaatttcggagttgaaagaatcctgcttttaatccgcggataatttactcggagtattttccggaaagcaagggttgtttgcgacggcatttcccatactggttctccccagaaattgattggatataccgttattctgctgataattggttgtctagccgatggatgcaattttttttatggggctataccaaattgtttggggttggctgaaatcgtggtggggtgaataaagcaaccgttgaaagaaatgtcacatggtggagggagaggttaggatgttcccccccattgagtctcccaaggtgatgcctagttcacgttctatacttagtctaatcagaaaatagcaccccggcgtaacaatcgacttggtagctacatcagaccatctccacgcaggaagcaccccggccaaccaacgcaacccctgtatgctaatttctcaatccagttctaacagggttttcatgaccagtccactagatccagtatgaggcgcgaaattcttagcttgacaattgcaggacctccatgcatttagatccaacttctcctgcttcttctttcttctttctagcgacttcaatccatgtttcgtcagcagattagaagattctccaaggcctcgtttttagcgggtgctgcggttgcgtcggcctatgttacctacgaggtagcctttcccaagactcagttgctgaatgagaatgagaagtacgtgaacaagtttccaagtttcaagaccacggtagagaacatgccttcacgagaagagatgctcaagaaactgggtcccgaaataaagaaggaggacaaggacaaggttttttctgctgaggatgttccggaaaagtcttttgatttggtcatcatcggtggtggtgcttctggtgctggttctgctgtggatgcctccttgagaggtttgaacgtcttggtagttgagaaagaggattttgccgctggtacgtcttccaaatctactaagatggcccatggtggtgttagatatttggaaaaggccattttccagttatccaaagcccaattggacttggttattgaggctcttgccgagagagcctccatgctggaaaatgccccccacttagctaccattctgccaattgccatccctatttacaaatggtggcaattaccttacatgtattctggttgtcttatgtacgatttgtttgcaggccgtcaagctctgagatactcttacatccagagccgagcagctacacttgctactcagccacagctagattctgaaggattgaaggcttcccttgtgtaccatgatggttctttcaacgatgcccgtttcaacactgctcttgctttaactgccatcaaacaaggtgccaccgtactaaattataccgaggttgaacaattactgaaaaattctgagaacaaggtcaaaggtgttcgtgttagagacagggaaactggaaaggaataccttgtcaaagccgaagctgtcttgaactgtaccggaccttactctgaccgtctgttggatatggaccacgaccccaaaggtgtcagtcctgctaaggctttggacacaccaagaatggtggtaccatctggaggtgttcatatcgttttaccagagtattactgctccaaagacgttggtttgctggatgcttccacttctgatgggcgtgtcatgtttttcttgccatggcaaggccgtgtcttagctggaactactgatgtcgctttgaaatctgtccctgaacaccctgttgcttctgaggacgaaatcgaggaaatcctgaaagagttgcaacattatgttacctttgaagttaagagagatgacgtgttatccgcttggtgcggtgtccgacctttggttaaggatcctagaaaggccccaaagaacggtgctacccaagagctggttagaaaccatttggttcacacctctgatactggtcttgtcacattgagtggaggtaaatggactacttatcgtgaaatgtctcaggacgccgtcgatgaagttctcaaggttcatccagaattgaaagatccaactaagaatgttaaccatgtggagatcaaaccatgtcaaactcaacatcacaaattggtcggagctgaagacttcgatacctctctggcagctcgtttagctcaagcctacaaagtaccaagtgatctggccgctcatttagcttccaactacggtgaccgtgctccagtgattttggaaatttataaaaaggacagagctaacagattgccggtcgcattggcagctgctgacgagttggcacaattaccaacctatgaggagttcgagttcccattcaccgttgcagaattgaaatattctgtccataacgagtacgctagacatccacttgacttccttgcccgtagatcaagattggctttcttggatgctcgtgccgctcagaaggctgttaagggagttgtcaaagtcatgggagatgaacttaactgggacgatgaaaagcgttctcagctagagaaggaaaccactcagtacatcgaacatatgggtcttaccgctaacaagacaagtttcttggaaaacgaggtgtagaaaaatatatatagcgtatcggttaatgaaatactttgaagtaattagtattagtattaatatgtttctatatgactgagtaaagcgttttgagacgttgcacttcatggtctggtaacacttgatcaaaaccaactccacgacggttgtttgtcatggtcttttcaaattcggatcgaggacgaccttgcatctgttttccaacagtagcaagtgagtgtatcaaatcttcttcaccaactagttcgtggaaatgtttggctccaccgtacgtgagcatggctagatcacgtaaaatattggcagtgagtccccagacattgcgggtcttctcgccaaattccatatcctgttccgtctcatcctcttctgatgacagatcctgaatggactctagccagggaacttcatgggggttgtggatagggaagataaaggaccgtagattccaggggattcctccccacttggttttgatatagctttgtttcaggcactccttgagttcgtagcggcgtggtttgggctgtagaaaatcttttaggggaaccgaaaatatggctgaactctcacctggattcaacaggattgaagagatagctttgttggatgcatgatgaaagtcgataaatccgacacagggcctgactcccaagaaggttctcgataagtatgctggaagtgtgttgatcttgtgaatagtaaatcccgagtgagacttgagatagtcatcatcggctgatatacctatctcttcttctgtctctctgcgggcaacatcccattcagtttcatctaacgtatcggccttacctccaggaagggatatgtgaccagagaaagctcgtagtttcttagaccgacgggttaggataacacgtaactctcccattttgcctaagaacaatagcaccatcactgaagcccgacgagccaaaggaagctgaggccatattgaggtctggatctgtgagccatggtacactggagaatacttggcgatgtttgtgaggtactttgactccatttggttacggtgaatggcgtcggtgagttgcgacggtgaataatctgcggttggtgaggaagtaccagttacttgacaactcggttcgtgcagctgctttacaggtggtggtggtggagcgtggtacttgatcctggaccatatatgggtgttgataagctgttgtaggtaatcaatagatgaaatctgttgagtgttataatagacacgattgatagtgcgacgcgacggctgtatgttctggaagtgcaacatgggggtgtgctgccgggcttgaatttatatgaaatgcatagaacgaatgaatatgtcaagaaaagaagaagaagaagaagagaaaaaaagagtaagagattccttaagtcttatatataaccaaaggaggggactaagttttgttggttgttgtactagttctcccctttttgtgaggtttgaagaggagttttggtgggtttgtgtttacattttggatgccgttcccctcaatgctatttttgcagcgaataggatcgaggcggagagagcggagagtgagctaggtggagagtctagaaggagaaattcttagtctaggcgagcgaggcggtgtgagtgtatacgataagcgagccactaaatagccgaaatccgacatcaataatatttcgcatttgaatagtatggattcggtaacatctgacatccgatatcttgacatgtacatgtgtgtcgcataagccttagtcgatacgagcctcggcaagagtatgtaatggtttgatgttgttgttgaacttaccagctcctttcttcttgatcagcttcttcaacttgcgtttgactaccatgacaggtacggtactcttacgtactaaatagttggacagggaccccaaaaggacccctttcaaagcactggttcccttggagcctactatcactagagatggtgacagatgacggataacctcgacaatgaaatgtctgggaataggatgatgtattgactcaaaaacaacatgaacttgaagtttggtaagtttaagtaattccaaagtttccctggtcattcgttcaatattgtcaatcctcatctgttcattgagctctgctcttttggatgctgaagttgtaggggttgtatcttcagggggcttggagcccgaaggcgccaatggttcaagcatactaccactgtgatagttctgagatggaattccgttcagatgcattgaagaatactcgtcatcctccaagacattaagcatgtacaagacagatccgtcgaccagaatagttcccacacaccattccagcgcatatctactctcttcagagaaatccgtacataatagaaatgtcttaggatgttgttcctccttgactaactcgaagaacctgccccgtgttagtgaacgaatggctcgagcattcgaagcatcactgtcaatatcatcaatttcgacagtttcatttagtgtccgggctagctctccatctgccctctcttcaatatccgcagtgtatggtacatgaaattcttcatcagttcctgacagaccgggtccgcctggagatactaatttcttcttgtagaccgcgtactcttttaatttctctttgcgctctttatcatcctgataatacttatcatgcgataaccgcgccccatacttctcagctttagcttcgatcttgtcgatcagctcttgaggtacctctgatccaatcaaacgagcattagcaacgcctcgttcagcagcacttaattggtctagttcctctgctctcttagcattgttgacacatttggaagcatttgtctcttttgtcactcttcgatcggcaggaatactcgatggctccgtgtaagaggcaaaattgggcaagatcacaccttcatcctcatcaatttctgaatctgtatcactgatctgttcttcctcgctggagctctcatcattctcaatggattcatctttgtcgtcatccttgctcacaagcctttcacttggatcatgaacagtaatcgaccatttgttttcttttggattggggttccttgaatgagatctactactccgacctcttgagactcctctgctatgaggaccaccagaatttggagacacagaccttcccctggcaccagactccctccgcttttgcctttctagaatatctataatttgttttctctcatcatctaacgcagcctccagagacattttgcaggactgcttatcaagtagtataaaagaagggtgctttctttgtcgtggaacctagtcaagttgcaagggaaggagcaaagtgcagcatccagtttccatccacgtgtgggtgctacactacttcttgtcgtgaatattttttccgagtcgttatataagtaaggtcctatatatatataagtatgtttttgagttattatcttcttttataattaatagtgccttacttcgaatctcatccttccataaatatgggtcgtgcactacacacccccttggaccgccccccagggtttctaaccgctcgaaattgtgaactgtggttggccaatccaagcgcgccctcgacactcctcaacgctgttttttatattaactaaccccttcctttccttttctctcctacacccagtgttaaatctttatctttaataatattcaaagatgctttcagcacgccccgtcattagaagagctgctcgttctgctgtcgccatcaatgtcgcccgctctgttcctcgcgtggtatgtatttcctgatgatttgaatcactttttgatttggctgtcaactggctcccccatgaaaagtttgtctttactcaacgttgaagcattattgatgattattttggattgtagaggatcaattccatagaatgctttaaatatttcacacattaatgtgttttcgaacaggacaatcgcttcaaatggtgtggtgaaatctatcaaaagtgtactttttctttccattgacaactactaacatatcattaggtccgcccattagtttctagaggttacgctgccgccaaggctgctccaaccgaagtttcttccattttggaagagaagatcagaggtgtttctgccgaggctgacttgaacgagactggtagagtcttgtctgttgggtaagtttttctgaatttttttttgaatatgtcatgggctgatcttagggaggcatgatacaacagtgctttactccacaattgtgacgtattgattgatgtgttgtcctcagatatcttcttgtccagatccatttttttttcaagttttctcgacattttattggacagtcggagatgctcgacttgactccctaagaactacgcccttacaaacaaccttaaactgaagctcagtaaactaacattatagtgatggtattgcccgtgtcttcggattgaacaactgtcaggctgaagagttggttgaattctcctcaggagtcaagggtatggccctgaacttggagccaggtcaagtcggtattgtcttgttcggttccgacagaggtgtcaaggagggtgataccgtcaagcgtaccggtaagattgttgatgtcccagttggtcctgaactgttgggccgtgtcattgatgctttgggtaaccctatcgatggtaagggaccaattaactctaaggttacttccagagctcaattaaaggctccaggtatcttgccaagaacatccgttttcgagccaatgcagactggtctgaagtctgtcgatgccctggtgccagttggtagaggtcagagagagcttatcattggtgaccgtcaaaccggtaagactgctgtcgctcttgacaccattttgaaccaaaagagatggaacaatggttccgacgagtccaagaaattgtactgtgtctacgtcgctgtcggtcaaaaacgttccactgtcgcccagctggttcaaactttggagcaaaatgatgctcttaagtactctatcattgttgctgccaccgcttccgaggccgctccactgcaatacttggctcccttcaccgcctgtgctgtcggtgaatggttccgtgacaacggaaagcatgctttgatcatctacgatgatttgtccaagcaagctgttgcttaccgtcaattgtctctgttgctgagacgtcctcctggacgtgaggcttacccaggtgatgttttctacctgcactcccgtctgttggagagagccgctaagatgtccgacaaattgggtggtggttctttgaccgctttgccagtcattgagacccaaggtggtgatgtctctgcttatattccaaccaacgtcatttctattactgatggtcaaattttcttggaggctgagctgttctacaagggtatcagacctgccattaacgtcggtctgtccgtttctcgtgtcggttccgccgcccaagttaaggctatgaagcaagttgctggttccttgaagctgttcttggctcaatacagagaagttgctgccttcgcccaattcggttccgacttggatgcttctaccaagcaaactttgaacagaggtgagagattgactcaactgttaaagcagaagcaatatgctcctttggctgctgaggaacaggttccagttatttacgccggtgtcaacggtttcttagactccgtcccattggagagaatcggacaattcgaggaggaattcctggcttacttgaagtccaacgagaccgaggtcttggaggctatcagagtaaagggtcaattgtccgatgaattgttggccaagttgaaatctgctaccgagtccttcgttgctactttctaaacttagcagttaacgattacgatttaagcatttttgataaaagactcaaaattcgacatacaattatgatgttataaattgatatttagatttatgttttgcaatgtagagccttgtaaatttgatctttgatatctggagaactatgatagtagactgaggctggcgatatgctctttttagacacttcgtggtgttccttgctgtttcttgactgactttccctctaacatcaaatttgtcgctaagattgtttccaagtttccttccaagtttcctcctacttattgaaccatgacatcgtctgattcaaccaaccaggaggaaactccgcaaccagagaaacattcaaagcaaattactaacgatgatctctaccgaaggtcgacccagttcagattttggtcatttaccgagcaacgattgaaggatttgaagcggtcaactaatgaaaagggagctgccaacttgaaagaaagaatatcacaattggatccttctataccagaagtctctgagatttgggaaaaggacctcgtgaaaccgctcactgtggaagaggaggttaaaattgtcgaatattatgcgaggaaagcccaaggccttgccaattatttcaaattaccaacacaatcaagggctactgccatatcattttttagaaagttctttctggtcaacagctgtatacaatttcacccacaatatatcatgtacacatgcctgtttctagcagctaaatcagacaaccactttattggaataaaggaatttagcaaggccattccaaaaacaaccccagagtcaattttacagtacgaatttcagatactgcaaagcttgaagtttgctcttttatgccatcacccttacaaaccattgtatggattctttttggattttcaagtggaaatgaagaataatatccagtcagataaactcgctgagttgtatgaccacgcaagagataaggtatctgaagcattattttctgatgtttcatttttgtttactccttcacaaatagcgttggctgcctattatgagctgaatcctgaacttgttacgagttacctttccaaaaagttttcccaattaagcaccatcaacgaagatgagcagttgaagccttctcccaacatccaaaccaaacttgtagataacctgaaacattgcatagaactatctcacgcatctttcgatccagaaatagaagaagttacccagatttcaagaaaagttcactattgcatagatcctatgaagctggtcaagaagatgcagaagcagaaagcggtgtcatagctttaatttatttttaacctactctatattcatatggagggtgttactatcagtttgttttcgactgagcccaaattatagatctcctttttgtcatggttgattgcaattagttcttggaacactggagattttcctccctcagccacatccataataacattgcctattttcactgtggttcttccagatttatgcactctgaggctccctattattccgttgagattgtgcatctctgaacctacgccttcaaaagtgggtagggtgttcggtaattgaaaaaatagaggtttgggcaaagattgtggttccatactaacatcaccgtcatcatcttttgagacattcatttgttccatcagctgtttaatgtgttcatagtccttcgttaatttggatttttcctctttctcttgcagggggtctagagaggatataggttcaggtgtagctgattgttctttaatttctaacggagtggctgtaaaagcaccagtttcgtcgtctgacattggttcaggttttaatgagacttccctagatgtggttgtattccctgggagtaagtttgggtctgtttcaatcttcacatcggcctctccattttcttgatgttccactcttggagctctcacagggaatagttcagtgtcctgatttagctcaaattttgtattaacgtctatcacagtcgtgtcatctacctcaaactcatcgtccgatccagattttccatgtagttttttaagagcctctgaagttgatgctgtagatgaaggtagtggagtacttctggtccgtgagtcacctcccacatgtccttgtacaccatgcgataatggcccggctacaaccatatgcgtacctgctggagcaccgcggcctctacctcttcctcttgtgacagttcccctagtttttcttctcattgggtcctgagattcgactaccactggagctgacttatctctttcctctttggttcttctagccaccagttttggcttgaatttgagccccgtttttttggaagcattggactcgttacccacaggagtggtccgccgtgatatcgagtccaatctgttaagattcgagtcgtctgacatgccaattggaagagatcagtcttagcttgtttatgaaacttgagcccttccaaatttttcattattcgcgccttatatagatttgcttgaaaaaaatattgagaaaaaaaactttgaggaggaagcaatgggaaagagaggaactagacgtaatagggcctctaatatagacttttcagaggagcaggctgtcaccaatgagttggatgattttgccgaagctcgtgaaaagattttgctagaggaatcaggaatgggtgctagattcgatgccaatgatatcagtgatgaggatgaggaagtggctgttctaggactagacgaagatgaaagttctgatgaagaggaagctttggctagaaaattccgtggcgcaagtgccatggatgatgacgaagatgctgagctttacaacgacttggagaaaaccgaaaagaatgaagaaccggaatggggtgaatccagagacgattattatggtggtgctgaattagaagatgaggaggccatcaaactgatggagcaggaggccatcaaacagcaaaaaaaacatttagaggatcttaatatggaagatttcttggatgatgatatggatcaagaatggaagcagtctgcagagaaggaaacattatctaccgaaactgcgatggaacctatcaaagccgatgaactttcctccgatgagcaagtcaaatttttgaagaaagcttatcctgagtttttacccctactaaaagaatatcaaaaaatgaagccactactcctagaattcaaggatcaagactctcaaatatccaaggtcaaattcacagcattatctgcgtatttgggaactattgcagtttatgtcgcattatttgtatctgctctggaaagtaaggagcagtttacaatgaaagatcacccggtaatggagggtattttaaatacaagagaggtatggaggcaggcaaatgagctgtctggcaaactttccaacagcaaattcagtgatgcgtctaagagtataccgatcgaaggtgaatctgaatccgaatctgaataccaatctcttatcgaccacggagattctgaagatagtgggctggaggttgatttggaacaaaatagtgagaaacaacaaataccatcaagcaataagacattacaagatgactctgattcagattcagatgctccgcgtgagtataatattaaatccttggatcataaaagaaaaaatgtgggtgatgatctgactcagcaggagaaacgtgcccgtaaacgatccctgcgattctacacatccgttatcgaccaagccgatggaaaaaagacagttaagtatgctggtgacgacgatattccttacaaagagagactgtttgagaggcagcagagattaatagaagaagcaagaaagcgtggagataatactaacacttctgcccctggagaagctttagatgaaggagactttgaagctgctgacgaggaagttgctaaggatgttaataacttggacgattcctactaccaaaatgtgctcaataccaagaaggaacaaaaggctgcaagaaaagctctgtacgaagaagctgtacaagctgcaaaggaaggcaaattggatcaatttgaggagaagattggaactgatggtaagcgtgcggtcaactaccaaattcttaaaaacaaaggtcttactgctcatagaaagaaggagaatagaaatgccagagttaaaaagagaaacaagtatgaaaaagcacagaaaaaacttaagagtattagagctgtatatactggagagcagggtccatatgaaggtgaaaaaactggtatcaaaaagaatcttacaaagagtgtcaaacttgtttaattatggttcttcttttttcatcagctcgttccatttctgagcaagttctgccatggcggcagaatctaaggatgcatcaacaatatctttggggacctgattttcagaatgctctttggctgcaaacctacttggattatgttccgtgaccaatctgaagtcaacatgtgttgctatggtcagttcgtgccatgtaaaaagtaaggaatcacagcttctattgaaagggttgaaatcaactatgtacattttagtgaagggtctgggaaagtaaacgtcaatcacataatttttcagaggaaacttgggacttaccgtctcttctaaaaacttctttatcccgctttctatcacatctttgaggctatcaagataattgtagtagttaaggtctctttgagatattcctatcagtttgccgtctctgacgaaacatctaaactctagagctggatttatttcgacccattttctaagaaccagttcgtactttaatgaagtttccaattttaaatcgtgagccacgtagttagaggagttcaataagagatagacatcgtttaccgaagaacatttcattgtgttgttcatcatgatccaagttgcatcccttggagctgaccagttcagtttcggagcgacatgagaatattgagttatcacatctttcactttactgtggaactcagaaaaattttctgaagggtctaaaaatgtttcctctgcatctgaccaatcgctgtaatcattatcatcgttaatttctacgttattgttgtcatcacctggaagatgaatgctatccttactaatgtactcaatgaaggagtctggcacttctattattttcgctggagacacaacattctcactaaaagtccggtaccatgaggaataggagcaagcactgagatcttcatcagtagtgctcaactcgttgaaaatgtgaacctttccaggcatagttgtgtgaagttgtgtgagtatattctaatatctatctgtaataattatttgcgcgaaccatggtaacgtaatcatgattcttgggctgataagcgtcaccgaactatgacacgtaagaacaggcgatggcaccaaggaatttgtcctaaacttccactatcgaaatttctgtagtcccattttcctgtgctatttttttttatgttggttcacctctttctttctccatttctgctttcaacagatccaccccaaatcactacaccactgcaacttcaagcaagtcgcgacagacactacaatccttgaaaagttctctagttccttactactcaaacattcgccacatgacctctacccaccaatcgaattccatcttcaaagataaggaaaagcctcaagaggtccgtaaagccaacatacttgcggcaagagccgtggcagacgcgattagaacgtcgttgggcccaaagggaatggataagatgatcaagactggtgacggcaaaatcatcatctctaatgacggacatacaatcctcaaacatatggctgtgctacatcctgctgcaaagatgttggtggacttgtctgctgctcaggataccgaggctggagatggtactacttcggtggtcgtgatcactggtgccattttgggcgctgctgagaaactgttgaacaaaggtattcatccaatgattattgctgagtcttttcaaagagcggctgcccgttctgtggaaattttactaggcatgtcgcacaagatctctttggatgatagagaacaactcatcagggccgctactacctctttgagttccaagattgtatcacaacattctcacattttagcacctttagctgtagactcggtgctgaaagtgtccaatgagtatgctaacaacgtagatttgaatgatatcaagttgtttaagaaagtgggaggaactattgatgataccgaagtggttaacggacttgtcataactcagaacgttgtcaaatcagcaaacggtccaacaagaatggagaaggctaagattggattaattcagttccaattatctccaccaaaaccagacatggaaaacaacgtggtggttaacgattacagacaaatggacaagattttgaaagaggaaagagcttacctgttgaacatctgtaagaagatcaagaaggcaaagtgtaatgtgctattcgtacaaaagtctattctacgggatgctgtgaatgacttggccctccatttccttgccaagcttaacattttgttggtaaaagacattgagagagatgagatggagttcatttcgaagagtacaggagctaaaccaattgccgatatcgactcctttaatgagacaaaacttggatctgcagatttagttgaagaaattgaatcctcggggtcgagaatcatcaaggtctccggaatatcttctgccacaaagcctaccgtctctattgtctgtagaggtgccaacgagatggtgctcgacgagactgaaagatcgttacatgatgctctctgtgtcattagatgtttggttaaagagaaggcattgattgctggtggaggagctccagagattgaagtatccagaaccttattaaaggaatcaaacaagctatcaggtatggaacagttctgtttcaaggagttcgccttagctttggaagtgattccaactactcttgctgaaaatgcaggattgaatcctatagagattgtcactgaattgataagcaaacacgatgcaggagaaaagaatgcagggattagcgtgagacgttcaggaacaaccaacacatttgatgagcacgttttgcaacctgtgttggtgagcacgagtgccatcactttagccagtgagaccgtcaaatctatcctaagaattgatgatattgccttcagtcgttagaaatatggccaatggaatttcttagttatttggcattttctttatttaatattctgactgcatccttgctgaaaacataggacagcccacttagtatagtggagattgccacggtgatctccaatgcaaatagaccctgtaataccatggctgaagagtctgatgttaaatatggaatcaacactggctttatcatcgagctcccgatataaaccatttgcagccctgtattgatcttgcttatcgtagttggcctcacctcggcactcggaatgctaaaatcccaaaatctcttgaaggtttttggtcttggtaaggagacgtatctgtagtagatggccgataatcccaagagtacgtctcttcctaatatgatcacagccacgtacattggtatttggtgcgattgagccatgcaagcagtacatatgatcatcaatgatttatcagccattggatctatcaccgtaccgacaacggatttcatattatactttctagcaatgtatccatcaataaaatctgtgatacatgaatacgtgaataaagaaagagctgacgttacgtggttgtgaactatcaaatatccaatgataggagcagaaagtagtcttgtgaaggttaaaatattagggatggtatatatattctcgtgatactcggaaggaatcatgctggaaaaactttctttcaactctttagatttggccagtgtattttctttgattttcttagtcgtttcgaccgtttcaatactcattttcttacctatttccttagtcttggttatcatggtttgcttgcgctgaggcgacttgttcgttaaatgacgaacagagagaagattgacgacagcaagtggaggaagagccctgagcgtaggcattgtgagatggtgaaatgggccaccactcacaaacgcaactctcctcaccgctccaccaaaatacatgaacaattgtatggggaagaaaatgagatttgccagaaacgaaattggagaacgagcgagaacgcctgaaaaaaatgtcaatgaattctcgaacgcctcaatatacccgtttggggtcgcccttcctggagagtcatgattcaacctctgaaaggattcgatgcaactccgaaacctggtagacaaaatgaacgtgctagtctataccggcaatggaaccaccacagattccattaaacacactctgtattctttgagaacacttctttctccttattatgcggtgattggtgtggacagcaaagtgctgttgaacgaaccatggcaatccaaaacagccttactggtttttcctgggggagcagatctacctttttgtagacagttcaatggtgaaggaaaccaaaaattttccaagtttgttcgccagggaggcaaatacttgggcttatgtgctggtggctactacgcatcggcaagatgtgaattcgaagttggcaataaagaactcgaggttagtggtcccagagaactgaaatttttccccggaattgccagagggactgcttttggaggatttcagtacaagtccgaagctggtgccaggtctaccattttagatgtggacgaagagaagctacctggatgtggtaggactgtttataattattacaatggaggtggtgtctttgtagatgcagaccagtttagtaatgtggaggtcttagcaacatacagagatcatgtttgcgttgattttggatcaggaaaggctgctgctgctgttgttgggtgctctgttggaaaaggttacgctatcttaacaggaactcatcctgagtacactcatttgctgatgaaaaaatcggactctgtcccagattttgagagggtcattagtgagctgcgcactaaggagaatgaaaggcttgccttcctacgttctttgcttcataagttcgggttaaaagtaaacgatgactctttggctcaaccaactttgactcctttgcatttaacatcactttaccctgaaaagttgcagcaattagtgaaatcgatggaaactaatataggctacactaatggcctgctgaaatgcaccactgatcgatttagattgtctctttcggcagagaatctccagaaacttgaccaagattttcaagttcccgaggaagcaattaaacaattagttgtccacataaactctctacctgatcgcaaggataccccattttttaacttggaatcatactacaatcatctgaaacgcttttggacaagatacaatcacccaatgggagattttggttccacgttaatatacggcgaagtactcacatcaacttcatctctgatggataagaatgccaacctattacgtcttctgcctcatggtttcacaatcaccggaaccactcaggtttcgggtaaaggcagaggaggaaacgtttggatcaatccacctggggtcttggcagtatctacggttatgaaacttccaacgtcctattctgaacgtgcgccaatagtttttattcagtatctggcaacactagcttatatcgaggccattctcagatatgatgagtcaggtctctactcaaccatcccactaagaatcaaatggcctaatgatatttacatactgaagccagagtttgtggaggatgtttctaagattccacatggtgaagctgcgtatgtaaaagtgggaggaattttactgaacactaatatttttgatgaacaataccatatggttgctggatgcggtttgaacgtcaataacgctgctccaactacttcagtcaactctgttatttctgcaatcaatgaagtcagagccaaaaagggtttgaccggtatcccaccggtagaaatggaggttgtgttagctggcttcctataccatctcgaacgaatgtttaacgagttcaaaacttctggatttagtcctttcctagatttgtattacagacgctggttgcacacaggacaaattgtacatatccaacaccagaacaatattagagccaagataaccgggataactgaagactgggggatgctgatcgcccaagaggttgattcagagaataatttgacaggggcaaggtttgaactccagcctgatgggaattcttttgacatgttcaatggtttaatttccaagaaaaattagttattataataaatcgtttattttttttggagtaaggtctacataataattttttatacagataacaacttagaacctcagctagaatgcacttgaaaacttcaattctattcaccctcttttgattcaccgttaggagaatgacgggaaggagagtactgtggggatgctggggagtattgaggagatgtgggggaatactgcggtgaagtcggtgagtactgtggcgaagttggcgagtactgtggcgaagttggcgagtattgtggtgaagtaggagagtactgcggagaagtgggcgaatactgcggcgaagtgggcgaatactgcggtgaggtaggcgagtactgcggtgaggtaggcgagtactgcggcgacgttggtgagtactgtggtgaagtaggcgaatactgcggcgaagtaggcgagtactgtggtgaagtaggtgagtactgcggcgaagtaggcgagtagcttggagaagttggtgaataacttggtgaagttggcgagtaacttggagaagtaggcgaataacttggtgaagttggcgaataacttggagaagtaggcgaataacttggcgaagtaggtgaataacttggagatgtaggtgaataactaggcgaagtaggagaataactgggtgaagttggtgagtagcctggtgaggtaggggaatatcttggtgaagtaggagcaaaaccaggtgacgtaggagcaaaaccaggtgatgtagctgaaagtcctggagaagtaggctggtatggactctgtatacctgcatactcagtcaagccaccacttctatcatctccagatccagtttcagccattggagaaaacataacatctgccacatcatcatgattgaactcatcatcatactgtgcattgttgtcataaggagttgcagaaccttgtgttgccttacctttgaacaacggcatggtgggggcatagtctgctggaagactggtcaacaacttctcatcaatcatgacatcgaacgcacctgttcccattggagccagttgacccagcatgacattttcagacacaccacgacaatcatctaactctgcagccgcaccagcctcaaacaaaatttctacagtctcttcgaacgaacacctcatcaaggcaccagtgtctgcacggttaataccgtgacgagtgatagccatcaagtatccacgtgatgtcataacatcgactaatagggccatatgtctatagttgacataagaaccatcaaaggcaataacgttaagaatctccttgtataaagaagaacgagtagcctcaattcccaatactgaaagaatttcaacaaaggaattcgagtaagtacgggaagagtcgacaccaggtacagccatcacttcagcgaggttaataccatcagtctctaaagcccaaagttcttcatttttgtattccccagactcatctggaacagaaaccttatgttttaccatgtatacctttgagattcctggaataccacgcaaagcaattaagtcaagcatgtgagcttcaattcttttcaacatttggtcttcctcagcttccaattcttcatccatagccttggggtcacgaatcacacgacaacggatgatcaacttgtcagcattatcttcagaccacatgacaaataaatcatcactaaaaacttctgaaattttgtcagctacttgattcatcgtcaattgcttgtctaacattcttgcacggtctagttccagacgtaacaaccatggggattgcttgtcaatcgtttcttccaccttttcatcggggatcgagaagtaagcctcgacagtatcaaaatcttcttcaatcacagtgctcgtcgggtctggatcatagtagatctcagtggcagaagtcacattcttcaaagtggtatattcgattgaagattgaataactttagctttctcgatgtcaagtgctatttctctatcaagatacactgtcagtgcaggggtcttgatattctttgcaacattcaaaatttccttcagacgaggaacaccaagtgtaacgtttttagacgacacacctgcataatggaatgtattcaacgtcatctgagttgcaggttcaccgatcgactgagcggcaatcacaccaaccatctcaccgggatgaaccaaagatctctggaactgagcttcaatagtacccagcacccattcaaaagcatctctattcagtctgaactcctccaaaatacgacgagtagccaacctagcacggaccaaacattgaaataatgatgtagcattttgctgtgcttccttgataagttcattctcaccacggagcacaaatagtttcttacaaagatctctaacaccgtgaatgatttcaggaatcgtcaagtcactggccttcgcacggtctaaatggaagatctgttgagcgttttgaatgatacgacggaggttcacaggaagaggccagttgtgatctccattaacaaatactatctctctcaagaatttacggtcactgaccaattgttcatattcagagttcaattctttctgtagctcaacatcaccaagtatgtccgcagcatattcaataacgtcgggcttaatcgagttcttttcatccatcaagtcaacatagtaacgtttgtggaaagccttgtcacttccaggaatggtatcaatagtttgtctttcaacttgggtaccatcaagaccatcttcaccataaagaaactgaataatgtcacctagtgagtttctcgtagtaccatcatagtgaaccattatatcctctagtgccttcactaaacgacgctgaatataacctgtttcagcagttttcacagctgtatcaatcaaaccttcacgaccagccatggcgtgaaagaagaactcttgcggagttaatcctctcaagtaggagttttccacaaaacccttagattctggtgagaaatcatctttagtaaaatgcggtaacgaacgatcagcaaaaccgaaagcaatacgtttaccttcgaccatctgctgaccaacacaagcggacatctgcgcaatattaatgaaagatcctttggaacctgcagacaccatttgcttcacattgttcaaatctttcagattcatctcagcagaacgacctgcagagtcacgagcatcattcagcgtacgagaaacctctccttcaaaagactcacgtaaagtcatacctggtttcaactccagttcattatgttgagccttgtaaataatttcctggacttgttctttggcgctagaaatggcatgtgtaatctccttcatagtgctggcgtcggcaatcgcatcaccaattccaatagaaaaaccgttatgcaataaccagtagttcacaactttttgaatgttaccaaagagctctgcacatatcttaggacccttttcccgcataacagtgtgaatcaaaccaccaccaccagatcccacggttttcttgtccacaactccaaacataaccttaccatcaacaataagcataccattgtcttttggagacaataaagagtttccaccatcagttctttgaagatggataccgcttggtatagcgatggaaagtagttgtttaccagtccaaagaggtttaggcttcaggatagcgggctgtggaacaacaccatcccaactgggaacccagaataacatgttcattacttgctcgtattcaataaaggtgtctctcaacgtcatttttctgacaccacacagtgtgtcttggacgatacccataacgggcttgtttgactgtggagagacgatttgcaagggaactgcacaaagctgtgacagttctgctctggtctcctcagattgtggaacgtgtaaattcatttcatcaccgtcgaaatcagcattgtacggtgatgtaacagataaatttagtctaaaagtagagtagggcattactttgactctatgtgccatcatggacattttatgtaatgacggttgacggttaaaaaggacaggatcatcatccatcaggtgtctctcaactttccatccatactgtagaactatatcacctgcacgcttatggtacctgagatcaatacgatcaccgttatcacggataacatatttggcacctggatgttcgttcggcccattacgaacgtattcagtcaacctatgaatattgtattgtgtgactgtctctgggtaggaaagagttttggcaatactaatgggtacaccaacttggtccaactccaaattagggtcaccggaaataacagtacgtgctgaaaagtcaacacgctttcccataagattacctctcaaacgtccttctttacccttcaatctcgcacggatggcctttacaggtctcccggatttttgcaatgcttgtggctgtcctgcaatatcattgtccatataggtagctacatggaattgaagtaattgttctacctcatttatgatatgttgaggggaaccatccatttcgagtttttgtacattgatatttgccttcaaaatatcacttagtttgtgtgttaaatcgtcctgtccttgagtggtttcgtccatggcgatggaaggtcttacttggggcggagggacaggaagcacagtgattatcatccattcaggtctcgcatagtcttcgttgaaacctagcctaaaacagtcttcaggcgatatatgcttgaaaacattcaagatctcaccgggagttagtagtttacgttctggttgcgcatcacgatcgctgaagccgctcttcttccatgtaccccaaagtttcataccgtctttacggacgactggctgggtatttccacatccacctctggagacgaccttctgttcagagtactcatcaacaggggcatcagcttcacataccatcttagttttacacagctgccacacagcgttaaatcgtttttttggatctctaatacggatagcctgagccatggtagggtttgtttcgtcaagaagaagctttccacagttcatacagatacattcgcagacttttttaatcttcggaatgaaaccaatatgaaagactggcttagctagctccatgtgtccaaaatgaccgggacattctgccattccctcaccacaagtttgacatttgaaattacggtctatggaacccaacttgggatcatttaatccaccttccctcggtctttggcgactctcatccatgatttcaggatattcaatcttaacaactgaaatagctctaatttcctcgggagacaacaagccaaactgcacttccttgacggacctcagtggggcacttgaataaggaaactgactcatatcttgctaatttctaagctttttttttctgtttttgtttgggaactattatagtttacgggggttaactagatgtgtcagttactcttgtatcacttgcaagtggaaattatgggtttagcaaaaattaacaaaatccctttcaaatcaaattcacgtctaatgagctgattaacaacaacaaccaaatgagtgccaattctattttcacacaataagacgttaagacaactggattaatataactgttaatacaatgtctaatcagattgattctcaggaagatggttgccagctggagaggcttgtgtgtagggtgttctcgttgtttttcatgctttttcgtcggaggcaaaagagaggggcgcgaaattacggagatggccagataattacgcaccagggttggggggaggtgctacgacgcttcgggacggtaggtggaaccacgatacgcggatgcgcgggtactatctaacctgtcttgatgtttacgtgccatcgctgggatgaattattagttgtctatgtgtttatatgactctactcaaagaacttagacaaagcagctttctctttggcaagacggtcttttctggccttcgtggttctttgtagagattggctaattgcaggatcacctggggataattcaagtgctttctggaaatctgagatggctgaatcttcgtctttcagtgagctgtaagcacttcctctacggtagtagcctttggacttggcctttgcatccgcagattcatcctcaatgaccaatgtggcatacttaatcgtgtctttgaacttggaaactttcagtccagccaatgccacgttggagaagacagatgtttttagcagctccaacttagagctctgttcctctgataaatctgatggtatgtattccagcaaataattagcagccttttgatacttttcgaaggcgattttggtgtcaccatttttgaaatactttgtacccaattctttgatttcagtgatggcctggtagacctgttcaaagtcatcgatgtctatgttctcattatctttcagaacttcctcatacttgtctccagtctcgtcggagatggtcaaatctgcgtcttctggaagttcaccacagtcctcaatgacaacgggttcaattggagcttcaccttcggagtttctttcaatctttctaactgtggctttaccagcaattacttttccaaacactacatgcttgttatccagatgaggagtaggaacggtggtgataaaaaactgggatccattagttcctggtccagcgtttgccatagagagaaggaacggtttgtcatgagtcaattggaaattttcatcttcaaatttttctccatatatggattcgcctccagtaccgttaccgttggtaaagtcaccaccttgtaccataaaatccttaatgatcctatggaaagtagaacccttgtagtgcaatggtttcccagacttacctatacctttctcaccagtagataaagctctaaaattctctgctgtcttaggaacaatgtcattgaagagctcaaagattattctgccagctggctggttgttgatggagatgtcaaagaaaatatgagaacggggagtcattactgaaaaaggattggatggggggcactatggacgggtgtctgatttatacggattcggtccccttgtttgaaaagtaaggcgcgattgtctagaaatttctgagacacagggcacattgtaaggcagtttcgaagggtgcgacctctgcgtggctatcctcctagatcaactgaatcgcgccaacatctgactctaagcaattgccagttttgactcttcgtctcatcttacttcttcatcttgaactaaccatataatacaatggcaaaaactttggaaagagaagaaccacattattttggggctgggccagcgctactgcctacttcagtattgcaagaggctgcctatgacttggtcaactaccagggtgttggtataggtattggtgaaatttctcatcgttctaagcaagctagtgaagtcattgataacacgaaggccaatctagttagtttgttgaacatccctgatacacatgaggtttttttcttacaagggggaggaacaacaggattttcttctattgcttccaacttgactgcctcctttgttaagaaaactggaaggaagggccgtgctgcttatgcaatcactggaacttggtctaagaaatctgttgaagaagcccagcgtttgggtttggacgttgacattgttttggatagtaaaaaagttgatggaaaatttggatccatacccccagttgacaaatggagcatccccactgatctatcaaacacttcttatgtgtattattgtgataatgaaactgtgaacggtgttgagttcaaggagttcccatttgaaagttttcctggtgttgaagtagttgcagatatgtcatccaacatcttatcaaagaggctggatgtcagtaaatatggattgataatggccggtgctcaaaaaaatattggattagctggaatcacgatctatattatcaaaaagtcgttgcttgagcaagctgatgatgccactttgaaagctcttgaagtgcctctttcaccaattgcggttcattatcctacagtagtcaagaacaactccgcttacaacacaattcccattttcgcagttcatgtcgtcaatttggtcctcaggctattagtaaagaacggtggtgtcgatgcccaacagaagataaacgaggagaaggcttccatattgtatggtgcgttggagaagttcccacaagtttatgagttgcctgcttccaccgatgctcgttctcatatgaatgtggttttcacattgaatggtgacttggatgctgaattcttagcccaagctgcagaaaggaagctaaatggattgaagggtcaccgctcggttggtggaatgagagcctccatttacaatgctgtttccttgcacagtgtccaagagttaacgaaattcatcatcgaatttgctgaagctcattcttgatcctgaatctttccgccaatataatacgtaacttcggcagtttcgtcttcgttcaagatgcaatgaagaaccaacgcatggttttcactaataatcattactactttgtagcacagttccgtcagtttagctccaagccgccaatcctttaattttatctgcacactatggggcatatcttgatcttgtgtactaaattgactctgttgctgtgtctctccttccaattgctgaacttgtaagaattctttccatgatagttgaacctttctggaatcctcttcaatggatagctcaagtcttccacggtttgttcctgtaacgcagatatacccagatcttttataccgttcaatacgtctgaacaacggtaaaatatctctgtcgagcttcatcaaaacctccgcatgggtcagttggggctctacgataccttgatcgatttcagccttcaaaactttaactggaatcttgaaactgtaacttctagacgaagccatagacacatgctccgtgtagatcagcgatagcacggccatagatctgttcttcttggaagattctggaccttcatttgcaactggtcttcgttgaagcctaatcgacagcccatctgaattgctcttgtcgaaatttcttaacgcgttgatcaaagggtcaatattagtctccacacatagcacattatctctaatcgactcaacttcgtacaatggaaagacttcctgcgatatcttgcaccaagcctggggctcatttaaggccatacttattatacatagatgcacaggagtaaacctcagcacacataattttcgtaatggctgtatagctgataatgttgataataacacatccgtgttggatacgcatagcttcaatttcattgtacgatgtggctcatcaggacaaacagaggctaaagaaccagactactactacagatcagacctctagctcgaatgatcatcgattacataatagtatttattgtacaggtgtgttgggttttataattacgaacggaccatcaaaatctggccaatccgtactcaaaagaaaaccacgttcttatagcccattatctgtattcgtaatccacgatggaatcttgaacagagatatccagctcaagacgcaagaatgaaatcttcacgccgagcgaggtacagggcaaggtatttaaaagttgtctcagtctacttggtcatgttcacaagttaacatcatcagacttgtagttgtccaagacaattctatagataaagtttggcgaaaatccccccacgttagtgatgtaaatatcaatgttttcagggtcgatgtaatccatcagcggattagtcacctcacatcgacctactagatcttgatcggaataatctatgacttttccagaattgcccacctctatcaaagaatcgttatcaaaggggtaagttggggataatttgtacaaacctgctactgtgaacacaggagtacggtgttctttggcgcattcagttactgcagctacacccgaggtgcttacacatcctccgttaacaaacacagagcgggctccaatgatgacttttccgacacgagacattactgcaaagacagttgaatctggaatcaatactgtgtctattttggcatctgccaatttcttaacaaatttgtgtgcatcttctgtatggttaggaaaacactctgttaccaagacagtgaattttctcttctggcgagccttcaacaaaaagttcaatacagtttgtgagttgggagtgggtgttagcaacacctcgttgtcatgaattaaatcaatagacatcaattctatattttcatgaacagcagaaatttcatccatgaggtcccggattccctgaattacgagtgatcttagatcttgagtgcgctgtttagcgtcacttgtgctatgttgttgctggttcttcgtatcagtcgtgctaagcagagagaacatggagctcatcatcgccgtattcttatctatatccggcttttccctgtccatttctaaggattcatcacgaataagcgacaaaactcggcgcactatgttaccagatgcaaactccctcggctgagcagcaataagctgccttcctgcgtctctaattaactcaatgagttggtctgtgttcttccaacgggccatagttattaggcgcatcagcaattgcgcagtctctatcgcaaccttataagaaccggctagctgcctccgtttgagcttatatacaagcccatccacttgctcttgtatctgttgctgtgtttgggacataaaggagatgggtttagtagatgaagtcagttttcttggtaacagaaaatccatgtgaggtttggtggtgttgggacaggcgggtaacttgaagatgagctgttggatgtcgtgtaacattattcttcaaagaaatcaccaaatacatcatgcttagcttgatagtttctagtcgtagttttgttcgcttcattggccattgtcctattgtcattaattttcattacagcttctcttacagaagcaacagaattctcaacttcttcgaagattgattctagggttggaacgttgaaatgttcgttatcatccagtaatcttcgaacatccatgtcaaccaatctttgcaatttgtcttttctggcttttaaaagtcgtttcttgtctcttagcgatggcagtggtaatactttctgagtcttcatttcatgctgtgtctcaaccttaagctcgtctttcctcttgcctttcaattttcttgctttcaatttcaagttcgaaccaaatcccccttttccaccgcataaaggaatcctcaattgcaaatccacaaagtcgccctttagctcacttacgttcctcaatttgagtaatgggcttccatccattttagtgataactcctcgtttctgtacagttagaggtaacatgttcataaggtttcgattcagatcttcaatggtggtatcatagtccgtcactattctcaagtcagccagacctggcattgtcttgacgaatataacaggcattcttaacggattatattggagagcgctctactccatacaaaagttaaactacatgcagaagataataacttacccggcagaaaaggcgcgaatttcgaagaaccaggcaaatatccagtaatcgcaaatttctttcacttcctcaccatacttggttcatcaaatcatgttgcttcgtcgtcagttcacccgtgcacttaacaatacttttccaagggtcattcgtccaactcagctggttagaactgctgctacttttgaccgttccaagccacatgtgaatatcggtactattggtcacgtcgatcacggtaaaactaccttgactgccgctattaccaaggttctttccagctctggtgctgctgacttcaaggattactcgtccattgacaaggcaccagaagaaagagctagaggtattactatttctaccgcccacgttgaatacgagaccgccaaccgccactactctcacgttgactgtccaggtcacgctgactacatcaagaacatgattaccggtgccgcacaaatggacggtgctattattgtcgttgccgccgctgatggtcaaatgcctcaaactagagagcacttgttgcttgccagacaagttggtgttcagaacttggttgtctttgtcaacaaagttgatactattgatgacgaagagactttggaattagttgaaatggaaatgagagatttgctgactacctacggttttgatggtgacaacactcctgtaatcatgggttctgccttgtgtgcgttggaaggaaagcgccctgaaattggtgaagatgctattagaaaattgttggatgccgtggatgaatacattcctactcctgagagagatcttgaaaagccattcctgatgcctgttgaggacattttctccatttctggtagaggtaccgttgttacaggccgtgtcgagagaggtaacttgaagaagggtgaggaagttgagattgtaggtttcaacgatcaaccaatcaaggctactgttaccggtattgaaatgttcaagaaagaattagatcaggctcaagctggtgacaacgctggtattttgttgagaggtatcaagagagatgaccttaagagaggtatgatcttgtctaaaccaggaactgttaatgctcacactaaatttttggcttctctgtacattttaaccaaggatgaaggtggacgtcactctcctttcggtgagaactacagaccacagatgtttgtcagaactgctgacgtcaccgttgttcttagatttcctgaagacgctgaccactccgctcaagttatgccaggtgacaacgttgaaatggaatgtgaaattgtccacgctactccattggaagtcggacagcgtttcaacattagagagggaggccacaccgttggaaccggtatgatcactagaatcatcgcctaagaacgttgttctgttttttttaaacgtatgtaaatagataggcccggtctgaagtaaataagattagtacattctcttcgtggtcatcaaaagccccaaggtcgaccaagctttctccagtgatcactaactgctatcaggcttccacctctttttcgtaggataccattcatggtggatattggtgcttggactctaacatcatgccctctttcttttagatggcgtattagtttattatctcgtggaaactccagaagaacttcttccggaagtagttgatgatgaaagcgtggatatgcaatgacgtctaaaagatccaggtgataatggtaaactcttataattgcttgtaaaactgtggtagtgatcttggaccctcctgctgccccgatgacaaaatgaggtactcccagagaatcaacaattacggtaggagcacatgaagagagaggtcttttgtaaggctctacccaattatagattgatggatgcaaaccaaatgcattagatgatgttggaactgaaaaatcgtccatttcatcatttagaataatccctgatataggatcgtgtattttagatccaaatccaaggttaacagtggttgtcatagccaccgcattaccgtattggtcaacgatactgaaatgagatgtaccatgaggatcattaggtagaaaggctggagcataatctttccaagaaggaagtgtgtgggaatcattaattttggcatgagtttctattgcccactcatctgatttgtatctgtcgtacctcttcctatgatcgtcaatttcagtttcgttggtggagtaaatgttcaaatctccaaggttgcttcttactgaagccatccacttcatcgtttcaacaagcctttgagactcaacagccccgaaatcattatgaaattccttgaaatcttcgaataagtccatgagcttcaacccagcaaggagcaccaaccctgaggatgccccattggacgtataaaccgtaaggccgtcagatgtaaagttatgcaatgtcaacgattcttcaattcgaactctatattttgcaaagtctgaggcttcaaggattcctccatactttctagtagcattcaccatgctttgtactatatcgctctctgggtcatagaatagatcaacgttgccactttcagctattctcctcaacgtagtagccaacatgggacgattaatccagtcacctctttttttaatttttccgtcttcattcaatgcaaaggcccaatcatatgaatgctcgtaaatatggtgctcaatagatttcaatgcactagaaaacagcggatcgacagtccatcccacctcagccaactcagcaacgggcaaaatcaaatctttccactcaacattaccagaaccatggtgctgaaacagttcatagagtccctttaactctcctggaatggcgacagccaaaccacctactctggccttctcctcatgatagttgaacatttctttgaaacttttagaaggagccatttctcgacaatcaaaactcagagcggtaggattatcaattaacttagagacaatgaatcctcctccccctataccggacgaatacgaattgattgttccgatacacagggccacggtgactgctgaatcggccgcattgccaccttgctgcagaatagatacacctaattttgaacattgttctatatcggacgccactgctgcattttgaacactaattgaatagttctttgatggggtaaatgttgggccatcaattggcaacgtaatgttgaactgtgggtcataaatgtctttcgagtgaacctgctgagcaaacagctctgcgtcatatttaagccacgtcagaaatgtcaatgctacggtaaacaccccaaaatacaggtagctgcctattgggcggctttttgcatggtgatacggtttcatggtgtccgagataggtgaacgaagcaggtacaatcagctactcataattcagaaactgcttatctgacgtaatattgagccaaaagatagggacgcgcgagaaatcccaaccaagaggtttctattcgcaagaacataacaccagtgtttactctaatgtcattttccgagcagatccttgaaagaccaattgaaactatttttaacctgataaggccaaaaacgttgctctgctagtatgaaggacgagctagagcttccggctctgccaccgttagaggatcgaaaacgaaagtccaaaatctccatggacccttttgtttttgctagcgagtttgatgaagattcctacgactcatacaagaaacaatacacggaacatgtcaaagaaacaatagggttgtccagggaccctttcgatgtggaactccaaaagcatgaactgaaagacttaatacacgccattactaatgaaatcaagctaaagggcactcgtgcgccatattttttccttccattcagacctcagttgaatgattatagactgaaggtttttctgaacagagtgtttatagaaggaaaacctgcttctttgaaggtgattgaaaaagtcgtaaaaaagacggatgaattcacgttgacttctgctcttaagtttttatggtctagactccccaatggttacattgtaggatggaaatcgtacgcccagtttgcaaaactagaacaggaacaaaactatcctcaacgcgcttttttggatataatacctcaatgtttactatcaccatcccatgcctcaattgtttatgatttctttgatcttattgtagctattgcagctgacactaagcaaaacaagatgagtgcccgaaagatatcgaaaatgtgtggaatatgggcattcggtcctattaaagtctcccccaagggtgacacaagctatcacagaggaatcgcaaattggttgccagcttcggatgccatatttcacttactcttgtccttcgtacgttcaatgctacccgagtctccaaatgatgaatacaagctacccagaacgctgcaaaatctggttctttccaactcctacccaccagcagaaacagtcctaacgtcccgcagtaatctagtcgatgttccccttattactttgaaggttaataacccttctcgctcacctatagagatgctccacagggttggaaaaacactcaaatttgatgatacaaatctgttttatacgagagaagaatacatactgctaaagtctttattcaaagattatcaatccttacctcaaaagctatctagtgaaggaaaaagggtgatggacaatttttgtatgtttgatgaagacctaatatctgacggagcaggatctaaccatattcgatttaaactttgctctggatggagttcagaaatgttgcaaccatacgaaaattgggacgagtccaagggtgattattttactgccaatatctccaaaactctgatagatgattactttgtttggacatggttagcctcggtttcttcagagcagactagaataaaaaggaatatctttggaaaaacttatatcctggaaacagaaattagcccagggtacaagaaatgggttattgttgaagagattgatattagcagaaatggatatgacttggatattgagttaaaggaagagaagttaaagaagttacaaatgaacattgagaaactggagaaacgaaaatcgaacttattggaaaaggaataccgaaatcaaaagaaaacaaagcccaaaaagttgaataagatagaacctcctccgaaagacacgccatacgtatacagaggctttcctaaggactttccccagaatttggctgaaaaagagcttccacctacacctcctatcataaaagagtcattaccgcaaagcatggataagtcaggcgattatatttcgttgaatttgcctaaggatgaagaacaaagagtgactctgacatcgcctcacaaagcacagcagaaagtagcacctgctgtccgccagatctctgaaggagtaagtgaagaatcgaattcattgacgattagcgatgaacctgactcaagctcttccgtaaaccaagattacttacttattgagaacgatagaattgatgatcccatggatgacttacgtgacatcattgagcgtatcgatattgaagaaattgagcatcagaactatagcgaactggtatccaaagtctctccaacagttataacgacgagaccttcaatgaaagaggagaagagaggtagaaaagaggaaattcgtagaaaagaaccaaaaataattaatggacctaaggaattgggaggagatgtctatcgtgttcctggtgatattccagaatcagatgatagtttttatttgcaaaggaaacctccgtcagattcacttccccgacatttaaagggagtttctcctcctcctctttcaactgaacatagtcctcgtaaagtcaattctaccagcagttctccatcactacctgtacatgtttctacaaatttcactccgaaggttgaatctaaaaatacattgaaatctaacatttttaacgagattgaaaatttggaagcagaacttcaagatgttttgaatgatgatgtcagctccaaagatgttcgactaggattaacagccggaacttcaagcgtttacagttcggttatgtctcatagaattgaacgaaacgaatttccagcaagatctgagaatagttcagaacccctagatcataatcgaatcgaccctgtaatcacaaaatcaccggtagataaccagggcactcctcagactactccacaagtaagggatggagctgaactatcagatacaacgcctcaaaactcaagaatacgccagccccctactgtacgccaacagacatcaagtccactttcccctcttgatagaagaaatcctttgcagaactcctctcaagattttatcagtcccaaaaataaaccagagacatatcatacaccatcacctcaagaacactacccacatcaagtatacccaaatgcttctcaaggaccagctcctaatggcaattcattacaaacgtatccacctcaaaattatccacctcgagattacccgccacgaggttactctcctcaagctaatcttcaggaatactcgcccaaaggctatccaacagaaggttatccatcacaaggttatccaccacaaggttatccaccacaaggttatccaccgcaaggctatcctccacaaggctatcccccacaaggttatccgccacaaggctatcctccacaaggctatcctccatcggggtttcctcctcaatcatatccatcaccatctcacggacagggtcgtcgaatttaccaccctgttcaagggacccaaggttactaccctccacctaatcaagcacagtatcaacaaactcaattcctacatccacccagcccttatcaaggtggtgccggccaccagtcatcgtattcgttgacgagagacccccgttccgcatccaattcacctcgctcgtctaattcgcctgccagatcacaggatgcagcaacccctgagacgttctctcaaaagatggtagcaaacagctttgttccggctgcaaaggtaaataaactacatggacactctaacaagagtgccgataaaaagaacttgcgagatgcattaaataatggtacctttggtatttagtgacaattaatgatgatgaatgatttcaaatctttaaagagaaggaagaaacataaaaaaaaaaataactacgctaacgtcgtgtgcactcaccgtagcatcctagagttcgacaagtatgggtagcggccctttccgctgcaattgagttttgatcaagtcgtttcatcatttccatggaaatacgccaatgtgcactgacaaatagtgtcccgatttctttgacatatcgcgtctatcaattggcaccagatgtactcattcccatcgcctacctactcccggaatatatcaaagcaatgaacgtaataacccttaaagtatctcccgaaaagctggagaagtttggaaaaatagatacgctagagatcaagcaacctagaccgttaaagaaattgactgtcacccttagtcaatccaacagtgcatccacaacaaaaccaagtacgccattatccaaaagagctttgcttggagacaggtcatctccgattccatcggattcaccttcctcgtcagcagctggaaatggaactcgatacaaaagtaaaggggcaccgggaggtcattctctttccttgtcaggaacgctagataaaacaggcgagcctagaaagtggtttcgtcaagccagagaaataaaatctttcagtggtttcataataccttttactacttggaaaggggaatggaagaaagaagatgatgaaaaagacacgaacactgatttcaaaaatgaaagcaataactccactcccataggaacaccaataccagaataaaataaaggttaaagggacagctacagggttaaataatgtatattaattgaacacataatgctagatggccatattcgtacagagacttgaaatgctcagtttcttaagtagtctctcaagtaggaactgaacttctcagctccagtttccaacacgtccttcagctggttgatatcatcaccaaatacatcatagactttttcttccaaattactagctgtcaaacctctgcttggagctggtttaggatcaggttgtccgaaataggaagatgaggaaatggcagtagctccgttgaattctgtttgaagtttggagcgggcattggagtcttctccgtaagtagaacggccaaatacctggtcagatgaaattgccttctgtccagaaaacttttgagaaatctcacctggagtatcatcattaagggcaccgtgtcttgctggacgacttgccttttcaacagatggctcgggattgctagaggaggcagtcataccgaaccccaacttggcaaattgctgagttgttttctttacagaagcagtggacgcattagagtaggatggttccaatacgaaggcatcttgagttttcgaagattccaccggagcagtgatggagtttgttgcggttgaggcagactcaattgaagaatcagctgggttatagcctagctttttgacagcctcttcttcctcacgagcctgtttttcaaaatcatcaaaatcaaagttggcctctttggcacttaatttctttgctccgagacgggctctactcctagtagagctgcctccaagtatattctttttgggaccagacgtggtagttgtcttgacagtagttctctttggagcagagttttgcggcaattgaggagtgcccgatcttgagctgattgcgttcagtgaagatgtagaagagttgacggcaggtttagaccaactgctgaagaaatcttcatgatggtctgttggttcaggggtggagttgtcagatcctgtaccatctaaaacatcaggaaatttggcaaaatctttctccaccttttgagctagcttctttttatagttcacagcgattgggttgtcgtatttttgctttactccagtggttaacagactcccaccgccatttttgttgtagaactccttgaataaatcatttccaccattcttcatagagcgcaactctctataggtccaattagcatccaacacagatgatttgacaaaagaaatatgaacaccaacatttctatgttcccccgagcactctaaacaaacaaaaattccaaaaggaatagaagtccaacttgggttactggcttgacagtcattgcactgttggtttgcaggtcttttcttcaaacgcttgaagatttcctcaacttctgcctttgtggcaaactcatctgccgacattgattccgtgttttatgatgtagaaggtgcgaagttgatttgaaataacagctcaaggaagaattcaattacgtaatatagttgaaattgtaaggttgacgagaaaatggtatttgatcctcaaagtataggagaatctgtaagagaactgtattctagataagttgatccggaagtcagagtatgcaaagactcggcgaccgtatctactattattttgagacgacacagggcaaaatcgaactgaaattgctatatgataagatcaaagggatctaatagccagactaggatgaaattgaggccaagttgcccatgcttgttcttccgcagatttttacaattctgctattatttcagccactccaacagtatctccatccagtgaaaaggacgaggttgatatttggtaacgggttacctcgaaagttaactaacatctattttatcagttaatcccgactcatctcattgcatcgcatatccatgtctctgtttgatcttcttagacagagggtccctgtgagaatattgccccttcctacacgggatgaatgtacagaggacttcttttatcagctaatatcgacttgtgaaagcatagtcacttctaaccctttttacgtgagaaaggcactttcccgtatagtagactctctagaagcgaggtccatatatgatgataattattttgataagctgtacgagttgtatgctagtttgtcatcgcaaccgcttggggaccttgacacgatacctcaggacatattggagtaccgcatcaacgagcagaaatctgtaaagattaaggaaagccccaactttatttcaggaaggggaacaactgggttaaggacatgggaggcatccaaactattagccttaaggtttaataatgacaaatcttacctgccgtatattcaaaataaaaaagttgtagaactgggagcaggtacgggactgattggtattagcttactaagactggcaagtcatgtcacattaactgatggagatccaaatttagtagaccaaataacgaacaatatacggttgaatgaaaacgatgcgttgtttgacctaaaaacgtacagctccagagttctcctttggggaggtcctgagtcggctcccaaatgtgatacgctaattggggcagacgtcacgtatgatgtgtcgattttgccagagctagtgaagagtcttcaatcgtatgagtacagcgttgcgttaattggtgcaactgtgcggaacgaggtcaccatcaatgcttgggaagggcaattgacggacgcaaaattgaattgggaa

SEQ ID NO: 106 - DNA, 323139 bp, Pichia pastoris
ttgtcaattaaggtgtataagatatgtaaatagaagctgaacgtaatcccatcttcccttatcacttcctaatggggaaatatgtcttggtttttccccttagaggagttttcgagtaagccctttccgggcgccgaacggtacctcctggcttcccttcgatccctccaatcccccgcgctccatatgttgatatcaattcccaaatacaaataaacaacctattgttccctgccatgaacaaggagagattaagccctcctttaaatgtttcacagagatcagatatgcttcacgacaatgaacacgtcgcagataggatgcatatggatcttgtgatgaaaaaccacaacttgatacgggagcaggaacgcctggaactgttacttcatcaacttcaagaggagttgacaataaagggcagtcggctaaatgaactggttttagagaacaagaaactcagcaacgaattacagcacgagattgaaataaatgaaaaggaatttaatcgtttcaatgggcttaagaagacgtatgattacaaagttaaacagttgtcgaatctgttgaacaaccaaaataaccaagatcattcccacagtttgacggaaaagtttaatgattctgcagccattgaagaactcagcaaacagttacatgttttggaaaaagattacgaattggagaagagctccaaagttcttatcatcgatcaatttgagttaatgaaacaagattacacagagcttcatacaaagtattccaggttacaacaaagctatgaagagttgatagaagaaatgtcttttgaggatctggacagtcaccccgaacaagagtcatcaataccagagacgccgtcaaacttggagcaggagttttttggcggtgtagatttgtcgtcccaagcaagtaaacgactttcaataaattttctaagcggaaactcctcattagtgggtgatgaagatccttctatagatgaggaggagaaaaaggtcaatatacaagacaataatcataacaaacatggacatagaaatccttcacacaataaactcaacggtaataataacgctactcatattttggatatggatctagatgtatacagcatgcaaatgcgcaaccaatcataccttcacaatcaggagctgatcaaattggaatttgaacttaaatcattgcggctgcagaacgaaaaattgtattcatacatagggtttctgttgcaaaaaactgccaatgatagcttcagcactttcaaacacgaatttgagtatgagtattcggatgcaatcaacatagaaagcgccaaacgaaatttgaggcagataatgcgtagttctagcgcaatgcctatacgtccagaattacatcaaacatccaacaatagtgacgaggatgattatggaaatgagactgtagagaatatcgatctagattcattaacgacggatatcaacaacgacaaaaaaagaggctcactcaatcaagacagcagaacagaccgatcgttttctgttgatttgacaatacccccattgacagtaaagaaacgacaaaaatctacccacaaactcaaaggaacagatacaaatcgatacgagataatacgagatatcacatcattaaaattgcaaaacataaggaggaggaagagagacaaaaaacttaagtcattacatttgaaacgaatcccctctaacacgttagtaaactcataccctatactgagctcctcactgtcatcgtcaatgatgatgtgccatcgacatcatatggtagactgtcattgccagacgtattttctgccgatcaacagcatgttcaacggactgattttgtccttgaataatctcttactaggaacagcccttattcccatgacagaacaaaagcaagaattgtttctggacgtagattgaaggggtaatatttattaatagagtaaggcaaggtagtattaccatgcatcaacaaagatcacaaatattttcagtcatgtgactccaagatgtactccggattccaaacacgaaaagtttcaaaaaaaaagtggtccgattcgtaagtggactataactacaagacttggactgcatttgggttcctcttcgtccttcctatatctcatgatctagaatggctcttcataattacatatacctaaagcaccatcatgtggatggctccgacgctaaagaactagatgatgatgatattacgctcattatggtcaacgagaggagggcaattcagccatcccaggaccaggaaaaggtcgacaagaagcgcaaattgagacctcggaagcataaaaagaatgcactagaagattgaggcaggtcccaacttcgttgaataaatgcaaaacaaaataatacacatgtttgagcccactgacacctctctttcaaattttttttccagacaggttcttattggacgctagttctatctaaccaccaacaaatcgctaatgtagtcattgattaccgcttggaaacacagaacgtgctcttgaacggaaactaattggcactgtctaataaggtggtatggtacaaagaagaagaaccattttgggtgaagtttttactagcttagctattgtgtggtggacgactatatcgtgagatgtagagctgatagattgtattacgtaattaatgttagttaattgacatcacatggattaagttgcatctttaatgtttactctttgcaagagatggctcaaatgtcaacgtttgattcaaaaagttctctagtaaactctacaacttactgaattgggaacagtttggaaaacttggaatctctgtctgataatggaattttaacctctgtacaccactcatctcctttgccttgccctcatcgttggtgtacccgatttgcaggtttccttcgcgactactcagtattctcccccgtctggtctcactcccaccagagcatacatagcctacctccagcgtgtgccacccactacttaggctaaaagataccatcattccccctaactgaccgttagcttacgcagatctggttttgttctccccaaaccgtcattgcgtggggtttgagctcaacaaattgtaaagaggcggtacgtatcaaccaattacatgggatttgcgaattggcgcaattgaaccgctaagccctatccatctcttccctctcgtactctttgtatcagtattttttttcctcctgaaacttgatattttttttggggaacctttaatctgaaggctttttttttttttccttctttgccgaacggtagcatctctaaagcaccacctggcctttacaattcagatagccgttctttcaaagtctggactaacaaatcaaccattggttgtttttgcgttgtgaaacaaacccaagaatgtcgtcgtcatcttccccaagtgcaaaggcaacgcagcccattccgaaaaaatccatgctcataaagactgacaaacccagaacacatgtatgtcaaacatgtactagagctttcgcaaggttagaacacctcaaacgtcatgaaaggtcgcataccaatgaaaaaccgttccaatgcggagtctgtggacggtgttttgccaggcgggatttggtacttcggcaccagcagaagctacatcttgaagtattcaacagcaacaagagaaagtatactcgcagacagagttcaggaggtgtctctagtaactcagactcgaatggtaatgaaactgatgcattaaatgacaacatcaacatagttcacaataacacagaggcatcattgcccctgcctgatagagataacctttcatcaatgaagcaaccgctgccacaaacggttggtactacggattcagactcctcaccattttcgcctcagaacttagaatctttgccgatctctcaatcgttcaactttcctttaagcaagaattacacgatgcaaactgctaagagcactactacggataacgcttccaacaatacccctacattaacaaatcaacccatgcaggactactccaatatatctggtgttcccatggaatattttgaccaaaacttgaatcttttacagaaatcggaagactggcttaacgaatttattaatactccctttgacaccaaattcccacaagcttccagcaacgtcggtttccatgagactcctgaacaaatatcaataccgcaaatgagcactactgcatcactgaataccgaatcacctataaactctaatgacctttcaatgttgtttaaatcaagacaattggatttattctctaagatggatttcaacagttttggaactgctccagacgaatctggtgctcgtctaactgaagatttacgtttccatatcatgtctacctacaacttatccaatggccaatttcctcagctatccgaactcaacagctacctcagtttctatgaacaggagtttgacagatactttccatttatccatattccttcattgaacatcttggaaaactatgagcaaatccctttgttgctttctatggcggcagtgggtgcgctatattcattccatgccaggaactccaccatgctttttaactttgcccgataccttattcataattacatggaaaaacatataaacagcaaactgtcaccttctaatctttctcctgatggtagacctgggatgatgaatgctaactcaaatggctcaaattttgaagatgttcctctctttgtcactcaatcgctgttattgcacatgtacctcggaatatttcataacgatttggatgtctcacatacagcgatcaagcagctgacctcgttggttggactcgtcaaaactacccatctggatactccgttggaaaactttattatgcctcccacagctctctctaaggataacttaacagatcaaacgcttctcaagaataactatgattatttcattctggcccaatcaaggatcagaacagttcattgtttatacttgttgaacatcctatttacatcgttgtgtgatcttcccatagctttacatccaagtgatatgaagtgtgggtctccatgtgacggagatttgtggcgggtcaaatcaccgcaagaatgggttcaatgcgtctcacttgagagcttcaatataatccacattagcaatggcgaatcttccttcgcagatatctggtatgatttgactaatcattactgcgataagggcgtttctttgagaacgttactttcgttattgatgacactaaatggattagtgcatattgagagaaagaatttcaatgacaacgaatgtgatattaacaaaagggctgcacgttggagactgaactctcgattacaaattgagtcacttatcaaaacgtgggaatccttgtgcattgtcaatggtggtgtcctggttccaagaggccaaaggagtattttaaacataaacaagcgtccagtattgaagcttattctaccattgttgtcgttcgtgaaaatccgtaaatgtgtcgaaatatccccatttatggagaaagtgtggcaacgaaattggcctggaatgattactgcaatcaaacaattggataaagacccagaagctttgagggaagcagccaattatgcaatggatatcatcagtctatagatcgaaataatttccatcacaagagatgctgagcagacgtcagtgcgaacacccatcttcttcctaacgtgcatattcactgcagtgctagttgtagcagagtatgtttatgccactgaaatttgggccaaaaactatcttgtttccacaaacatgaaatctccgtctccgttgtcaacttctgacagagtaatttggcttcgtgtggaaaccttgatgaagaaagtcgattttaacttaactcccaaaggatcaaaccagacttcgtactcagagtttttaaggattcaagccaatggtgctctagatgttgaaattctggacgatgaaattgcccagctaacacttgaaccaggagacttaaagcccatcgctcaaattatcacagctgccagactttcatctaggtctttgagtttaggagtccgaatcctagcggatgctccagtttggcccatagctatggtatttgctgaagccttgaaggctcgagcaacagatatccacatacaacacaacacctattctgcaaatccttcaccagtctgaggtaaaataatgactatgcatttacgtaccgagtacgtcatatgatcaaattcgtaagtatgtattataatggaatgacttatatgaacgaagttcagtcgcatttagaagtgtgttgctattggaattatattaattgcaaggccggccccgcttatttatagctaaaaaacaccagtttcatgcgtaaagaggtttttcgccaaagtttgtagtagatgcaacctcctaccaattgtgaaactggaacaggcaagaaggaatacaactgctgttaccataaacatcgatgctaacgctgtatatgtgtaaaatgtggatatagtcagcaatctcaaaaacccagaatcagcgtttaaaaaggacatttcagatatgaatatcctataaaatttgagaatcaatgacgttgttacacgctgagatttatttgaggttgtgtccacgggactagctgtactaaatttggtgatgacctcgttacctgtaagattgaaaaactcttcagtatctctgataatgtctgaggaaaatacagtgactgaaaacaattctttgataattcggacaagcaaaataggaaataccgtagccccaatggcatcccaaaatctcatcgttacgggcctttgatcaactggaaacgtatttgccggacggtaagctctggttgttgcttcttcgacaccatctcgacgatcttcttccggttcgcttgcgctcactcctatttctcttcgcctttctgcaatcagtcgaatcatctccctcaaagagtcgttatcataggggtcatattcctcaattacacgatcatccgaagccgaattgagacttcccacactctccgaacgatctatgtgttcttcttgaatagcatctgtttcatttccattcctccttcttctgaagacactccatcgtaccattctgaataggaaaatgttaacctggataacttcctagtagacccaagtacggtatgactcgtgagaccatctaatagtttccaaggtgcgaaattagcaaagcaccgaacaccaatgcgcgaccacaactaaacgttctcctattgacaatataaatcctcttcattggacaagtcgtttaaagatccatacttaatccaaaaaatgtcaggtggaccagttccagtgttcaaaaagtacactacgggatccaaggggatctgggagaaaatcagacagttgctcactttggttcctaaccgttccactggtaatccattggtaaagaattacagagttcctcctccaggatcccaaaccttgaagtacaaagacccagttactatcccagctggcgacatagtgaaaaaccaatattatgacagagatcacagaagaaactatcctcgtcttgttgctttcgatcagactaaggttagcggcctgttgactttgggatccgctcagaaccctcgtatttctgttggagaaaagggccagaaggagcttgcagtattcgaccagagtgtgtcgttgtcatcaactttggctacgattgaccccaaagttgtaaaatctgaacttcttgctgagggaggctctccagtggttgctcccagtttaaacaaaaagatgaagtttagattgacggaagaatctgagcatggtatgtatcctgaggactacccaatccgcatttttgctcagaactagagattatttatttatgtgaatgcttaatggtatttttggagtcttgtagttcttcacggatctttgaagcgagttttttttgtaatgagagttcctaggaagacaatcttatctttcctggcgcgcgacggtgatacacgtcggccatccattgaactttattgaaacttcttcaaacaccacattgcagtctgtattcatggtacggacgctcattttagttgcgcttggccttgtggtcgtggcattgcttgtactgtaccttttggtgttgctgttttcgcatagtccgagaaaccctttcgaaagtgaactatatttcatcaccactgagaaggatggatcaaaaagtgcacctttaccactccccgttgcaaacagccctagtgacggaacaatagagttgagtgttgtcattccctgctataacgagacaagtcgtctgaagcttatgtttgacgactcgataaattacttgaaagaaactcttccagatcgatttgaaattttgatcgttgatgatggttcgaaggacagcacagacagctatgcattagacttggctcataacacatataacctgaaaccaggtcagttgcgcgtgatcaagtttgaggagaataggggtaagggtggagctgttatccacgggctgcagcatattagaggtgagtatggaatctttgctgatgctgatggagcaagcagtttcaaggacatgtcaaaactacttgcccaggtaaaaaatgtcgaaaacaagaacaatgacaagatccctgctatagcaattggttcaagagctcatatggtcaatactgatgctgttgttaaacggtcattcattcgcaatttccttatgtatggtctccacatgttggtttacgtgtttggtataaggcagatcaaagatacacaatgtggattcaagttattcaacaaaagctcaattgcattaattttcccgttcatgcacactgaaggatggatcttcgatgtggagattctgataatagcattaagaaaaggcatttccgtgtctgaagttccaatttcgtggcacgaagttgatggttccaagatggacttggcaagagacagcatgaacatggctattgatctagtagttactagaatggcttatattttgggaatttacaaagactcggtagtaaccaagactaaagtagaataatagaaacataaataaattaactatacaaaaattcttcattgaagtctatcgaaattctaatatctattgaagtccttttaaagaatgactcaggtaaaacccaacaaaagctactgcagccagcaacacccaactcagccagactatttcatgattgacagagatcgataccacataaccccaaataaacgggcccagggctctggctagcgctgttaatgacaaagtagttccattcacaaaagcactatgttctctgggtgaagctctgtgaaattaaaagaatgacctgtgggaaggccagagaacttgccaaagtcttgagaatatttgttgagtacaatagtgttgtgcttatagcttggggcaaattaggaggtattgtgaacaccagatatggcacggcaaaatatgaaactgcagtcagtatcaaacaacactgcagggctttgattctattgaaagtaatgtcaacccacggataaatgaaaacaaccaccaacacaccagcgacacccgtggtggagagtaacgtaccgatttctggggtattcagtcccattcctccagcaatcagaaatggaaacttggaagctaaattaccatcctcatctctggcaacatcataagccagaaacacaggaagaaattcgtcgaacacgacagcagtgaaacacaatatgaaattctgagtaatagcattgaaggtcttaccctctaatagtacatgccatggatagcctgattcatggtttcttctcatttctgcactaacatctacagagtgattcgaaaaggttctcataatgttggctgaagtagttctgtatagctttccaactgtagtcgtctcgtcgtcaagatcatcatcatcatcgtctaaatcatcctcgctgacatgataaccttcgatctcttcttcgttacttgtggatcccaataatggatctgcttcagatggaactgccattaacgagccacctctcttgaatggcattctccaaggtctttgaggaacatcgaaacccaaaaagttccttatggaatcaccaatatctaagagataatctcgttggtcttttagggtatgatgagtttcttctaagaaaagagcaccaaataccagtgaaaataataggaagacactaacaactaaattggggagacaatagggatactttttgaccaaagagtcaaggaatgatttttgaaccaccagggatactaaacggtaagagtaggtcgatctcgtatactcttcagccgatatttttacaagatgtccactcataggcccaatgacacatcctagttgccaaagaagaggaagtgtgctgaatgccagaggagcatgatatggattagtagccacttccccaagaacagttcttatcacagcaacgtttccattaactgcacccataaaacttctagcaaaaagtgccatccagaatgaagtagaaaagccaaatacaagaatagagaaagttgtacctagaattcctatcatcaggactttttttcttccaataacatcagccagcctgcctaaatgaatggagcacagaaactggaaaaaggcaaatgatgctgaaagatagccgcagtactttgatatatgggcttcatcgggagcgatatgaaaatctcggaccatgaaaaacacatagggaaacatagatgtgaaggtgataggttcggcaaatctgaccactccaaggacaaagatttgccaaatcggaaaccctttcatttgctctttaaatgagggttttgtcatgataaatgagaatgcagtatgtatacagagtggaataacttatgattcattctgagattgagacgcaccatttctttgtggctcatgagatgtcgatgtcggatggtcgctggtgttggagagattcgatctggtgcattattgcttatcgagatgacactgaaagagaaaatctctgctagttcttttttccctttctgaaatgagaagacttgacacagaagtggagatcccatggaaaagaggcagaaagtaacacaagatacagtgatcccgcgtttgcttcatgcggattatcgtgctaaggtggaggagtttaagaaggttcgcatcattcaggacagctctattaaagatccagcctccttggagtacgatatggtgattgaaaaccagagaggaatttctttgtttggaatccctctttatggcggcaattctctagtgcatccgttagatcctccaaactatgaaacagaatctggtagaccagtgaacgattttgagctttttccactccctgatctatcatggcgctggacttgggataagtggcgtgtgttgatgattggtgatctagacgaacaaggctggtcttatgcctatacccgatttaggggccataggtggcgcggaatctacagagtgaacaactttattagacgccgtttatgggtcagagagaggatacaggaagattctcacttgatagaggaggactcaacagatgccatgattacgcaaaactcacatccattaaaaaagactgagtctcctgtagacacagagcctgactttccatcggacctttctgatctgttggagaattgcaaaattgatagagagcgtaccgagttgttactaaggtctgttcttgaaaagacaaaaggggacgaaaccatcctagagaattaccgtgatagtattcagaaacttgttgatgaaacttttgttttcaataactctaagaagttgttttgggatcaactggcttcggtccatcataattagcgctcgccacctttgttcttccttgttcaaagtaactatggaagaacaggatttgctgatacaactggctctcatacacagcaagagagtgtttgaaaaggttcatcggaagccatattcttgggattgtgagtattgcaggtgcgtgagtttatctgagggatgctaaccttaacgcgttttcagtatttttggagcttacaagaaacaaattacagaaagaacaaacaaaaaaagaagaagacacagataagacgaagccgacgagactggagcgtaaagatagattttctctgaaaggcaaacctaagttgaaaataactcggaaatccagagtcaaatcagtgatcagcaagaagacaactgacgcactggaattggtgggagttaagtacaatactacttgcaacaagttcgaaatgaatgttgtccctgaatattttgtcaaaaatgtcaagtttattctactgatacatgcctttaatgagttatgtaccaaaagttcaactctctcagacgtaataccagttctgaaaaggataaacaaagttctcagaaatactacgtttgttgacttgaaaggaaattgtaaaggtaatacgaattgcagaatgtttactcattattttgaggccttaaacaaaactttggtggcaatcagtgcacatacttgcgctaataggcaccaaatttttcaacttgcaatcaacatatacttgcatttagtccaagtgatggcaacaaaactcttctgcacgcaacaaactcgtccaatagacaaactgctggctcatattgcccaaccagtggtggacagtgtaatcatggaccggccattaccacagtcagctccaacccccttgccaacatatttggagctcttgaaaacccaaaagctaccatctacgaaatacaacctgtctgaggttgaacaaaaagatgcgttatatgacttggctcattatttcttgactgtgttacaactaattatagaaaactctaaagatgcctttactctcacagatataacacacagaaaactgctactcgctgctatcattcactgctcagaaccaggactggctcgcatatacagaaagattcaatggtaagacctaaggcactgggtccatttcacgaatcggatcaaaataactgtgttccatagcttcctttgctgttagccgttcgtggtgatcataacgcagtagtttgtctagcaagtcaatagcttcattgcaaacgtattttgcattctcatcgtttgcaaaacgagccaaaggtcttttcacaaaatagcttagagcctcgtattcttccccgagagtaagcttatatttctcaagatacttgtataaatcttcagtgcctaggacacgtacaatttgaaccagttgatctgtgtttgacttaccatggaaaaacggcaccttcataaacaccattgatgctaaagtggctccaaatgaccatagatccaatgaatagtcgtaataacgaaagtccactagaagttcggggcctttgaaataacgagaagccacacgcacattatactccgtctcaggatgataaaattctgctaacccccaatctatcaacctcagcttccgctgcttatggtcaatcataacattatgtggtttgacatctcgatgcattatgcccattgaatgacaaaaatctaaagccttcagtagctgaaacatgtaataccgcacatcaagatcagaaaatgtgggatacagggttctaaagtcgatattatctactgattcgaatattagtgcaggtgttttggaaacggagtctctaacagtatctaaaagggaaattatattgggtccacctagaaggttttgaagaatcttcacctctcgttttattttcttacgccgaatgggtttcagaacttttatcacaaccttcgatccttgtgggatcttgtacccttcgaacacctctgagtattttcccctgcctattttagatgttatttcatattgttcaggagaattccatgttagcgttacattatcataatcccagtattctttgtcttttttttcattggcatcggcgtagactttagagacgctatgttctggcatgctagttaatgtttgagtgtgactgagcgaaggacttgtgaaaagagggaaatgcgtaagcctgtcagtttctaatccaggctagcaattccctccacgccatttccccggtatgggggccatcctcagcgacctctccgcccagaactgaaccttcgcgacacttgggcctctcccgctccaaaatagaatcagaatccgatcatagttaccacgacagttcatcccccaatccatctcctctctacagtaagaatgtctcaagaagtatatgaggccgcattggacttgctgcgcaggttggatgctaaaaatatttccaagcatcttacgaatatttgtaagttgaaccctgatcttgcggaggatttgttatcatctgttgatgtcccccttactacgaaacaatgtgcggaatcagggaaacagtacttggcctgtgattacaacagagacggtgactcatatcgttctccttggtcaaacaagtactatcctgctttagaggatgaagaagatgcacctttcccttcaaaaactctaagggaagcagaaatcttcgccaacagctcgtttgacgtatacagagatttgtactttgagggcggtatttcatccgtttatttgtgggatattgatgaagacggaaacgatgtgtctaaggacggtaagattggatttgctggagtggtgttgatcaagaaagaagttgacgctggaaagtctggatcttgggattcaattcatgtttttgaggtgcaacccaacgagtctggtccttatgctacttacagaattacctcaaccatcattttagacctttccgctggaaaaagcgaagatcaactcttggaattgtcaggtaatctgacgcgacaaactgaaaaggatctaaagtatcaggatctttcctcacacatttcaaatgtcggtagtatggtagaagacattgaatccaagcaaaggaacatgctgcaggaggtttattttggtaagacgaaagatgtaattggagatttgcggaccacaaaaggcatatccagtcttaaagaagaatcagagaagcaaagtgaattgatccaaggcatgcgtaacttataggtaaatagaaaccgtacattccattactgagactagttttcatttgtctatcataatccactcaccatccaacatcgtctggaatcacctcatcaaacttcattcgcgttcgatattactcttttcaatctaacacttgcttccccaacaatggtctcctttgaatcattgatcccaacgcatccaggccttctgcccaaatggcttgtcttcatatccgcagtctcattcttcaactctgctcaaacttacttcactggtcctaatattaccagacaagtttacgcagctaaaccagccgagactacgggattgagttccagaacttttggtacttggacccttgtaagcgctgtgatccgtttttatggtggttattacatttctaatccgcaggtctaccagcttacgtttgcttcttataccattgcattgctgcatttcgctagtgaatggcttctgtatggaactacaagtttaagtgcaaaaggtagtaagctagcaggcccattcattgtggcaaccacaagtctgatttggatgtggactcaatgggattactacgtaagcccagtatgagggatcttagactaaactactagctgatactcaaaagaaaaaattgaatgaagttttgtacatatgtatacctagatcttggtgggatcttgcagcttgagaacctcaattgctggcccaagcaatctctggaatccattcttatctagggtaacaaccttgatcacgtcacttttagcaacgacagtagcttgacgtggaaggtcgttcaacagagcgagttcgccaaagtaatcacctttgcccaatgttgccatatgtccttcaccttctttaaacacttcagcttcaccttgttcaataaaataaaagttttctcctggttcgccttcacggatgatcgtgtcgcctttgttgtaagtctcagattctaaagcatcagcgagcttattacgttcataggagttgagacagcgtaacactggaacatccttgagaaacccatcatacatcgcacgtctcttggctgtaccttcaagtaaaattcttctaaacgtcatacgatcaagtgcccaaagaacacagtcctgactagaaatcacggtggccgcccgcggcgagttatacatcagtgcaagttcaccaaaggttgacccagactttccttggcctttagtctctccattgacaacaaatgtgacctcaccgctttccaaaacgtaaaagtaatcaccttcgtcgccttgtttgattatctctgttccgcgtggcactttcttctcttccaaggcatatatcactgttcgtagtgcttcatcttctagctggctaaacaggaaactctttctgacaatgttgtttaaacgttgcagttgctcatcactcaggtcgtggacaggtggctgccaagaactggtagcaaaaatttctggattcacagattcggcactcacagagatacgtctctctgggttgaacttaaccttagcaagatgtgcggcaaatcctgagccaggggaggcattatccaaaggccttattttattactttgagggtcttcaggatgagtgaatgagtccttaaaaatgctaccacgatgagggtgatgagacaatggttcatgaggatcacctccaaactggtctttaaacagaggtgcgcctgaagcagtctgagcagggcgtgaagagggggctgttgctgttgatggttgttgtctggcaggatcctctgctaacttattgttgaagtagtccgcacagaattggatcacatctttgggtttcttcaaggataattctctactcaagtcgtttacgacgtccgtgtatgctgtcatggtcaaacagggttcaattgatgtttagcttggtgtttctgtttcggcaactttcgtaaagcttgctattggtgctcaaagctgctgatttcaaatatcgtgaaaaagatataattgaaattctaccttgttgcaaattgctagttgaacggctgtatgaaagattgaggcaaaaattacttcaaatcaactagtcagttctcacagtaggttggtagggtggcgttctattgggaagatagatgctgcttccctctggagattaaggaagctaaaaggggtccggaatgggtagaacactaccaaaatataatgcgcgaatgatctgcgtcctgtcacattctattacttatctatccaatccgctaacggtctcaaaaagtgaaatatgtgggtgtagattctccgaatcccgatctgctttcaagtacgcctgttcagatcgatccagcatctcatccagttccagagctgtaagattattgtccactaattgttcctgattgctgttcctcaatgaagtagttaaaaggaattgtgccaattcgtgagctagggaatctttcttccccaaatccgcagaatctgattgatttgacccggcaagtcgacttagtgttgagaacttacccattgatatcaccagtctttccagccttctcttggaatctgctctggccagtagaacttgctctatagtgttgatattgcaaagcctgtatattattactggctgcgtttgtccaatccgatgtacccggtcaattgcctgcaaatctacttgaggattccaatctgaatcgaataatattactgtgtcactcgcagtgagatttatgccaagtcctccagatctagtggacaggagaaatatatcaatgtcttttgtagcaaaacctttcaccatgccagctcgttcttcttggctagttgtaccatcaattctataagtagagtaattctcctcttgacaccacatttctaccaaatccatcattttggtgaattggcaaaagattagtactttatgcttttttccgtcagggctcttcttagagtcaagtaatcttggaagtagctgtgctaacatttgcatcttactagactctctcacaattttcttgaaatctagtggctgatcgtcctcccacgggtcaaaaaataagaacggagaatcacaaattagtcgtaactgcattaccaaatttgagagttttttctttagtatctgtgatctcacaatactccaatattcgtttaacttttcatcaatggcgatcttttgctttcctctactgctttcattgtatttggcatcttgagatctagtcaatcttcgtctcttgctattagatggcagtgaagaatagaaacttttatcttcattatcgtgccctatgtcatcttccgaatcggatccaagcaaatcaattaactcagcttcttgattggggttggaattcccagttttagctcttccgagtgatgtaacttcatcattcattactttgtccaaaaatgtcgtcacttcactggtagtaaatcctttgattttgttgcacttcaaatactctctgaatccaatccgtaaaagtttgtcttttaactggtttttcagggccgctttatacaaaacctcttgagcaggagttagcttggaataaactatgtattctctcttggatggaagtccttttatgacatcctttttcagtcgcctcaaaaggaaaggcttcaaaattgtatgcaaactggtgattaaagatttttgaatttcctcattaatcacttcattcaattcctggtcgttgttgtctgctttaagctcatctaggctggaaaaatcaaaccattgttggaacatgtcgacatcatgaaaaattgaaggcaagataaagttcaataaagaccacaactccttcaaattgttctgcaatggagttccagtcagcaacagacggttattggtttttagcttcttgagttctctaatcaacaggcaattagtatttttcagtctgtgtccttcgtccactactaaatactcccatgatatcttctcaaggtactttctatctctaatagacatttcaaagctagtcaccactacattaacggacttttgtctcagtttttttctcagtttggacctaaccggtggtggtcctatatagcacatggtatccaagacaggagcaaatctagctagctcattgcaccaattgtcaacagtagacaacggtcacacaatgagaaacttccctttgatgttctgttcatagagaaacacaaacaaagatatcgtttccaacgttttccctaaccccatctcatctgccaggattccgttcaacccattttcatacagcgaaactagccatctcattccgtccaactggtagtctttcaagacacagttttccaataaagccggctggttggcagttgatatttctcccatctttactggtttttccttgtcaacagttgaatcctttaccaaattttcagctattaactcactgaattttagagaatggctcaccagatcatttagtcttttcaattttctgtcctttgtcaactcactgaactgatcaaactccttcgtcctttctactttgggagctatcttctctaggacataatcttcatcatcttcttcccctcccagcggtgacgtaggccccatatgatcaaggctcttcctcaacgaggggccaaatccagaatcaggattacgcgtgccatacagtgcgcgacacatgaaaaaccggaacttctcacattttggtgtcgtgcggcgcaaggatcccaagctacggtgctgagagtcgaccaagacacgaccatcaggatcgacaaacttcccagcttgggaaaaaataccaacaaacctaaaaacaacaccatcaggatcagctctgaaacataccaataaaatgtcagatcacgagtctagaccagggtctgcagatctggatgtggatatgaaagaccaaaccgtcgtagctcaatccgaagaggaacacatagatgatgctggctcaaatgctgatgcaagagaggcaaactcaagattggaagaggaagctaaacaatatcttgcaagacagactaaacctgtaattgttccatcgtatgcacagtggtttgatatcaataccatccacgatattgaaaagagatcacttcccgaattcttccctcctttatctgataattccaaattgaaaagtcctgagatttatttggagttcagaaatttcatgatccacacctatagattaaatcccattgaatatttaacagtgacagcagcccgtaggaacttggctggtgatgttgcatctatctcaagagtccacggttttttgcaaacttggggtttaatcaattatcaaattgatccaagaacaaagtcgtctctgactggtcctcaatacacaggtcattttcagatcagcgttgacacgcctaggggcctgtctcctttgattccgaagaacgcaacagtcatcaaaggtaaagatacaccttcaactacaccatcagtcactgaaccaaagacacctcaggacttggaaggtaatgaaattccgtataatttggaaattcgtcgtaatgtatacgactccacacaagatgctattactttaaaaggtgaagataagtttacttcaaccgtgattggtaccaagtatttcttttgcaacagttgtggtaatgattcaacaacaacgcgttatcacaacctcaaagccaagagcaatatttgttccaaatgttttgaacagggtcaatttcctgccagttttcaaagttgtgactttgtcaatcttgaaaaaattgctactacttctgatgcttctgcatggacggatcaagaagtcctgttgttattggaagctattgaactatacgatgacgattggaacagaatctgtggacatgttgggtctagaacaaaagaacaatgtatttccaagtttattcagttgccaatcgaggacagatacttaaatcaacagctgcacaagaagaaacagttctattcagagaaattaattggttcaagtgaaggaaccttaaaaggtccaagggagcctgtggtagagacggtttcaaacaccatagcacatttaatcaagacggtggatcctgatctagcagcaaacactctctcaaaggcaatatctgggatagacaaaggtactgaggacgaggatattgctagagcagccaaactagctatcggcactatggctggagaggcttatttgaaacagaaagaaacccttttgcaacaagaaggtctagttaaacaagttgttgaattagaactaaaaagattgaacttaagttgaacaaattatcaattgtggagaaaactcttgatttggagaagaagtctcttgccaaacagaagagcgatctcttaatagacagaatatccttgagaaaacaggttttgaaagtccaatctaaattgaaaaaggcctcggaactaggtgctacggacgaaggtctacaattatgtgaagaggctctagtagaggcttcaagagccccaagagtcgtagttgtaggaaacaatgttactgacaatgaaaaacttaaagcagatgctaatattggaaatggcgatgttgatgtgattgacgaaagctcccaaccaatcagcttacaattcccccaggtgtataagtattggagtttgtagttattacagtaagtaagatggaacggatttgaaactcagagatagtagctcacgtgaccgtatcggattctgttcacccaaatctccaacttcagtttacctaagcacagtccccccttctccttcccctgaaaatctcgagaacttcctctgcctttctcataataaacctttacggctccacatgaaactatcaacttcggttctcctattcttctgtataggaagcgtgtttgctcactcttcatcgaagcagaagagcaccagtaggaaaattgaacccctttttttcgaaaatgggaacgttaacttagacacgttgaacgacaggcttactgagtgtgcagtagtgcaggaacttcaactcgtgttggagaagcaacatggagatgatgatgaacctgaaggctactttcagagatttttcaacacgcttttcccttttggacctagtggtaacgctttgttggctaccacttacatttccggccctccaaatttactgttagctttgattcctagcaacattgacccttcatcgctctctattttggtaagctttgccgttggagggctattgggagatgtctttcttcatttgcttcctcagacgtttgttggagaacctttcgaccctactaagcctgaattcatactggttgatactaaacgtaacacagttttgggcgtgtttatattcgttggcttcgccatattctgggtcattgacaagtctttgcgtatcctggagcacgagcagggcgcagaaggtaacagccatggccatagccacagccatgtccaacctcaaattgaacaggaaataaaagacgagggtttctccaattcggttcaaaataacgagactttaagcataaacaggaaagacaaatccaaggcaaaagatgaatcaacatcagagatcacaacaccttcaatttccaacccaaacgcatccgtaaaaacgtctgcctacctgaacctcatctctgactttacccacaacattaccgatggattggctattgcggcttcattttcaatcagtcagaatgttggatgcaccaccacgttagctgttttcttccacgagattcctcacgagatcggggattttgctttgttgattcaaggaggattttctaaatgggcagccatgaaatcgcagtttgtcactgccattggtgcttatttgggaacatttattggaattgcaatccagaatttggggtccaaagatcttgacatcagcaggtttcaggatgactctcttgtttcaaatattggcattctggggacctcagttcaatggagtgatgttacccttcccttcaccgctggtggatttctttacatagccacggtaggggttatacccgaaattttggagctctccgcaaactcgactcgactacaagaaacagggaagggtttcttacaggtcatttttatgctgattggcttgtctctgatgttcttcatttcgtggttggaatgaataggcaatttccggtggagagggtattcggacttgggctcaaacacgcagcgcatgcacgcacgaaccacaacacattattatacctgatgtttttttttttttttgacagagagagacaggtttgagccgcaattcacgtgatcccccttatcacagtacccaccaaagtataaatcatacggcagccctttgtttgatttcttcttcacctatatactaaaagaatgagcgtcctatacacatttgtttggtaattatcctttcagcaaggcccttatttgcctcttttaaccttgaaattcagctatactaaccgtgttttaaggcccgattcggaggccaaaaatgtctatgtgacaggaacgtttgataactggtcaaagagtatcgccctgaaaaaaaaggacgatctgtttacagctacagttccgctaaatttgggctccaagattgttttcaagttcgtggttgatgatcaatgggttgtatcggaagacgaagaaaaagagaccgatgaacagggtttcttaaacaacatactatcagaagaaacacttttggcgcttgatacccattcaacttcctcaagtccaaaactgaagcagtatttgtcaagaactacagaaacaagtacttttacggctgtgtccttcctcgacagtgacgatcaatatgaacatgttcctgaccacctagaatcgtttggccagattgcttcagagatctcacccattgcggatgattcctcgatgcaggctacactttcaggctcagacgactctcgtcttccgtccgaacaggtttcggtatccactagtcctgaggtttcctcactaataactcgtgtccgaaagctgtttcgttattaataattattacccacattaggcaccacgcgctttttatgtatgttgtcaaaagttgttaatgtattcattaaagtgtgtcgtgtcgacattttctaactatgtatactctgttcccatttcgcaaactcctctcttcgtttgatgatattgataaattccacattgctctcaatatgatcaaagggagtcgtgcctatgatttcgtgctcccccgtagcttctcccatgaaaatattcttcagtccactttggtcccgaggcttgaccaatgctccactgtaaatgtccacctgatctgatgcttcaatactcaatattgctcctagagcaacgatcacacatgcaaccaatgcttcaatcttgatatcaagaggtagctctaaattgtgatccaataccctctttgcaacctgattaaatgtgtacgacgcataaccagcattaagcaataacaaggaccctataacataacatactcggctgatgaagctcattggtccacttgagaaatgacagacaaatgtaacaggtaatcagtggtcggaaggcttcgagtctgagctattcgttcgcggcataattgatctggtgggatcataacaaagcgttttcattatctatacattgttatcattactagtaatctctggtattggctccaattcggaagcctttagttttatctccttcaccaccgatgcaaatacgtttcctagcagtgattcattcaaacgaatcctctctaatgatttagtggacatgacgccgatgtcgaatagccgtttcagaatcaagacatatccacaaatgtcctgttcggcatcccagacagtggtctcctcaaagtttgtttcttgaaatgagacctcgtcatcttcctctctttccaactggatgttcagaactgtagccaatttgctctccagcactagaaaattgtggagtagttgtctttcgacctcaggtgagatgctgaggtccagctgtaaaaaaaaagaagccaatggtcctactatactatcgtgctctcttccttcaactctaagggcaaaacttttgcaagcagctaaaatattagcaaatgttgtggctgtgcgtgtatgatcaagattctccttcaatgaacgcaatataaatggaaactttccaaacagagtttgcaccagctcttcggtcatactcttttcctcaatcataaattccaaagctgtttctaaggatcgggatgtaaactgtaaccaaacatccaatctttcctcagtgcattgtacttctaccagtctctcaactatcggttctaagtattcactggtgttggtgaattccccaactaacaagagtttcctgagcgaaatggaatttaagttctcagtttttgaaagttgtttacaaagcgcatctatgctaagacgtaaccgcgtatcattactttgaactgcagctttaataatgagcttgaaaaaggtactgaaatcagcattcaacggtgaatctttcgacaagtaaacattcattccctgaaaaaatgtcaatatactatcagtcaaatcttcacatgtagactgattattcagcttgtgaaaaaacgaaccttcaaaaatgtggttaaacatctgcagcagacactgaaatttatgcttactggatttaaatttttcaaacagtaccgaaattttatcaataatcgcagatactatcacatccttgcttggatcttctgaaccactttttttgcgagagttatcataatctcccttttcattgtagcaagaaagtgaatctcgtacatagttcagtaggatagaaaccccatccgaatctaactgcagtgcctttcgtaaattatctgaaaggctttccatggaagtaaaatccgtgactaaaaatttcaaaacttgtggaactgagttgccatgactatagtatcttggaatatggtagactgaagaataaaaatcattcacatcgtaaaatggcaaaaggtgtaacttttgttgatctaaaagatcagtttgttcttctgtcaagtacaattcgtaagagtcttgcagaagacgagcaaaattaccgtacttgatgtagttgctcagttcatcgctttgttcatctggaagagtatgcgattctaggaaatgcttggtaagtcctgcctccactatagcaatatatttactcagttcggcatgaatccgatgcgtttgggatttggaaaaatgagagcagctcagaaaaattgatccaattacacgaagctcttcaacattctctagatagccacacatagttatttcacatagaacagatatggcctgtgatttaacatggaaatcaaggtcaaatatagcaatctcaatgatcctcttcttgaacctttcagtgaactgccgaaaaccagtcgcaataacatctttcttatataaccgccccaaagatttgagaacttcgaacctaacgtgagcatcagcatctgataagatccaaccaaaatatctaagataagtattttcgaaaaagaactcgggatatatgtcaatccataaccctagagctgacatgcactcttttctaatttttgggtcaacatctctagacctatgaataaaagttgtatgtgtgatgtcagtaaggtagtcatccagagcttttttgttaagtttatgtgtatcaatattcgcttggattgagtttaacctcgaagattttgttcttgaagttagcttcctcttttcagagtcgtactgattttgggttttggaaagcagcgatgcaactttcacagtaatcctgcaaagtgtggtttccatcgtaagtaagaaaagggtggatgcatacctcaacggtctcaagtttgaagtagataaagcgctcagccaaacaagaatagattccatgagattctcattctcatacagcattctattctcgtgagcaacaaacaatatttgctctacaaattccactactctattgcgaaaatacttccattttgaaatctttgccaaaccagaggccatcaaaggaaactcgtgagctttttgagattgaaaaaattgctgaatttctcccactgtttcggtggctgagtctggattagcaacgtcatgttcttgaatttgagatacgcaaccacaacatcttagtgtaaagttcagtaagtccttgattgcatccgtgggtgactcttcaaactgttctaaccagaatgcactcagttcactcacggcaacgtcgtcatcgctaagagctttgaaaattgagttttcttggaaattctccagctgatctactgaggagggaattacgcgcgtgttctttcgttttgggttcccctttgtctttttcgacacggttttaatagtttgtttcttcctctttttggtaacagagtattcctcatctgaatcggcttgtgcatctgaagaagacaagtcgtcaatatcagtgaggtcttgtgttaaatcctgactctgcttttgtgaagacctaagtcttatcgatcttctggaagagatcaccatttgatgattgtaagacaaggaaagacgcgtagggagaataatgtataaacacccgaaaacgagcatactatatggtgtaagggtgtgctagtgcaattgcataatacaatgggatggatgagtagtaaaaggcaattcatacttgagtgtacctgatcttagaccattagcttagaagtttcaattgatctgattagcaagcagtatactgttactgttaaatgaatgaaagttctaaacgctagcgtctcaaaaaatgaatttctcctgctatcctcagaattatctgctctcctcctgctcatcaaattctgcctttattagtttcaaactgacaaccacctagataatgaattagttattcaagttgtgggctcttttcatttgctgagtctgattaccaaaacttgtccccactctggcggagccttcttcctcattttgatcctttcgctcacctttttggggcacctgtattccttctcttcgaaattctttgaggtcttctgctcccaacctcaacgtagtggcttctcttctcaacatgataatagtgtgtagcttgtaaacgcagttacgataaatctaacacaaggattgttgccgttattgagctcttctgttaatattcctctccacctcttttgccccaatctcctggttgttcgcgaaaatacctcgtctccatagatcctccctactactagcctcaactctctccattacatcattcaaaatcgacgatcttctggaaccacacctgaccaatttatttacggacataaataatggaggaagcaacctgtaggatttgtcgtacagaggcaactgaggatgatccactctatcatccttgtgcttgccgaggttccattaaatatattcaccagaactgtctggaagaatggctcaagtattcaagcaagaattctcaatgtgatatttgccatcagaagttttccttcagagttgtatacgatcaagatacccctgcccacgctccagtgaagctcattttacagcagattagaacttcaatcgatagaaaattgttctcatttttggtgattatatcttgtatcgtttgcgcaatattgctgttctcatatacaactttggttctgcgatattcgtcattcttactttcattttcttttgtacatgggattcctacgactacggaactactgttgggccaatcggaaacacctattagcttgcaagagttcttcaacacagaccctgcaggatgcatcagaaaagcattggtatcttcattattgcctggcttcttatttttgctagcattattaatactagggcctgttataaaactcaaccatgagtggatcattagggaaacttcgtttcttaagatgctccataacagaatcggccctgttcattctaatgaacgtcatgcctacgttaaccaagtggatggcatgagaatcgcaggaatattgcagcaaattcaagaacaaagggatgctaatcacggtgttctaagacgggaaaatgtggacgcattagccaacaatattttgggtatcactgggaacgaacagctcgctgaggctatgagattagccattgaaaacgtggaacaagctgagcccaatcacgaagaaaacgatatcaatgatgaaaatgagatcaacctgttaaatgaacagcctgctcacgttgaagaaggactgcctgctgaagatcaagatgatgttgattttgatgagccccctgcggttgctgctcaaaatgccgacctggaccccgacttcagacctttcgacgtcgcagaagaacctgccgaccaagctgcagacgaaccagccctaccagagccaagagcccaggctgagccggagttggacttcaatttaggggtgcctgacgaacccgaagctaacaacgatttatttgagatcatgttctcacttcatccagccctaccacctttaatattgacggcagctatatttatagaacctgtggttctgactttgctattcattattccctgcctcgtttcgtttgcaatactagacttgcttcgtcctcttggcaggctcatcaacagcattcctgaagcagaaatggtgacatccctatttataagacaaccaggtgctgaggcttcaggtattcgcatttttggtcatctaattattggttacagtttctttgcattcatggtctacttgatattacgaaagattgagaaaagctgtaaccctcgtactaatcctcttagaaagtttcgacagttctataatattgtttttggttggagctgcacattcaaagtgtttacattactgggaatcgagcaactacttttccccattacttgtgggtttctaatggacttttgcatagcccctgtcatggtcgaccctcgctcaactggaactcttcttcttagtcaaaacttcaaggttttgaaccattcattacattacatgctctatctgtggagtattggaagctcttacatgttttgtttcgccacatttgtaggcatgtgtcggtctcacattttacgccccggagttctattctttatcagaacgccagatgacccaaacgtcagactaattcatgaagctttgacacgcccatttttcttgcagttgttcaggatttttatttccttaatagtttacacaatttttattcttgctggtattggatctgttacctggtttttcggtcttttcacgccgctacttccagttgtaattccaacaatacttccaacaggaattctcaggttttacatgagcccattatggatagctcctgcattattgcaaggaaggaagcacaaagatttggtgatcctttattggaagaaggcttataccatctctgctgcaagagtgagattgtcttccttcattttaaataatccaattccagaggaaagaggtcgtattgtctaccgtcatttctaccatagacttagtgcaactccagactactctaaaccgatgtctgtgagacaggccacgcagcatttcaaagaaaacccatcagtgaatgctatatttgttccagacggtaattacgtgcgtgtccccgatgacgacgctgtctccagaaaatatttaaaacgtttgtttgttgctgttaccaaagacgacaacctattagaacctttgaaagaggaaaatactgcagaggacaattcccaggaaccttcatatgattctgattctgaaacaatggaaataaccacgcattgcgttgtatacaggcctccacactttaaagcgcgttatatcagtttcttattcctgataggtttcttcgctatcagcctgtttgtatcgtgcattgtactcagtgatttgttgggtcggttgatagtacttcccattagtcttctttggatccatagtgaaagtatcttctcaccaagaatcaattttctctacttttttattggctaccaggtttggcttcaaatatttgagttatatcagaaagaggatgatacattcaccggactggcgttattgctaagacagattacagaaaaccttcgaagagtattgaacacaatatcaggaaaggttctggtagtagtggtagacaccatacatttattcattacactcatatctatcggtctgcccttgatgacccagaacagtgcagtagttgagaatttcgatatgttactaaaggatccaaacgatgaattgaatccaagaggaccattatccagcctttacaaggaagtcgatcctgcactttctgcattcccatttggactagaagttttgggtccttcttctctgataactatactgtctattgtggggatttcgacgtgcaacttggttccctacaaggatggaaccgtgaaacagtgggcactgctggttgtctattgtatttcaaatgtattaacaggatttttattaaacaaagcaaggggaccaaagacaattttggaagctttgaacatttacggttggtctttttttgcccattacgtcgcatttgctgcatatttcacaaccaaggcagttttaagatatttcaaaaccatagatgagcaagtgaaagagacttattacacatccaggaaagaactcaagaatttggacccatgattgacagaatgaatatagtatgtgttgtggaatatgtgtatgatataagcctattgtagtataagtacctatagttgatcaaaccattcattactcgtcttactatttacacgtgtatatgattaagtaaattgtctggtacctccacgagcgaactcaagcactttccaaccttcagtttcaggatggtcaacatcttctggtattcttgtcaacaccatgacgtaggtactcaagttgatattatcgggcgatccggctgcaatctcaccggtcttggcctttctataaacattgacttcttggacacgagctccaataaccaaggcaggactgttattacctggaataacctttgcactgagtacatcgactcctctgatatccaggatgcgaccatcagagaacaggccttgctctttgaattgcttttgttgagcatgaaaaacattgaacggtgcttccgacagccatgttttaagtacagcttcatcaccctgcacataagcctccaaaacttctgggataatgaactctctgagctgtttgttgaaattctcggtgttgaaagatggatcaatctctttgaacatacgaatcaccttggcactttcagtttcatcaaagaaacctccaattttttcaaagatagttctgaacaaagagatcaaaccattttcggactcctcccatctcattctcaagtctcctaacacttttccgatgggagtctcaggctttaaaaatgtaaacctgtcagatagctttggtcgttcaggcttgtaattggtcactactagagctctagaagcttcctcgttagcttttatgacctttggtctttgaggattactcaattctttctctctacgcaaccttctttgttctttagtttcaaaccctccatatcttgttgacgaaccatcatcaataacttctgaaacttctttgtacagcgctgtctttctgacaggttcaaaagatttgtcgacaacttctgctgtagtctttacagtctttctagtgactttacctactggagaatcccaggccttaacggcagcgtttccaacggtttcggcagttttcttgacggcttttccagcaaaggatgatcccttctgagccttatcatatgcttccttggctttttgaaaagcttcactttcggccattcttcccgtctcatcttgaagagctttaatgttggattttaattcgtccgattttttccattcgttcttgaaagtttcgaagaaaacctgcatcggagacttgggaccattgaaagccattcccgaagaatgaaaccctctgctagctcgggttattaccttaattctgaacatatttcagtaatatccgagtcagatatgtgatgatgtcgaacaagacctggtaaaaaaaattggttctgaaaataccggagtgaaaaaagaaagtttggggaaccagcggggcagggaatgcttctacgaaaggcggtgagaacaactggaggcaaataataaagaagcacccttcgcgacgtctgcttgtttttctccatgatatgtcccacgaattattctctttgaatttcaaacaactaatgacggtggaaatatacgttaagaatccaagggtctatctgggtctagatgaattcgatggtgtctctgatggggataaggaactagaaaagcttgcaagtcttcgggaacgaagaaagcttgtccttccagatccaaacaacattgttgggcatgaggaattgatcaattggttgactgaagctgagttcagtactatcgacgaattgaacaaagtttctcattcagaaaacgatagatatatcaatcagattctttggctgagatatctcagtgtgaaaggtaaacaggaccaatatgatgttaagatagttgatactttcggtatcacatttcccaaagccaacgaaactaattacacttttgagttattgctacaggaaattgcccgactccgtttgaaggaagacaaagaattgtacaccttattatacgaatacagtaccaaaacttttcaaagcatacccattctcagctcactaatcgacattctactcagaggagagaataacacaaatgaattgataagaactttcaaagtctacgagtcaattattactgaatatgaacaagttcatgggctaaactcgagtccatatgttgtgttattcctggaaaaattagcatcgttgacaagcagattgattaaagaggagggtagtcatgaattgatattaaacttcatcaaaactctaaaactcaaatttgaggatttcactgagaaattccaagtgccgttcaaattttatgctttggattccattcatattgaccccattttctgtgatcctgttttcgtctctcgcatttctcctgtcatctcatccctcattcagagttgtgagtatctatgccaaaactccctggatgcaccggatctgaaaaagaatttggaacaatcagtgaagttccatcacttttttattcagctgaatccgaaactgcccgtatcgttaggacttgttaaaacattggttaaacttaatcaaattcaatcagcaacgaagataatgaagaaaactttacaaactgacgctaccaatttcaaatacataaacttcatgatagttctattagtggctagtagagaatactcaacagccacaaagttaatcaactccactctgttatacatcgaacaagattctgaattatcgaaagctgaaaacgatgatattatcaatttgaaaatactagagatcctggttattgagaagattcattccccacaggttgctttaaactacttaaatgatttatttgaaacctatcacaaattttacgggcaaccaggaaacgcatcaccattgctggataaaatctggttacttgcctccgtactatacgaaaacaacaaactttacgacgaagccagtaattgcttgaatgaaatggccaaacctgatttatcaagaaaggcttggttaaatattgctcagaataaataccaagaagcccatgaccaaattgaatcagttttgaccccaattccatcttctttctctcctcaagcacgattctctgcaattttgggcctgtcacaccttgcctataatcaccccgaaacattcaagtcacagaaagacatcaaatctgtacaggctcggtgccacaccaacctccagcgattacgatcagactacacgttttctaaccaccatcatgtctatcattttttgtcactttcttatgagaaactaggtgatcaagtatctcttcaggaggtcctaagctatacggtcaatcttcctgacataattttagacctggacgaactatagttttcgatctctcatgtttttcagtggaactcgtattatgtaatagccccatcttggtttgtgggatgggatacgcgcgaactgcggattttgaaaagcatttgtataaaaatcgggagattttttggtattgatttgtttttttggcatagtcagcaaacatcaattagaaatccaccgaaactatgacttcaaataggccattaccgctctttgcctctgctgatgttcagaaacacgtgagtccaaaggattgttgggttacgctatatcataggaaggtttacaacgttacagagtttttggaggagcatccggctggagacgacttgattttggagtatgctgggaaggatatcacacagattatgggtgatcagctaagtcatattcactccgaatctgcttatgaaatgttggatgaagacatgttggtcggatatttggcaacaccggaagaagaaagggaattactttccaataaagatcatgaggtcgaagtgcagctagactccaagggaaatgtagttgaagtcgatattgacctaactgagtttggtgaacttccggctgagggtttactctcgttgaaaacagactatgaacacgacttggttaaacaccaatttttggacttgaacaggcctttgttgatgcaagttttacgtggatcatggactaaggagttttatttggaccaagttcatcgtcctagacattacggaaagggttctgctcctctttttggaaactttttggaacctctgagtatgacagcttggtggattgtacccatggtatggcttcctgtgaatttctattttttctacattggattcaccaatcaaaacaaattagtcgccatggctttttggcttttgggtctatttgtttggaccttcttggaatatgctttgcatagatttttgttccacttggactactatcttccagagaatcaaattgcatttaccattcatttcttattgcatgggatacaccactatttaccaatggataaatacagattggtgatgccacctacacttttcattgtactttgctacccaatcaagacgctcgtcttttctgttctaccatattacatggcttgttctggatttgcaggtggattcctgggctatatcatgtatgatgtcactcattacgttctgcatcactccaagctgcctcgttatttccaagagttgaagaaatatcatttggaacatcactacaagaattacgagttaggctttggtgtcacttccaaattctgggacaaagtctttgggacttatctgggtccagacgatgtgtatcaaaagacaaattagagtatttataaagttatgtaagcaaataggggctaatagggaaagaaaaattttggttctttatcagagctggctcgcgcgcagtgtttttcgtgctcctttgtaatagtcatttttgactactgttcagattgaaatcacattgaagatgtcactcgaggggtaccaaaaaaggtttttggatgctgcagtggcttcgcaggccttgaagtttggaactttcaccttgaaaagtggaagacagtctccatacttctttaacatgggtcttttcaacaaagctccattagtgagtcagctggctgaatcttatgctcaggccatcattaacagcaacctggagatagacgttgtatttggaccagcttataaaggtattcctttggctgctattaccgtgttgaagttgtacgagctcggcggcaaaaaatacgaaaatgtcggatatgcgttcaatagaaaagaaaagaaagaccacggagaaggtggaagcatcgttggagaaagtctaaagaataaaagagtactgattatcgatgatgtgatgactgcaggtactgctatcaacgaagcatttgctataattggagctgaaggtgggagagttgaaggttgtattattgccctagatagaatggagactacaggagatgactcaaataccagtgctacccaggctgttagtcagagatatggtacccctgtcttgagtatagtgacattggaccatattgtggcccatttgggcgaaactttcacagcagacgagaaatctcaaatggaaacgtatagaaaaaagtatttgcccaaataagtatgaatctgcttcgaatgaatgaattaatccaattatcttctcaccattattttcttctgtttcggagctttgggcacggcggcgggtggtgcgggctcaggttccctttcataaacagatttagtacttggatgcttaatagtgaatggcgaatgcaaaggaacaatttcgttcatctttaaccctttcactcggggtacacgttctggaatgtacccgccctgttgcaactcaggtggaccgggcaattcttgaactttctgtaacgttgttggatgttcaaccagaaattgtcctaccaactgtattagtttccttttggtcttatattgttcatcgagatacttcccactctccttgatagccactctcactcttcctggattaccaaaatcttgaggatgagtcttttcaggctccaggatgcaaggtatatccaagtacctgcaagcatctaatattgtctttgccagggggttctccacaccatactccttttggcatcttcttccttctttaacacttctatttttatcaaagtaacatgggtacaaaatttggaagcttttcaactctgccatttctttttccatcatttcgtcgggtctaatcacttgatccttgtttatggtgccaccttctttgaattgttcaatatactgacttatttgatcctggttaggaaccaaaggagtctgtccactttcggcatcttgtgatctgacaacctgaggagctggtctctgctcagctatcggagtccttaaagtaggatcaaactcggctaaatccatctccaagttgtctatgtcctctgcatcacttatttcctctagtaatggcattttgatcctacgacacactggtataagaaggaagaccaaagcactggagaacgatgaattactgttttggtgggtgaactaccttatctgagccttattatttctaagctcttagcggaccggggttccttggtagaaaccaatcagcatcatcttcagctctttcaagatgtctagctcagaggaagaggaagatactccgatgactgcgctctcagaaaaaaaactaaggagggaaggacagaaacttttgaggtattttgaagacactcaggctcaagatctggggattcatctttactcagcattccttctatcaaaacaaacaaatggtttattaccacgcaaaaggtggcacgcatggcctttagcaatagacaaggtttcagatccaaagtttttcgatcgttatgtcgacgaaaatgagccttatcatattcgaaggtggtctgggacgcgccatcaaccgataccacttactgtttcaaagtctgagcatccctcagaaaccattgcatcgaagcctggttctacattttacaaagagaggcaggtctctgaatttcttactgatcctctacagatcttaaaagaggaaataaatgcagctttccaaaggaagctaaaccaaaaaattcacatatcaaaaacaaaacattatcaaccggtaataggttcggagacaaatattcctgaaatacttatcaataagattctagctcgactgcatcacatactcatacagctggctgttgggaggggccagactccagtatcagcttcagaatttttaagtatcaaacggtcaggactactggattggatggatgtattgatggcatgtcgagaagactctcctcgcgttcataaactatttgatctagactcttccgatgccaagaaaatcgccagaagagatttgtttgaattgtatcggccaccagtcagatctagaccaagaaacgcagtagtagatgaagagaatgaatctgaacaagaggaaatcaataacatgggtgatccgtcctgtgtaagaagagtgaaaattatgaacctcaaacgggaattgcttgcacaaaagccagattttggttattgataaatgtccttccgtcctgtattattatgtgtgtctgttttgattatttaatcataatttatcattcgaagcgattgtttaaatcggatcgaaaaacttccaatgtgatctcgtctaaaagattcaagacaagactagtgttgagagtttgattttgtagtaaacggaatacattcttaccggcgtaagaagagttcgtctccccaaacactttggcaaaagtgcccacaaacatcttatcaattaatttttccgcctcatgtttggtcctactcttgacttcaggacttctctcaaccgatttcctgaaagggcctccatctggccataaattcgaatacagtgtatccagagcattgcaaacaaaagtctcatttttgatgtagaattccaggtactcatcacatttcctttcaatggtagatcccaaaagctgctgcagcacaataagcatagcccgtcctttgatccaagaattggatttctgagtggagaaaagactaatcaaaagatcgcagatgggtttaacaaaaggtgtatcacctgttctcaaagatgattcgttgaacgtggtcaactcctgttgcatttctctgactttttcctcaaattctttattatggagatcaaccgatttctttgaataacctttgaacgatggaataggcatcaggaatttccctgacaataatcctcttccaaacttgtcatactttttttcttggtaaaattcgaatatgtcagatgaaaggaacattttgaaattacgatcatcgcaaacctgggaaatacttatcagtttctgcaaataatcttctagttgaaccattcgttcttcagccagagatttcaacttatacttcatcaccaccttcctttttggtaaatgtacaaatgctagttgctgcgggtattgttccttcaggtattcattgagcttgaaaaaatggctaaatcgccgagccactatccatccagccgtaacaatgttgttgtcgtccactttctgaacttctattatgtacaacgtgaaagactttccttcttcctcagcatctatgaaggaactaatacggattcgtgatttagcatataaactattgtcactctcttgcacgatgtattgttgtttttgcaaagacttgaactgtatctctctttccaacacttcttttgacttccttaaaattctaagctcgttggaattattcgttacttctgcttttctcaacagtggtaacaaaacatccaattgattttctaaattgataatttcgttggagagctttgtgatttcctcggaaagattcaagtctttcggagcagccatggtcaagttagtatcaggaactaccgataatatactctctgtatcactaatttcggttttcttttcttcctcttgaaaaaatttgtcgcccaacaggccaaacaaggcactatttttcattggtgatctcgtacccgaccttgaatcgtcgttctgaacatgtggtggaaaaggtgaagctcttgagttttccaaagggtttctatcatgtactatctcgttcagggcatcttcaacagcttttagaacattttcactaacaaaggaatcgtcctccgaatcaatgcgctcgtcgtcgtcgtcgtcttcttcgtaattttttagggggtctccaaatccgtcttcttgtttctccacttcgtgttccttgactaaattgaaatatctggactgtttaaacaattcaaagtcagtttgattcatttcttcgtagacttgatcctgtaattgtagcatggaaagccttgcatttctataaacttgctctgtggggtgacgagagttgacaaactgttgtacattggcaaaaatctcactatcagcttccagtatctggtggttgaggtacgaattaaataagctcttaacttcgttaactttcttgtctccaaagtcaactaatgaagacttacttagactggaaaaagtggctacactttccagtgggtctttgatctgattcacatcgtaccaaaagttcaacacttcaacgttattcctctgctccatgaaagctttgaacttttggaaggaatctggattaaacaacacatctgatagctgatcagtatctttgtacttctccattaatgagtcgactagttctttcagcaactccaccttgtgagattcaagctttgacttggagagataggccttatagcggtctaactgatctttagattcacattctaagatcctttgtctcagtagctggtatttctcgtcctttagatcttttctgtgttttacggttgatcccttgacctgctgatttaaaattgatcgaaactgttgaatatgatcgttatcctcgacccagactgaggtaaactgaactatcttctggttataatagtctggatccgatagcatacatgttatgggagatataacccaagtggtaagaatctctcttactatgatccgtacaatgcgagactttgattcctgatttggcagtaagatccaaacaagtctatcgactagtttattcaaatgtctcgttgtgtcttctcttgaagatgatgccggatggacagttgtatttgttcctagaaatccatcgtaatgcttgactacaatcggcaacagcttcaagacgaccaatctggtaaaatttgtatctctgagtctctcttctagttcaagaacgacttcggtcatgtaaattttcaaatgttcagggaaactagaatcttgagttatgttcttgtgccatgagagaacaaaatcccttattattgaatcaaacagaagatcaaactttgcttgcacatcaccactttggatggttctaaaggtatcttgaggcttagggtcattcaattgggttataaatttgaatcttgggaatctgagtgcaagattgtcatgttggggtgaattccaggatggcctgcgtacctttaaactgagccacacaaggccaagtaagggaacgaagctgctcaatacacataatactagtatgggtactaatttaatgaatatgagagtgaaaatcagtattcccagtcctgttgacaagagggacatgtcatatacactgtcactcagttggatactttttagataagacgtgaagatgttggatgtaattacgtgcgagggtgtatgcgagttgatgctaagaatcttcaaaaggtacaggattcataaggcggccagtagagcaaacttatagctattaaacgacgttcatgatccggtaaatcatagcataattctttgtcattcatgctcctcactttacggtctcaatcccttccagttcttcctctctcatccatcagtcctcccctcctccctcctttaacggaaaacgaaaacgaccactttcatccaattcgcggcttgcaccatcaaatagataacatctgcctctccttcccttaaacaccctactcactccaatcacacaagatggaagaaaattacgacgttattgttctaggaaccggtttgaccgagtgcattcttagtggccttttgtcagtcgatggaaagaaggttcttcacatagacagacagcaattctatggaggtgaaagcgcctcattgaccttgagtcaagtctacaataaatttaagccaaacaaaactgcagctgaaagtttgggaaaagatagagattggtgcattgacttaattcctaagtttttgatggcgaatggagaactgacaaatatcctggttcacactgacgttacaaggtacattgagttcaagcagattagtggatcattcgtatacagggatggacgcattgctaaagtgccttccaatgaaatggaagccatcaaatcttctttaatgggcttttttgagaagagaagaatgaagtcatttttggagttcattactaattacaaagaagaagaagttggaacccataagggcctggacctagataagaacacaatggacgaagtgtactacaagtatgggcttgaaaaaggtacgaaagattttattggtcacgctatggcactttggcctaatgatgactacctgagagaacctgctagagaaacttatgatagaattatcctctacttacactctgttgctcgttttggtaaatctccgtacatttatccattgtacggattgggagaacttccgcaaggttttgctagactatcggcaatctatggaggtacttacatgctagataccccaattgaagaggttttctatgatgatgatggaaagttcactggagtgagaaccaaggagggtgttgctaaggcccctattgtcatcgctgaccccacctatttccctgaaaaggttaaaaaagttggacagaaagtcatccgggccatttgtattttaaaccatccagttccaaatactcatgatacggactctgcccagatcatcattccacagaaccaaatcggtcgaaaaaatgacatatatattgctgttgtgtctcattcgcacaatgttaccgctaaaaaccaatatttggctatcatttcaaccgtcatcgaaactgacaggccccatgttgagttggaaccagccttcaagcttcttggacctactgaagatgtcctgatgggcattgctgaattgtacgaacctttagaagatggatctaacgatcatgtttacctttcccgttcctacgatccttcttctcactttgagactaccactgatgacgtcaaagatttgtacagacgagtaactggacacgacttagtactcaagaagcgtaagactgtagaggaagaggaatccctcgcctgtgagtagagtggtttatatacgaggctgaaatggccctcatcttttgtaaggaagctttggattatttaatacaatgataagaaaaatattaaaaactttaataaataaaactaattaggaaagtttaacttttatctagcagcatcaactgtttgcatcactattttccttgagatggtggagcgtagtgctgttgatcggaacaggatctgctttagtagttggttgttcgtcattggtagcattatcaatttctttgattggattatttttaggggtatcttgatcttcatcttctgaatcagtgtatgatattacatcaattccacggtatatcatcatcagtttcttattgtgaggtatattgtcagccgcggtactctgctcaaacaatttgctgacatagcttgattctatagctttaaccaacttggacgctttatcctggcatcgctcaggagtaaacgcgggaccaagatcagagctgatgcgtttccaacggttgttccaatccttcttgattgtattaataagtctgatttcatccttctcagaccagttagcattacgcagcttgtgagtacgcaaatatctcatttgcacggcctgccaggaatgtgtctttccgataagttgagcaatactcttccaggagtaatgcatttgttctttgtagtaaattattagcgagtcttcttcttcggtccatttctggatgcgggcaactttatggccttctcttttaaatgtgggggcattattctcatctgtggttcgttcctgatatgacatttcatgtttagatggtggagtgtacgggtaagcttgttgatctgcttgtttagaaggagcagtaagagtcgaaggagtcccacccaaacctccaggaatagaggcatttcctctattcatgtccacaaatctaaagttcttcgggtcatccttgttgctagactctttgtcctccgttgcggggggagccatctccatggggtaaaaacctggagggatggaaccataccctgacgggttaggcatgtaatgctgtggagacagtgatggatattgcaagggcaaaggcgctggatatcctcccgagaacactggttgcatatgtgtttgtggaacgtgtgagttggggtaaatattatgctcgttccgaggcgagtcagacgcgaggtcgggtttggagtccaagctctgtacgagttgctgaagaggcttgtttgagtctgaagaagtaggaggctcatccacagacttatcggtggtttttggatcgtcgtccacgacaccctgattgttgttatccttatcgtgattggaacccattaacgagtgaattggaggtaatttggtgtccttttcatcagaaccatttctttggcgtttcttaggctgttttcccgactcggagctggagtctgaacgtttccttgaagtatcttgagccatttttctggtcttgctggagaatggaatctctttgttcgcaacaaaaccttctcagttgaagtgacaaagaaaaacgaaacaagaggttagagatccaaagttcagaaaagtcaattggggtggccaatagttttcaggtggctatattcaatcgaacgtttgaattggagacgttatacgagcttgagaggtgttgtttaacaacaatggggaagctataatatacaacaaaagaaaagttttttgttgtgctcgattatgactagcgcatccaaggtgctttcgtctaagcgatacagaagcttagaggcgcctggacgttgaaaagtatcctaaaccggtatgcaaggattctttttagatttgaaaagtatttgcaatgttttggagctcaagagatctcagttgaccagactattccaagactcaaatatgttctagtgcgttactacaaacaactgttgtactgttgcatcgtttcgagcaggggagtcgaacaccgtacattgcctacagacgtcttaaaatccttctaacaggctgccaggtaaaaggtcggctagttacctggagcaaagagcagatagttttcaaaaataaggcgtaagtaaatactttgtcagagctgatagtcctgctgtggtctatttagctatcagtttctgcgccacacagttcgtcttgacgatgttgaagaaacagtggtattaggtgggttgatattatgatggatgacggtccgctgaacttccgtgtgttcctccgtcgatatagcattttctctgctcttgagacggtcgtttactcgagtgtttgtattttgcctgattagaagcttggttttcactgcagatgatggggtgttctgctctgcgctttggtaaattcctgtcaatgagtgtctagattttgatgatgatggtgattggtttgggagtattcttgaggtaatagtggacgatgctttggtaaacacatttgaacccttgggatgcttatggtcctcggcaccaagccagtcaggaaacggaagatctcttgtaatgtagtagttaaccagagctttgtgtaccagcgtatcggtctctttatcaccgtcagactcttgatgaagcgacaagttggaaatcccagatgcgattcccgacgtaatgccgctagaaattcccttagaacgctgctttaccttagaccataaattgcgagactgttcagatggctgcactcgtaacattatcaagtttactcaagctctatccaggccaaagagtaaatgagaaaagacaaaaccagcaatcagttggccccagacaaagttgtttttctggatacgatttctcactattgtgattatataatcagaagttatacactctataaagtcttctcagtcaagaagataccgtacttctccttcaaagtcttcatcaatggattgttgatctcaggagtcataggagcccacaaacctggagtgcttaaagtaccgtccaggacttgctcgacagcaacagcacaaggcacacagggaattggcatagcagagtatcccttagggtcaccatactcaaccaaagttgaagttctagtttcagaggagccatcggcccattcgatgccaaacttgtgttgcaggcagactaagtcacgctcgtgctcctcaaattgcatcagctcttctagagtggcacagagtgtgtctaatgggttacctcttggagtaatggcattgtcagagaaaagacccaaccatctcaatccgttgataattctctgttgatcagcctcattcttgaaagtagctttggaagcgatagtagacacaaggtcagcttcagaagaagaaggagcaccaatgtactgtgccaaggcatctttccaagcaataggcttggagaaaatttcattggcgtcttccttcaggaatcccaagtcaacaagaaccttgacaaactctgggaaaccttggaatctcaaagtacctctgatgacggtttcagcctctggaatgttgtagagttccttgtaagtggttgaatcacggttagggtaacagacgaaagcaaatcctgggtagatgaagtatggtttggcagatgccatcaattcctcagaagagacctcctcgattttgccatctttccagtatttggcctggttggtaagagctaacaacactccacgagatgaccaagagaacttgtagcccaatggattgtctgagtcttctggagaaggtaaacctccacagtaagacaagaaagacttgatctttccaccggcacggtggacttcatcaatagtctttacagcgtacaaatggtcaataccagggtccagaccgatttcattcattaccacaattccagcatccttgatctgctgctccagagccttcaattgagggttgatgtaggacgtagtaacaacgttcttcttgttcttgatggcagacttcacgacagtggcatggtaaatataaggaatcaaagagatgaccaaatcaacctgagatacagcagcatccaaagcagcttcatcggtgacgtccaaggaaatagcctttgcaacggagccagctaactccttggccttctctaaggttctgcatgcaacggtgacttcaatgtccttgttggcggagagaatatcaacagttggtttggcaacaaagccggatcctaataagagtacttgtttgaccattcttctgattttgatcgaaaatttttcacagtaaagtttcaaagaataaatcagggacagatttatttctatgactattcaacgtcccaatgtggaagatctgggcgcgcctaagtagttgctctcgatgacgggatggattacgtaacgacgttttccatcgggaatgggatgggaaagaatgaaaattgaaaaaccgaaaaatattgattcttcgtttcttttcagcttatttcttttttcttccttcgatttttaaatttgagcctatgattagttccttcacagatgtggagctctgatcatgggaacttatctccatagctatgctaacctaaagtagtggtggtaaacgaatcccaaagattgattagttccttcatggggctatacgttttgcagaagtctttgcctagataatgggttctgtacttttgataaaacgggacattcctttaaagtgaatacttggaggctttgattgtgaggtcatgcttttggtaagaacactgccattagtatgggatatttgtaggagatgacgatcttgttttgtttccttttataaaagcatggtagacagttggttccatttgttcctattttttctggtatcttcctaccatttggttctagactttctcagaatcctcccccttcgttattaggacctataacttcaaggacatgttcgatattctagcccgatgtgatgtatgagtacactcaaatctattaatcatatttgatcactagtcagagaattcagtaactcatgtccctatcatttattgtcgaatgggaagtaacaagtagaattaaaccattcctgtctatattatatcctaaagggaggaaagctggataaaatgctcctagataagtggaagtcgaagaaataaaactgtaagtaagctattgaagattgaagtatctcttttttggcgagtgccatgttctaaggtaaacgcagtgacactagaattctgctaccccctggtaaactaaaagattaaatagtttaactcacgttcctctagtgttcacataaattgaacaatgtattgtaaacaagaccatcaccccaatcaaactcttctacgggagctctctctttcatcaacctttctctgactctcttcgcttcgtccagactcatagtatactgaactttgctagcgatctcttccagaattttatttgaaaattggctagatgcctctttgccaaagaaagaagtaatatcatccaccaacatatcttgttgctgaggtggaaccttatcgctggcaatagtatgcttattatttgggtccaccaaaaagaagcaaagaatttttctatgacctggcttcgttttatcaactaattcaaacggatcaacatgatgctgataaaggtttggaaatattaaaagtctattttcaatacaatcaacagaccccaaatatctagtcaagtttccttcatgccaaagtccaaagatttgtctgattccatcatgatcatgttgctcataatgtggctcaattgtagcattacggaaactaagcttggattctccaatgttttcagaatcatagtagtacaatactgtcgcaactatatcttcattaacggtaccctcaacatgccatgaacccccaggataagaaggtttctctggagttagatggatgttagctaacttagtaattactttaagatcaccataatcagccaagtccacctttttttcaaaaacaggtggtttaaactcaagaaggaatttggatttgttaatataatttactctttgactttcaagtaatgaccagtcgtcgccaaagtttctcgctgcctcaagtgctttcacttttttgtggaattcatcagtatatacccaatccctatccatttcgtcaaatctggggtattctaccctaagtctttccaagctactcaaatgggtcaatagcaggttcaatccaggaacagctttagaaaataccgaggcaatcaaggggtacagggtaccgtatttcaatgggtcaagattattgatgtaagattgaatctccacaacgtagtctccatctttttttgaaacgttaaatatggatggaagccactgcaagtctccagatatgtatttgtttgaaaaataaggagcgtacttcggaacttcgttgggaactattggtttagagacttcaaaccccttttcagtcaacaccagtgtctttccatgctgtaaaggatacaaagaaggatggaccaaatccaacacttggttatcacttccaggatgccagtccttggcatcttcgggaatatcctccagtttctcattcacaaactttttcaaggattctctgaaatcatcaccaatagctctgtccgaaaacaggatattctcgttgggacctgcagtgaaccctttctcttctgcgtacttgtcataccatgctagttcttcaaatacaaacttccagatcttctcagcgggatgaagaggggcaatgtcttccaatttcaattgaccttccatctcggcgatccacttctctctgatctccgcattcttgtatttggttgtccagtcaggtttggacctgatcgtatagcttagttggtgtacgatcagatcgtctacaacacgaggaaaacacacgtttggttctccagatagattgtcaaataaaggatgtgggaaatgttcaattgcagttttagttgccattgttaaggattttttcggattgttacgaaaacttcagaaattcaggggataatctccggaaaagaatcccctagcaggaacataacccaatgtggtgattggatatggtagcgaaggtcaaggaatgaaccccctatgcgcggctgacatactgatcgataatgacgtattgggagccttcaaactttcaagcgctagagaatcttctaggaagcaattcacaactggtaagcctcctaccttttctccctagagcataatatctggtgcattgtaccctaagatggcactttgcagttgacaaggttatgattttgggtcgataatatgacgcactttacctgtcagctaaaagtgtctttctggaacgcatctcttccgtctgtttcttgaaaacaaagcaaaaatttatctccctacttaattgatgattacaggatcgttccaagaattcaacaacttctctgaagccgctgtaatcattctagcttactggtggactttatgatttcggttaaaaaaaaagattgcagcacctgagtttcgcgtatggtctcccactacactactcggtcaggctcttagcagcttaactacggttgatcggacgggaaacggtgctttctgctagatatggccgcaacctaaagactaattctagtcaaaactatatgcagaatttaattaattgatattaggcttccaattgaattacttgaggtttcaatatttatacttatgatggttattactgtgaagaaaattggaagttaacgttcttttttgtgatttagtaacagtatatttatgtatcttagtaattttttcattcaacttcaattcatgtctactctattgactagtaattcattcaggagaaaaaaagtgtaacaaagccctcgtctcttggaaacagtgaattaaaaccttcaaagttcaaatatcattcagttagctcaactcttgaaaccctttttctcctacaatttggtttcttgactacttctatgaaccaatgtcacctcaaaccaatgacactcgcctggaaatctagaaattatcgattccactaaaatcggcagtaattatgaaagtctcataatctcaaaacaaatcgacgctcccccctctttcatagaacgcggtttgatagacaaaaacatttcagcataataacaccaatggaaaacctcccctcaaatctatcagaacagataaagaatctgatagaaaagtatccagagactgaaaatgttttcaaccagcttattgacttggttgacgagggaaccctgaaagaggccaagagagtcaaaatctctaatgagatcaactttgctgactatacagttatattgcagctaccaagtttatccgtccaatctcctttccgatcgaaatcgaatcttatttttgcatgtcccaaaagtgacacaagtaaacctatattggccatcgcaaagactaatgagaagcctcaattaatactagacaagttgaacgacgagaatgtactctatgctgtaatcttaccaatcccagagaaaaaagacttcaaaaatttggccatcttctacaaagagaatatgggtggagttcacaagaatgagcctttactgattcaatacaacgagtctttaatatcggaaagtcttaaactaattttgcagaaaatgacattcccgacgtactttcagagacaatgctccatgttaggattcaaactgaatttgttcacagaatcgaaggatttctacgttgttgcccacaaaggatccaaggaaggattcttgtattttctagaagaccagattttgtttggttttaaaaagcccatcttattgtttgaaaaatctcagattgagagcatcaactactcttcagtcactagactaaccttcagtatcacattgtcgtataaggaagcggataagaccgcaaagatagaattttccatgatagaccaagctgagtttgacaaaattgataattacgtcaaagcaaaaggatttacggataaatccctcacagaagaacttaaggcaaagtctaatatgaagaataatgagacctcgggagcattgagagaagctgctttacaaattccaggtggtgaaaaaatagtgggcgaatcaaacattgaagttcaaggcgatagtgatgacgaagatgtggatggaacctaccaatttaatggtaatgaaagtgaggatgatggcagtcctccgaacactgatgaggagactgaagaaaagggagacgatgccaaagaggatgacctcaatcaggaggccatcaaaatagacaactagagacctcctttcttccagatctattaatgacaactatacccccttttcgcaatgttctgtctaacttcgaatgaataaagtacattaacaaataaataaataggacatgactactgtatcagcaagttcagtcatcttttgataatctaaggttacgggattccttcaacttttcaacccttttctctaataacttgtcatttctctccgtccaaaggttaaatccatatccgaaagcgacccaacctaaagctgaatacacgtatccaagagggtagtaagagaatggtactttcctgattccttgttgataggctctaactgtgacacctagaaatgttagcacaacatttgccaaaaacaagcaccactcatcttctttgaaattggttacttaccaaaaagtccccatccagcaagcgaggcaatcattttttctagctttggtttgtgacttggctgatcggtatatttctgaacgttctggttggttttcagggtgattgatgagggtagcttaagatggtcagcacacgaccatacaattgccaggaatctttagatgttggatgtcaagtaatttaacaacaagccttcctgaaaaaccgtaaatacttcctcattttgcggtgctaatcgaacaaactctgttctttacaaccccaaaagaaacccaagttataaagagataagatccagcacggtacgaacatcctagaacatgtcgtttatactcaaacgagaggggagttttgacgaggacgatcatccttccaagtttaagaaagtcacggattcttttttgggatttttgaagaagaagattggaaaccgatctcaagatgaatatgttcaagattcgttccagcaggactcattactagagcagcaaacagatatattacaccccgatactagtagtttgcaagaggtagacagtgtggctgatcagtccactcgcccttcaaatgtattctccagttattacgatttattgaagagacagaaggaacaatcggaacacacacatttacataagcctctatctccagcccagccaaagcggatgaacacacgttcttcgtctcagcagggtgaggaagacgtgagtttactttctaagaggcaaagaaacacatcttcactggacttggtgccaccatccaagaaactaaaatctgtggatagcgtcagaacttcgctagtcgacataaacccgatggaaagggctttgctaatcaacctgaaagagagaatggaaatggataaatattttaagtctagggtcaagtacatgggatttcataatcgtcacgtaaggaatagtggcggaacaaggtctttccagaatacccgttcaccgctgtttttgaaatcagttgctacacaaaatcttagaaatacaatatctcaagatagaaaaaaacatggaggctacttcagtggtgaatttgagtacgacctggatgactccactaataattatccagaaaatcaaaacttgttacagtataagcctgcagttagttcactgaagttttcagacaaacctcaagataaataccaccccaaacctgcaaatgaagcggatgttgaacggattatcaatggaagagtaactgaaccagtttttaaacaaaataaatcgaacctagttgacaacgaaaaggactctattggaccctctataggatttaagtttggggataattcttcacaatccgagaatgaaccaaatgcaacagctcttgagaattccagtcagcccttggtgtcgaataataaggcagcggattcaaagcctaaagtttcatttggcaatgttcaggaaaagaaagattccgactcttcgcagaaagtatcttccaagattgacttttccttctcttctaagaaggaaatttcaaacccctcctccttcacgacttcatctgcatctgtgaatggcacgaatgccccaactgaggtacatgccaaaccatctttttcatttacggcacctacaacagcaaaaccagcattctcgttcggagcgccaaaaatcgatgaaatcaagcaggacgatggaagtcaaaaagtatcttccgcggcaagcgctggtgacataaagtcggcaacaattccaaccttttctcttgcggactcatctgatgctgcgaaaaaacaacagaaaccaataggagtatcctttggtctagactctcagtcctcagctcaagggcaacccaaaggacaattacccagtttcaatggttcagattcagtatcttcagacaaaacagaaccaaagccaaccttttcctttggaccatcaggaagtacatctcagaaagatgatggaacaaaacctaagtttttgtttggatccgctggcactgcctcatctgagaaggcaactgatattcaacccaagttttcttttggtgctggaactgctgcaaatgataagagcgacagtgcaaagcctacgttttcctttggatcatctaatggttctacagccacagagaaaaaagataatgctaaagactcttttactttcaatggtaatacggagcaagcagctgagccagagccgaaaacttcctttagctcaagtacgccaagtgatcagaaaattgaatctaagcctgcgttctcatttaccacctcgtcagaagtgaagaccggagagagcaaaccagcattttccttcagtgctcctgctaacaaggaaacccctaaaccagcattttcattcaatgactcttcagaaaagaaagagcaacccactactaccaaatttggtagtcaagataataaaccgtcttccccaccaaaaccagtgttttcatttggaagtaccaatgcccagaataaaccgaacactgattcgcagaaaagtttctctttcggaaaagaaagtgcagacaacagcaataagcgcacgttcggatttgatgaaacaagcacttcttccaagaatagtgcttcagcatttactttcaatgtaccaagtaacactaccaaacctgccttcagtcttggtaacgaaaaaggggaaagcttttcagcccctgctttgagctttaacaataatcccaatgccaacaatttcggatttggatccattaacagtaatgttgccagtgctggtagctcgaaggagccaaccccctctgtggtgaatttctccagttcgaaaggtacttttggaaccagcacacagccttcagttaacaacaatgcctttcagttcggtgcctccatggcaaacaatccttctaccaaccgttctgaaaacaatgcgttcccacaacctcaggctggttttaatccatctcgatcggctactcccaatttcaatttcacaggaacaagtcaactcgatccggcagctatttttggaggttctggatccactccacctgttccatttggccagccttctgtacaattgaatcaaccccagccacagactcagcataacacgggtttttcttttggatttggaaaccaacagcaggcaccgtcaggaactccaacaccttcaacaacacctggtgtgaaaggcagagtacttgctcgaatgaggcagagaagaagaaattaaagtatgtaatattagtttatgatacgtaatccattttcattgaaatcttctgttttcctttcactgtgctgctccttcttatttgcgttggaaatgtaaaattcagcctggtcaattcgctggactagttcaatcatgctcttttccccgtaattagttccatatgatgagcaaagctgtaaagtattactattccaacggtctataatacgagctctttgtttctcgttcaatcttgaacgagggaaggatcctggttccacaaatgccactatatccaacattaagtgatggacgttgagaactgtgttcactatcactgggacgagagaggataatttgaagttttttctaggttcaacgaccaaaatagcgtaaccatcacacttgaacaagcaggtcgaaaggatatcatagattctctccacagttttttcaatgtcacaagggaaatactgtagaccaagaacttcaattgtttcggcaatttgacccaaaacaaataagagctgcagatcaaccacagaattgtcagacgtagtctttgatacattatgcaaaaatccaaagtctccagttcgaaaataagtgacgccattttcaccacctttcaatttgccttggaattgagccattgcaaaactgtcagttctgccttttccagtaacaaaaccttctgcatttgcttccgagcagacccaaatctctccatactcacccacactacacatttctaatgtctcaggattaacgatagcaatctgggtacacacaggaacaataccggagtcttgcaaatgcaaagcgtggtgattggtcttcgggtttactaatgagacatatccctgcgacaatgcgataggatctaaccacaagtccactggttcaaaagacaagtaagatctggaagtaatcatcggattgcaagggtgagaatagacattgctaagagcatcagttgggatctgggtattcacaaaatgggttaaaaaatttcgataaagttgacaatcaggacgacctgaataactaagcatgaaattcttgagatctccaagatcaaccctttttgtgtccattcgttgaaccgcatagtttagcatactatcagtaccaaatgtattggtaactttgtatctggaaagagccaaaaacaaggttttgggattgctagaataatccattggagggaccaaatacgtagaagctccaacaaatactcccaataatgacgactgaacaaatccgatccccgaatgatgtcggacacatgccaacaaaggtttaatacttgatacttgacaagtttccttgaatactttgcacagccccataatattggcgtgagtgaagcgaacacatattctatactggtcagatgtccagtacgttagtatcaacgcagtggtgaacggttttctatagcctgcaccagcttgaaacttcgatatctttgagtttaactgtcccactggctgtgataccttagtatatttggtggtattcttaattttaggtatcactagcttagcgttcaaagctacacgcctcaactcatgtgaaatttgcttcattttaagcaaagcttccacttctgtattggcgaaaacccgagctactttgaagtccttaacaattccaacaaatccctgaacatcctcttctgccctattaggatcaagagctggtaccggtataggtattaggcccgttttgaaacaggcatataatgcaataacaaattcctcagaaagcgtatacatgagaataacatagtcaccaggactaaatctttgtttgtcaacaatgtatgagcataacgccgaaactctctgatcaaattttttccaagataatggttttagctctttgatactttgtttgtcaaccatagagaaagccagctcctcagcttggttagcagctctccaagccaaaatatcgacaattgttttgaagtctgtaaggggagcattggttctatcatcaacactttcttcacgatagtctagaccggagtattgtctttcggcaaactcaaagatcttttgcctttccttagattgatattgtgaccaaataccaccggtaatgtcatcacctttggaaatgttactgacggcatgagacacattaaacttgatatatcttcctgtcaaccgtccttcattgaactttcgcttgcacaacatgttagcaatttctaagcgtccgtgtcttccagttcttggtaattctaaaggaggcaccaccaagatacaataaagcttgacgttgtcgacgtcctcaagaacttttatacacttactggaaagctcttctagtagttctttatcggtggctacaacaccatttttttgggccctttgttttgctagttttgtctccactatggccacagggagatactcttgattgataaaaatgtcaaaaaatgaacagtcttctacctcttttatgttcctaaccagagtttttaccaaatgacttgaataatgatattgatactccgaatccagggatttcagtttcttcgcagagtcagccttagaggcctccaagcgatctctccaggtcactctttgccttaggcggtcttcatataaccctaaaatgtaaactttgccattgtatgtaaagccaaggaggccagttcttaaaaattcaagatctagaacaccctcataatcactgcacttagcatggaatattgtattggtttcatctgacaaaccccaaaatcctccagaaatgcaaggactatctacccaaatttcgccaacttccatgttggcgctcaatatgttagtttcaggattcactattgctagagtcgcgtctggtataggataaccgaaagctcccactcgaagatactcagcagtatctgatactgttgccggtggtttgtcactgactactttgactgtattagtcattaacgaggccctgtcaatcagaagttcggaaagatcggaagatagtgtcttggaatcgattaaatcatcgttcaacggtttgtggtacgaataacccaatctctcttcccctccaagccaatccctcattgatattatcattcctccatattcagacaagctgagtactggagcaacaattctatgagcattagtacagcctaatggagtgaaccaacgatcgatcaacaattgatgaaagtctccttccacagttagagagtttattagacaccacttgacactcttcaagttgacttttattttcttgctgtaagttctagtgagttgaggaaaggattgatagttgtaagtcacttgtttgaggcccaaataatcagctaatagaatgttgacttcatatttggagattatatgagcatacaaccccggagtctccattgatttttgagcagtccaaaccagtaggtttcccgagtaaatggtgtacaatatacctattattaacccacttgattgtctcgggtctaatgtggaaagaattacatttcggaatttgttgaaagccactgctgaccttttcaatgaggtactatcataatcaggcatgcttgataaaatagaggttatgctattcatttgatgcattattgtcctgtgggaaagaacgacacctctcaattcacccgtaggcgacttgctgtattcaatataggccagatcaggaacctgaagagcaggagaatcatttttcttggaaatttgttggtaggtccccatatctgtacttttccagatatccattcctttgggccatttggttttcgtttgtgctccaggtccagtcctttcgaaaagcttgatagaactttctgacattaaacacagatgggcttgagtgtcgttcataattttcactaattctttgattggatacgaactgctcaaagggatagcaacaactccagagaggaaacaaccaaataaggctactgcaaactcaacaacttctgtttggtggtatactaagcataccctgtcacctctgtacaaacctgatttgtttcttatttgttgagcaattctttctgctttcaagtaaagtttttcccaactaattgaagatgattctttacccttttgatcaattatcagcaaagcgatttcttttttgtagttagtagccctttgtcgcaaaatagagggaaggttatcaaatgactccaaattggattcgtcagctaaatctcttggatctagtggtttctgcaactcaactctctcaccgttttgaaagaacctaccagctctctcacgattgaaattttgattggagtataaacttggagcagcatatgatgtacggtcttgagtagaagataagtcacctctataattagttccattttgcgaagggtagggagaagttgcagtgtataattcatcttcccccgttgcaagatcgaattgtttaattgggcttatgggtgttgacgtcgaactaacaacacttgaatttcgattgtgattcacagggacaaaaggcgagtcgccattcaggattttttcccttttctttatgtatcccttttcagtcaataagccctcttcatactcattacgtagctgggataattgagcaattatatgctgcggaacgtccatggggatgggaaagtccattttgtctcgtctatccccttctggtaattatcacgctgacaaacaaagccttttttttaactagaagactcagattataaagagtgtctgctcttgaatatatgagttgccaggaggtgtatatcctgaccgggcttattccaaatttttttaactacgttccagtagatgaaacaaacaccaaaaaaatactcgtgcacccgccaaattattatttttctggggtatgggtacatgaggtgctctagagagcaattatcatcgctctaacaatcaagattgcttctcgggttatatttgttcttcaatgtccataagtacaaaaaactctgtcaattccgagcatgatccattgcagcagccgaccagctctagcaactatcagactataccagagacgaccccgaagagcttacctcccgacagagaggaaaggagacctcttctgtccccagatgatccaagtgtatcgccattgaacgtcagaaacgtcaggatttgcaggttcatcctcggtgctattatcaacgtgtctttagtatggcttgtattattgttgatcagtgacttcgtttcagtaccaggatttgataacaggggtagaggattcatagaaattgatcttatattgctgagtttgtttgccaatgccagtactctgtgtttctttactatcccatcgaagttggaaagaagtttggacatggctatcgctggaattgtcacacttgatctgcttatcatgctattgtatagacggttcttacatgaccgaggcgggttggggtttgcaaccatgctatggctagtagcaagcctctcatttggtgcagtttcagattatttggtagaagaggccaagaatcacgaggaaattagacttacaggacgagtggaaagcagaaagacagtatatgagttttttgcagtagcaacgcgagttactcttcgcttgataacatttgtgctagtgctactgctttcccttaatttttggtttcaagcctacgacttcaaaactaaaccctgggggaaactcattccagtcggagactcacagctagagttgcacttggcttgttttggtgatgtctattccaacaaaagttttaccccagaggaattaatgtttggagacgtttcaatcagttcttctaaagacgaacaacctatcatcttagtagacggaggccagttcgtttcatctgaagaagcttctgagtgggttgaagaattatttcacctagataaagttcagagatattgtgtttatgatcatccgggaacggcattctcaaattcgttcccttcgccagtatctctgggcattgttgctgacttattgtacgaggcattaagcaaagaaaaaatttatggtccatttgtactagttggttatgatattggcggtctttattcaagaatatttgcgtccaggcatgcgtcacaggtacattcgatggtcttagtggaggcatggtcacagagtctgttgaaacctaacccttttgcaaacgacagagagaaaaacggcaagactaagcttgaagatttgcacaaaaccaccggaataagaagaatgaacgccaaaaccggtctttatttttggtggaaaggaatttatgcaccattcagtttgaagcgactgcgacgatttttggtacaccgtcacggcccagaggatcgtatttttggcaaagatatcacagttaacgataagttctggagatttaagctacaggaacaaattagtagctcactgattagctaccacgaagtcaccaatagtctcttagagaccaatgggatcccgatagcagtcgccagttcagacgttatgatcaaaaaatctgtaaactggggacgttggcagagagaactgaccaagatatccagcaagcctatcgaatgggttataaccaaggggaaccatcgcccttgggatgatccaaatggtcgaaagcaactgcaagaccttttgctgcgtgtaattgatgaagagtaagtaaagaaaaagagacatactagctcgcttttcctaattgtcatccttattatctaaatctggtagatcactgtcattttcagcctcttcagcttcagcttcaagatcgcataccgatctacagttgggacacatgaactgagggtaacttgtaacaatcatccgcctaatgcatttataatgccatgaatgggagcaaggactagtaaaaatagcttgacatggttccaaagtaagtaggcaaatcgcacactccatgggttccacaccaccatcctctggcgtggacctgcccggagccgaaagttgctggagacgtctgtatgactctttggaaaactttgcagccctacgggaccatgacttattgagttctactctcatcttgacacacctaaacgtttcctcggtgcccccacgaaaatcgataccaagctgtaagatgtcaccatcttgtaacctgaataaaggagattcggtattagctggtgctagtcgctgattattcaaaaacgtaccagaggaactctttaaatctttgatataccaattgccagacgaatcgactgtgaactgggcatgagatctgctgacaactttcgatttgaaaaccacgctggcacttgacccttgtggagcatgggctgcatctcttgacttctctgtgtatcttcctatggatatttgatgatttggcttgatttttctaattacagaaccaaaatatagtgcgggggctgttgtggtgtgatcaacaaaaggtgttaatctgatcgaatgaagtttcttagactcaggctctggctggggtagtggctgttggctagaggaggaatttaactgaagtagccccaaaagttcaacttctgaggcactaacagctgcttcatcttgtgaaatagggcgaaccatagttggcgaactgtccattggttgagaggagctgatgggaacaggtctgatcaaattagataaatttgagatcaagccacttgcgaaccccaaagaagatccgcgtctacggctattgccttcactatcaattagtgaaagagcttcaccttcgagacttgcagttgaagcttgaggattgctatatggcataactctttggcgtatgttctaccttgctgtcaattgtttcagggtgttgtttcgaattaggtaaaagggacaaacgagcttccgcgatacacttcatacaaaacacatttaggagatacacgatcagtttctgttctggttatatatatatacatggatgtgtgtctagctatacgagttaaccccatctgttgagtttgttgagtttcttggcggtctttgcatttgtctttgtacgttgacctctcactggaagacccatggcatgtctcaaaccggcgtacgatccgatagttctcttcaactgtatattttctcgtacgacactacgcaatttgccttcaatagtcaagtcggatagctctttcgttattgccatcacttgttgctcattaagctgatgcattctcatggaaggatagaagcccaatttagagcataatctttgagcagtctgcaacccaactccgtaaaacttggaagaaagacctatctgatttttgtgttgttagcattcatcgacccttaaaatacaggagactgtaaaatctttacttacgtctatcaaggtctttcctttgaaaccttttcccaggatatgaaccaccatgctttgaccaatatactgaagagacgagaaatgaatgaaatcgagatgttgaaaagatctcgaacttggtggttcaaggatgtcaaatgtcagatgtccacggccgtttttttttttttctcttatccatttttacttctccactccgcaattaacatagtccaccccgccacagtcacgtgcaagataccaatatcatatcaacaattacatctcctaagattgagggaccctagttaggactttgaatcggatcgtgatcgggccatcaagtgatgcataaactttcaaatttttttctcatttaactggcaggttggacgtgtggttttccttcactaacaaatcaaatgagtgtaaaatcgttagaaacaactcctttgatcaccactacagttgttcaatctacctctgatagcgaggtggataaagattcccaggttcagtttcccatccaacccgtcgacgcagtagatgaggacatttctatctgggatatacccaatatcttcaagattgaacttgcgctgttcactaatgtgtttgtgggaagttttgaaggaactgtgacatcatccacgtatgcgattattagtaacgagtttgatgcggtgaatattggttcgattattactatcgcttatctgatcaccagcacatctttccagccactttatggatcactttcagacgttttgggaagaaggttcatgtctttctttgctatcggggttttctctgtgggaagtttgttctgtggtttggctcgtgacatttactccctgtttttattcagagccatcactggaattggtggggctggaatcatctcaatgtcgactatcatcaactctgatgtcattccaagaaaaaagagaggtttgtttcagagtttccagaacattatgcttggtgtcggatctattattggggcctcattgggaggactaatttgcgacaccataggttggagatggtgcttcatcattttgttgcccatgtcccttttgtcattggttcttacgtacctttacgttagcaaccctccacatcatctcagtggactcaaattaagttcagttgatatcaaagggtctgttctgttggttgttggtctcagtctgcaattgatagcactatactccaggtcattacgttttttcttattttttttaatttccagctctcttctgcttttctatttcatctacgatttgagcaagaatgacccaagcaccatcaaattaataccttgggaaactgttaacaaactaccccagttgttgacattgaactttggattcatcgttggatttgccaactttgccaacatttatgtgttaccacttttgttccaattagtattgaatgattctgccacaaaagctggtcttcgtctggctatcccctccttctttacatctgttggcgcattaatcacgggatacgtgatgaacaagaatgtgaatcatttgaattggctgatcaagttgggatttgtgattctcattttgggtacatttttgaattccctgatcacccctagtctcaagaagtacgtcaactttattatcataccaaacaacataggtcttggaattgcataccctgcgtcattattcctatacattttccttttccccaatagtcttcaagcatcatcgactacgacccttttactcgcaagaggtgttggacaagtttggggaatggctggagcatcggtagtggttgcccacttggttaaattcaagctatggcacgtactagctgaacataagaaggacttggacttgactgattctcaaatagcagacataattgagcagtcttctaaatcattgacttacgtcagacatcttccagagaacatagctgtcttcgttcatagcagttataaagcaggattatggggagcacagatggtttccattgctgttctagttcttggtcttttagcttcgatttttaaagacttttcatcgaaggctggtaagaagttcgtgatctaatgggctacaaatagacgatcacgagatttttgtgatcaactgatccctagtatccatatttcctaccttatttatcaggatatcacatttgattagattccttctgttatttttcatagataagaattgttagaagataaacttattctattacagctaaactgactggacgactaaatcactgtccttcgaccttcgttagactaaggacaccctatacaagtaaaccgcaacctttattttcagcagccctaggaaccttcaggggtttcgatgaaaaaccctttctacttgacactccattatatctcgtttaagtccgtgtgagatatttcatgtctcacgtatactaagaagcgcgaatattttaagcttctcgtttacgaaacttctctttagactaattcctgtgatcagctattgccaataactggattattcgttctccaaagtatgtggacgagctatgtaatactgatactcagtatcatatggctcctcactagagctttaaagctcatcaatcttccaattgataaaggaatccggtctttgaatgtttttgttcctaaagtcccgatattatccaccgatcggattacccaaaattccataataatacactgggaaaacaaacatagtacatcgagcagttgttccaaggttggagatggagatgaaattgagcacagggaaggaggtccccgattaatcgtcaatacttcgcccaaggctgtcagtttctaccaactgtacgttaatggagaacttgtgaccaccttggaatcagcagtaaatatgtgcaagttaagcaatctgaagccagggacgagatatcaactggatttgattgcctttagcatacttaatttcagatctcgatcttctccagtatttgtcaaaacgattgagacaccatatcaaaaaatcgatgacgctgacgacttgttgcactttttagctcctaagaaggatgcagaaagcttgaaagttcattccacatttaggcaaaacagaacaaacatttacagtggtatgcccatctcagaagctaaagttcgtgacgatgttgaccagatcacggatatcgaagaacttagatatcttttagaagctggccaagaagatctgagatctttactgtttcagcaaactcaatgtgccaaagactttgaagaaaaggaaattattttgttatcaagcagagaggatctcaggaaacgtaagaaaatggaggatttgaatagaaatagcgtaagggcggaactgaatgctcttgaagaaagtaagaaagatatagtcaccaagatcatgaataaccagtatctgtttgatgaaaaaaccaaatcaatgcagaaaatgaaagatgaaattgaaaattggaaaaataacttgaaaacaagccagtcacgctgtgaagaacttaagtctaatgaaaagaaaatactgagagaattagatcagaaaatagatggcaagaaggccgacattaaggccgccaaattagaaattgaggttttggattcagaattgcaagggaatattgactataaaatggagagagaaagtctcaaagccgaaatcacttccattttgagttccctaaatagagatgcagactcgcaaaatgggcttctcaaaaaggatggaatttcactattaactcgccttaaacagatcaaagcagaatggggaaacttacttgaaactcaacaatcgctggatgccgcagctgattccaattggagatcttccgaacaaatggagcttcaaaaattgcacagcattaaagttcagtaccaatctttgttatcagataaccaaacccttcaagagcttttggctggtgaacgaaatgttctcacgctgccgcgtggccaaaccaatgtgggggaatcttttccgtcgctggaatcaaataggcccagtgtttccttatttcctattcaaatggaagcatcgaatagcagttttcagcctgcatattttgaggctgaagataatgttgaggatttgtcacccaatgttgaaatgctattacctcagtctttaattgaaagcgaggagctaatcctgaacaatttggggtcaaacacagtcgatatcagaaacgaggtctttttagataccccctccacacctgttttaaaggacccttcatacgaaacttcatcttttgagaacacggcgcaggctggcgaaaaatcttttaattctccttttgaattcaattcattgcatgaaagaagtcctagtggtgatggagcgtctttttttttccagaagtcccctcctttatctcatgcttcattagtggaaccccaacatttagatgaacagctatccaccttttcacccaaaaggcttagcaacgttttcaattttgggaagaaggcagcagcagccaacaacaatatttctatgactcttaatgcggactcagattacaatgcaaatcatactgctacatcttccaaattttttggaattatcaaacgaaatagtcaaaacactaatactattaacaacaggactagaagcggcagtttaggtagctcaatttggagcaataataatcctaacaatactggcacacagactggagagtttagggttggcagttggtctaataataactatggcggatttatgactcctcagcaaaacgatacccctgaatatagaagtccatcggaaagcctaattccaatcagtctgcctcaaattgacattaaaaacttgaactatgaaaatgacgatttatttctgtctcttagccacattacatcagatttagacgggcaacactcaaacgagaattcattaggagagagtgccttggaaaaaaaatccaagcaagaatctggaggttcgcctatagctttcaagaaacgaatgttttctcttagttcatccccttcaaaattggagaatgatcatttggacgataaccatcatggaaacaatcacggtccatctaaatcatccaagtttttttcaaaaatttctcggagaaattctacagtcacaaccagtagtgactccaaggtatcgcagaattcacaagaaaccacaggaaacggcttaaataccagcgatgcaagcatatcatccagttctgctgtatctggaacaaacagttccaaatttagcagaagattagggttcctcaaaaaagacagagggaaagaagctaccgacaaagctaaaatcaagaaaaaacagaaagaaatagggaaggataaagataatgacctaattgagtcaactatagacgaagtaagtgacgagtcggaaaagaattctccagcaccagaatagataggcggataatattcttctataatgagtggtggaaaaatgaaatgatttagcttaagcacagtggacttcgccatctgagtgtgtgtggcactctgttccagcagaagtagacgttgtagtgacggtagcactaccagaagatgtagactcttcatcatcctcaccaatttctccactgcatccctcgcctgggacggcgatgtcgtatgcatacacatctagagcataaaatcttagggaagcggtgtttctaactgcttcatctggactctcaatagccaattctaagcattcttcatacgtatcagcgtagtgatcgactgtcaattgaccaatggtggtagtgtgatagagtctgtggagcaagtcagaagcccagtagaggttgtttggatagttggcaacgttataaccgttggagcacatttgagcaaggaacttcctggtctggaaggaaagatcacaaatgacagtttcgtcggatccattttcacctctccagtgaccggcccagccatcaaatttacagtttccgtcgatgtcatcgcatctgaatagcaggttggatttgtcggcatcaacgaccactgagaaccatccgatgacttctgcggtactagcattaccgaagtattgagtgaagaactcagactcgttaccatatctcaaggtgtgatctctggcatgagcggccatgatctgagcctcttctagacccagggacagttggttgaacttagtctggttacaggaagaatgtattggaaaccccttaacccaattagcagaccagtcccctgcttcagacgcagaggttgggctagaaaccaattgtgtgacggtgacatcttcagctgttgttctggaagccagtgcaagtaaacttgtaatagtcaagttaatgaatcgcattttttaattattcagctgtaatgtattcttggtatggtggttttggtgatctcagactcttgaaattcattctttatatataatttttcaaacttttcactcgtttcgaaccaatttagggaaaagttaatgaacaaccactagggtgggtatgaacatgtacgattaattgttgttcaatggcatcgccaaacttggaccctgagaagttgcatgaagcgtgcggctcctgcatgagatcgacggcttcgcaaccctgatggttttgacgtcgaggcatcggtccatcaaggacggtatttttgaaggagtactctcttcctgaagaaggttggcccgggaaccctgcctaacggcctgaattgcattgttcctatttttcagtttcttttttcctgccagtttaatgaatttttctcaaattaggaagatgaagaggaataaccttaggcttggcaaaatactgtagtagttaaaacgttatagtttcttatatattcaacgaagtaggaaaaggatgctcagttgttacagaaacaagtatataccattctcattatgaatttgaaaacttggattactgtgtttattgcagtagctcaaagtgctacagtcactgtgaccagtacaggcgacttcagaatcggtggtctcgtcaccactgctcctgctggcacaacggccgccgcaacagtggcaaccaccacaacttatgctggaggagtctacgaggttgatattgcaagcgaggatggtcatgatgatcacgaccatgatgagcatgacgatcacgaccatgatgagcatgacggtcatgaccatggcagtgcctctaccacagcaactgggcaaactactgctgttacagattgtcacttccacgaagaaacacagtactgcgttaacggtgacaaggctgaaggttatattgttcctgcccctacggaaactagtaacgcaccagaggaatacaccggctgtcactctcacggtgccgaaacttattgtttgagagaggatggagatgaagtccaatttgtttccctaggagctgaagccagcagcgatgaacaggaggatgctgctgagtttggaggtgctgtaggtgttacatgtcatttccatgctggtgtggaacactgtgttgatgcaaacggtaatactgtcaacagaagcggagctagtgcatgtagtgccccagaccatgattacaatattccccttagaatcggatgtctgtttgccattctagctacaagtgcaataggtgtctaccttcctatcctaacaaataagttcctaaatttcagcttgactggtgtgatcttcacaggtttcagacagtttggaacaggtgtgattatttcgaccgcatttgtgcatttaattacccatgctgaaatgatgtggtctaatgagtgtatggctccacttgactatgaagctactggtacctcaattaccatggctggtattttcctctgttttgctatagaatatttcattaaaagaattgctctagccagactcaagaaagcagatgctgaaaacgcccaagaagaaatcgaagtgactgacgaaaatccaaaagagaacgagctaagtgattcttcgtcttctctagaaagaggtggaaccgtgcctgttccaccactcagcagaaaaatttccgttattatgttggaagccggtattattttccactccatcctacttggtgtcacattggtagttgctggtgattctttctttattacactgttcatcgttatcattttccatcaaatgtttgagggttttgccttgggaaccaagattgccgaactgaatatggtctcactctggtataaactccttatggctcttgcttttgcccttattactcctattggtatggcaattggtattggcgtgttgagtagattcaatggtaatagctcttcaacgttgattgcgttgggtactcttgactctttctctgctggtattttgatctggaccggtttggtagagatgtgggccggtgactggatatatggagcattagtcaacgccaactggctgaacacaaccgttggatttctatctcttattgctggtatgatactgatgagtgtgcttggtaaatgggcataaaacttttttattaatatgtattaacccttcctaaatgacaaataactttactatttattactgaggataaaagttagcggcacgatcctgatccttaacagcattagctttgaccgctggttcgtagtcatcttcacccgaccagtctacttcgattttcctttgttttctaaaatctgtgttcttcatcatgtagtgcctttcttttgcccatgcatcgctcacgtcttcaaatccttgatcccaatactttttgtaaacggcctgaatctctttttcttgcctctgtctctcttcttccttagccatccattccatatgctttaagtcgtcagaagatggctcatagatatgccacaccacgtaatgaggcaaccctacaacatcatatcccatccttctagatagtttaccaaatccttccgtttcagcatgtttttcaaatgaaaatgcagggaaattgctaccactcttgaaaaccttggccttactcaaaatggaaacaccaccaataccatccaatggcatttctgcttctggatctccataggggtcccgaaggtaggccaaatgtggtcgccaggtagcatattccacatatccttcaacaatgactgcatcctcgtctaaagttgaagccagttgtagaccaccatcactctcttgccacgagttcaagtcgtacggctgttgattacctaaccaatcaggtagtggtctccatacattaggaacaataacatctttattgtgatgcattaaatcctcaatgattgtcgtgggaacagtttccacatcgacatctctccaataaacccatgaatggtaaggcttgacagctaccgaactgagccagttacgggcacgagccatcaacttacgacgagggccctgggctgcaaatccatgtctgtcactgaaaccttgtccaatagcttgtccaaaatctttttcgaagattatgatttccccgaaatggatcttaggatcagggtcatgctgcaactctaaaaggttgtccttaaggactcccattgtattgtccgaggagtcagacaccaaaaacgccatatctactaaatgatgaggatatgtcatatttctcatgtgtctaaagaacataggcaagtgggcagctgcatctctcaaaggtaccagaaagaccacgcgttcacctctctgccaaccatcctcactccctttatagttgtccaaatcgtaataatgtgtgttcttggtgttttcaaaatcaggctcatataggctgttattgaatggtcgtatcatgttaaacaacatcaaaaacaaggcgactaaaacgaccagtatcgttttagggttggtcgcaaagtgttttgaactcctcaaaagcgtggagttgtatcgcctcagtaccttgaagtttaatgtccccattggttgtgctattattgagtcttttgacatctcctacaacacaataaaatggtttgggctcgacagtgcgaaggaatcgatgataccgttgatatttattgttggtttgaaggaaagcacaaaatgtgtcgtgtttgtacgaaaatcgatggtggatttcaggaaacatttccgcgtggaacttctctacggggtttctccctgattatataatctaaaatgcattaaacttctataggaatagttcactgttggagacaattctcttcttggatggcttgggaggaggcactttcttgcccaagctggtagtagaggatgtaggttgtggttgtttgattgcttctgggttgctgagcgtcttaggaagtctccttttggggcctttggctcgagtcatgtttggatgggacagactctgatgatgttcttgtgataatcctacgtcggatccatcaatggttcgggattttgtcaaggatttctctagcaccttgctggacgatggatctaccataaatggaataggaacaggcttagatgagaatgtttctgatctttttggtaacaatcccttagattggttctggtctggttttctggacctcagtccattcaattgagcgttaaatattgtttcttgagctgcgttgaaattatgattcttaccactagacttggattctcttagtttctgcaattgtgactgcaatatatcttcctgcggttgattaaagttactcttactagccttcttcggaagtattaaaggcttggattttatttccttcgccttgacaacagcttctggtggatttgagtcaaggcctttcgccaaatctttgggttttgtaggtttcaaaggtgcaggcttggtagttattggctttgagggcacttgtaaagagcttggtttggctggggtctttggctttggtgagagttttttcaaactttccaccactgaatcatcattattttcttcgatgactggctccttcttttgatttcttggtttgggggccggaggaggaggagtagaaattttcaaagatactgtagtttctggcttcaaaaccttcaaacttgtaggtttagagggaatcaatggtttcctttcagtttcggcattctccttcgttttgatgtctttctgagtacccagttttaatgcagcgtttggcttctcttttgttccctcatttatcgtcacgtttgacctccgtagtggtaatgcaggaggattttcatcttttccatcgtcatgagtaacttcttctcttccaatccggttacctttgttaataacaaaatctcgctttggtttcctcaaaacgtcctcacttcgtatgaccttgggagctttgctgttattaaagttgggcaaagaatctacaaatgagttcttctctggaaactctagaatggaattttttggacgttttggcaattgaggggcagcttcttcctccgagtccatcttttgtttctcttcatcccttgcaataggatgtatcagctgaatatcattgtactcttcttctgaccctgatctcaacgaatctggcttttgaggtctttgaggagggccgtttgatttggactttgacctcctcagctcatccaaatcgccgactttcgaccttttcgattctacctcctcttccaatttgagaactcgttcattgtcttctttcttcttcttggcatctaattcttgtacctttcgtaagaaggaatcgacattcggatcgttattagccactttcctgcccatatcagtagtttggaattttccccatcaggacccaaaataatggtggtcgcgattgaaatgaattgattcataccttgtctcgcgatttgtatagttgatccatctggcatctaccatcaccaagaatccatatactcccaaggacctgtcactgatttcaaataggcttcaactaatgagtgtcatagtgcatcctcttgcactattgacaataatcgacgagttccagagacgaggtcgcaacaacgattccataatattcggtgggttacttggtaaacatgatgaatccaccaaccaaatatctgttgttaacagctttgtgataccattgatcgataatcagtttttgaataaagagtacttgcaggacatgctactcaaattttctatcattaattccaactttcgattcgtaggttactatcacgttcaatctttaaacggtaccgaaactcaacagtatgacttgaacgctattaacctagtatgccaagatgataataggccttcgtcctttgtccattggatagtaacagatccaaaagagttcaaatcattctcgatgtattacttggatgattcaatggttcaactcgtcaattccaatattcaacattacatttctaaaccattgccctatgaatttaaaaaccttctgtctgagaaaattgctatcgacacaatcctcaagcaatccaggctagaaaaagacttatccaccaaaaactcactgaagaaattaaacaatagttatatcgacattcattcctcactgaacgttctctataaatcagtcaataggcttattcgttacctcaaaaaatgctcaaaatcagaagtttcaattgactatgacacagttcaggaaatgaatactgtaatactgaaaattgaaaggcttaaattgataccccaagtcaaggaggagtttgacttagtgactctttcactactggtagacaatcttgatcagatggatcatcttttgtatctccggaaacaagtggaacagtacaaaatatctgaatcaatgtatagttagtcaatatcaaagtttcatacaacagtgaccatccagcatcgcatctgtcagtttcgtataatgtgcgcgcatgtgctgatcggtatatcaacatctcttcctcttctctgcttcctttttcctcttgtttgttatcaatgcagtacgtaggtagagccattggatcagtatccaaaacctggtcgtccattaacccggccacactgagtggtgctattgatatcatcgtggtggaacaagaaaatggtgatctggcttgctctcccttccatgttcggtttggaaagtttcaattattgaggccttcccaaaagaaagtggatttcatcgtcaatggagaaaagacagacttaccaatgaaactgggcgatgggggcgaagctttctttgtgtttgaaaccgatgctgccatcccgagtgagcttcaaacttcccccgtcatctcacctgtatccagcccagaaccagcctctccactgagtactccttccagaccaaactctgaaccagattatttagaattaggggatggagaatctacaaccagtgaattagagaacttcaagttaaatcgatatccctatttatcaactgaggtatcgcattcagatcctggtgttgggtctgtgagctcaagtcctgagaatacgaagattattcaaaagatctctcggaaactcaatacgaaaaatattccttccaaggttgataataacggaaatcttgtattggatatacaaggttacaaaagtgatgatctagacgacaattccaaatctttgaaacagttgttattggctgaactcggagaagatgtagatttggacaaggttattgaaaaagatcacgaaggaaacattatgatcaatggtgccatatctttgttgagcggagaagatgatctggaatcatttcctcagaccgacgaccaagctgagagtctcaaattggatctggagtcagataaatctgacattgaatcagacacaaatcatgaattgtctcgctacttcaaaacgctaagacttacatcagatcaattgaaatgtcttacactgaagaagggaattaacgagctgaaattcagtgtcaacaagggcaaatctgtggtgacggcaaatctatacttctgggactattatgaccccatagtcatatcggatatagatggaaccattactaaatctgatgccttaggccatgtatttaccatgattggccgtgattggactcacaaaggtgtagccaaattattttcagatatcaaatccaatggatacaatatcatgtatttgactgcaaggtctgttggtcaagccgattcgacccgctactatttaaacaacattgaacaagaaggcttgaggcttcctcaagggccggtgatcctttctccggatcgcacaatggccgctttacgaagagaggtaattttgaagaaacctgaggtgttcaagatggcatgtttaaacgacataaagaaactgtatctcaccaataccaaagacctaaatccgaacacagattctgcagatttcacggatatcaatacgaacactttgagatcttcaagtcttacagaggatgtacaaacgccattttacgccggttttggtaatagaattaccgatgctttgtcctataggtcagtagggataccatcatcaagaatttttaccataaacccagacggtgatgttcacatggagctactcgaattggctgggtatagaagttcttatgtacatattagtgagctggtagatcatttctttccaccagtgaacactgaactatttaagtcgatgccttctgatacctatcggaacacggcaaagttctctgatgtcaattattggaaagagcctttgtacaattttgaggagctcagtgatgaagattctagtgaagatgagctaagaagaagaaaggaggaggaacgtttacagtctgctcctcgtagtccaatattggcagcaggagcatcgtttttcaaaggaagtagtagccttttaggttcaccagaacggatgactttgagtgacccaaagccaactgaagttgcccctagcacaatcaaacccccaaaatcagttggttctgtatcatccgatgaagaaaagctgaaagatcatgatgatttcattgacgttgatcacgaagatgaaaccttggatgatgatgacgatccctttgactacgattacgagtatgaagatgaagaagaggaaaatgacgacgtagatgaagttgatgatggggaagagtattcagatgattattatgacgaagaagacgactacgatgaagaattagatcatactttagaaccagaccaaaagaaagaactggaccaaacagctgaagccaaccagttacccccttcaggacccgatgaaatggaatcaaaatctttcaagaaagccagtgatttaataagcaaaatgagaatcgatgacagctgagggtaaataagtattagttaaatctgcattttctatttatatacattatttctagagttctttggttacttcaactggaatggtggcgtccttttctctgtgtgactcggttttggcaaagatttttttaagaacagcgtcttcgtcgtcttcgtttctcataataaatatcttctttccatagctaaaccagtagaccagagaaacaaccaaccaaccaacaatagctgcagccgcgtagttcatgttggacttagtaactggcttcacaaatgggaatgagtagaataccagagcaaataatgcccatgcaacggtcatactggaggtgaaataaccaaactttccaatccagaatggaccatgagtgatactgtctcttccattgtatataagacaagagacaggaattgcataagacaacaggaggaaagtgatgcatccggttaccaaagagttataagccaagtctgaagccaagtaaaggcaactgaccaaggaacataaacagacggaaaacaaatgtgcgttgaatggaatacccattctcttgtcgacctttgaaaggaatggagaaaatggaagaccattgtctctggcaaaagaccaacagagtcgcatttgccaggtgtgaccagaaattaaacatccacaggcagtcaaaaacaacaagaaacccaggaaaatggcacctccttgattttgaagagcttggtagtaaatggaaataatgggggcaccggtagcagtgttcagcaatgcatccagatctctgatagagaagaacatcgaaatacagtacacaaaggaagtaaaaaatccaatggcaacagttcccatgatggcaattggaataaccctttcaggttgggcgacttcttcagccatatgggtagcacaatccagacacgagaaggaccaatttgggttaattaaaccaatgatgaaggcgattccagcggattcccaaccagtttggttgtcaaaatcggaaaacacgaatttggcgttttggaaatgtccactggagcaagcaagtacggtgatggtgatgacgataaaagatcccaaagaaatgtacagcgatgactttgcaatcgatgggagaaacttggcataacagttgaaaaagaaaatgaaaaaattcaagatctggaaagctacgaaaacgtgccagcggtggaattcatagtcagcatgggtcagttcgtaaaatgcaactgcaatctgaacagtagccacagtagttgaagttgatgagaagatggaaccagcatatgagaatgaaccgcacaggaaagccaatactgggtatttaggagctaataccttagcccaaacgtattgacctcctgaagaaggataagcagaagccagttcagataaggtgataccaatacaggtggatactgctgcaataatcatgataccataaacaatcatcattggaccaccggaagagataccagtgaccaaagaagcggagataccaaaccaggagttggtcaaaccgaagccaacacctaagacagaccaaacagaaaagtttctattcaactcaggttcgtaacccaattgagccagaattaagtcatccttatcaagagttgaatctttggtgaatcttcttgttagggaaacatcgtttacatcggatttttccacgctacttgacatttttgtagaaagaacgagtgttacctaaaaaaaaacctcaaggtatgatagttttagaggaggtgtccaaaccaggatacgagatagtatttatagtgtgcaacggttcggcgagaacgagattcggacaagaaaaaaagaaaaacgctgaatcaaggcattaccaagataggcggccttttccgataaaaatctgaaatttggaaggggaaacgggaaaaccaaagacccttacaggtgcaacatgattgtacaagtatccactgccaatttcctgataactataggggacctaattggtgatgtcgcaatatattggttatgtcccgaatgggaaagccaatcttgtgtgactgtgttttctgtgcagaaaattgaagctttttccaaatgaccaagacattagataggtactccgaagtagggtcagttccagtaaactgcttttgtttgaacgaaaaggcagatattggggagatggtgtgaggtcgtaaagcttatctagaagataatccaggtggaccagacttgttgtaaggttgaaattatgttgtaaagattacttcctaaaatggtgataatggtgcttttaccatagcgccctgctgccactttgggaatagtttgcaggttggtttttctgcttcgcatttcgcatctccaacagagctccctccagcgttttcccaaagggctcctcccaaagattccttccagcgttcccctaccctcgcttcatttcaacgcgtattcaccctagctctgtctgtttacaaacacggttgttccctcaaacagttcatcatgtttgattcccttccgttggatcagtatagggccaactatcaggcaattaaggagcacaaacccattccctatggtgatgctaagggtttaattctcatgtcagacgatatcgatttggatctggtattgagaaaacatatcccaaccaagattcttgaggagtactttcataaacctagggaaggagatgctagtactgacggaaaaacacggtatgctagtgacaccgaagagctgttaagattttccaatgtgtttaaagacgacagcattgaaattgggagatctaggtcaatgtatggatcgccaaaatactcatcattcgaaaaggaaaacatactaagaccttctaccaaggctaatcaaaaagggacaaaatatgacattgatattgccggtgacctgctagccagttctcacaagtttatatccaaccttcccaccactaataagtatgaaaagctactatcttcatcaatagagaagaccatacgagagttcaagagattgaaagaggagaatgaacaactgaggagtaagtccagctctcccaggaacactggggctcgtcaatcagaagaactggtgtacttgaaggacgtaaacaagacattaatggaaagacttcagaaggaaaaggacagtaaagaacagttaacaaaaatggaaactgaattaaaagtgaaagatgattctcttagagatttagagtcacaattagtagaaaggaatcaactgattgatagcctgcgagttcagctagctgacagggaaaagctacttgaaaagtcgaagagcgaactggccgaaaaggatcatatcattgaaactagaaacgttcagttaactgaaaaagaccaattggttgaaaaaataaaatctgagttggacaccaggaaaataattaacgagaaagaaaacacttctaagacgaggaactctttcggcactcacgactcagaagtacatgaaaaacaatcaacacctacccaaggtgattcttctgtcaagcaatcagaagccgaggcggcagtctccagcattgcccgtgaattacaccaaattaaggaaagtataacttacttgggtaaagatcctaaaaagacaaagctgtttgaagagatcaatgagatcagagatcagatcaaatatcttgatctcaaaagatttgaaaaagaggaagaaattgccaatttaaatgagaaggaactatacatacagcagttatcaggtcgttcaggctactattttcaaggtccaaatttggccaaagagcaatgggattctatgcgtaatcaaccaactgcttcccccaaacatgacgcaaacatgcaagactctccgacctttcgtcgtgcgcagagagtgaaacaaccgtgtcccacctgttttcagtccaatatttctcctacccagtctactcgggactcaagagcaaatcagtatgcacataataacgatatctacgtgaatgacttggagaatattgatccgaacgattttctgtccaaactgacaggtccggaagaaaataggaaaaaagaagaagctttgaattaccttgactctactcgatgtgcaagaaaacatgcacaaggacatacacaaggatctaaccatctaggggacatggaggagatacatgaagagattgcaaactctgaatactactagtcttagtcaaatagttctccgtctttgaagtaacttaataataaaaatacccttacgtaagtactgatttgaatatttcgcgatttttctcccactcgcattcagtggctaaggttgactgagaacactcacactcaatcaaactacacaagatgcctcctgtgaaatctctggacatctttttcaaccgcacagagaagctcttagaagccaaccccacaacgacaaaagtttccatcaaattgggcgtaaatttcaatgatcacgagaatcctcaaagcaagcacaacgtcataacggtgagagtatctgatccagtgagcgggtccaatttcaaattcaaagtgaccaataaaactgatatgctgaaaatattcagtttcttaggtcctcatggcattgagttaccaatttctggccagcaaagccagataaagagtaatgatcagactcagagtgacaatactgaagtgcctaccacatttcataggggagccaccagtattttggctaataaggcatttgagaagaaaccactgattattaaggattcaagtaccgcaaagaaaggtggtaaaggtggtaagaagaagggtaagaaattttaatgcacatttaatatgaaaaattataaatagataaatgaatgtcgatagttaactaccttctcctggatttgttctttcttcttctcttgccttttttacgcgatgccttgtttgttgttgatattgtcagatcggattgatcattcgccaatatagtggtatttggggcattgtgttccgtactatcttgatccgaggaattagatatgtaactaggtggcctggagctgatttcatcatctgtgtgagtgaggtagtcatcagaaagaatagaacggacttgacgtggagacattaatggtaaactgctcggttttgatattgcaactcttccttgcaagtatgctttgggtccaaaaaacgtggtttcattttcagggtattcagggggcaaagcctcccccgtttgaagtatcgtatcttcaacatcttccttggttgaaagataaagaggcggagccccaagactgccctcattgtcaccttcgcaaaatccaagcttcttgacattagcctcgataaacacgaaccctagttgtcccaaattaacagagacctgagacctaccacctgtggatcctatacaggggtataaatctagtttgatatcatgcaagacctccattatctttttcccattatgcgtaacgtaaacggaccctgggtaatatttatagccaattcctataacatcaccctgaatcagttgtggcaacaatacaggtgtatctgaatcattaataaacggtctattcagtctcatatgccctgacgattctattccaatagaatagggattataacccggaagtcgaaagtctggataaggcttgcagcataaaccaaccgaaattagggtattagcggggttgaattcataaagcttggcctcaaagtagacggtgtcttttcgtctattttttgtcggtaatggaaagtttagagtagtagagtgcggtttgtcggtggtgaaaataatgtctgttctatcttcgatgtagaatggaactgggatattccttgaagtactagtgccttcatcggtaacagcgccataatccgggaatgatttggctactagtgagctcttttgactttgctctataatttcctcttcatcaaaggaagccgaatcttcattaatagatcttttgtatttctccggatggttaatttgatctaagaccaggtctgtgtggtttgtgtaagattcaaagtagaaaatattgattcctctatcccttaaactcagttgggcatcgattccaaaccctgtgccctgaggaactacattgggtttattgaagtggaaaaaatgtttacccaagagatattgatctttctcctcgtctgttaaaagcggaaaatacgttttctcccataacttgatcttatcatcatcaacttgaaaattttgaggtaaacggatgctgaagttgtctcccaagtcataaccaaatgttgaagaaccgcagaagaaagtgtagtaaacggctatgataatcagaagcaacaacagtaagctcaggatcgcactgaggccgataacgaagggaatgttcaaatctagttcgggattccccacgttaacatcatcaaaggaatacatgataacgagatgtgtttaccttgagatgaagggcaaaaatctctaacgggaaagaaaagtgtggatttggttggggtttgaagtgtgatcataagtatgaactttttcttagatattctgtttcgcgacgtgcagatcaaatgtggagacccattgtactgtgggcttccggacctacacgatattgggttgacaagtgttcttccgtatgctacttattaagtataattctatgctgaaggaaagtccttttcatttacctgaatacaatacagccaaagcttctcgggcgtacttgtcgaggtaaaatgcctcaaaggaatctcgtaattcagactctgaagagtcactgccacttgcctgttttagaggatctaacattggcggaagttgttcagcagcgctctcttgatatgaaagcagttctccaattaggtggttcacctcctgtgttttctcgtagagcttcccgttctgttctcgcaatttatcaactgatgactggcgactttgtattatgtaatctctgagtctgtccactatcattaggatattatcttcgtagtcatctaatagctggaccattcgggagttgtgtatctgtgtttgtgttattttctctcttagtctgaggttctcttgcctgagagccgctagctcggattcctcgtcccctgcagtattcttcggtttttcgtctatatgcaaagaatccagagatgttttcaaagcttgtggtatcgtttctggttgccgcttagactttgctaaatctatggtcggctcagaggattcagcttgctgtgttgctactttttggaagttggagagggcttccaatttccgaaataacgaccgtttcaattgtcggttggtgtccaacttcgccaaaagaacatccaccaaggaatacaactgagagtagttgtccttccggatattcagctcgggaattggcatcattttaccacttttctccatggtaaataaaaatgagagcaagataacaacaagcctgggcccgttctactaagaactctaatctacagtgcgcgaacagatcagatcatataccccacctccttcttacttaccaagatcatctacaacaaaatcaaatcaactcaacaatataataaactaaataaatatccgatactctaagcagaaatatcattcagaatctcctgctcgtctctatgtttgaactgaagaatcagatcgtcttttgggaaaatggtggcaaaaactttgatctcttcactcaatggagtgacagtatgatcaatgtcgtacaacatggcagctttgccgatcaaagcggtgaaagccatcataacatagttctgccctaggcacacatgtggtccattaccaaatacgagccagttctttttggcttggttggctggtgacccttcgacccatctctcaggaataaaatcatctggattttcatacacttctgggtcatgcaaggctggatacaaagttggaataaccatagctccttttggaactgtatagttgtcactgactgggtacgatttcttaacgacatacggaaccatcaagactggaggcctgtatctcagtgtttccttgaccaccatgaaagtgtacttcatagagtcaatcagctctccagtcagcggcttattgatgtctccatcacgcaaacggatctgttcttctctgattttagccatgacatcaggtctatcagcgataagctggaacatccagcaacaggcagaagaagaggcatcctgggacgcaaacaaaaatgtgaagatagcttcagaaatttctctattggaaaattctctaattaaaagcttagcatcaggatctttggatttgctttctctagcttgcttcatggagtcaatccatgcatccatgacgcatgtgggctttccattctcctcgttgatatgttttttagccatagcagcacacgactcgaagatcttcatggtgtcatcggcggtgactttcccataccaagtcttagtgaagggaataatgataggaaagttgaccaactctaatgcggctgttactttgtaataattgtctgcaatcaacttaatttgctcatcagtaatataatcaccacagaaagtcttcagggacagagcacacataatttctctaaattcgtggaaaaaaatcataggcttctctttggacatctctgcaaaacggttgaggtagtcatccatgatcttctcttgggcaggaatatagacttccagggcctttttagtgaaaagaccgtttaaaccttttctatagtcaacatgttccttaccgtctaaaaatacccagttcgaaggtcttaatattttaacagcaacgtcaacaacacaaggttttacataagctggactttgaagaatcttcctggctagatcccgagttgaggcgataacgacgaacttgtggaaaatagacacacaggatagcgggccggaatcccatttggccttgtactcttcaaattttgggtccaaagactccaaaaaaggaccaatgactggccaaatcttgaattttggtccggctatgttccccttacggatttgatacattatttgatcgtaagacagaactccaacaatgatagccagggcagcctgccaccaagtgaagtcattgattactgactgagcataatgcgatatagttccagctattgttgaggagttgctcccactataacttgaaatgacttgcgacatatttagcaaagagattaagttggaggagggatgtttttcttttctgcaaagagtttaagtgaatacccgtaaacgagccaaacgaagaaaccacctgattaagtaagtgctgctcgcgaaatgcagatcgtggagctgaggttaagaggtcaagaggtcaagaggccatagttgaacacctgactctgtaagggcggtcaaggagaaagagtctgataagtggtatgacttccctttgtttgtttctgtaagatggtctatatttagcttgagggctatagtccttctaaaaacacatttcaagtgtaagtcacgactcttattcgcaaaattgtaatgagtgtcacatttgacccatagatagaaaatttattaaaggtttgcatgtgcgattgtgaacttgtgcactatcattaggctcaattccgtttaccggccttatgtttgttcattgtattagttccttctctctgacctcatcgcaaactgatttttcacaccccaacaccatcttctctcttcaaccatgtaaatgactcaagtctcatccatctagctttctccaagtaaaactaataggccaataatacacttctatccagatgtccgggcttatcgaaaaggtcagcatccttcgaaatgactccattcatgttggctacaatatgtcgtcgcatattgtggacgaaattttaacgaaaaaggcttcttccacttatgtcttaatcacagattccaacattgtcaagatggggcatttacagactttcgttgatgagtttaacaggctcatcccctccaagaggcctggctccagaattcttacttatgtcgtcccccctggagaagccaataagaacagagctacgaaggctgctattgaagattatcttcttgagaagggctgtaccagagatacctttattcttgccattggaggtggtgtgattggtgatatgattggatatgttgcagctacattcatgcgtggggtcagatttgtacagattcctacttccctcttagctatggttgactcctccattggaggtaagactgcaatagacacacctctaggtaagaacttcattggtgctttttggcaacctgactatgtttttgttgatgtggcatttttagaaacgttgcctgagagagaatttatcaacggtatggctgaggttgtcaagactgccgctatctggaacgagcaagagttctccagattggaaacctactcaaaaaggtttttgaaggttataagggatagaagagtcgatgactctgttgatttaacttctttgaaagagcacatcatcaaattggtactagagtccatcaaagtcaaggctgaagtagtcaccctagatgaacgagaaggaggactaagaaatctcttgaattttggtcactccatcggtcatgctatcgaagccatactcacacctcaggcccttcatggagagtgcgtttcaataggtgcagttttggaagccgaactttctagatacttgggaattctgtcaccagtcgcagtttcaaggttatacaagtgtttcgccgcttacggtttgcccgtgagtattgctgataagttagtgcagaaaagaacaaacggtaagaaatgtcctgttgatgttttacttcaaaaaatggccattgacaaaaagaatgatgggtcgaagaaaaaggttgtcctcttatctaaaatcggaaaatgttatgaacctaaagcatcttatgtcaacgatgaggatctaagatttgtgttgactgatgaggttcttgtaaaagattttaactctgctccatctaccgcagtagttgtgcccccaggttctaaatcgatttccaatagagccttaattcttgctgctttgggtaaaggtgaatgcaagataaagaacctacttcattctgatgacaccgaacacatgttaaatgcagttgccgcactcaagggagctgacatttcctttgatgacaacggagaaactgttgttgtcactggtaatggcggaaacttcacagcaactgacgctgaaatttacttgggaaatgctggaactgcttccagatttttgacctccgttgcatccatagttaaacctgactcgaacaccacccatgtaatcctcacaggcaatgccagaatgcaagagagaccaattggaccattagtcgatgcccttagaactaacggctctgacattgaatatctaaacagagaaggttcgctaccattaaaaatcaaatctggaaatggacttaaaggaggccgtattgaactcgccgctacaatatcttcacagtacgtttcttccgtgctaatgtgcgcaccatatgcttcagaacctgtcacgctgtctctcgtaggtggaaaacctatatctctgctttacgtcgatatgaccattgcgatgatgaaaagttttggtattgaagttacgaagtccaccactgagccttacacttaccacgtccctcaaggccattatgtcaacccagcagaatatgttattgagtccgatgcctcctctgccacttatccgttagcttttgctgccatgaacggcactcaagtgacgattccaaatattggatcttcttccttgcagggtgatgcaagatttgcagttgatgtcttgaaacctatgggatgtaaagttgaacaaactgctacttccacgaccgtccagggcccaaccaaaggcacattgaaaccattgccattagttgacatggagccaatgacagatgcttttttgaccgcatccgttgtagctgctattgctaatgatacgaaccaatcaacctcaattgtcgggataagcaatcaacgcgttaaggaatgcaacagaattgaagcaatgatcacacagcttgctaaatttggtgtaagagctaaagagttagaagatggtatcgaagtttttggaatagactatcatcacttgaagactccatcagacggagtttacacctacgatgaccatagagttgccatgagtctttcattacttgcaggtttggctgaatctccagtgcttattcaggaacgtcattgtactggtaagacatggcccggatggtgggatatcttgcataccacattcaacgttgagcttgatggacatgaagctgttgtagaaactactacagccaaggctaatgaagacaaatccattatcgttattggcatgagagcagcaggtaagagtacactttcccatgttattgctcaaactttgaagggtttcaaggttgtagatttggatgatgtgtttgttgagaagtatggtgatatcagagaatttatcaaagaaaacagttgggagttgtttagggaaaaggaggctatgattgcgaaggaggcttttaaaaactactcaaagaatactgtgatttccactggaggtggaattgttgagactgaagcatcccgcaaattattgaagcaacaaatgaaggatggtcatattgttcttcatttgcatcgtgacatcgaagaaactgtcgtcttcttatctcaagacaagactcgtccagcatatgtggatgagattaatcaggtttgggaaagaaggaaaaatttatacaaagaatgttctaactacttctttttctctcctcattgccaaactgaaagagagtttttcactttgaagaaaactttcagtaaattcattaacagaatcacaggtggggccgttccaagtattcccaacggccgctcagcttttgtgtgtctaacgtatgaagacctggcacccgttagctcaaagctgactagggtcaccaatggttgtgatgcggtagaacttagagttgatttgctaaaacaacatgactctcatttcatcagcaatcagattggtattttaagaaaccagacaagtgttcctatcctgttcaccatcaggacaaagagccaaggaggaagattcccagatgatagttacgaagacattgaaagacttctcaatttggccatcaaactgggtgttgagtacgttgatttagagttgtctttaccagagtcattacttgacagtgtagcatctaaaagacaatttactaagatcattggatcgcatcatgacttctcaggcactgtaaagtggaataatgtggaatgggaaaacaagtatctcttagctctgaagttgaatgttgatattattaaatttgttggaactgcgacgagcttgaacgacaattgggaattggaacattttagaagtcttcatactgataagcccttcattggaatcaatatgggacctctaggaaaagtttccagagtcttcaacacaattttgactccagtaactcacaaagatcttccctcaagtgcagccccaggtcaactaaccttgaaagagattaacgagtattttggacagtttggaggaagcagccgtaaaaagttttacattgttggaaaacctatcagccactccaagtctcctgaactgcataagaccttctacgatgaatttggtttgagtcacacatttgacaaatttgaaacagatgacgcagctaaggttttcaatgatcttgtgaaaggtaacgatgaactgggcggctgcgcagtaaccattcccctcaaaatcgacatgctgaagtatgtgaatgagcttactgattcagcaaagtccattggtgcattgaatactataatcccaattggggatggtagatttattggagataacaccgactggattggaatcagagactcccttcatcaggctggatgcgagatagctcccgaatctagtgtcggcttggtagtaggaggtggcggaacctcaagagcagcagtttatgctctccatcaaatgggatgctctaagatctacatgttgaatagaactccatctaagcttagtgagatcaagaatcatttcccatcaaattataacatacatattgttgactctctggatgcaattgatgaggacgacaagctggatgctgctgtatcaacagttccaggagataaacctctggacgaccagttgatctctttgcttaagaagttgttagagaagaaacgtggtcatgctgtgctcctagaagcagcttacaaacctagagagacgccaattatggcattggcattttccagaggctggaaagttgttcctgggagtaagatgctagttaaccaaggaattgagcaattttacaagtggactggctatcaattctcctcccacattgatctgtaggtttatataaatagctttaggggtttgagtgtttctaatctaggcgtaccaaacaaacctgcaggacttttctttttcccctttcagtttatactttctgcatgacattgcggctcatatatctagatcaggttcgagaatagggacgataaagattagaaataacggctaagatgagcaggcattgcggagaacacagcactcaatggccggcctaccatcaacacagaacagacactgaaaatctacgtctcaattgatggcaaatggggcgttgccaaatatttgttctgccgactatcaaagaggcaactctgaggactgtcggaaaaaaagaaacaaagcaaaaaaaaaaaaaaaaaaagaaatgatacagaaaaagaaattcagcagacgatttcttagtagatataacatgtcggggtaaacagaaagtatttttccttctaaacttatttctaacactgctacttgctattgctaataagcgcaattgaactaataatggacagtattttgaccaatcggtgtttaacgccggtaagcaatcacgagaccttcaatttggttggtggttctaaatcattgacctctgcagagaccaggaaaaactctgacgaaaggtcttctatatcaattccttcaccacccttgtctccttaccagaggtcgttagacgtcgaaagagaccacaagatctttgacgttgtgggaagaagcaatgatcaaattgttggtgattttgaagaaccagcaacaaagactcaaacggaacaattagaggaaggcaaacctgacgatgctccaaaaatttcttcttcagtgctgttgtctaaccagacatttcctatcaaggatttgacgaatgcaaagcttaccgtcaatgcctgggcctccattaacagtggagattcttctttcaaggaaaatcaattagtttttcttgacagctattataacatcatcgataccagaaaaaagagagctcccaggaggaaatatccaactgctcaaccaagaagaagagtcttcttctcagcatcagaaagtgagactccaaacgagagagtcagaaccagaagagtcattagagacaacgttaagtattctgactatgaatcagaggtggaaatatcaaggccttccacgccaaagagatctacgaagagagtcagtaaaccttccactccacaaccgcaattttactctgattatgagtcgattcctgattattcaccaccattgtcaactcttcccccgaataacaccaaagctttaaaagcagagtggaagggacaacctatgaatctatcagatgatcctttagttggcaaacttcatccagctgaggtcactctagcttccgtattgagactcccttgcaatgtctatctggattccaagaggagactattttctgagaaagttagtcgattccgccttggtcttccattcagaagaactgacgctcaaaaagcttgcaagattgacgtgaataaagcaagtcgtttatttgctgcttttgaaaaagttggctggttggacgactatcatttcagaaagtttctcgatatgtgaaaaacagaggagttgaaacacaaggaaggtaaattttgttttaagtgtatgtattttagagaaggaaggggacagaggtcgtaaggatatgggtttaataatgtataagtatgggtaaagaatataatagaattagtgtttaaaagatattcactggtataaatgaaatgattaaaagagtactcaaaaattatgcatgaaccatcatcggtgagacaatacatttatctcttattgattatgacttgaaattggttcatgccttcttgaatagtgttataagtttttgggtgactgtccatcctcttgaaacttgaaatcactggttgatgacttatccccattgattcctgctctgagagagacttttttcggtcagaatgatatggtaagtcctccggcaagctttccaattcgacctcatcgtgggtcttcaaagattgaaatttggaaactgttgcacttaaaggagtgaccggggatgactctgtagatgtggttcgatgctttatggtgctcggatcaaatttaggagacgtagttgcagatccagcatcagaccaattgggtaatgatttattaccagcactgctatttctgctatggttgatctttcgtttctctttggtacggtttggctgctcgatgacgaatgagaattgtcttctcgatgcttggtttgacaaattggggttcataccactcaattccagtgtgctggagtactctgaaaacgaaagacgttctccaattggtttcatcttggaccgtttactttgcgtcaaggtgccctgcgaagccgatttacgcaacggtttaattgagttttttcggatcccccctccaagctctaaaatcggactggtgcttgatttctcccgtggcgaagactcggcagaagaaacatccatagagtatggcattgggggcttatcaaacttttgaatgccatgttgttccaaaaccgatgaatcacttaaaattctctgcttgattttcatagacctattagaaacattgggcttcaatgtcattggtccaacgactcgtttcttattgtaagctagaggttgaagggatgattgcttttctctggaggtggtgatacctaaaccgttattgcttaacggctcatcatgcagattgctggtatcgaaatcgaagataaacgattgatcgagtaaagaacgactagatccctcttcgttcgaagtcggaacgtctaccaatggtccatcagcaaaaatatcctcaagatcttctgggaatgggaccaagggggtagcattgtcattcatatccatcaagtttaaagtatctgtgtaactatgttgctgcgaaatactgctggtatagggaacagcagaattcggtgaatgcatggcgttaggaggaaactcggtcactcctatcagattagtttgcggtgatggaaatacagaatatggataagaaggctgcacgttttgcagttgtgaatgaatctgaacatgttgggattgatcagccagctgagtcggttgaacatgttggtaaccctgcaacggttgcatagattgcatataagacacctgttgcattggctgcacttgagaactttgctcgatgtgaggatgttcagttaattctctagttcctaccgggttttgtatttgagacgctttgaaattctctggagattcattaaaagcagtcttttgacgagcatttggatcttgttgtgaaagtgactggtgtggttggtctgaagccaagcccgattggttgcccaatggagactgctgcatagaagattttccggtgttgttttgaaaagtgccaattggtgggccttcaatagtagctacagggtcatgagaaaccgacaacaaagggtcttgcgggacagtgccgtatgggctcatcctaaccaggttttggtctagcggaaggtcctgatataaacctgcgccgtgctggaaggaggattgatggcctagcacaccattgctgttgccatgcattggttccaaatactcaatattgccgtattggttatacatttgaggttaagtgaaagtgatcaaagaagaccttatgtgtgttcttagggtacagcgagtgacgaaacaacagaagcgagtgatggtggttctttgacaactttttgtattgttgactggatttcctcctaccgaatctaaaaatggaattcaagaagagactcgtagttaagcggaaacgacaaacgatagtaggcaggtataccaaactggatacgttggaaagcttaaaagcggtttagttcacaggaagaagattagtggaaaaatgtgttctgattcaagaagctaatttatttatctgatagaggtaattaaatggctggacatgagcagtgagctcgggtcgtgtatggtccgaatggagtttgtcacattttaaaatgggggatggcgcacggggaagaacagtgaggaggagaaccgcgagagggtaagggagtgtttcttttctcgtttctttttgcggctggatgagaagagccagggagcactctcaaagggagaaaaaaacagtatcggggagccttcgcgaagacatcccaattccttgcgataggcggtgctactagaatgattatctaacaataccactgaccctaaacggctcatgattagatcctcaataactcattcaaagataggcccgatatcgaagatgtttctaaggcgattctctacgaacggatctgtttggaatgcctactcgcctatctttaaggaggatgaaaacttgaaagatctgagaacatctaaatttgaatacaagtcgttgtaccagccactgaaaattgactcatttacctcagagattgaaaactcaagtgaaaaggtcgattattacagccattgtttacgcgaggaaatgaagcattacggaaattctgaattccaggacgaagatcggttgaacaatacttcttcactgcctgagttgaggatgataaaaacgaaaaatcaggcgtttgaaacgtatctgatagagaaccccaacgtggacccaaaaagcacagtaacgaaaatgaaacaatatgtgaagtttgctgtaatgtttatgaagttcttcaaattaggtgttatgaatgtgtggaaaaactaccgtcttaatagaaaagaattttacggcagttattacatggtagacccaaaaaatgaaaatgcaaaactaaaagtcaaaaatttgaatagcgtcattgacgagcttcatactgtcattaattgtgaaaggaatgtaagaaatgctagtgaacagagaagggttttgaacaaaggtggcacccaagatttgtttcccaagattgaactttcacgatctactttgcaaagagttctgcggacccgggccgactttatcaaactccctctatttgcagtattgtttctcctattggaagaactcaccatcggtctatgctacatcttccccgagatagttccctcaacatgtgaattacctcaattgaaccatagattcttttaccaacaaagcaaaagccaaaaagaacttctagagctgagacagaatgcacccaaatctgaattgtttaagaaaaccccctacaatatttcttgcaaggaattgtttgtcctcagcagcgttttgaagacgaagagttccttaatccccaccgtgttgtacccagaatcatacctgcgtcaagccctgttacgaaagctgaagtcgttaaacgttgataactatttaatcgttagagatggaggcgtatggaaaatgacaaatctggaaatactacgatcctgcatagacagaggactcgttgatttctccaaggaattgaacccaaataatgatcctcagtctgaagaacaaaaatctcattatgaactcatcgatttcagcactttgagattccggcttcattcgtttatatgcgagatgaaccgttccaacaaccatgcttccgttggactactaggaatgtattgattctcatcacctgtacatacaattcagcagtgttcatagatatttttcttgtaaatagacttatttcacgaactacccattcaaactacaatagggggacccaaataactgggaaacaggatctccattcaagactatctttgttgctttcttaacgtatctctagtaaatcaacctcaagtctagccgttctaacggtaattcgcggatattgattagaacccttctgttatcaatcctttgtgctttcaaaactcaatgcctggcacctacaagtttcgccgaagctacaaggcttgtcttaactgcaagatacggaaagtcaaatgcgatcttggcccgctagacaatcagaacgaacctccttgtgcgaaatgtcgtagagagaagaaagagtgtgtctttccggaatcaagaaacagaaagagacgatctgtggttgaaaatcaagaccaggaatacaaccaagaactgtatcctcatgaaaagtctagaaggacctctcaagaagcatcagaatctcacaaatatacatcaagcaatctcggacaccctggtccagtttttcctcctccctccaacattaacaatctacttaacaactcagaaagaaatcactatgagaatcatccaccacccatgtctcaacgtttaactgtgccatcggtaacccataatagaaagttgaaagacgattccaacagctcctccacctctgaattaaataacttggatttcaaaacttctcaaggtacaatggtttttctagcctctgccgctggggagatcgctcgtgctgatgaaagagatcacatcgacgccttaaaacgtcatcagcagctggaaacgtcgttttcacagactcaaaatttacaacaggatatgcacgggacccggggcgaatcaacttcgaaccagtccgctgatgaaagacacacaatgccaccattagagagttcgtctagcgttagacctaagccttcaagtacattagcagacatagactacattggcccaacaaaagtcttgacagagacccaagctcgccgcctgatcagtttattttttaacactatgcacccattttttcctcatataccttctgaaatgcatagcgccgattgtttggcaggatatcctattcttttatgtgctatcttaaccataagtgcgcggtatcacaaattagacgaaaacgatgatgcttcatcgtcaaataatattcaagttcatgagcaactgtgggtatattgccagaggcttatttcacaaacagtttgggcagaggcatcgactcgttctataggcactgtgttcgccttcttactttttacggaatggaacccaagggctatacattggcgctggtctgattatgcaaattctgataccggagagcttgcccctctaaaagaggttgtccttgctgcagaagaaggtggaagtgttactggacttgatgcgatgcggcgtagcgatagaatggcatggatgttgataggatctagtgttcgtttggcccaggacatgggttttgtagagcatgattcgggtgtcttcctggctacccatattgccgaaataaacacagctatgaacataaacagaagatcaatgctgactagctcgctgcatgaaattgatattttggatcacgacagtcaagatccttctttcgaaaatgaaccattggacctagttgtaatcaaggaaaaacagaaaagaaatatggtaaaccctgatgatgataggcctaattcacagcccgtcaccaaccatttaaagtttacaaagatgcagatggctaagctagagttgttgcagattacgtccatttgttacgagtcgctatacggaaaagaccccaagtttagtggtctggataagcatcaaaatctagcattattggatattctgtcccctctcttggagagttggtaccgaaggtatcacagattattagtaccttctagtccttcctatctggcccacaataacccaagaaaacagttcttgaatcagtctccagaattttatgccgaattagccattttgctggatagagagtctctgatttttgattattactatgcaaagttatacattttttctttggcattgtctcctgaaatctcgaagtctagtatatcatcaaggaaacaaaagcagatgaaacttgatgacatagctaaatcctcaaagtacgttgaaatggcttttaatgctgccaaagaaatgctatcagttacacaccgaacccataagttacgaatcctaaggtttatgccggttagatggctaaccaggattgttcgtgccgtagctttcgtggtgaaatgctatttaaccttaacttccccagttcccattgctcctagagagttcaaccctagtaacattttgcacgatgcagtcaattctttcaatggaagcaagacagatgacactagtagcaactaccaaagtgcaatgttttctgttattccactggatgagattattgctgtcattcaaagagctgctatttccttgagagaagcatcaccggatgagttacatctctgtacacgttatagtactattctcatgtacctttgcacccaaatgaaagcccgcaataaaaacaatggtaaagtgatagactatgaggcagaaattcaaaacgcgtataaggatgctgagaaagttagacagagtggccttgatagccctgccaatggcttgtctccatatgcaagcgagagatcatcgaaacagaaagatcatcactacaacttgacagagcccataaattctccttcgcaggagaatacttatgatgataacttttcacaaatgatgaacccttccgaaacagtattcaactggttctctaataatgactttggtgtaggattagaatttgtggatgcatggactcaagaactggaacaagactatcttcaaaaaatttcagagaatccgggcaattcggcaggcaatagttaatgttcattgaatcattacataataacacaatccttttttctagatacgaataattttcgtttatggcctttcttgggttcgttcttgttgccgggttgctctgatttggtgattctcaatggattgtgcaatttagcagatggattgggttcacttcggacagatacaccatcagtcaggttgagttgatctttttcttttaccaacgctagcaacgaatcagttcctgactgggtcttcttcactgatagcatatccctctcagattgtacagaatttcccctggataatacagtgacgctgattggcggctttactgcctcaacataaccatatttatcataccaagtgaactgtttttcaacatccatatttaaaagttgattggtgatctttttattggaaacaaatgttgaggaggtactttcccttttttcggctgttctcaaaagtgagtcacctgaatcactttgagacttcgatttggctttcacgttgccaagtcgccgttgttctccgtcatttgaactgttcactttttcaaaattcttttgtttagttggcaaagtaattgcatccttctcaacgcttgaggctgtgtagtcgcttactattgaatgctttcttgtagaggtttctgtattagaatcgacattccaaaacttaactttggatccttccgggaaaatcacatctaatgagtttgcatttggaaagggttgttcaggaaccttgttagactccgcactattttgcaaatcttcctgagaggttgacttctccattcgataaaagagaagatatggttcctctttctcgacggctttttgaaacgatatttcaactgtcttatcttcccctttctgagtatcattgaaaagttcccaaatagcggagtcttctcttccaggtatgtatggatattttcttaccagtgaaacataatggccggaatttatcgaagaacccctatgacatacgcagctttgaagaacaagtttgaagttcttgtgcgggttgaaggaatctagattatatttcacggtagtatcatcctccgaaataaaatagggtgaagaaatcacagtaggaatgattatttttgttttgtttttctgggtcttgccgttcacttccatgtaacgtttcaaacatatcggcaccagtggcagctttcggttaatgtcaaaattatatgggctatgcttggttcccttcaacggaagaaaaggcttctttttgaaatcaaaactaggctcagtgtgaaatggaagtaattgcaggaacatccacgcaggtaaagacacttcttcggaaaaggaggattcccttgcagaaaagttggaaacacttccgtctctcggacgagctgtagagagtgtagatgatcgttgtcttgggtaggtagattgagtgtttgcacgctcctgtacatttctaacaaaattatcgatggaagaattggaaagcatggtgttagacgagaactgcccttttggtgatacctgagaagacgagctgacaatagattcgtctcttgacaatgttggctccatatgggtaacctcttgaattatggcatcagtaaaagtacgttttagtactcctctctgtacgaactcactaatttcatcttcatattccgatatgttaccatcttcgaaatcctttggaggtgggatacctcttgagtttgagaaattttcacctgctcccattgattgagatctcactaaagtttttcgtctttgtaaatgtcttttgactttgatattactattgaagtaatcactcaaacagtcgtccaatgttactgtatttgattcattatcagggtctggctgactcacagacaaaaagatacatctttcttgaataaatttcagatcgtctttaatatcaaagcggcctttatgaataatatcaatccttaaagtcaacaatggaatctgtaaaacttcggctaagaatgcaaacatgaaggctgtatcattttgttgagacgacaacgcctctcggaacccaagatcggataaattgtggcataatagctgcataatttctttgctgacaagttgcccacttctcaacaaacttataatcaatcttaagttcatctttaacttaagaagggtctttttggggatatctttatctaaatgttcccattgattgtacaataaatactgatcataatcgtccatccttgcaaacatggcaaacagaagtgcgtcaatataacataaaacattcttccaattatccatgccaatcagtttgataggtttctcattatcgtctttgtagaacatgctggtagtaaccaatttattttgctcacataacttgaaaaattgatgcatgactaaacctttctgtaagtcctttccgataaaaggtagtagagccaaaaatgtaatttcatcctggcagatatccgagtggactccccttgcctcattattgcgtgagatcatttttgtcatattcctttgaaaggagttatgcaacattaaattcttgtgttctctccaaatggacttggaatgcttagttatgataaaaacgcaatctctccagaacttgggcgtaagctttggctgttagtaatatgttgattcatcggatacgaatggacggtacttactagctcttgcgtaggggattcattctctgggtcgggattcatatctgtatgccctgagagtcagttatgacgggttgttaaaataggggctttttttcttcctagctatgagcgcaaggacagtttacaccctgagcggtataaaatcaaattatacaatctcgatcaaagttgacgttaatggccattagatgcagtgaattaggatgagaaaatacttatgtaatcacctggcggtgcggaactataggtctcgtagaagaacgcacttgaggaagggccattgataaaagctggagacatggcaaccaaatcaacaggaaactttctgtgtaggtagaaatcactaactgaagtagactcgttatcacttgcccttccagttttctttgtacaaatacttatttctcttgcccttgtgcgccgcatttttttcttccttctagcgtatttctaacgatctgcctacccttatgtacacttcttatcgctggactattcttttttagaccagtaccacccaagatggactttaacctgaacatacatacatcattggacatagtctcagatcatattgaagcacttctatggacaattttgtttcaaagattgtttggaacaatctctccctcccagtccacatttttggggataacttatccaaaggtggagctgcctatactacaaacactaatagactctaagatcagtcagttcaaaagggatatcatggaaagcaaaacccttagccagaatgatcacgatgacgataatgataaccagtcgttagaagatgaaaccgaactaggatcctttagactgtccttcttcgaaaagttctccaaaagggatagtaaaaacaccctactcaaattctggactaacgagacgaaagaatctagtgaagatatcactggtatagtcaatgatgatatacagagaggatccttccaagactgttgggaaacgtggaacttgacactgtatatttcatcaggaaaagattatgccaacagtttcttggaaagtatgtttcagatactagatattacagatattaacaagtcacatattccaacgattagatcggtggcgatagcaccattcccgttcaaaatcgcctacttggtgaaaaaagactcatccattggaagcagtatggagtacattacagaaaaagatgctcaggaggaataaatcaggtcatattttagaatctcctgaaaccaatatacaatcattataaatcaagttacccttgttcttatagaaccctttcttgttcagatacgaaatcaacttttcgtcataagagtttggctggaaccaaatagattttaccaaatctcctttcactgactcaagcacctctttcaatgagttgtaagatacgtctggtggcgtgattacggacaaggaatattcatggccatttgcaagcgcctccaagattgaactttttgttttggcacccaatacctctggggttgtggggtttattggaacgacattcaaatttcggtccaagtaccatttaagaactttatagccatacttttctggattcttagaagctccaactaccaagtatgttctattaccaaaaaatgccatcttgatcaactgtggagaaggaatggaaagtgaatcgaggagaactgggatgctgattatgtcatcatttaaagattatcaagtactttcaagaatgccaaggggttgacgagcaacagtaaagttattccgatcacaataattttggttaagattcaaacaccagaagtggattcggtatcactttgatggagcttgctgggcaaaaaggatgaatgtaagcatttgttacaacttctatccagataaaaaacaggaagaggacagtagagctattatgattaggtccaacgtcttaagaatccttcgctcatcagcatcagttcagccctttttaataactgttaattttgcattttcccgcttgaattcgataggtgactgagtcggaaatgatggtggtcgtccatcgtcgcctttcttccctcttacaaacagttcctatctgagtttgattttgtttctagcgtaaacctatgagcgtgtggctcgtattctgcgaaagataattgagtcttttgttgaatggcataaatgcttttcatgttttgatgtctagtcacaggtgacagcatcttccacttaatcttagcgttcgttgagactttgaaaccactgagtgaggctgtatgacttaatcagcattccaacggagttgttagacactcaagcattcatatcactttggacttattcttgggccaaatattataaagcactagcagaccgcagcttactgatccttcgtgtcgctttgttccattttcttcagtctaatgtctcttaatcatgttcattcacgaagaatagttttatcggcctgcttgatcttggtattcttcttccttcttgcttggttgcaccatcatatagttaaatttaatcagtgttgattatgtaagatatcgagtaatcgaacatctagagccaaataatttcctcccatcacaattaatctgcactctagatttacctggaagttctctcctataagctggtttcatgtcagataaggacataccctcatcgttgaccatctctccctggtcaataaaaccggctgctaagaaaaagaaaatttctcaagataagacgaactcatccactgcacctaatactcatctatacggcaaagtgatacggcatgacaaagagaaaagaaataaggcttgtaacagctgcagaaagtccaaaatcaaatgtgaaagcagcttagaacaggataatgctccctgtaaaagatgtttaaaccatgggcttcaatgtgtttatgaatacaaaattccaagctataaagttattggcggctcaagtgtcaacgaggtactggataactcaaaaaataactttagaccaaccgaaaaggcagatatctccaaaattttgaacccccaatcgtcgcaggtactcaccacttctaccaaccaggcaagcgaaacaccaatacagaattcaaataatcaaggttggaagtcgtcagtggagaaccgtttgcaaaactttgactccactctcaccgatattttaagcctacttagagatcggcagaatggaaaaagtcaagaaccttccatttcggctactatagactcaatactaacattggaagatgctcatatattgtttgactattttgatacaaacattacacctcaactatttggttttgatctttctagttattcggttaatgagttgagggcaacttcacctatactttttattaccatctgttgcatatcctcaattcatcatatcgactttaaacacatacatgagtccctcaaagggcttttagaaaagttatctcaggacgttttacaaaatccaccgaataacgaagtagaagctttcaacactataattgcattatgtatatccggtttctggtttcaaaagaatcaaatctttactggactggctctccagctagccaagaatatgaacctaaatgtcccagtaagaaaaaataaaagaaagaggagaaattcaaactcaagatcaatatccgataaggatcgtttgaagttatggtatctactgttcattctggatggacatcagtcactagctttcaataggcaaccgctattaagttctaatgaccctgctcttactcatagtagacaattgctttcatcggaaagtgttagggacaagtactgtgaagccctgagagaaaacccttcaactgaattgatactaaatggaagtcctccaggaagttcatctgacacggactctccttcaaaagtgacgaatggctcaagtacatctgaccagtcccacgagttaaaatattctgatttgagactagtatctcaagtggaatacaaccaagcaatcagtgaagtgtttagaggaaatgcatgggacctcttaactcctgcttcatttggaatcccgtttaaaagtaacgttgaactggataaatggatggttcaatggacggtgctactttcccccatgcattcgaataatatctggtcttcaaagtccaccttaatttattacaattttgcaaaaatgcatatcaactccctctccgtgaggaagctgcatacagatgggtcttcatttcccgagtggaaggatgatgaagatgaggatgatgagtcattgagcaacacagaatacgaaaataaaagagcccaagtatcaatttgtaaggagaacagtcatagtagtgactcagacgactcagattctgatgatgaatttattactcactctccagtggtgtcacagcgtgaaagtctgaaggtgtcttctcagatagcagtgtctgcggccgaaacagttttgaatttagtactcagtgacaacgatataatcagtgcattaaggtttgttcccgtacacgttcatgtgatgctttactacgctgcgatgctagtcataaactcacctacccttttaaggacgcacttcacaggttccaagaaccacaaaggaaaaaaagaagatcctaacttaactgcagtcaaaatcgttaaaaagctaagaaacttaatttaccaccacaagcctatagaccgaaagtttgctgaaattgtcattctaggtttggataaactattggctgacaagcattccacgttaaaaaacgaatcttcagttgatccttcgacacttcagaaagtttttaatgttcttcatgaggatgaaataaactttagagaggagtccaagttagctgaaaagatatttgcatggcctggaacaaatcatggccatccttgaacacatttaagcatatttactaacatcgcgatatgagtttatgtacatcagctgaactagacccagttacacagaatcatatcaacgtatttaatttcaaaaagatgaaggttgattggaatgacgttaaggagaatgtcattagagctcctcaaatctttcttcagaggaccaatcttgccagtacaaatccatctctaattgatgatgaaataatcggattgcaaaccaacttcaaaaacttagtcacaaactgcaagcaccttcaggtttctttgaagaggtacgaggaatctgctaagtttatggtggaatgtgggttacaaactggtcaaagtcttaaaagtctagttgcggatacatcgaaaactcgaagtgaaattgacagtttatttctcaacaagatcaatcagtacaatatggtattccaagattgcaaaccaattgtcatagaagttttgacttccttgaatgatagagttggaagcagattgaaacagttggaatctcataataaagaagtagcaagcttgcttagacaacgagaatatgcacttttggacctaaataaagaaatgctatgtcttgaaagattaaaagctaaaggcaatttaatgacttgcaaagagcagcagaaaatcttcacaacagaaaggaagttaacagtatgtgaaagaaactttaccaaactaaacagagtgattaagcaagagcttcctgtctatttggtgatttccaagagtataattgagaacattctccaagtgatctatttcggcacattgacagtattttatgaactacagaacaagctcaagtccttagaacgtgatattaaccttcatgatgcggaccaaagtcattatagtacaacaacaaaaaacatggaattagtttccgtatttaaggccaaacatgcgccagtcgctcttcaagttgattccctgaaaatatgtcatttctacgagaagaatctacgaaatgtggcctctaatatcccttcagcttcgactattgttacaaattattcaggtctaaaaatcgtacaggaagataaggatttagtatgtgttgcagggtataattttgaaaagattaatgatcaagacctatcgttcaaaaggggtgatcatattaaggtactcaaacaagagggttcatggtggaaaggagaattgaacgggaaagttgggaatttcccctctaattatgtcgaattaatttgagaactccctttcttgtgagtgccttctgtcatttcttgaatggctgactcccatttaatagcacacatcttagaacaaaaatgtcttctgattgggacattcttagcatcggcaatgtcccaccactcataaactgcagctacaggctctataataatattctcgcatgatccacaagattcgccattcgtaccttggattagtgcctttgaggccatctttaatatgtatttgctggtactttttttccactgtttagcttcggaaatcgatattctatagtttgatatacatctcaatgctagttctgtaagtcgtgggacatatgatgtagagttcttaattagctcttgctcttgtgaatcaaaatccctttcatcagcaaaagcctccgaaatggtagtttgttcgttaagtagattaggtgtccgatttggagacaggtaggggccccgttcttgttcaaggactgactttggagaagatgttgacttctcgagtaatgagaggtcaccaccaaaactactataggctttgtttagcctaggcataattttagatgattttcgcttgttggaccatctgattcgactagcataccgcggaccaggtttcaaattcagttcgatatcaccttcactaggctctttcaaagggttaggacgtagagaaaaaacttgcagtttatccagcttcaagatcgaatgcggcaagtggactatattgttattacccagtgccaagtaccttaattgagtcagcttctttatgttgcctggtattctagttagatgattaaaccttaaggataaaacatcaataaaaggaacttggaataaactatggctcaggctactaaggtgattatggccaaggaaaacatgtaattgaggagacgaaagatggccagagtcattcaccattatcgaatccttaaaatcttcgaactcatcaggtatagaagtaagcccaaacctttctaggtcaattttattctcattatcctcatcaaaaaccatgcggagtactttaacagcttcccgttgggcttctgccgagtctttgtaaagaaattcccgatgacccatgtcatgatctttagtggggctagttgagtaaagttcacaatttctgactcccgagactcttccatagttatcgatatccaattccaatgtgtcttctgacgagagattttttcgggccaactgagagaacgtgagttgcatgggaataggttgagactcaggagcgacaacatcaatgggagaagaacttgaaagagaatccagttcgtctattcttggaggcgaactgggcatagaatttcgttgtgacacgattctgtcagatgattccgtgaaggacgaaatcatataatcgtccacttcattgaagtacgtgttggccgtgccgatgttaaattgccggtctacctttcttcttttttcatttctttcagcttcagtttctcgagtatgcgccatttcggaagatagtttatcgcaatcatccttcatgagctagtcaattgaataaatgctttcttccgtccgtatatgagttggatggttttcccctgattgatcaacgagtttaaggctataggagtaacgcgcgggggtgtccaaaaaaataatcttacctaattgagagcggtgcagtctcgtgacttcaattcacattctattcaaatatggggtaagaagtctttcttcaacggggatacagtttctcatgaactgctggctcgttaagactaattcatgatagataacataccttggaggtggtacagctttaaataatgtcgaggaaggatgaatgtacactaactggttttcctttaacgacttataagtcccacttttagacagtttagctgtattagggaagaaaccggcgatgaacgctcgttgaatcggcagtagtttgctgtttttgctatcctgtcctgggtttgagattccgtgttcggatttttctttgtgattcaatatttcaactctgtcgcacactctttctaactgatctcggacgtttctagcccttgatagcgatttaaattgcaggaagttatccttgcaccactgatatgaatatcctgtgtccacccattgattgaagattgttagcaataccatatggtcccctccgttctcgactacgaatgcttgcttggccttatcagccatagctttgtttttctttggtctgaagaataaggcactagattctcccaacatggaaactatagtcaaaacttcctgaacacaattgtattgatcactggcaagtagagtccttgctagcataggatccgttggaaactcggccatttgccttcctgtttttgtcaaccggcctttttcgtttagccctcctagagaatacagtaactccagagacttcatcaaggcctctggagaaggtgcatccatgaaatcgaaatgcaagagatcgttgatccccaaagtcagcaataataaaaccacactggtaaggttcgtccttagaatctctggagtaggatttttaggcagttcgttgtcgtaggaccacttcgtatacaatctgaaacatttacccgggcccactcttcctgctcgacctgccctttgatcagcggatgcttgggagcatggagtcaccaccagactctccataccagttgcaggattgtagacattctctttaacaaatcctgggtcgatgacatatttgatgccgtcaatggtaattgatgtctctgcgatattagtagctaagacgactttccttgcattgggaggagtcttctcaaatattttctgttgcatttcagggggaagattggcataaattgggcaaatgatcatttcttgaattttggaccccagtttgcgacatatgtcggttatgttttcttgcatgtattcaatttcatcctggcctgttagaaataccaatatatccccaggagtttctttttggttcgtatgtatttgaaatattgtagttatcgcagcttgtaagtaatttgcctccggttgaatggtgtaatgaatatcaactggaaatcttcttccagggacgttgaaaattggagcatcgtcgaagaatttgctaaacttttccgcattcattgtagctgacgagatcaataatctcagatcctttctatatttacagatgtctttcattaatcccagaagaatgtcagtgtgaagtgttcgctcgtgagcctcatcgatcatcatggctgaataactacttaattcagggtcattgagaaactctcttaacaacataccatcagtcatatacttaattactgtctgatcagtggatctgtcgtcaaatctgatagagtaacccacagtagttccaacaggacagccaacttctttggatacacgagaagcaacgctcatggctgctacccttcttggctgagtacatcctactttttttccattttttgtgtacccagcttcatgaagaaattggggaagttgagtagttttacctgatcctgtttcaccgacaattatgagtacttggtggtcctttatggcctctaaaagttgttctctatacctgcaaacaggaagggattctctagtttgttggatatttcggatctcttgattcttaagatcttgaatctccatctgttccgcttgtttaatagccggttcttcactgtttccagtgaaattgacatggaacttttcatcaaagacaaaatcataattcttactgtctggcaggctaaattcctccaaattaagttcttttccagtagtagccattctaatctgttgactttcccaagcttgatctctggtttgttttgtagcctcatatttttcctttgaataaagtacatcagcctttctctttctatccgctgtggaatcatctggcaattggtagttttctccgtccttcaaaagttcagatcttttctcaaagatctctaaaatttccttcttaaaactgatttcagagcgttccttctctgtcaaattctcccatccatacttggctacatcttcctctagttcattaacctctcgtttcaaaagtaggaacttgtccttctctcttttagttagatactgctccctcgctagtcttctcaattctttcatatctgtggtatcatcagctcgtggtttgggtgctttattcgcagttttatcttgatctttcagtcttttcgaaaactcatctctttgtttttcatcatcatccaagtcatctacagattcgagtttggtatcttttttctgctcatcatcactatcatctgaccagttaatatgctgccttctaatgctaacaccaccagttccctcagacatctcaccttctgaataatctccaagatacgataccagataaagttatgtgccagaaatacgttcgcgatgctcaaagatgtctattactacttaagagcccaaatccatctatgaaaagaattcgacaaaagagggtctagaagtttatgatcttcatgatgaagaagccaatcaaaatcacaatgccatagcaaattacagaagctggaacacctctcgtgataaatgttccaacagtcaaatacggtactccaatttcatccagttgacacacagcagcaacgttgggaaaccctgaagttggcaaacccatagccattgagcacatcaatgctgtaatcatgattaaaatcctgggatgtggctctggtaaagcatttccgatttcggctgccaatggtacaatgatcaaggctgcaacagtgtgagaaacaaatgtggccaccactaagaccagtaaaccaaaaacaagtgaaatggaaaaaatatccaagtccatcacttgagcttgaatcgcttttgcaatatgagccagtaacccagaagatgagacagctttacccaaggcaataccacccattgctagaaggacaatattccagggatagttattaatatcctcagtgaccagtagaccagcggagtaaaaggcaatgatgggtataattgcaataattcccatttctccaaagatataactcaatttggattgcaaacaccagagaataatggtgatcatggtaacaaatacaatgtaccattgcgcaaaggaaaatggagcgtcaattggtttgatggagaccaagtttagatgcttttggttttgaaatgtcagcaataataaaatccacactaataccaatgctacaacggccactggaagagcgataatgaaccattctccccaggaaggttgaggatccatactttctaaagctacgatattctggggggatgcaataggggaagcagtgcctccaatgttcgatgccaatgcaatacctaaaatcaactgttttgcaaacactgaaccagtcggaagagttctcaacaatggttgaatgatggataacatcaaaactggcgccgccacgttactaacccacatcgatgcaaatagagaaacgcccataatggtcaaaagaactatcggaggagaatttcctgcctttgaaaggatccaagtggagatggacttgtcaacatgatacttggataatgcagctgctagtgtaaaaccacctagcagtaacattataacagacgaccacatttgggaaaaaatgtactttgaagcttcttctccggtgagtacatggtcatcatatggatctttgagcacacctaacactacaattgataagggaattagtagggctgtaatgtatagtggaattgtttctgttgcccaaagtaaagatgcgcagaccagtattgcgaaacagttcttttgctgagtatcttcaaatggagaaaggaagagaagcaagattgacaggaacgcaattgcagagcctttaagtactgtttgagaaaccaaaataattggaattctaagataccttccagcgcccagcgaaacattgatgctgcttgcaataggaattccatcaggggtgcctttgacctcttcaagattagcagcttgtgtctttctctccatccccaacatatctctccagacggtgtttctctcccaaacaatatgttctcttaaatgggatcttaattctgatttggcaagattgaagtcgctgtccgtaaccaaaagagagtagatagagataacggaggcaatttttttgttcaaagtatctagagttgatggtttgaaaatataagagacttcaggcagctttgccaaatattctgccttaacctctgtttccaacgatttatcgaacttcttcaaggctttcgaaaaccctatctgattcaactcaatgaaagacttcaattcgctaagtgcgacataaataccagttaagcttttcttagtggtaatggtgacttgagtgctaaaatcaaggttaaagtcatcatcatcgaaaagctctggcctggaggttcttctctgaacaagggatttcaaattatcgtagctatgacagttactatcgtttgctgagttgattgaaaatcttgaagatgataccgcacctgtttcatcggttgcgaagtcgtttgatttgatagttccaatcaaatctcttagtcttttacgaactggctcgtcctgcatcgttgagtttttgtaagaagattcgaattcttcaatttctcttattatctcatcaaaatctttataaatgtgcttttccttctgtttgtagaaggtatcgatcttacgcagctccttgtccagtgccttgaaaaagacatctacaggatcagagtctttgaatctgcttctcaaaggttcctgctcactgtcataaggcgtagtagtcttggaaagtgctccactgttgacataatctcgctgcaaagagtagataagcttttttaatgtcgagtacgagatgtacttagtggaccattctggtaccgcattaaactgaagagaatgactaaacttcataatatacggttgctgtttcggatgaggtgtaagatcctttaaggggatatattcatgagtagagccttgaatcttagaagtcagtgaggcggatagtgggaccagagggaaggaaggaggtctggatgttagaaggcatatttttgtcgggcgcgcagtcgcacaacgtttctcgatacagattgtcactccatttgccatctggtaggccgccttcgcacaacctctttccatcccatcgccgcttcgcggcttgcaggtgacaggaatcggaggatcggacaaacgcggaaacttcaagtggggaggagactttaaaagaaacaagcaagtgaactttttttttttccttttaggtacatcttcggggctctagatatctatatatatctcacaacggatccctcttttgtttaagcaagttctttgacaaagaaggcaaatgacaaaatggctctaactaaaaagccggtgataaaacctatttttatctctaaccttgaccagatcgagaaggtagagaaggtagagaaaacgagagaacaggctctgaatgacatcagggaaaagctaaaatccaacaaactgaaacaagaggaaaaggcaagagaggaaaaggagaagcaggcaaccgtcatgtcttggtctccttcaccaattgtcgcaaagaaaagttccagttggggttcacagagttctgggagtagtggcagtggtactgagtctcctgcgataagagactttaggcgaaaacagtcacgagaattgtttggggacttcaagttgaacatccctttaaaacaatccaaatctgctcagagtatcatggtgctaaactcagataactctagtaattcatctaaacgaccatcgtttaacaaaggtcgctcagagagtgttcttcagtttacggcttcaaacaacaaactggattctatttggttacacaagatgaccaccatctcaagacagcattcagttgtttcgtcccttgatggacaagatccgaacgaggaggacgacatcatggaagatgttgaacaatttcatgtggtatcagggaccactaccccattggacatccccagcagctgccatcattcaccaggggactctgagtatttggatgacgcagatttcgtcgccgtctctccgaagtcgcaaccccccagtatgagtgacttagcagactactacaatcagaaccagttcctttgaaataaccgcatgtcagtggtaatctgtcatccgatcgcgcgaagatgagaaggtttgcaggagtttgaaaggctaggcctgaacaggattgtttttcataactatatcatgatactacatgttacattaattaatattagcaaattcataatgccaaattgaatattgtggatcaacgattccacttactcgtcaacttttttgcagttcgtagttcttgccccttttcttctgtctattttggtgtcctccacttttttcgcactttaagctagctctggtggggtgttagttgttcctctgtgacaaggtgggcccaaattctatcagtatcgaaccattcattcgtatagcaggagaggaactctggcttgctctgccttagcttgtaaagacactgatctttgtctccgacaaaaagactttcaatggaattctccatggagctcgggtccatataatccattctcagtggatacttcttgttcttaggcttgggcaagcgatctacaaaggagagtttttgcctgctgctgaacaggttcagttggtctaatgttttggcgaaactgcttgcgtcgtactccctcaattgattgagatttatgagcaagtagttctctaggtgaagttgtttctgaagatttatgtatccatattgatgcagttgcaatgtcctcacgataatgacaatcataaacttgaaaaaatcatgacatctaagcatggaagaggagtcatcctgcaagacggggtaaagtctgagactcaatattagtatgctttcgatgttgggccacacactttttttgatgagtgaaccaacaccaaaaataagcagaggcccaaagaagtgaactagtatcataacacaatagtgttgccctgtagtcgcaaatgcagggaagctcgtgatttgaaagtcctgagtccagtccagtaagaatggaacttgttccaggagggcttcgaagatgaactcccgcacatacccattcaacatccattctttggaggacgttgaaagctgtggagggtttctactgaaaagattgatcaattgttcactgatgttagccaaatccgctcgatgtcgaaacatggtgctgatggtagatgagctgacttccaaagaattagaattgctcaacatcggttgcgggatatcaatctcactgaacctaaaactttgagttaaatttggtttcaattcatacaagtgagtgatagtcaacaatcttgtgaaagaatagcaattccagaacactttacggcgatattgattggcatctttattgatgtacaattttgcaacagtgcagattttatcacctaatgcgctgtatttgtaggcaatttcattgtgaccagagcataagaagtaataggagatcaaagtcagcaactccaccacttgagactgctctgaagaaatgcacataagaggaactatggagagtgcatcccgaatgtagacaaatccgggcagtttctctgggttttcatacactacttcatgtgagaggttgataatagttgaatttgaaacgtgctgtgagagttttgcatccctaatcagagatattgccacgatacacaacagtacggatttaaaaaacagttcattatcttttttttcttcggtaccttcatttggttgaaacgcgttcacattgttgtcgacagcctcaaataaagtactgatatctgtgctcagaacaaactctttaaacatgaagtgtagactgcctatcatggaataaagtctctcgttggtaaaagaatcaagcgcacggtcgatggctttaaatctggaaggatctgatctttgatccttggcaatgtggagttcattttccaagaatttgatgcgatcttgcaaacttctaaaatgactttcaagaatggaaatccttttacccggagtttggtaaacacatttgactttactaatagagcacaacttgcaaggatttccccctgtacactttgtttttcttttcttacatctgatgcaggcgactttggccctaggatcttgtttcgacttggttgctgcgggagggttcaccatcagcgatagagatgacttcggctgtaaagtgtcctgggtgacataattctgaggaaactgctgatacatagggaccccaaaggcttgccctggaacaattggctgtgggtgttgttgttgtaaaggtagggaatgaggaggcagaggagtaatctgaggtctgccaccgattgcaccgccaggtagattctctaactgagaactttgatggctgctgcttgattcatacatatgagttggctggccatggcccggattaaatgctggggacggttggtacgtttgatattgccactgctgaggatactggagttgtgaaaagttagggatggattgatggcgaatgaatggttgctgtggctgcgatggctgctgtgattgctcatacaagttcagatcggtattcttttgtgtacttgagtgtttttcctctttgccagctttttcgtgagccatattatgatttgtgaggtgaaagtgaatgtttctatttttattaataatccaataaaggttgtctctgaggctagagactatatgcttttgtttctaaggttatgcttggcctataacagcatacccgttttaagtgtctacaggtggggagctaaaatttgaaaatcaacaggtcaaggtgcttttatcaccgtgggccttcatcacaatagtgactaaaccgcaccctaatacgtttcttttttcgttccctcatgttcctgtcgcgtctgcttccatgcgaccaaaatgcaattaaatgcactattggctattgggataatgcagagataggcaatgtatactttgacttcttaaccaaactcgtagcaggatagatagccttacgggtagctttattacacgatcggctcattcaaataatcaactcaggtattgagtgagagtactttgaatattgtgcaatatcagctccgagaagactttcagggacagaatgcaaagcgccttttttctgaaaacggcattctccgtggatgcctccagataaacaagaaaaagtttcaacccctatacaattctcttcgccgcgtttcaacggcgactaatgcaatgtccactgctatcagatgatacatattactggcgcccagatacttcttcactacgtggtcttacttatctctgtgaaattactcacgcttttttaataaatcaactcatgaccacaagttatgcctacagaagtaacatgtcttatgtatgacggaaacgatttccgagaaaaatctgtgcaaacaaaaaagaaatcatccttgataggagaaaaaataaaatgcggtaacatccgttcagtcattcttctcaagcgattgacaaacacatgctaaataacaaccaaaatagctttgcccaagacaccaagtgttcagttgaactgctgtgcatgaaagcgcaactgacttacgttttccgcttcagcatttcaaactttttttagacatgtgacttggccggagttttcctctttggtgtggcgcacagcccttttcgctagttgtggcggggcgcattccactctagggtatccttctaggactaaacctgaagtgtggacgctgagtaaacgaagcattccgcaagctggacgttttttccgactttgggtaatttgcttcagggcaagacaaacaccagtggtgagcttggcgtcgaatgacctaggcttgaacttgcggagacaacctagttgttcacatctggcaaaacacgtttattatttacatacgttgcattcctgctttcgtgtcatttacggcatcgtgactggtcaggaaactgaccagtgtcttttgtgtcgaacgtagcagcatggaagatgagttccgagtcgcgtgtctcaggtttctgatctatgtggaatgaaaatgaaaatctcgaactgctttttgaggttgggtgcaagaaaaaaaaaaagaccgcatcgttgtcgatcccattttggcatgaagttggtgaaattctagctaatgcatagctttaattagttattacgaaaacttcttgaagggggtgctagtactcaaattttacccttactccgaatgtgaggaagacattattccgcacgacttaatttcgggactttggttccataattgcattcacattcaatgggcgatccttgtcgatcaatggtggatccctcagtctagagggacaaaggcgacgcagcaaatttagcgcaccaagttaaatcttggaatgcactcagctcgccatgattcagttttgattcagtgttcttgatcggtgaagatcctttcaaatgcaaaaggaatagttttctcatttcattgcagtacgtaattccgtatatttcaccctattagatcgttgaaatctatagatacgactttgcgctgggagtaatttcttggcggcctgattcttgatgaagttaatgcaagatgaagggttacacactgccaatccataaaccaactgctgatccatgcatgcaatttcagttcgtaagaatctttacaggatggttggcatttctggctttctgacttgatggcaatatgaaaccattattgtggcacaattgttgtgggattttctttttgcaatcatggttcaggaaataatttaaatgaatcttatgcatgaaacacttccttgcatgcatcacgtgctttcaatgcatttcaaatatacctggatctagaatcaggtttatgtccgtaagccagctaagagacgcctgccatgaccagtcggtagcctattgtaaaactactctccaatccaacggaacctgtaccaagagtgcgtgctggcgactggtatttaatcttattgtttcgaggcaagggatctttccatgcatgttgaactaactctcatttggcccgtatccgaggttaactcatttattgcagacaacattgaccatgaagcatctttttgagatgaaacaaagtctggactgggctttttcggttgaagtgttagcctattgaccaaaatcaccgaatgatgtggcctacccatttcacaataatttcagctaatgtactgaacaccgtaacatttttgtagtttgaataacttgtgcttgttttgctagaactagaaataccctgttgaatctaaggataaaggggagagtgtgattggataaaagatgaaatgtcaataagataaaaagaacctccgatgccgggagtcgaacccgggtctgcccggtgaaagcggaccgtgctagccgttacactacatcggatgtagataaccaaaaattaaaccattgagcttttgttatacaattttactgggagctgtttctgccttccttgaggtaattgatccatcccagagatctaccattaaagtatactgctaacccattttggtattttacttcctgtgtatactctttcttgattgctagttctctcgagttataattttcacagcttggcatggttctgcaacggacataatatttcactcagttcacatccatcacctgcaatgaacttttattagctttctaacttacctccttccctgtgcaatcagtagtttgaaatttttttcactatctcatcctattctgttctcttcgcccttcctaatgtttttttttcttcgattctcactcggtgagattgagttaaaatgcaagtcttagcgaccttacataaaaccctcctcttctccatagttatcaatgagtctatagacatggtcccaactaagaaaaagaggtcattttatgggtgttggacgtgccgaagcagaaaggttaagtgtgacaacggtagaccgtcttgccagcgatgccagaaatccaatctgaattgcttgggctacaatatcaagctcagctggtcaactccctatacagttggaaaacatggcactcttgttccattatctaactatgttttggacaaagaagatgactctatacaacgaagaaacatatctctggtaaggttcacaagtgattcaacttataagaacgacaaagatttggacttggtgctcgatgagttggaacaactacctgtctatggaaactcgcctaacaaaagaggcccttttatggtgttccaggcgtcaacagatcacaaggtaaagacagagacaaacacaagcatacctaatgatagttcaaaggatctattcagcatcagaagtttaagttccactaatctcgtgccatacatgaccatggatgtagttgatgtgattaatcagaatagggatttcgtattagaagcattcgattcaaactttgtgcatcaagacgccttcacgcatgctctgaataccaccttggaagatgaacttgaacttcatcactctgcccctgcctctactttcccagagcgagatagaattgttatccacgagcagctgaagccttctgcgttagtgactttcaaaggaatcaagggagacattaactccaatcctcgggatgaacaagaagttcttgattgtctatttccaaactactacaactctgaggctaaccatagcatcttagagatgtccttatcacgaaaccaagagctgaataatttagacaaaacatacaagctcttcgaaaacctttcacattctcatatctcatcgatcagagagtattcttttccttggcttctatctactcaaatgtttcaaaaattaattaccaatttccagtcagaaaaacatttcatgatgcttctaactttcagaggaaatgttatggactctgtcattctccctgtgctgtaccgagctataggacaaatgtcgatcttaactgcagacattgagcatgaatttggaagaattatttcatctgaaatgtttcacaagaggatgatgagaataatggtattgagtgctttgaatataagtgctttcttactctaccgaaaaagtctattcgaacaaaatttttacggttctgattacctggaaattgctatcgttttaagaagatttataatccttgaactttccaaccttataaaatgcttactggtaccctctggggtaccattcaaggatgctaaaagaaaactacaaatcaaaaacggtaaacttgtgaattacctgatcactaatgacttgataaaagaattgattgtggttcttgtatttttcattaagattgatgagctttttggaataatagacaatttcaccactctgtttgacatccttgatcagttggtggattatctgaacaactataaaccttcattttatgagaatgctgacatgctggaaaagaatatcaacttgaagttgattattatgtattacaagtttatgcaaatcttcttcttctccactacaaacattgacctatttaattacgaagtcaaagataaaaacttcgaagacatgctcgatgaaaattataataagatcagtgcggccacgctgaatgactcttttaacccagatgccttctttaatatagactttttacaagaggaagtttctgtttctgaaaaacaaaacaaaagtttccttagcaagagttttccagctaggttcaactttgctaaaggctattctgactcggaagaggagtccaatcacaatcaaacagggtcggaaaaccgttactataccaaagacaatgaaaattcacgagttgctaattcacccaccataaaggaatcgttgattcatatcccctacccgtacaacgaatctgtttacaaatacagggatgaatctatagtttccactttggagctaacctatggaatgccagaaacgcttttccaacttttcaagaaaacagtcactctaacaaaccatcatagtttcttcaagagaagaaacttgaaacaccctagaaatttctcaaaggttgcaagtgatctagaaaccgaattaaagagttggacgttaccgtggattctctatgaatccagtgatactatctccatttcatttctcagtacatttcatcggattctatttcacatgtccatgagttattacaattcaattctcatctacttttatatttttgtgcaggatttcaaagcgtccgacttatcttccttggtgcaagaatcactaacgcacttggaggctttggtctctctttctgttagttcaaatgtggtcaaagatttcactgtccatgtgccattctggccattctttgtctgcgcctgtggagctacgcttgaagcagatcaagctagagcagttgctctaatgaaaaacttcaagacgaatgagagatggataggcaagcaactaattcacgctgtatgggaaaagcacaggcagaaatttacagatacaaactgggtcacaatgaccaaaagttgggacataaacgttttcttatgttaacttaaatatagtaatactggttattattagtgtcatctaaatgaatatcagaacatgtgaaccctactccaagtagtcgtaagatggaatgtccaaatgtataaacggagtctctgtactgttcacggcgtaatatctatgtcttcctatctgaagctcagcgtcatcgtacgtttcagctgaaaaggtgctatcatactcatcatatgaagtaccaatatcataataacgatgttctgatgatacagcattatctatagttgatcccttcaaaggttgaaatggttttccaaatcctgcgttgatcaatgacttcttaatccatgggttaattatgccactaaagtggaactcgatatctctaccagtgtatctactgactgcctttctcaaatcaaccaatgcttgtatagatgtgacatctacaccagtaactgaggcaaagtcaaaatgtataagtttaagaataggtctgttgtcttcgacaacttcaatttcatcttcattagaatcaatgttcttcttccgtttgaaaatattcttgacgctattaaagttccacgtaagctcacctgggtcgttccagggtctgtccgacttgactttataaacaactgtctctcctcttcttgtgttactcttcatgtaatccaaaagggtgtctaagtgcctggaacaattcaaataagtgaaagcttcaccaggtctgtatacaatgacaccagttggcggaggtaaaatctcaatttcttcattgatatagtttgcataagtgtgagacgaagaaagaggaaactttgatttaggaattggcacccatcgggttgcaaaacgggtacgtttgggtaattttgataagtcaaagttagaaggatcaaactcctgatccgagggatactccttggagtattcctttgtttgcagttcaatatcagaattctgaccatcttttgaaaagaatttaatatgtattttcttcttctcaatggatccggtatcttcgttgattgaggaggatgattcggaatactcagatctaccagacctgctgacaacaatagggtcgatcacttcagcaaccttgattcttccaaggaactgtccatgagtgcgaaggttcctccataacaaagttacagcggatgcggccatagcaaaataaataccattctcaatcgttgagaaaacactgacaagcacacagatcaggaagatagcagcatcaagtggagcaatcaagtaaaaatcccaagtaactctccagtgagccatcaaatctccaacagcgtgaataatgacggcagacaaactagcttttggaatgaagtagaaagcctcggttaatgcgtatagagccaagagcacaacaacaccagtataaacacctgctagtggagtacgtacaccacatttggctttcaaagctgatctggagaaagaaccagtagcagggtaggcactgaagaaagtacctaaaagattcgtgacaccgatagcaataacttcttgatcaggaacaatcttataatcattgacacgaccaaaggatttagaaatagatatgtgttccagaagaagaataatcactgagactggaatttgacttgcaaaagcggagaatataccattaggcatttccatgacaccagtgtgtttcaaaccagaaggaacagttcctaaaatggaccaaggaactttcttagcaccacctgggtacttattgtgtgtccagtcatagtatgcaccccaagaaacaagtgtggcaaaaatgatgacaacaccattacgcatgactgaagtgtagaagaaccacttctgcttgctagggtacctttttggaccaaagtcacagacatatttccaaaggtataaaataaacaaaggaataataccaaaggcggcatcgatggtagaatctggtaaatgtttaagtgtttcgataataactttgtaggttgaatcacgagtattcacaagcttattgaaacccatcagtccaggaacctgtcctgcaacaatattcaaagctgagccagtcatgaaaccaacaacagcaggcatagagataaattccaacaagaaccccagacgcaacaaaccaatacccaaggcaacaacaccacagataaacgctacagcagttgcaataacatgtgcagggtataaatcgccatgcttctcttgaacatgagccacaaccttaccgacttgcaatgacatgactgcgaccggaccgatagaaacatccttagaagtagcgaagaaacaataaatcaggacaccaacaaaactggagtataaaccaaattctggtgtcaacccggcaagctgtgcgtaagacatagactgaggaaccatgacacatcccacagtgaccccagcaatcaaatcagagtagaaccatttcaggttgtagtgcaaaatccagcgtagaatagggaataacgatatgagataatctttaaatctagtccatggagagtcgacgatctcatgaagaacatctaatggtccgacctgcttgtcttcgtagcctgcaatcttcacagattcatcattagcaaatttgaagtgctgtggttctaagggaagttctccacctcgttcataaatcgaatcagacatgctaatgtaaaaagtaagattgctttcaaaaattgggcacagctgtcttcacctttataccaaatgtcctcactatgttagcagatgacaggtaccaggagatccctggaaaaataagaaataaaacttggctaaagcttaccactatggctcaagcgacaattgtgtttgtgcacgtgacaaatatatcctcttttcaaaagggaatctactgcaatcaacgacacgcgaaccgttccagatagctgaaattcctattacagtcgggtgccagccaccgttacgtgataactgtcattacggcgttcgaagccacatcaagagaagctttaagtttttccatggcagagatgacatcttggaaggaattatagagtgccacaggtgcaagtcttatgacatctggtttcctttcatcgcaaatcacaccaagactgtgtaattgctcaaaaacgataggcatccatccatcagcgaacaataaggaaatctgcgatcctctctctaacgacgtatgtggcgttatgatagtgaaacccctggagagcaattctgtaggcttgacataatgaggggatctcttgagcagcacctccattaatttagtcatttcaatgcttttttcacgaatagccttaatgccaccaaacttgtgaataatctttaatgaactgtgtaatgcaactacatcaaccacactaggattgctttgtcggaatcctagagctgacggaattgggtcgaatacttctttcattgaaaatctcgcagatgcattatttccccaccatccagcaagtctagggaaatagttaagcggagacgactttgaatggaacttctgatcggtccatctctcatttatgaacacacctgctattcctcctggaccactgtttagatacttgtaggaacaccagcaagcaaaatcgacgtcccaatcgtgaagtcgcacgtctacatttccgacagcatgagccagatcccatccaactattatttctttttcgtgtgcggcctttgtaatctctttcatcttaaaatactgacctgtgtaatattgaattcccggaaagcacatgagagcaatttcttcatgttggtcctcgataaccttgatgatgtcctccgtacgaagtgtatactcaccagtacgaggctccagctgcaagagatcgtcctctgagagatcttttagataagcctggttcaaaaatgcatagaagtccgagggaaaggcatgcttttcaaatagaattttgcgtttacgtccctttggttgataaaaggaacataaaagtgagttcagattcatggtaagagtacccatcacagctacctcattttctttggcaccgactataggggcaatcagaggtactacaggaaggtcaatatctaaccagggggtcttgggatgctgaaaatgaccttcaacacctttccctttccagactgctagctcttcaaaaatagccgattcagtagccttgggcatcaagcctagtgagttaccacacaggtaaatgctatcatcattctctgatttcgattcgggaggtgttattcctaaggatttgaatgtgggaatgtgaaattcatctttaagtgagggaaatctcttgtctaagacttcaatgtcctttgccgagtagctcatcctgttcgatcgtgggtgaggagagagtgttcatcactagagtcttcactctcctacgcgcgaaattctttttatagcgtggtcaatatcgagtaagcattacggggtaaagaaattactaccatgattgatattcactcataatcaactataaacactacttctcagatcctcgtagtcccctcaataaagaggcgccacgaccaacaactttgcctccagtcccaactccggctcctaataccttccctccagcaccaacaccagcacctagcaccttgcctccagctccaacaccagcgcctagcacctttcccccagcgcctacaccagctccaatgacttttcctccagctccgactccagcttctaaaaccctttcaccagcctcaagtgaaaaggcagtggtttcaggccgtaatagaatgacaaacttaggtctgaaaacaaagcgaagatacacctctccagcttccaggccgtcgtcgtccttgagaggaacagtcagttctgtaggtgacataggatcaatgtctgccagagacacatgacctgatcccagcttgtcgttgtgggaggcaacatcccaatctatgcaatcaatattcagaatgcttccacatcgattaccaatttcaacctcaaaagattcgttccattccggattgagagttctcttgatctttttcgtcttgtagacctggttatcattcaagtaaagttcgcagaaaggatcagattttccattcctatctgcagaaggaagatctttacctttaaggacagttactgataattgaccagagtttccgatggaatcttgagatggcaattgactcattaaaacagggatccaactgcactgaagataaattgaaatagtgcccgattgaccaggaagtttcaacaagtacggtttgtcgtaagatctctgaagaagctgtatagttggaagggaaatttcagccatgctgttcttcaatctattagctgaaaagtccttcacatatcgtatcaccgtctgagaatattccagctctttaactagataatcaccgttgacacctagtcggtgcttaccacctttgcgaatttttcgagtggtgaattgtgaataaccattttgatcaaagtatacctgaagataaccagattcatgaccaaaatctccactaataatatcgtagacaaagacaccttgctggtacttgataagctcgtcaaaagaaagattcaatttgtgctcttcttgttctttttcaagctcttcaagaagggctaaagttttggctttctctttctcagctttcttaagttcctcggccttgccctcggactcttcttccaatttcttcttctgttcttctttttctttttctctagcggccttcttattcagctcattttgagaaacgactggaatggttggaaagaaatcaatggaatacttgatagtacctttcactcccttgctggaaatgagcctagcttctttagtttcatcagagcggctttcgatgtattttccttcatcattcttgccgacaaattcagccaggttaagcgcaacagcacctaacgttcgatccctgccattcttctctacgtccattgcttcaatagtgattttttggtttggagatgcgactgtgacatatagcacttctttgaagacagggttaactgtagaattttgaaccaaagttctgcatctctgaaagttattaaccagaatacgcacatatgggtctatgacaccaattctctctaagttgggcaggccggtacagctgtcaacgaaaatacgagcaacaccaattggctccacataactatcggctttttcaccaccgggaagttcaactggtccccatgaggccttcagttcaacttccccaccttcgttcagagggaaccaagaatatcccacgatagaagagtccacaacgtctatcaaacggcggtgcaaggcaccaattacatttttcttcccgtctctcaacagtatgtcaatataagaatctgcacggttatcaatcatatgatgtacgagggaattccatttgggatcattgctcttttgggccccagtcttgttgattagttctttgttcaagtaaacttcagcagttacagagattactttgtcagattcattgaaccctcttgcaccaactacagtgagcgaggtgataccactattcagttcaggaggtggatcaaacgaaccatcaggaagtgtagatccatgtatgataggcatgtacttcatatccaaatggagcgttcctactcgcttattatttcttaatattggaagttccaaatcactcagttcatcttcgtccatgaaggctcccaaatcataaagaatgtttccaacaagctggtcctttctgaaatcattgaaatcgtacatgtctaaatgcaaaggctcggaaaagtctgagaccaagaaacgaatagtttcattccaaattggctctctcgtatcctcaatggttgaagtacgggcgatctcttttcccccaaaactaaagatgacataaggatccactgtattaccaccggaagtatcaacagctttgatatgagtggcctttttaacattgatttctatgatcccagaaggagatccaaaggcctctcctgcaagcagcatggggacattcagctgaaaagaaaggggatcgaatagcattcttccgatatactttttgatcatgtcgtcaatcaaaaacttcagccctgggatgctcaaaatttcgaacgataaaatagaatctcctccaaatatgcgacaagaaaagtcaaactcaggagggttgactagtgataagttaacggttctgacatgtgggaattgggtcatcattcgaagacgaacacgtagcaaaacacgaaacgaaatatcacttaccactattggcagagtgagtccataaagttttaacttaacaatgactttctggttgattcggttacgcatctgtttaacagtggcatctgctaaagtgttgggagtgaaagatacaccccaatccatgacagacacatcgtcattagttccagcaagagttttgcacatatcaattctaggaggcttggtaccagcagtgaaggctcctaaccaaagttgctttatgaaagctggagctggagagtttgcaagaattgggttgacttgctcgcagaccatcttcgagacacctggctccaaaaagatccagtacttatccaaaaatacgttcaaccagttcattgtctcatagtcattttccatatttctaacgacaaattctctttgcaattcccttctcaagaagccacggaactttcgaatagacgttctgtaatataaggccaagggtaaaacgataaagaaaactaaagcaagtgacagcttgaaccttccaacaatccaacacaaagttgcacccagaaccaatgctgcgaaattgtggtaccaatctccataagcaatctctggcaaagagttctccaggaaagtttgctttgtaagaagatccatgagctcatcatcagcagtgagtgtgtccttgggctcccagccagcaacttctctccagccggtaaaggaagtattatggacttctcttttttgtgccttttcttcatcgttatctaccagttttgattcactctgttttggctgatctgcgtcatccctttgctgctttgctgtatcaaatgtcttggagtccagcttctgtgagccagactcggtgtcgtccaaagctccttgtgctgcagacattgagttgactctgagattaccaattgaatgtgaattgtacgcgcaacgctatctcgtgcacagcaatatactacctgaaaagcacatcggtttcgtattcttaatgagcggctcgaagacgggtaacacctgacgtatacgttttggtgcacagcgaaggaaaggggttgaagatcacagagaagcgaaaaataaatatagcgcgatcaaagcacgtgatatcgggaagcaaaaaactgttccttcagaataaagatacatccatacatcatattggcttccttgtagctcggggttaatgatacgatctcactgcgaagggaattgccagaaacgggcgcgtcacataagaatattcttgggacgtctgtaccaaccaaaaaaaatgtggtttttcaaaacattatcgcttatttccatggtacctggaacttttcaggggcccgttctccacgaaaataacggtaagaagatgatttcagctagatagctgatcccaccccttcagccaggtcttgaacattgtacagtcgattcagtaactttttttgacagtctaattctgtatgcacatgtcgttcgctcaagtttagcgtgataagaattttggactctagaacattcaccttctccacctatgccatgcgattcatacatggcaaggccaagctcgataacaaagctaggctaaatgctgatccttctctgtttatcgaaaaaatcaatttcggatccatcggcctttagtatgcaggtaagcaaaaatgtattgtttagtacgccaacccctattatatcgagaaaacctgcatagaaaatacatcgagatccgaatgattggacttgctggctaccaatatggatgaaaggtcctaacaacaaagtggttgcctgcctccctatgcatggttagatccgagggctatttttgacttccagacttgattccagatcacatttatagtcaactatccgctgaattttgggtctttctcgtagttagaacctttttttgtcactcgctatacaaatgttttctatcaagaatattgctgtcgccctttcaacactagctgctgtccaggccgttgccttgccttcttacgaagtggccttggaacacgctgccagaggtttagttcctcgtgctttcgctgaagcccttaacccagctcttgaaaagagagccgatttcatgtgccatgctgcttgtggtctggccatttacggtgcttgggaatgtggtccagaagaaggtccatttgacgaagagtgcttatgtgctgctgactcctcattttcaacccagatcgacgcttgtcttgagtgtggatggtgtatctatcagtcctactttggtaacctggctggtgcgctggatgcttgtggactgccaattaccccaactggttccacatgtattgagactgctactggtttgactccaactcttggacctttcaccgactacactccaactcacccaaacaacgttccaacttccagcgaggaggagacttccgaagagccaactgaagagccaaccaccgaagagacttccgaagagccaactgaagagccaaccaccgaagagaccactgaggagccaactgaggagccaaccgaggatgagaccactgaggagactaccgaagagccaactgaagagccaactgaagagccaactgaagactcaactgaagagccaactgaagactcaactgaagagccaactattgcaccaactggtgagccaactgaggagccaaccgaggatgagactaccgaggagactaccgaggagccaactgaagagccaaccaccgaagagacttccgaagagccaactgaagagccaaccaccgaagagaccactgaggagccaactgaggagccaactggtgatgacgacacaactgaggagccaactattgccccaactggtgttccaactgaggacccaagttctcaatactatggtaacactacaacagttcactccaccatcagagaaaccagcatcatcgaatacaccacttgtgttaccgacgttcatggtcaaactaccactgtcactgttccatgccacggaaagtgtactgcttccccatcagtccactctactgacttgactaagacctacactacaaccaaggctattgtctctggtaagaccgtcaccgtcaccgttgagtgcgagaccacaactccaaaggtttccaccacacactccactactccagttccaggaactaccacacactctactactccagttccaggaactaccacacacgccactactccagttgtgtcgtccgtttcttctactcatgccatttcctccgtaaccatccagacacactctggtgctgctaacaagctctctattgctggtgccgccattgttggttacgctggtttgatgctgttgtagattgttaaatcctacaactttagttaaagtattaagttcttagtgtatatcttttcataaagatgaattatttcttaaattgtaagccagaagtagaattatcacggcaataagtataggaattgttaaatagttacgattaccgtttttaactgtatcctttggtgtaactgtgttgaaactatcggtttgaatgctgcaatctttgtagggttcatgctgtgaatgacgtgaatcttcaacttcatcatgtattctttcagaagcagattcatttgccgctaaaacgactgcatcatccttgacattttcacccttaacgtcttctaaaagattcgtcaatgctgtggcaacctttccgttctgttttgaatttgttatactattgatgctttcgactatctctttttccaatcgcctacgatcatccatctcctcttcagaagatatatcgtaatcctcttcctcgtcctttgaagtaatttggcttttcagtaattcattctccaatgcaagtttttccatctctttaaacaatctatcatgatcctcctgggacacaccagattgtttagtttcctttgaacttgactttccattcgaaaattcgtgattcaaatattcatcaagaaagtggcccatagccaacaacttttgatgctgtatgttttcattattgatagagataatcaatcgcctcgtgacatcctctaaccgagttattcctttcaagttgggggatggagacaccccaggagtaggtacggtaggttccacctccaaagagtctaaatttgggtcaccagctacaagagcatcaagaattttgtcctctgagtcaagagcatcactgaataataacgcatctaacgtatcattaaacaattcagctttccgttcatcattatctatcactaatccctgtacgaggtcttcgtactcttgcagattcatggtaagaaatttctccaccttgacctgaatctttttatgcagtggctgactctctaaagtggaacctagggtcaattcatcccctacgttcaacaagtactctttcttgtgttccaatctgacatcgttgatgaatgttccattagatgacttcaggtccctcacgtatagcttaccctctttcacaaacaagctggcatggcttctggaaagagtccgggaggcaaaataagcattggtcaaacttgtacctgctcgacttccagcctgtcttcctagctcgagctctttaggatagtcaggaaccactagtaccttgaccaattcaaaggatttattcagaggtactaacttaacaacatgtagttttgtcgtaagctctggtggatccctcctgataggctggtagttactcgtactcttggaagaggatcgtttcctcatatgcccctctacttcgtattggttagtgtgtgagaagtgctgatagatgagctctgtaaagcataaccgatgttaggatgtggagcatattaatgttcaaaatggtaggcacatgatctgtcatgtgataaaggcaacccgaagtgaagtgtatattgttaatcgtgcggggggtgcgtgcgaaaagggaatgagaactggaagtttgaatcagctaaaaaaaatccactataaagcttcacctgcccctgctcttaacacaatgtcatccacacatgtatttaatccgaatgaagatgttaatacggccaagcaaaagaagaggaaacgcgccacgggtcattttgagtgcacttaccccaactgcagcaaaacattcacacgttcggaccacctctcacgacatcgattgaatcacaacccaacgaggaggtatgtttgtagctgggaaggatgcgataaatcatttgcaagaagtgacgttagggacaaacacttccagaggcaccaacagaggaatgtgcttccttcacctacaacgcccgtgtcagagaaggacgggtcctccagaaccatggtgaaagatggatccaacaaggacattttccgatggctcttgaacacagattatgcagtacaggacttcctaccaggcaaagtaatagaacctcttgatagctttttttattttgatgttgatcgctctcctgattcggacattcaagatttattgattggatcaaagggcactgacatagttcgtcagcccgtagtcatggaacaacctgacgctgcaggaaaatctcaggagaaaggtctgcattccagctatgtaccagaaagtggacagaaagtttcttcggatggcaaaaataatttcaacaactcgaatggtgacccaacactaattgaccagacttactttgacgatgttcttagagataagcttattcaacttgtaccaggattgcaataccatgcagattttgaacctgtagtgatacgatactgtctgaatgtcttttggaccgtttttcacccccaatacccctttattcatagacctactttcaagtcagctgaagcacaccctcttttacttttgagcatcattatggtaggtttgggatttgttaacaagaaccctgatcatcggatagactctatttcaatcactgatagctacagtttgggcaatatcatagctcacccattgaggtggcttatctgctcttcacacgagttcacgactcccccagaattatggattatacaaagcctgattcttttagaaatctacgaaataaatttttccaacaggaagttgcatgaaagggcatatttgcatcatggattgaaaactcagctacttcggagatctcctcttttaggaggtgatccattaaagaacaaacaagatgatgatgaatcaaacactacaaatgctcagaaatggttaaaacgtgaatcaatgaaaagagcagcttttatgtgtttccatttggataccactcatggcgcaatatttggacacgaaatgatactcaattcccatcaaattaagttttctctgccatgtaacgagaatttgtggaatcagacgttatccgggtcagagaaaatcaaaccagccatgaactttctggatgtgttgaagctgcttctaaaacaacaggatcctccatctactttagttgaaacctttgatttttctagtaaccatttgaatgaaaatctgaaactgagtggtttgatttcggttttatttcaattagaggaaaaggacatggagttgaaacttttggagtgggagtcaatgaaagcttcttggagagacaccctaacactggccctagattggtggaaagatcacttactatcgcagaaactttcaacattttctaatttgagtggaaactattgcacaggtacgtcattattatgcgaattccccgtttacttcatcttacagacgtttatgaagatgaaacaatatgattttataattttcacaggagcaccaactaggatgaatgtccgcgtgggtatgagtgattatacgatagtggagaagagaattcgttcctggtcaaaatccagcgcaggatctttttcggtggtttttctttacttgtttctcattgatttattgctggtcagtgatgctgagaaacaagatttagaatttacatatgaccccaataccgatccaatactttacagacccaatcttgtggctctatcgttgatgatactgtggtcgtataattttattcaggaggggcctgaatccactgtcatggcgaaccttaaggaaggtatggatgatttgcccatgaacgataaagatattccataccaggaatgtggcagagactacctgaagagaattcgcaatgagctgatggttgacgagaatcaactaaaactatcatcagaccttaatactataaaactttactccaaaataattacaggaatgacccacaagaatcgaatggttggtctcctcaagttcttcaagaaaggttttttgaattgcactagtacaatctgccgtgaatatgggagacttctagagaactgcatatcccggagcttggggagaagacgtattctctgtaacaacatgaaccaataaatgaaataaatttaatgactctaaataatatacgcttttctcaagttgtagtctgttggcttaggtccatcgcgaagtaatataccttttttcgcctggcctcatggacttctgcgttggaactattgctagagacgaacggttatgttgtcaaatagaagatttatcaaacaactagccaattgggtgacagctatcactatactgattaacatatatctctatacttatccaagtttcaattccgaaagatgctcatggtctacgaccgaagttagaacaggatccttaacaaactgggaaggtttggttctccaaatcccctattttggcgatattttccagcaatattttctagatgagtccaagttggaagacaactctgatgatatcaagatactggcgcttggcgatcctcaaataaacggcaattggcctaatactccttatatcaaaagactagataactttggtaatgactactatctgggccatatctacagaactatgaaaaggcggctacttccatcccacgttgcggttatgggtgatttgttttcctcccaatggatcagtgattcagaatactacaatagaacgagaaggtatatgacgcgtttgtttccgcaacctgagcaacacacgctggatgccatgaattttgtagacaagcatgaggacgtcgattggagaagcttttatggatggatgaacggtaacttaaatgacggaagcttcctgcgagaggaagagtatgcttattatgacatatacgactggaccgagcctcgtatcaagggtgaacctctatttatcaacataactggaaaccatgatgttgggtatggtgatacaacctaccaacatctagccagatataggaaattgtttggtaaagataactatttcattgagtacgacaacgacactgaccatccttggagaatcgtggttcttaattctttggctctggatggaccactattacaaccagagtttcaaaagtacacttggcagtttgttgaaatgctctcaaaacaaaattatcctggacaaaccattctaatgacacacatcccattctataagagagaaggtttatgtattgacggtccgtttgtggaatattttactgaggaaaatgcattggaagactataggatcgggctactcaaatcagaaaatcatcttcaatatgagacttctcagaaagtattgaatgctgtctttcaaagtggcaaaccaggaattgtactcactggccatgatcatgaaggttgtgagaacttctattccaaggatgaaaacaacgtttgggttgcagataagactgtaaagaacaagaatttctacattaaagaagctactgtgagagccatgatgggtgattttgatggtcatgctggaatcatgactggtcatctcaacaaatcaaccggtctgtgggagtgggattacagtacctgcccgttctctgtacagcatgtctggtgggtgggtcaagtcggaattgctctctctattctgttgcagtcgattggatttctcatataattagagggaaataaaatggccctttcttaaaattactaaacaacttgcaaataagtcacaattcatcatcaaaatcatcagcccaatctatttgggtagaagtatactgttccatcagttctaaaagttcttggcgtttagtctcatccaatgcaaaatcctgttcctgttcctgtgctttactttctgattgcttctccaacttgttatccctcttgtgaggtggtttgtagccaccagtcttcttctttgggcttttctttttgggggcggtcaccaatcccaatctttgagccagctcgttacttttgagaccttcagatgactttgaaccgttattctctcgaggagcgtgaacatactctttcttgtggttgtcaggctctagagatacttgacctagtctttgggccagcgaattcgttttcaaatctacaggaggtgcggatggtggttctttctttgcctctgatctgtgatgctctctcttcggttgcctctttgagtccttattatgggcgtgagagacttttgaaaaatccccactggactcatgctgggccacttttttgctggatttttcttccaacgcggggtctttaacattagcccaccttgacactaaaggttcgttcttggtaaaagttttggcctttttgggcgtatcacttgcactttgcaacccttggtccttggacaacttcccagactgtttcacatttttcgactttgttcttcttaaggtgtcatctacgcgagctttctcggccaatgagtcttcagtagcccatttagaaaccaatcctgacatgaaagagaagttaaagctatatgagaagtgaatacatgttttacaagtaaaaaaaatatagaagatgttcctcgagaatgcgcgagaaaaacactcaggctgggggagacatccaacacctttaatagcagacatcattaacagaagagatcatttatacttttgcatgaacttcttgtggaagacgacccagtcgttgatccactcggaccctggagcaaggaaagttgttctaatgtgatatgttcccggcttctgtccaaatccggagcctggaacagcacaaataccagtagtctctaacaattcattgcagtaaaattcatcaggttcaaagtcaagctccttggcggtcttgatcgccttctcaggaatagtgattttggggaaacaatacatggccccttggggtttgcggcaaacaacaccctccatgctgttgaacgcatcgtacaatttcgtggccctttcggctagggaatcgtgaatagcacgggtctcatcgtaatacagtttgtaagattcatctccttccttgggcgggttaatcattagttctaccagagcttggcctgtcaccactgggcacagagaaatagaagaaagcttggtgatctgttctaacacagattcgtcgaaacctatgagttccatatagccacctctttgcccacattctccagaaatacccttggaggtcgaatgcaacgatgccaactggatgttcttatacaagtcggcctttgggccttgtaatagatctagcaacacttttctaacggaaatgaacttaccgtcaaaaatgttttcctgatacacttcatcggcaataacaaccaaaccatacttggcacaaacattcaagatatcctcaatggcttcataggaaagaatggcaccagtggggtttccaggattgattactatcaggcaacgagggtcgattcctttagctttggaatccagaataatggactctatttcatcgcactcgatggaccagttgtcttcctcgttcaagtagtatggcaatgcggtacggttgttgagggtcagtgtggcagtatagagaggatattgaggaatcggaatcaagaaaccggtcttctcattttgtcccagtagagttaacagataagtgacagcggtggatgcaccggtggtaagatatattagctctttcctggcacaaggatggccgtctcttctgctgatgaagtccgcgatagactgtctgatagaagggacaccttgagattgggagtaggcacccacggaaccaatttgtttcaataagcttctagcacgctcaataatatccttggggaaaattgaagcaacacgaggatcgtccaacaagggcgggtactgcagcagggccaggatttgtctgtagaatgttaatggcttttggtctaattgctgtggattaccaatgttggcactaataattttggtgaaaggcaatttatggtctacatcgttaagctgatttcttaaaagttctgccttagtaggaatttttcctcttacggcatatttggcattgactgtatgagggttcaaatcagtgacggtcaactttggtgcgggctgaaaatctggtttgatcttcagccccaacgaaacaacagttgtcgaagacatatgacgacaaggacgaataaatttattaactctcatcttcgaaattcgggcagtacggggtttaaatatcggtaactagcagagcttatctccaaatgtggtgactgatgaaaatgaaaaaaaaaattctaggcgccgaaccaattgacgatgacgcaggcagactgaccaagtagagatccgtacaccacagaagtctgcattattttgccagtaagacttatcagtagcgtgacatttaatttgaggggatggaacggcaagagagagcataggagtcagggtggaagagttagaaagataagaccaagtggttcgatagctgacacaaaaaagcaaaccactatagcaatgaaaactaatttttgatgagatgatatttcattcaagtgcagattgagtcagcgatgactagcaattttgcgtcactcactgtaaaccagttggctgctgcaagattactgctttgagatctccaaggtacactaattacaataatgtgaaaacatttgtaatgcttcggggagtatcggatgtacgcaagacccgcaacccgtttgcgggtttacttttttatacaaagggcctcctgcgcatatgcgctggctcgcgtggggaatggggtaaaaaaaaaatcgcgagaaaagatgttggatggaaaaacagagtcatatgatctggaacgtgatctggacttttattatgtaagacgactttcttggtgttaggacagttcaatcttttaagctcatcccacttgttctataaaaggtgtaattttgccacacatcatgtccagcttgtatgagatactgggagtagatcccagtgcaacgcaagaagatatcaagagggcatacaggaaactagctttgaaacatcatccggacaaagtcgaagaatcagtcagagtagagagtgaagctttattcaaggaaatatcaacggcttatgaaatactgagtgacgaagtgaaaagaagtcaatacgatatatatggtgacacggatggtgtgccaaatagaaatggccctggttctgggggtgttcctgggtttgggttcgactttgacgatgcgaatccttatggagctgacgagttcttcaattttttcaataatcatcatcagcaaagaggtagccgtcctccgaaagaaagaaagactccagatgcagttatggagatggaaatatcccttcatgatttatataaaggcaaggtaatcaaagtctcctctacaagatctaccatctgttccaaatgttcaggtagtcgactgagaaaaaatgcagattcaaatagtatgatgaaatgcatgttttgtcacggttctggtatgaagagagcaatgagaccagttcaaaatggttgggccattgaagagtatattgattgttctcattgtgatgggtcggggctccgtattcagtctaaattcaagtgcaagaaatgttcaggttcaggatgtgtcgaggaaagcaagatactagaattcaacattcctagaggagctgctagtgaaggcgaaatcatactggaaggagagtctgacgaaaaaccaaactataaacctggaaatgttatattaaaatacactaccaaggctcatgagtacttggagagaaaaggtaacgatctttacacaacttggaaattgccattatgtgattgtctaacgggatttgactacaagccctccataaaaactttagatggccgctttttgatggtcaattctcccacaggtaaggttataacaccgactacagttttgaaggttcccaacgaaggaatgccaatcttagaccaaggaagaaactggctcttcaaacaaaaccccaaaggtgatctgtacataaaaattgagattgaatttccaaaggacaattggttcatagaaagaaatgagattacaaagttaaggcttcttttgtcccatgattcatccttcccaaagactgagatttctgaaggagatctcaataatgccatttatgctgctaatattgaattccaataataatacatgagttatatatatagagaagattgtaaatagccctacagaaatatcatccgttctaattcctgattagatacattgagatctccgtatatgtttaggtcgctgtcgttttgcgaatgtagtgggaatggtagtagcttttctttgtttttttggtgatcttcttcaatctgttcatctaactgtagcaagaagtcttcttcctctttttttagctctctcgagtcgagtttgggtatatgcttataatcttgagagtacagtgaatctgtgtatggcttcaaatcctgaaacttttctattctaaatgtggtgggttctgaatatgtgatcccctctgactcggtctctgaatcggcttctctatcggatagatttggctcatctagtgttggaactatttcaatttcatcctgagattccaggttgttttcattcaagacggtcagctgttttggatgaatcaggttcctcttgtctaggatctgtttgctattgacgtttgtagatcccaatattgttcgaggtctagcctgagaatccggtttgacttgctttccaaggctctgccgtgatgtcaggctctgctttgcattgtctagcttgttctctttatcttgatacacagttgttgttagtggcattgacagtgactgaggagagtagaggataccatcttgtttacaaacaggaacacatacacgcgataaacgcatcttgccttttctggttttagtattgatataatgtgcatttttccctgatctcatctcatacataaagtagcactcataaggcacaatcaatgaaggagcagttagaaaaactggcttccaattttcagaaatcttgtttggatgccaggacaattgagtactcatgtcaattttttcataaaaagttcaaaaaatgccagaatcctgagaaaacggctcgacgagagtaccttcaaaaagctttgacctactacaatgcccaattgtctcagatgaacgagacaaagcacataccccaggagctgttcaatgatatatatagcatagcatactttcaaaatcggcctatagctgagagatgccctcggtggtggagacaattcatgtatgccacagatgaaccattgcaacggctctatatcaactcccttttcaaaattgaacatcgcatttataaggactttaaggacattgacgacaaagaaacgctccgtgaatacgatgcttatttcgataaacagcataatagtccgccggtttccatattggagagtttcaaagacctgtataactcctctgaccaagagtccacgaattgcaaaaatttgcttgatggatctctattgcaagcattttataaggagaatggaattgaagatctccaagtcgcatttgacgaagaaacaaaccaaaatgtcaggaaattgtctcttttcacgcagtctccgttgttcaaagacaaactctattacaaacgtaccaaccctccctccatgaaaatagagtttcctggaactgttttcggacttccaatcgcacttaaacgacaaaatgttaaaaagagaaagaaattgcaagaattaaggcggttcatgttgaacgtggagccagtagctattgatgatctcgactatttggacaagtctatagacatggacatagatgcaaaaattaaaaggaaaatacaagtctgggtgagaaataaatatgctctcgacgaggaaggccagttcataagatcaaggttttgtaaccgccctgcagataatgtgatttgattgtatggctcattttagcttgaaatatagatacttcttgcgatttgagtctatcaggaaccctgcttcatttttgtgcgtcatcttgaatgatgttggaataaattcgtccccgctaaatctgctcagttgaatagggctgctttcaattgaggttaatttcaagaactcagtagcttggccatcggatgccaatatgaaagttgagttttcagagtaatgcatgtaagatataacggacataggaaacgaaaaatgacgatgttgcacatcggcagtgatcaaattaatggaaatcaattccagtgcgtctggggtgtttgttaagacgatagttttcagattattgtgcgtttcagaatcattagtagaatacaatgttgaagaaggtaacgtgatgcttagagggaagtctttggagtctgtttttactttaagttcttcaacaaaactagccgtaattgtgttcatgtctatcctgatggtattttgaagcgaagacaagtcatccaaaaatgcatgcatgacggaacttgttaaatggtttgtaagaaattcagtcacctccttggttttaatttccatatctggtgtatcatcagtcgtatattctagcaggacgtaatctaaccattcgatgaaatacttaaatagtctttgctcatgattgatcttccatatgaatagataagtcttctgtagtagatccgtgcagccagaaagtaacttttgaagctgttgtttcgtcagtggggttgttgatccctttaattcgtctagcataacaattattctttctagacatggtagcagatgactgaagagagacttcttattcccttcgtaacaatttactgccagtttgatccaccttctgatgtttttgtctcctaaataatcagtaatccaagttttcagacagggatgcataattcctgtcaataacaaaccgtacaacaaggaaataccagtttcgtcgccttccgaagagataatttcttctttcaaaagatctaataacttatggttaaaatctaggtatggcttagtttcatgatgcaattgctttaatacttgattaacatattcgatcaacgagttgatcttgctgtagctcagtcccaaattaacaatatctctttgcttcaaaaagttcaaactaatctgcttgagcagggtactcccatctctattgtataagaagtagagagttgaaaggtcatccgattcgaaatgatgcaggataacgtcattggagtcaaacttgaccaagcttgcaatttgaaagaaccctaatagactaagggagatgacgttattgtaattggtcaacaaataattcagtgtgttatcttgcgttaagtacttatcttcatcttgtaacgatttattcatgaagacggtgtctgtgttattcaatggggttaattttggcaacccttttgccaggttaaagtcaaaaaacttctccaatttttcttgaagagttggttccgagtcttcggaactttgggactttatctgtttgacattaggccaactcaaaaatgaggcagttggcccgcctgtgttatttgcagactcaatgacatacattagcgttcccatatttccatcataaagtcttattgaaccatcttttaaactgactgcaatgatcttgccatccggtcgccaacattgacagataatttcactcttcaagctcactgaccagactttttgggaattcacacgaaaaacactcaattgcaggcggtttgctgatattcctgagataagataaatggtgggacaccattggtagttttcttcaggggcgctcagtggcaatggcttctgatatatctcttccatgatttcctttcagcttttggacgggacaaggttccagatccatgaacagatcgcgtttacgctaccgtccgatggggaaaagattatataatcagatacctcatcttttcatcatctccacttaactataaattatcacaactactggttgctgacaatcctgaaggatgttcaaaaaggacccagatttgaaaccactgtctaatctaaagaattcagaccgaaagaagctattcgcaaaggttgtggaagattacaaagtttctaatgtgccgattgactatcttttccccagtgactccaaacagggcaacttcaagtcaccgcttaagatttcgggaactatctacacagatgcagagagtactccaacgtggtttaaaacgaaagattccaatgttctgccttccataatgacgctgtggaggtacccttccctcatcccaatagttctaacgaacgacatggttatcgggaaactgatcaatggagcagacttaatgttgccaggctgcattcctccttttgactctaggtgtgttaaggggagtattgtcggagttgctagttataaacagccaaatgttgtatatgccgtgggggagtgtttgctaggtttaagtgatgtggaggaaactgttggtaaatctggtgttgccgtaagagtttaccaccatttcgaagaccatttgtgtcaattggcaaaaatcacgcttaaacctcccaaagaagaggaagccttagagactatccttcagtttcaagatgtgacttcggaacaaccagtagaagaagatggcttgcacaataatgcagaagccctcaatagtgaggttcaagacgaaaccatcgagcatgaggcatccgattctaatgaattggcggaagttttgacggagctaacagtggaagatgtcgatatgttttttgaaagagctttgcttcagaccatcactcaagacaaaatctcacttccaatttctgcatctaatttcatgaaccatatcctcaaaaatatgccccctatagactccagcctggttactatgaagaagacttcttggaaaaaaactagtaagtatttgaaagccatgcaaaaactaaagctgttagatctaaagggtaaaggggaagatctaacaattatttccgtagcaagttctgacaatgaaaaagtcaggaagtttgtgccatatacggttaaaagtgtcaactcgtctaagcagagtcagaacaaaccttccaaagataagcttaccattctgttttactataaacccaatagttgcactagaagtttctttaatgacaatgataaagtgaccaatgttttatactcgcagcaagaattgaagaacattttaaatgagtatattcgaagcaaagatctagtgcgagagaagaataagatatttttaaaccctcctcttcaggaaattgtcaaactgaaagagggaagaactattgcacgagacaaaatattttctgagttccttaaaggttttactattaaccataagataattccaattaacactccagatgaagaagtagaatcaatcaagattaaaaaagggaatgttccaaaagtggaaatcgtgacagagatgaggattggcaggaaagtcgtcacaagaatatccaattttgaggtctatcacataaaggcgcaggaacttgccaatgaattaagagtcaaatgttccggctctaccaccataggggaaaatatccaaagtaagtcgaccgaggttactgtacaaggacctcatgaaaagatcgttcaagagttgttggcagcaaagggtttgagtccagcttggttcaatgtgactaacaaactgaaagcaaagaaaaagagaacttaagttgaaaatgtgaatgggaatgtattcaattttacttcttcatgactctcaagaacattaagcaagtaatcataacgattggaccaatcaatggcaaataaacagccattttgtgctcatctgggaagtacgcctgctgaaccatgttctcactaaaaaatgctctgtctgattcttcgatggcttcgttagatagctttagactatcaacaaattcacgagaattaagcttgtcaatagattgattgatgttttctatagcagaattgacatgctctatggtgaaatctggaatattgattgtggataacctcttggacaaagtgatcagcgatttcaagttgtcgactgccaactgcaagttctctataattttcaatctcatcatgatatctacacgtatctgaggagatttgggtgttaacgattctatgtgctcaggtaccccgatcagcttgtatagttgagaagtaaatatgtccaatataggcatcaagtcggtttcagagagttggttatccactatatcgtttagaataagaactcccccgtattgggctatcaaaaaagagttgtgctcggaattttgaactttcaacggtctggtatcttcagatggaatgtaaatgataaagttcaacgttggatccgtggtggttgaatcttccaatccccaatcggaataattgataaaacttgataaatttctctcagttaacaaatactgaccatcttctattattaagttatccttgttaatgttcaaagaagcaaaatagatcacctgagtttccactcgcaagtccagataagtacgaaagttttccagggcaccatccaaatatctttcaagactggaagtatcccaatcaatcggcagtccgtcgcccttgaataagttgaaggtaagcttcagtttatctttgaatggaatttcaaagccagaattagtggttagcaacccttgatgaacggagatctcatacttgagtacctcatctagaatgactcttgaaatgaaatctggtaccaacttattgacaacaacattctcactatttcttattacaattctcctctcatagggggaaataaacagcccttcgccattaggatcttctgagttgaccagttcaatttgataatctaaatcactcttcttgggccctgaaatcaaagaaacgtgataatccacgtcaaatggatgctcgctggacaattgtgccaactttgaatcaagtaactcctgtgtctccaaaaccaaatatcgcataggtttcggtagttcgatataaaaggggatatcatagtgaatttgtgatttgagagtagaggacagattgttgatctcttccactggaagttccgctctgtataacgatgtagtgaggaaccaaagaggcacgcctagtaacacaatgactgagaaaaccgaaataaagataagagttctcagcgatctctcctcctccggctcagggggtagaatctctgatttggattcagacatgtatgctgtttggttgaagagatgagagtttcgattgtaagcgaatttcctgggaaccaagtgtattaggtaaggatatttcaagtgttatttcaaggtatcactgagtgtaagcgactcctctaagctcccaattagttcactttatcttatcttagttatcatatatacatgtctaaaagtcaattactattccaggaccgtgggtagatgtaatggtggtttctccaaaaagaataggtttcttggttctaattctggaaatgctctccttgatagcagcattggcctcaatgatattctcaagagtctcttcgtctgtgaagttcgtacgagcaacaggaagactgagtaagttgttgcgctgcctgaatggcaagctaccatgggattcaacaacagccttctgcacatctgtgattaccgttcctcttttagcattcggcatcaagcctctaggacctaaaatacgggcaatttgattaagagatggcacaatgtcgggggtagcaaaagctttatcaaaatccaactggaccttcccattcttgatgtcttcaatcagttcacttcctccaaccaaagaagctccaaatttagtggcttcctcctgcaatgctggatcgtcagagaatactgctaatttggtctctttcaaaggacgaggaagttttactgaaccatttatgggtggagcacctttatcgttcacaatgactgaacatatggaaattacagcttcattgataggaaatcctacctctgctgccctcagatatcttagagcttccgggattgtcatgtataatggagacttgttggctggttgttttgcttgtaaacgaagtaaggccattctctttgcctctttcttcttggagttatcttgtgaagcttgcttctttggagcataagcaagacccgtagtagaaaatagcctacagtagctgcttactgcaacaaaaccacgccctggtatacttctggctaatgacatggctgttgcaaggttggacgtggaggagtgagtttcttcaaatttttcctactacaaatggtcgagtgaaaaaatatgtctgcttatataagcaatcaataaaaggatttcagtattcgattctacatttaaactatatacacatcagatgggcgacggacaaatgattcagtgggataggtaccatcttccctttagctgtctcctgcgaatcacctttcgtccgcttatggatctcattctagctaaaaatcctaatcttctctttctttttaatgtggaaggttggtatgtgtttcctctgtttccacctctagtaccccatcgtctttgtgaaaatgagccgacaaagttattgataaaagatagtggagaaacttcttgaacaagggactgtgattgtatattggtagggttggccaattggggccgttgcataatttggcccagtgttctgaacatatttccattagcacggtacattccggaagcaacatttgaagccatcttttgattaaccactcgaagcattttcagctggaagaaaagagatggtgaaggacaacttggaagaataagactgagtagttacgaaccacttttttgctgagttcgttggtagtttttcgtactatgctttgtcgcgaaggtaagtttaggggagaaactttagacggagcgattcaattatagtgggaagttctcttggaggagaacctcatcgcctcaaactataaaattttcagatcgaactgaatcagtgccccatgagtctacaatctataggccgaaatatggctgtctcacatccagtatccataaacgttacaggacaacagcccctggaaactgaaaatgtacaagagctgcttgacgagtttattgccaaagcggatgaagaaacggctcaagagcttaactttatggctcttaacgatggaactactgctactgcaactaacaataatgcagccaaaatctctcaattgaaaagattacaacgagaactaagaggtttacctcctttgctggatgctccaacttttggggaaaagccccgtaaagcgggatttgaaggtgctactgctgacacaggtaaaattgaagcaggagtcaaactgaataaaaaaatcaagttcgacgatgagcctgtcaccgtagagccagtaataaatactgtcacgaattctcaaaagcatgtgatagaagaggaggaagaggaagtacttaaggaagttgaaactgacgaacagcctaaaccagaagcctctgattctgagtccgaggaacaagaaaggaaacgtaggaaaaaagaaaagaaagagaaaaaggacaagaaggagaagaaggagaagaaggaaaagaaagacaagaaagagaagaaagagaagaaggataaaaaagaaaagagaaaggaaaagaaacaggaatctaaagtataatatctcatgtaaactatttatagatgaaagtacgttaagctgaagtcatcaaccttaaatgagaccctttttcaacaggatctctccaatgagtactccagaaccagcagctccgatgattgtgttgtgggacaatactaccatcttgaaatctaacactggatcctctctgattctgccgacgctaactccaaacccattatcacgtacacggtctaaccttggctgtggtcggtcattttgttccaaaacgtgaatggtgttcttgggagcggatggacagcccaatttgctggcctcacaaacgtagtctctaagacattgcttgactgcctcaacacttggagggggtcttcgttcgaatctcagggaaatgcactcagtatgaccatcaattacaggaactctattacattgagcggaaactttcattgcgtcttcactaacaagtctgcattccatcttatcctcggagagtcctcccaaaatctttctggtctcccattccattttctcttcttcaccactgatgaatggtacaatattgtctaatatatctattcctggaacacctggagaaaatccggctccggaaatagcctgtaaagtagtagttgtcaggaggtcaattggtccaaacttctccaccagaggtttcaaaggagcaacgagcccagcagtggaacagttagaaatgcaaatttggaatcccttttgtccagacttaactttctgttcaacaatttccagatgctctggattgacaataggaacgatcaaaggaacgtctgcctctcttctgtagttctttgcgttagagacaacagctaaaccactagaaacaaattccttttcaatttctccagcataatcggcgtctaacccactgaagataatgtcacagtccttgaaagcctcagctttgcactcttgaacaatgatatttcttgcggactcaggcaaaagatcagtttgcttccagacgacggcatcttcatacctctttccagcagagcgagaggaagctccgagaacagacaactcaaactctggatgatcgcttagtaaaagtataaaacgttggccaacacttccggttgcgcccaaaacacctgctttcttcattgtagtataaaatataggaagacttagaaaataatgagtcaaggatttttctcctattaaatagagttcgcgcatcaccgggtgacatcacctcgccatgtaatatgggggacccgttgagcgttctccaacgccgtccagcaagaattacccttcttctgcagctccgtctgggggaaaaaagaaaaaacgcaaaatgtccctatcagatttcacattaatcggaaaggatgatgtctatgaccatgtataccttttatactcagactcgaagctgaacaacgatctaggctattaccctagtaaggcggataagtttgtgatacccatcggcgacttggatatagaggttgaacagtccaagtccggagtttattccaggcatggcacaggtacgactgggttttacctctggaacgtttcccctctatttgcagaatggatgttgtaccataaacatcccctaagcgatatgttcaatggttgcggagttgtggttgagttggggtcaggggttgttggagttttggcatcaactctgagcaccagatgtgaactgttcgtagctacagatcaaaaacatgtcttgaaattactggccaaaaatatagaaaacaatagacaaccgaaagctaataccaagattgtcgagtttgattgggagaatatcgaatttggagtttccaatttggagtcaactttagagagaagacaagttgatttcgtcctggcatttgataccatctacaatagctttcttctagaccatttcattgctgctacaaagactatttgtaacagtgaaacaatcgttgtggtaggcatccagttaagagacgaggatgtattatcagaattcttggaaaaaatgttggataagtcgtttcaatgctatcatgtggaccaagaatggctatcttctgatttgaaaaatggatacagtatatattgcttcaaactgtgttcttagttatgtctgtccaaaagagcagtcttcacaaattcatgatgtgataggtcagtggcactacttcttttggtgtaatcactctccaaacatgattccaagaatgatctggccaagtctgaagctgtgggcgggatttcaggacgagtttgcattccgattttgaaaatcgcttgcatttgactaaaatcagggaaaggatgtttccccgtaaacatttcgatgattaagcaccccacagaccagatatcagctttattggtataaactgtctgcttgacgacctccggtgccatccaatagacggatccttgtagtgacgctctttttgaagacggtttcaggtcactcattcgtttggatataccaaaatctgaaatctttactgttcctttggtgtcaatcagtacattggcacctttgatatctctgtgaatgatttgtttttcatgtagataggctaaacctgacaaaacttgttttacaaaatttcttattagtggttcttcaaaaggaccatagttgttcagcattgaagacacagatcctcctggaatatactccaagaacacattgaggaattcgtcatcgatgctagatccaatacatcggacaacgttttcatgatcaagttctcttaataaggaaatttcttgtttcaaggattctagcatattttgtccatgagcatcattgactgatctagcagtcggtagttccacctgcttaactgccatcagctctcctgtgaagctattaatccctaagaatacggttccaaaactaccagcaccaatacgagcacccttcaaccaagattggggccctctttcttcctctatggagagctgctttagcatatactcgtcgtcaccagtatcatcatcatcacattcctcaaataattcaataatcgaagagtctccttcattaaactcattgtgtctttcatgaactgaatcagaaagttcattactagaatttgcctcatgatttgaacgaactgtgtgctcgttgtattctggctccacggtatctccgtcctccttcgtgattctatcagcaagaaccttgccaattgttttcctcgtgcttgaactgatgatactagccctatcacctgcaatgttactcatagcataccgggaaagtgacgagcttaaccttgaatgattaccgctgtgatcactgaaaatagaggcattggagaactgagaagacattaaccttgaaattctcattgagttccttactgaattcctcacagtttcctgtagtttgttaacctttgtatctgggaaatactctgccaggtttgttgaaatcaattcactcggaggtctttgtccaaagaagttattcaaggacggttttccttcagtagactccttgattacgctattgtcattttcttgagctaaacctttatctgaattccttgccaatttcatagccgctgtagaggtttcgattgctgctaatgtaggagactcagtctttttacacaaaatgattctgttcctttcaactctatctgcagaatggcacactgtgactaattcaatgtcgtacatcaaatgaagttcttcgtcatcattgacaaagtatgcagcacacaaatcagggtccattttcaaatccaaaccttttagagcttttcgcttgatggacatggcattgaagcatcctcgtatgtcaatttgtttcttggaaccgtcgagattgatgaatgtcgccaaagatttggacgacttttcatcagtagtagatttcaaactagaatggcttcgtcttagctgatttctaggtgatttctgaaccaactgttttgttggggacaagggagaaacctggttgccaagtgcatccttctccgacaacgatgtctcactagcgtagtcgggtagaatgatctcactcaatctttcgagaggcagtatggttctgagcctcttgagccttagtctctgaatttcattctctaatcttattcttggaccaactttatcgatcccaagatcaatcaaagcccccttatctagatcacacagtagatctgtagttataccattttctatgaatgttagatgatattcaacgttggggcgaaagtgaatacttaccctcaaacctgtctaaatatgctgaacactgaagttcatttagccaactggaaagatttaactgttccattgcattggatctaataatagctgaagagtggtccgtaaatcgtcaacctcagcttgagcgataagtatgatgctgatgttaggatgttgaaactgatagcgatttcactgttggtattaatatgtttaggtagggcattgaagtgggaaaaaatgaccggcttggtcaattaagtttgtaaaatctatttatagaagacagtggctagtaattggtcagaaacgtacagttcacttgagtttcaactgatgcaatccaattgaaactggtcaaagtagaacatttttcgtagtgggttgaagtttcttcccgttggagtattgagtaaagttaaggggtccacgaaatagctaaatttgttaaacttcttaaatctgtaaagccgaatggtctcttgaatggccgggttgggctgaaagatgaaaccaagcaggcggtggcttgaagaaaatgaagtaaattaagtcttaagctacccaaaattttcaataactacataagcctctatggccaagttggtaaggcacctcactagtaatgaggagatcatcagttcgaatctgattggaggcatgattttttttacattaccaatatttaatagttatctcttttagttcagcttccagtaagtcgaacattctatcctcttagtaagtagtaacgggtccaaagccactgatttgggagcaattcccccatcctttacgaaaatctttcatctgaaaatttaaaaagtcgagaaagtctcgttctcctacaaccacgcctaagatgccagagccaaatgatgaaccaccctccggattcaattggtggaggagaactttgagctacaagacaggcctgggtttaactcaagaagaaaaagtaaagtatgagaacgatctcaaactcaaaaagtccaaagatgactgtgccaagtgctacgaatacagagactggatgttgcggtattcaccaacggtaaagttcctgatggatcaaatttctcaagcaggggggcagatttctgctaaggatattgtgtgcgacgaatgcgatgatttgaaaggtggagggtttcatcctgaaattggaatccttatttgtcaaaacaggttgatagacaagtggcatctggaagacattgtttctcatgagttgattcacgcctatgacaacaccaagttcaaagtggactggtttaatttgcgtcatcacgcttgttctgaaattagggcgtcgtcactcagtggtgaatgcaggataatgcaacagttttggagatcatcaattagtagattcaatagtgggcatcaagattgcgtccgaaggagagctgttctaagtttgcaggcaaatcctaattgtaaggataaagaacaggctgaaagtatagttgatgaagtttttgagagctgtttcaatgataccagaccctttgagatgatctaccgatgactgtgttttgcccatgtaaataagtatatccctatttaaaacactaagtatagagagcacaagaggcttggcccagtagatattcccagccagaaaatagaatttccaaggatttttcgatcagccatgaattttgtcctggagagataagtgagaggaatttgggccatttgaaaatagagtaagtaccctctgaacttaccaaaaatcacatacatagtcagttcatgaacgaatgagcttaacaagaatgtgaaaagggtcgcattgtacctggacaattgaaatgcgctgatggagctatggtatacatgtctcaacaaaaaccgatgaactggcaagttccaatcccgagcaaattcatcccatgagacagaattccaccattccgaataaaaggatctatctgcaaatcctgtcaattcagcaacagcattcaatatcaattcccagatgagataaaacaccaacatatacattaacaagaatggtggagccatctccaaaagaatgaagacatatggagaaactctttgagacacaggtaatttcctcaattggatcgcttccagagccaacgggtataaccaactttcagcaaccaaaatcattaagaaaatcacaccgaagatgcctagcatcttggtcccaacatacttccacctgatctcgttagttaatggataatcaatctcatatacaacggttgggtacatggtgtaccaaaaccaatttttcaagttcacgttagatgggaacggagatgtggtgctttgactagtaagttcaaacttgcaaaactccactgatttttgaagagcggcagtggtctctttatctaatttttgctttttattgttcaaatgccgttgtgaaaagtccagttctttctggattttgaacagatacccattataaaaagcgtatgaatgcatcttcattagcatgaccaatgagtgcaataataaaaaaatctttccaatccaaggaaactccatcctcttagctgtcagcagccagaaaaagaggaaaccgcactggtaaacgtgctgcaggtacatgcctgtattatcccaatcaagatatccatttttaatcagtttttggaggaaaaacgtagcatacatgctaaggtacatcaacagatcagcaaatccgaccttgattaaatctttttgcattatcctgatgatattggaggtgtaaattcttgtgttatttctttcgtattccactaatgtttttaaagctaacattcccacagccatccatgccagaataaagaatccccgaaagggagtttccattattgatgagtcaaatatcgaccgtgactgattgaaacttatgtcaccgaaacgggacctcaattcccccttcttatcgtatcgagtagatatttgagcgttctttttgataagaaccaagtcatggctctttaaatcttccataatgtcgtactcttttaaatcctcttcgaagcctgtcatgctgctgccaatttcctgacccttcaatgggaaattgtgtatctttgagcgttcctttttagcattccttttaattgcctgcatctgagtgtcagagtcgactctcgccactgggatcggcatcattaaatggaggtgaaagtttgattattcagtatttcggctttgaacggtaatttatggaaccgaaagaagcaccacatctttcattatcgagcatccatacaccaccatggataagctttgaaaaaaaaaaatccgctaggataatctgactaccaactatgtcacgtcctgagcagttggcaccggcagaggtgttttataatgaaacagaatctcgcaaatataccaataatacacgtatccagcatattcaggcgaaaatgacacttcgggccttggaattgctaaacttgccgaaggacacggctaatttcattctcgacatagggtgtgggtcaggactttctggagagattttaacagaggaaggagatatgtggattggaatggatatatcacctgacatgttggctactgctttggatagggaggtggaaggagatctgcttctggcagatatagggaatggaattcccttcagagctggaacttttgacgcagtgatatcgatttctgcaatccaatggctgtgtaatgccgatacaagtaatgccgatccaaagagaagattgttgaggtttttcaatacgttgtatgcctcactgaaaagaggtggtaaagttgcagcacagttttatccgatgaatgataatcagctggatcagattcaaagtgccgccaaggtagcaggattccaaggaggtgtggttattgatgatccggagagcaagaagaacaagaagtattacctggttctatccgctggtactccagatgttcagatcaacttagaaggagtagtgatggatgctcccaccaaggaaagaaaacttaataagaaacagatgaaattaatggagacaagaaaagactacatccagcgtaagaaagaagtaatgaagaggaggggaaagagtgtggccaacgactccaagtttacagccagaaagagaagaccaagattttgagtcgtagttcatttttcatgtatgattatgtaatataatagattaggtaagagtagaacagatattctttccattcgcactcgtagctatacgtttttttcttttcacccaatcaacaccatcaagtgacggacaagggagtagatgttgttgcagagttttaaggcccttagggctacgagaagcagccttataagtactccaataatacaaacagccgggtacaagacacaatatttgggccagaaagtggttaaggtgtatcagccattgcccaagttaagagaaggaacaccattgatgaagtacgttaaggagaaccaatacaagaagttggatccaaatggtgtgaaaaagagtttgttggacaagtcaaatccaagcttgttacgttcgggagatatcgttcgtattacctataataataaacagccacctttagttggtatggtaattgctgtcaagagaaacggctgtgactccaacatcctacttaggaactcttatgctaaactcggagtggagatcagagtgcctattttcaaccctgtgatcgaaagagttgatattctgaagagacctacgaagtacagatcgagaaacaagttgtattatatcagaggtaccaagttggatgtcactgatatcgaatcgtcattgaagaagcagcaaagaagatcaaactagtgtatataggataattaagctgttctggtgtgaccagtggaacaatagatcaacgtagcccaggaggaaaaaataatgggaagaaaagattcctttcagtgaggaaaatatgtatgcatgccttcaattgttggtgaggtttccaatgtgttaacggtcatctccaaccgtagtgtacggcgttcactgctgaacttctgtctgcctttagttcattttgcgattttgatttttcagcacgaccattcgacagagcacgttctatcgccttcatctccacctctctctagacccttaacattccaatccaacaaatgcttgctattctgtccttactggccgtggcttctgcccaacaggtttctcagccatactatgagcacacgtacgaagaactgaaggaaatgggcttgctccagcgtttaattacctacaattggaagctggaattggtcaccgtttcgttcacattggcctatcttttgacccatttcttgggcgcaagctacaatgcaaggcttgtgggcaaatgggtttcatccgctgaagaagtattggacaaacaatttgcttccttaggatgttcagttaaggaaaaagttgtcaaggacgacaatgagcattacacttacttcgccactggtagaaagaacattgaatctctgactgtaagattcactttgaagccaagacacaatcttttgctcttggtaacagaaactatcctgtccttcttcatttcctccattgagaaatccattgatagcgtcaacatcatcgttaagtacaacgatgaggccgaatccaacattgatgactttatttgggctattgtcaacaaagatggtatgaaccaagctcgtattgaaaattattttctgtcactgacaaagacttctgaatcgtccaaacttccaactgaatatgtgttcatgtccgaaactgctgatattaccgaggaggtgtacaatgatgctgaaaattctggtcttactagctctcctactttgctcaaatacgtcgccttcactgatcaatccatcgtcaagcctactactcttgaagaagccgcttcttccaagaaggcaattctgttcaccaatttcccctccactgcttctgaattgaaggctaaccaggatttgctaacttctttcttgagtttggtggacaatgttgtagaaaacgtcaaattcagacctgagactcttaagcgagtaaagaagaccagagaggctgaaattcagaagatcaaaaaggctttggacgaagttcaaaaagaagaattggagagtaaacgagtcgaagaacaacgtaaggaaagagagagaatttctaaactcagccccgaagagcagagaaagatagagaagaaacgacaagaaaaaaagcagaggaagcagatgaaacagcagagagttcgttaatgtgatgagttatctttattagtttctattttccagtaatcttccagcctttcccaacaggggtgttgaacacttccagagtacctgctccggcacagtaactcaaaacccatttcaaatttaaacctttaaagtagtaccactttcggttcttgtagttccatctttcttctagtttgctttctaaagcttctttccatttagtagtgccaattactttaaaaacgaatttcttactctcttgaattagcttcaagaaccctccgatatttggtacagaaaggtagtaattttccgtgtttatagttgacttccctgtagaaatgttcaaaaaacctttcgaaatcaggtcatcgatccgaaatccatacttttcggaatctttcaaagtgacattatttgcggacctgttttcggttaagaatttactaaaattgctgacattgccatcatcactaaacgtctccactatggtcatataatcttcattcttaataacgacattatcgtgaaaatctttatggttgattctcagttgcttgattttacctgtatccaccagtttctgaattgcttggtctacaaatgtgggattggaaggaaaaactgagtataattgattgaccagaaccaatctcggatacgcttctcttttggtctcaatctccagttttgatttcttggttaatcctcctttggctataggtggatagttgttatcaaattggcttaattgaatttggtctatagcagtaatcaagggatcttcccttttggaaccgtagtattcagctagataatcgtccacccctccgtccgcttccaattccaaatccaggttgtcgaatattcggcagtcatagtttaatacttgaagcttttgttgcttatcaaattcttcttttttaagtagcttttcctggtttatctcgttgactatagcttgctccgagggcaaataatattccggttgtttcttatctatgtagccttggttttgtagttttgtcttttttagctgagattcaatcaaagatctgtggctcaacttggaagacttggatgcagtgagtttcatcgtatttggcgccattaccagccaaatatagagggataactatgactttgcttaagtaaacgatccattttggaaacttcaatccattgaaaaaatgtattacataatcaatttccccacatagcttctggtctttttcatctgaccaaattctgatctcttttaacactaagtaaacgggttacaccagttatatggcgccgacaaaaattatacattcatgttaaagaaccgaaacaacattataaatacctaacatttctatacaaggtctaaactctagatgctgagtttctcctttaagatcttcgttactgcttcaatggccttgttgattccttcagggttggttcccactccttgacagatgttaccttttccaccagcttttcctccgataaattccgaggcaacgttagttacctcagaggcaacgacccccttcgagagagcattgtccgagacataacatccttgggcaatcttgggttcagattcattaccgacaattaaatacaacgatttatctggaatttctttcttgatataactgaatgcttcagttaatagtttggcattgctggagactggaacgtgagcgacaaaaaagggcgagtcttcatgctcattgaaatagtccttaacagtgtccagagttttcttgctctcagccttttgtctaaccttcagctcatccttgacaaccttctcaatgttggtaaacttggtctttaggtcgttcttggcaagaacggaaatttgcaatttacccagtgcaacgttgaattctttgagtttcttctccttagcctcgccaaagctcatctttgcaatggcatccaattgatcattcttttccctggcaatgcgctgcacggtatgagcctcagtgctggtgactgcaacgatacgccttattcctttggcaataccactctcttcaatgataacaaagtccttgatatcaccagtcttagctacatgtgtacctccacaaaactcaatagaagcattgtgccattcagcgttcgaaggattcttcaccagctcttcaactggaactccgatggagacgacacggaccggatctggatacgtttcaccaaaaacagctctcagaccattgatctccttaccgacggctaacgtgacgtcgctggcaaatactggtacattcttcttgatcacttcgttggagatgtcttctactttttgcaattcactaagggtcaaagcttttttgtgagaaaagtcaaaacggagcttctctggagcaacaagggaacccttttgttcaacatcatcacctaagacgtctcttagagcaaaattcaaaatatgtgtaccagtatggttattcttgatgggccagcggcgcagttcatcatagccagcaatgattttgtcagaaactgatagaacaccttcttcaacataaccggtatgcaatacatagcccgcataggattgtacgttctcaacgttgaattcagcaacgccatcaatgacaatcttacccgtatcgtatatctgaccaccttgttcagcatagaagggggtcttgtcgagtagaattcctaactgttggtcgtcggcaacttcagaagtcgactgaatcagttccttaccgttgtaaatggcaacgatagaagcctcaatgttcttggttccatacttgtaagagtcatcagtctttggaacttcagaatttttttccagctcgcccaaaacatggacgtcaagtttaaccaattctttgccttgggtctttccgttacctttagatgcttctcttgaagcttcttttgcaatctcaaagccttcgtcatcaatcttgagacctgtttcttcagccatcaatctagtcaaatcaacaggaaatccgtatgtgtcatacaacctccatacgtctcttccagccaatgtttgttctggtgtcttggatgcaatgatggcatactgttcgaacaatctctcaccacggtctaatgttctagaaaaagaagcttcttcctcatctaaaatctcagcaatggtgtcaaagttcttatcaacttctgggaaggtctcttttacttgttcaattaaagctggagccagttgagaaaagaactttccaattgggtagttcatatattttctagcataacgagcaccacgacgtaaaatacgacgcaaaacgtagcctctaccctcattgtttggaacaccaccatcggccaaggaaaaggtcagggtacgaacgtggtcagccaaaacacgatacgcagtgtcaataccgtccatatcttcctttccaaaatggccagagtagggccttacaccagtaatttcttgaatcttcgtgaacagaggatcgaaaacatcggtgtcatagtttgatcttacattttgaagaatagaaaccaatctctcaaatcccatacctgtgtcaatgtgcttagaggggagaggcttcaaggagccgtctgcttcacggttgaactgaataaacacaatgttccaaatttctaatacatcaggatcatcttggttcaccaaagaagctgcatttcttccgccgattctgtcgtaatgtatctctgaacatggaccacaggggccttggtcacccatttcccagaagttgtcttcaacagacccaggcaaaatgtgatcttcagcgacacctagggccttccagtattctttggcttctaaatcaggttccagtccgaggcctgcatcgccgccgaagtaactgacgtaaagtctttccttttctaagccatagactttagttaacagttcccagccgtacccaatggcttccttcttgaaatagtcaccaaacgaccaattaccaagcatttcgaagaatgtgtgatggtaagaatctcttccaacatcctccaggtcgttgtgcttccctccagctcggatacacttttgagagttggtggctcttttcaaagtggcaaagtcagacgaagggtcaacagttcccaaaaaaatgggcttatactggttcataccggcatttgtaaacaataaggtggggtcatcgtatggaatcacagaggatgatgggacataggtatggtctttgcttttaaagaaatcgaaaaacgtggaacgcaccttgttggcagtccattccttagatgctagggtactcattgcaattattccaattcggggtttactcttgattgatgaaattcctttgtgggggaactttagcatccaacagttggagaaaatgagtaatggggaattggaagcggtgagctaccaagatttacagacccttcaggcgtagagtcaaaaaaaaaaatcgagaatccaggtcacatgactttgttcatgaagcatatacttttactgcacgaaaaagggaaaatgtaatgcaacaagttatgttctacttgcaccaactttgagatgtcttcgccacccgatgaccccaacgctctgggtagaagatccatcttttacgagccacagtggaacccgtcgggaaaagcacccaaaggattcaagaatgtaccatatccattgaaaaaccctaaggactatccctcggatcccagggcggaaaagatcccactacctgaaggaccaccaccgaaatactacaagagaaaaacaacagcaatagaagctccagaagaaagaagagacttgtacaaggaaacgctccagtttgtgccacgtacgatagcatcaacgcagaaacctaaaactccatagaaaatatcatgtatatttcatttcatctaacaatttcaattttgatattacagctctctactatttctttgcaaagacctgctcaacctgttcaagagactgtagcaggaccttctgttggaacttagggtccttcaattgctcctggaccttagaaatgacagaggaagccaactgctgttgctccaattgtctaacctgtgattcgtatctgacccaagagtccaaaacagatttggcctcagcagcaatgtcaacttgttgcttcaatgcgaaagcctcggcctctaattgagcagtctccttggacaactcgaaaagggccttggtagtagagacaatgtctttcaagttaccaacctggtcgattctacccttgacagcctcaacatgcttagttctggagctattcaaaatgtcggtgatgttctggatagtggaggaagcccattcattgtaaagtgggcctaggaccttggctacgacacctacagttccggcgaaagtcaaaagcagaattgactcctcattgacgacatacagttcgttggagatggcataaacggcaccagcaacagatgtggcaacgattccagtcttggacaaaatgttgttacctggaagagcgtcgatgatggagttagccttagcctttggttcaacttgagaagattgcagacggacagcacatggttggaatgctcgcaatccgatagtcgattgacgtgcagctctgaaagaaactctggcaagagacatttggatatgtgtgaatgttgttggagttcacctgttggtcaaaggaattcaaggagaggtttttcgacgggacgagggagaagcgcgaatgtctgtgattggtcgctaggtgtactattaggagaggagacgtggttggctagggtgctgaaaaattggttgtgcgacatagtaagcggagagaggatttgtacccagtgaaactggacagtagtttgcaaatggggaccttgttgtccacgactgacatctggctaatcgctgttacaatcacattcactctatgaattattcccctaggtcacatgttctgttttccatgagattacataaacaaccaaacattattaccctcatcatgtgacccagagcatcttaggaaaaccgcgttcctttatttgtaaacataactcctaactttcctataacacaacgaatgaagtcactttctgggctagggctctctcctgactcaaatcggagtgaggagattttgcctccagaacttaatgtggtcacaatgtcaatgttggatgatgtcagcttcaagccaactttgaagcctaggcgggagagaacttcagtgtacaaggacccttccatatttgacaaatactccaacgagtatttcacacctcatacacaaaccagggctcccattacgccaccgtcacagcaatgtatggagtcattgggaagagggtcttctcgtttgtcaaaaaaatacaatcgaataggtttaggagctcctaagcgactgtcgcagaaactaaccgatgagttttcactggaaaatattatgcaaaggggtacaaagactcagcaaaggaggcagcaattggaccaaaagttgcaagataaagatttggacccggataacttacaggaaattcaaaaggatcttgaatcccatcgctcaaagtacctcaacgaactgaagaggcaaaatcatagtcctccattaactacaacaaaagctcaattgccagatgtagcgccatactttgatagaaatacaccggcgcagaagactccatccagagaacctttacgtccaatttctagcaatgtacgatgccaagaattaaacacagcaacaacaaccaacaaaacctctgtgcaaccccaagcgccacaagataacatacaacgatcaaagcccattgttcaaataaataataaacattatgaaaagcttgaattgattggtagaggaggttcgtcaaaggtctacaaagtcaagtcttttgcaaataataaggcctacgctataaagcgagtcacattggatcagttcgacagcaatgccatcaaaggattcaaaggcgaaatccagctgttacaaaaacttagtaactctgatagagttgttaagttgatcgattacaatttctctgacacaacgatacacctagtaatggaactgggagaaattgacctagcacatgtgttgacgtcgcaaaacagtttagatctcaacgcggttcggttttatgcttcagaactatttaaatgtgtgcaggcagtgcatcaatcgggtattgtacatagtgacctcaagcctgcaaactttttgtttgttcgtggtgtgatgaagattatcgattttggaatagcaaatgccttggatgatgtgacatgcaatatttatagagattctcagattggaacgcccaactatatggctccagaggctcttatagaatgcagttccaaaggtgttgcatccctgggtcccgagtctagtacttggaaaattggaaagggatctgacatatggtcttgcggctgtatcttgtatcaaatggtttacggaagacctccttatgcgcactttaatgggaatcagcgattaatggcaatcatgaatcctcaagtacaaattgaatattcagaaaaagggctagatgatgtcagagtaccatccgctttgaaatcattaatgcaaggatgcttagaaagagatcttactaaaagaattacctgtgaagaagcccttaacagcaactttttgaaccccaagacagtttccagagagttcatttgtgacttagtagaccatgccttgaagtatggcgcaagaaaccagaatgtcacaccagacgtgatgagctctttgtgcgaagaggtgtggagcaaagtctgtcagagcaataactgaaccttccttcattcagaaagggaaaaacgtaatcaacttcatttgtatagatatctaccaactacatatcaatttatcttgagccaagcttctctaaaactcgaggaccttgctcttcccactcctgtctactgatccacatgtggtctttgtcggccatgatgttggccagaaccgcacctccaatgaaaaccatttgcttcctcctgggggggtcttctatacgaaccttgaatttctccaatcttgttggatcgccgcggagaaccttatggaaccattgctgtttcagttccttttccaatctggatggcaatcctgggtacatactagatcctcctgagagaacaatggacttgaataatgtagatctaatatccacatcagcagattgaataacgttaaacaaggactcgccaacaccaggttgctcaacatcaaccaagttaggctggaaaagacattcaggagcttcaaatctttctgaagaacattttataactctaccatctggaagttcatagctttcgactagtgtggtagtatcattggccagcttggtgtcaaaatccaagtcgtatgaaacgtaacatagtttctccttaatctgacgaactgtttcgaaatcagctgttctgttaaacgcatagcctcttctaagaagcaagttgatgagatttcttgtaacatctctaccggcgacgtcaaggcgctttgtcaggtggctcagaaccacagattcataaacagggacaatatgagtgacaccgtctccactatcaacgacaactcctgatgataatccttgagcataaagcgctaaaacggcctgaatggccacataaacgtgtccgaagtgatatttttcaaacatgacatcacacatcttttctctattcttgagcgggttcatcgggggttctgtgagtaagactttacgatccgtggtatctatcttcatacgctcataaaaggcgtaatcccagaggtgttccatgtcttcccagtttttgatgattccgttctccatgggatacgatatttgcagagcactacgaacactactggcttcgtctccacacatgatatctttaatttccacagtcccagttctttcttcagcacgcagtataggtcttccaacaatagaagggaacgtgtggtccgggaagttggtacctccacggccgatcttaacgaatcctgttccttgatccagaacttaaaatgcggttagtggttgaattcttgagatacagaagtggacaacgggttgcaatactgcgacaagagcattgattctgccctgtgaataatacaaacttccattggcccattctggagcctacgcggccaaaaaaaagttcttaaaacttaccaattggttgttccatttatttggtgatgttgtgtgtagatggtaggcttggactgtatgagcgttcgagttcgttggtgggagtaaaagcgagaagtaaatatttcgttacataagcagatctgggattagttactatcctttccatcttgagggtgatattcgtcaaggcccacggattcaccatttgccatccgttgtttggtcagtgcagcaataatagctgccccaactcccgagccatcttctgctggaactacagtaactaagtccggagttgaatggccccattggaatatatctcggagcgctcttgcagctctgtcagggaaataaggatagcgggtgaagacagagccatcagcagcacaatgggctttcttgtagcctcgttttttgcaaattgcggcaatgctacatactgacagtctggctgctcttgttcctatgagttcgcaaattcgtctaatcagttctctttcgggaaccgtagtttcaattcctaggctgttaaaaagttctccagtctcacatagattctcaaacggatcctcttcaattctcgcaggaaaggatgtatccataatgaacggttcatttagtttcccgattgtttgtcccttgaaaatgtgtccttgatggtgcaaatctacaagcaccaatcgtaacaattctccaagataatagcctgatatcattttttcatacgactgttgccctggtctgggcgattctaaatcaattgtatcatcgtatttggtcctaggtagaactgagatgttattgtcaaaagcaccgtattcgcagttgatggccatacttgcatcctcttgaatatctggtggaagagcatttgatatctttgagaccgaacttatcgtatcatagtatgcaccattaacaccagttccaaatatcagtcccattttagtctctggatccgtatacgtagaagctaccaaagtgcctgtagtgtcattaattaaagccactaccacaacggacaatcccaatgattccaatgcgtcttgcagcatagggacaacgtcatggccttcaacgtccggaatatcaaatcctttcgtccaacgttgtaagacacccgaattaatcctactttggaatgcagggtaagaaaatgtgaaccctaaggggattgggtcttccggactttctctataatcaaactcttcatcaatgaaagtcttcacacattgagcaataaaaagccaaagttcatttgatgtggaggttctgatccatttaggcaaaacatattttgattgaatggtatcaaacttcctatttcccaacagtctgaccaatataacccttatattggtcccgcccaggtcaattgcgagatagtctccagtttcctctcctgtggggaaatccatcacccaggtaggtagcattgggatgttagagctgcttgatttcaagccttccttcaattcagcaacaaattgatccactatctgctttaacctgggagttgatacaacgaactgtgcctctacttctttataagcttttcgtaactctggactaagctgattaaatagatatcccttatcgttaatgacatgtcaaatcctgattcagaggtcaatacccacttttctatgctgaggcttcttcgcccctaagtgaaccatttttactagcttgtcaacagtctttgcaggcaaaggtcggtgtcgatatgctttaagtgcttttgtggattaggagaatcaaattcagatttcagctaaaatcggccaaaattctctgacttttttttttaagatgagaataccgaaatagccctcagataggaataagaaaacactgaatggtaaattgtgcactccttgacagatcttgtcagctgtttgactaaccctaagaattccaatttatagattagaataacttccatctgacaaccgtcaaaattcaaatcgtgtactacccacactccaacagtggatcaatcccagatgttaatcatttgccttccaatcctattacgctaaacgaaacctcaagatggcaacctatgcatcaggaattcccaaaattccagactttgacgtatcaaagcttagttttcttgcacaaatagccgatggcgatggagacgctgcattggttgacaaagtcattcagggcgttgagacgaatgagatggctccctactatcattatctctaccaccaaatagcattgcccggcttggagtgggatcaagggttgtatgacaaactagtcttgcaaaatgaaaagaaggtagaggaattgaccaacaaaataaaagtcgtagatgaagacgatgaaggtgaagtagagaacgctgaatgttgggccgaacttggaaactactacgctcaaattggagacaagaataaagcaatagaaacacttggaaaggcaaccgatttagctccaagtatcggtgcaaagatcgatatcaaactcaccttatctcgtattggattcttttatgatgacaaacaattcaccaagaagtacttggatgaagcaaatgctttaatcgagaaggggggtgattgggagaggaaaaatcgttataaggtatacacaggaattcatgatctttcaatgagaaaattcaaagaagccagtgatcttttgattggggccttgccaacttttacgtcaacagagctattgacatacgaagacttggcattatatgccttgatagcaggtgtcatatcgttagatcgaaaaaacctcaagaaacagttaatcgactccccagaaattttatcaattgaatcacatagctctttgttcaagcctattttcagtttattgaaggcattgtatgattgcaagtacgactcatttttcaagcaccttctggagactaatgaccaaattttgaccaagaacgttaatcttgctccacatgcaaattattacttgcgtgaattgcgagtaaaagcctactcgcagctgttggagtcttacaaatctctgtctttaaaatccatgtccgaagagtttggagtatcaattgaattcctagaccatgatttatgtcagtttattcccaacaaacagttaaactgtgtaattgacagagtcaatggaattgttgagacaaataggccagacaacaagaataatcaatacaacttgttgatcaagagtggtgatgccctgttaacaaaacttcaaaagtacggagctactgtcagattaagtggtactgagaaagctaattagcattatttttagacacctataatacttttagatggtttccaaatatgtagagaattatcttcgccgacacttgatatcattgtttcatcccatggattccacgagatgtcgttgactccgaacatatgcccaccgtgagtgaactttagcggttgctcattgtcaccaaaatcccaaatcttgaccgttttatccatagagcatgaacctaggagagagttatgagggttccattcaagtgttgatatggattcctcatgggccttaatatcttgtatagtgttttctaaatttctaagatccaagagtttaatctgaccttccgcgtcacctgttgcaagagtgaatggcacctggtcactgaatgatagtgagttgatgcccgtttgatgaagtcgtgttgacttaacgggatccagtccctgtctggtatcccaaagtttaaaaaagccatcttctccaacagaaccaaaaattgatgtgtgtctagggatgaatttaaggtcattgcagccattgtcatgagcaatgaatatcttgtatggatcaagagaatctttgtccctcgtgtactttttgatatcccataatacaaccgttccgtccattgagcctgacaacagttccccttcaacgctaggattccaactcaaacaggaaccttcatccttatgatatgtacagtaaatatctggtttaattgtgccgcttagtggttgagaaggatgttttgttcgatcaaaaatcgaaacactcccataattattaattgtcgctatgatgtcgggattttgaggaagatatttgcatttattaacttctccattatgtgctattcgttggatgatgctcaacttttcgcagctgcgattagagtttttggagtctttggaagatggtaatactagtggtgatatttctcctttgacgctgtcaaaattgtccagagagttcctcagtgactctctcaaagagacttcgttgtgtctactaaacatcccaaagttcaaaaactcattgctggctcccgacgtaaatgttccaaaaataagcctttggtaatcgaactcatcttcgtcatttcgttcaatgtctggcaaaaactcaacagataaagagggccacagcagagacttgctttggaaataatcatacaagtatggagagttcttcttccatattttatagcggagaatcgtctggtcacccagactaacggggtcaacttcttcggccataattaccaaagacgtgtgaatgaacgcgtcccataccctcttccaaaactgatagtgaaaatgtcagtgcattactcaaatttttattagataatcacttctttagtactcatataccatattacaatatacatctctataactagaacgccttaagcccaagctttgaacttcttgatcaattgagcagtggatgagtcgtggctttcttcaacgttggcactgtcatcctgcagatctttctggacagccttggctagaacctttcctagctcaacaccccattgatcaaatgagttgatgttccatatagctccttcggtgaatgtgacgtgctcataataagcgatcaaagaacctaaggttgcgggagtgattttctgtgtcagaatagatgtagttggtctgttacctgaaaatactttgtgtggaattagaccaccagtagcaccagcagcagctacttcctcttcagtctttcctagcaataaagactcggcttgagccaagaagttagatgccaacaagatttggtgagcgttgtttgcaacagggttgtgggattttgcagccaaaatgaaatcggcagggatcaaatgagtaccttgatgcaccaattggaagaatgaatgttgagcatttgttgttggctcaccaaagacgacagggccggtgctgtagttggcgaaaacattgcccttggtaacagatttaccgttggattccatggacaattgttgtaagtaggcagggaatctgtgcatatattggtcaaatggagtgaccaaatgtgtctgacttccaaagaagttagtataccaaacggagagtagtccaccaataactgggatgttttgctccagaggagtttccaggaaatgtctgtccacggcttcggcacccttcaagaagtcctcaaagttgtcaaaaccaatgtagatggcaactgaaagaccgatagcagaccacacagagtaacgtccaccaacccagttttcaaaaccgaacatattcttagtgtcgataccgaactttgcgacctcctcggcatttgtggataaagcagcaaaatgcttggcaattgcctcacttttgttaccagttttcgaaaggaaccagtccttagcagtattggcgttacggatggtttcagcggttgtgaaagtcttggatgcaatcaagaaaagagtagactcaggatccaagtattttagagtctcagcaatatgggtaccgtccacgttggatacgaagtgaacatgcagtccttcctgggcgtaaggcttcaatgcctctgtcaccatgactggacccaagtcagagcctccgataccaatgttgaccacatcagtgatctgcttaccagtgtatcccttccaggtaccatcgcgaacctgcgtagagaactccttcatatgttgcaaaacactatcaacttctggggcgacgttcttgccgtcaacgtacattgggcggttagctctgtttctcagagcgacgtggaaaacagccctgtcctctgtgacattaatatgttctccggcaaacatctcgtttcggagtttctcgacgtttgcctgtctggccaagtcgaacagtttggcgagaatctcatcatcgatcaagttcttggaaaagtcgaaaaacacctcagtcccgtcgaagttcttgaaagtgtggctgaacttggaagatctggctggatccttttggaaagcctgtttggcagaaaagttctttccctttgacttataaagctcttttagctcttcgaaagctggtagttcggatgcgagcttgaaagtagcattgtcctcttgcaatagagacggcattttatcaattggttggagttgaattattccggaagaatggaaaggttgggactcgaatagattttaaatttaagcaacctaggaggtttaaatagacaaggggatgggacgtcagattgtctgcaatcgcttatatatttattgcctgacggaataagggctacctggaatttctttttctgcgaacgggcaagtgtggtgcgcggcgaaaagacttccacaaagtataaggtgggcggaactttgcgtggtgggtgggcgagaaaggcgtccgagctcggtggggggaggatatcctgaaaggtagacagctgaccgaatgccgggtgttactgcaatcacagacatccgacatctagtaacacaggtgacctattacgtcaaagcaacgtttctaagttctgatgtagtatcttccaagtcttgaagcttctgcctgtatgcagtttcgtcttgatgcctagactgctgaatttcagccaactcttgcatttctttcaacagcttcacttgcaacccctttagtgattttatcttggagtaatgatctttagggaagacgaatcctttcccttcctgttccatctgcgttgacagttgtttaacatcatcaagaatgtctatttcggtcaatagtttgtcctggtagttgattccaggacggatggtttcgatgttatcagccatttggttacaacttctcgaatagtagaaggtaagagataattacacgatggcctttcttgtatggggaaaaaagtattacctcagcaattgaattttgttctcaaatttggggaaaggccagccaaagacattcggttcccatcctgaccatcgattactaatctccagagaaagtgctttcgagtagccctctagaaacgttgtcacttttgcgccgagtccactcaaatggctcgtcatccatggaagaagttattatggttgaaacaggattatgcggataactacacagattcatccttcttatctcaactaaagaaaaataccacggtggctaattactcttactttaaactggtcaatgactttgctcttattgtactacattcctccacaattgttctagtgtcaatagtgttctatggagtgtaccatgagaattggaaccccgtgatcccaacactagtatccacttcaattactttcatcttctgggtggtgtatatggtcatcagttatatcaaccacttagaagtagcatctgttgtgggcactttgaagtcttcactgcttatcctcttcattttgcttaccttgtctccagttttgaaaagtttaaccgattctacgtcctctgattccatttgggcattgagttgttggatctgtgtggtcaatgtgctgttcaatgattatgtgatagaattctctggagcaactcatacctcaaacttatcgaagaatttggccctctccaatgctatactccttgcatcaagactctattccaatctggcggccttcagttttatcttgttctgcatacaggtccaagggctcttcccaatgttcaacaacttcactcgtaggtgtcagatgcttgcttttcacagatttcagctcatagctatcgttggtggagtgaactacctagtctactcaatattaggaatgagcgctcttagctgctgggcagctctacaaggaatcattctttttgttggtccatcatactttattaggttacagaaatacaaagaggagctgcaaggaccttgggacccagttaaaccaaggataagtgtagcataaacgcaacgaactcactcaatggcttaacctccaaacacaccaccagccagacacaggtttcttctggtgaagtgaactgtatatactggagtttttttagtgaaatagacagacatatggtcattggtggcgactatctccttacgacggcgtagatcttctgtctttttctgaattccttgagccgttacatcatttataggctctggctgggctgaaggagagttggtgttctttttcacatcccatactcttacactgttgtcggcaccggtactgacaagcacagttccttctcgggagaaagccagggaataaatggaactgcgtccatgacctcgcatggccttgatccttcgtccagttgaaatgtcccacaagcagactacactatcttcacctgccgatgctagccatcttccatcgggtgacactgccagacaattgatggccccactgtgtcccatgaacactcttacacattctccgcgcgctatatcccacattcttgcagtcttatcacttgatcccgtgaatagataggtcgagtttggatgaaattcaacacaatcaacgtcatttaaatgtcctgcaaaaattcttaaaggatatatgtgatcgcaactccataaacgtgcagtttgatcgtgagaggcagtagcaaaatagtgtcccattggagagaatttgacgtcccacactgacgaactatgccccttataagaaacgaggcaggtgtaagtatccaacgaccataacctaacagtcttgtcttctgaacaagaaatcaaatacctgttatctggactgaagtcaacaccatagacagcacccgaatggcctacaagtctcctagatccctttacagctactccgtcattattttgttggttgtatggatcatttttcaacaacgatctcaacggcgatccatcaatactccatagtttaatgaatgaatcttgaaatccactggcgaccatagtagaatcgtcattgaacttgagacatgtcaagtcattgtttgtgttgtgaaatgtgtacatacacacacttgggagagaagcttgcgctgcgctcagtttaatcttagccctagaatcctgaatcatggcaatatcattacgtaaatcttgtgctgattttaatggcagtggtaaagtgtctttggaaggattattttcatcacttggatcaactttgaagttttctctgtattcttcaagcagcgtggtactaacctttttttgagccgcctgttcatgctcatccttaagcttgagctctgcttctagttctttagaatactctggatcaacttggagttttcccaacttgacaggttttttgttgaaggcatctacactactgatttctctctgttctcctccaatagaggtgttattcaaagtgtgtagctccacaataccttcagagagattaagttccccttctctttcgacagctatagcctcagttgtgatcacaggctcaatgtactgatttatgagtcgaagaactacccctcctccaacagcatcattctcgttgaggaaatacaataacaagttgaaagtagttcgtccaatcagtactttgaacttatgacttctgaaaattttggccacatcattctcttgcaggtgctctttcaaagaaatacctcccaatttagatatttcgtactcgtgtaaaactgaatgatccttcgaaaatttgtcataaaattctctggcatggctgggatatccccttgcaatcaaatcaagatagcaatgcacaaatactggatacaaaaacttttctaactctggtctgtagaaatccaaggatgattcacaccaggattttagtatagagtatccccgcttgatcgtagcaggatcatcactatattcaggtgctcttccaggagcagtaggcctgctgatgtttgtggtttgaggagtggggatattcgttggaggtgcaggaatgtgcgacgactccattcgtaacatggattcagtcttgtggtaaccctttttgttcaaatactccagcacaattctattcaagtctgcagcagaaaattgctggggcttttgtggctgctggtttgatacattagcctgttgcggaggcttcggctgtggagtgattgacccagacggagcggacttatcacttgaatccccaggctcttgcttcattattactttgagttcttggtgagagcagaagacgttgtttgatgttgacaaaaatcgagaaacatggagagtgattacgtaataacgttatagttatctttttttcctacaagtgggaaggggaagggttatttcgtaaagtcagatagcattacaatattacacattacagtaagtccattgatcatctctatgacattctatactcaacctctaccacaactctgtcttttcctttgtaagatttgttcagtttcttgatttttcgttgtaaactggcaattctgttcttaacagtgtaactcgatttgacatcattggctgacattcccacttgaacagccgtgttggtcttgtttgcttctgcccgcggtattacgttgaagtctataacacctggacgtatgtttcctccgggatgtactccgcaaataacaaacattatttttccacaatattttgtccagtatagtaacctttcaccgtcatttggatctgattgaataaccaatttttctagtttgccgtaaaaaacttcttctgattcaggaagatcaaacccccaacgttcacaacatgctaggcctattagagcacgcactttgtgagaaaggccatgagttccagcgataataccagaggtagccatgtggagcgctgctgttggttgcaactctttaggatatgaacagtggacaaatgcaatgttgcaaagagcaggtactatcgtctgggtgatctcggaggggacttcctctggaagtgcaccgagaagaagtttcctgtattgctcagacaaaaggggagcataaggacgagtggcagtcaaaaggggatcttcagatcttatagatggtgagattctactgtacaatacaccctcacgtacaccgccttcactgaaactgacagttctaatttttggtaacacttggaatgctgcactcatcagtagtccaacagcagggagctgttgttttcgtctttctgaaactctgaaaatctttgggcttccttcactgaagtttggaacttctttcttcaacaaaaggtagttcgccaacaattcgactttcttgaagccagttgtgtaaccattgatgatcgtttgaattggatagtttgggtcttcatgaagaagaagatgtcccacaccgcggaatcctccgccgcaagtatacaaattaaatccgccatttttttcagcttcttcgatgagctctgtaggaatttttatcttctccaacgctaattcataagcctgacgaacctcttcataaacctctctttcatcttcatataataatcgctgagtaagggcagcagccccataaggtagagatatagggtattcagcaagtctgacatccccattgactgtggatacccagctcagctgagtagatcctccccccacatccatgaagataccagagatattatggaatgaggaggcaacgccgaaagcaccgcatcggccctcgtcttcctttgaaagcaattcaacttcccatcctgtggtcttcgcaattgcgtccctgaattctttagagtttggggcttccctagttgcttctgttgcaactatcttcacgttatcatttgaaactccaaaatcctcacaaatcaactggaatcgtttcatggccaaacagatctcagtgattgcttcctggggtatcggcttacgtgtgctgatagaactggcagagcccttgtcgagttgggcgtcgaacagtgaaatacccaatctgtccttgaagacacaaggcataattctggcatgatgggaggcggtggaagacacagaaaacctgattccattggaaccaatgtccacgatggctaccaatgagcgtgctactatttcagcttcatttgcctgtagctctactgtggacatgtttgctggcaaatagagtacggagtaaaagttaggacggggatcttctatggtaagcgcgaaacacagcaattttctggaaaattttgtggtactgtaagggagacttagaagggagacaaatcgatccttggaagagcgagaacgccatccaacatcgaatcacaaccctctctaacatctctcgaatcaagctcacccaagagttccctcttcctttcctcctttagatccttttgatatcctctgttgggcgtttagtttatcatggcagatattgagattgagattgatcttccggttgaaccggtggttgaagattttccatcaaatgccgagtcgccactttctcaggaggagctgtttgaatcctcagattcacagcaaacagaggcagagttggaagattccgaaatcactactaagataaatctttctaacgtttggtctgctgtatccagtgtagctatcaatttggtactccctttcataaacggaatgatgctggggtttggggaaattttggcacatgaagtcgcatttagatacaaatggagaggagctaagatacagcctccaagtagaatgttaagggctgctagtaactcttcggctgctgtgcagtctgaaaagtcttacaaagaggaatcacccgccatttcccagagaagaagtcttgtattataggtatgaattgaagttttattttccgcgtcaaactgtgtttaatggttcctgcccattaaagagcgttcgttatgtgctttgtaatttggatcctttccgtacggaaatctctttatctgtccacaaatgcattgtagctgcaaaatatcattcctaggggcctttttctttgattcattgacaatttcaggtgaataagtcacaccgggctttaaatgtctataacatgttttgcatatagtccgtttgattgtaggggagattttgaggacagttttcttggctaccaaatccatttgtcgggagtacatccttgaaagtattccattggagctggcacttgcctggtataagtatgatattctggtgtattggtctcttttcggggtctgcttaggaagtttgagtttcctcaaaggtttggatgaaggatcactatttgtcatagttgatctctgtcagactgaaataattatttcttcagtcactttacagaagtacgagaaggaaaactaagtgctgtgcgagcatgcccagcggacggaccgttcaactttttcttcccctggagggttgtgcgcgctcaacatgttatcgcagaacgccaccagttcttctcttccatatacaaaatgagtggctacgacagtgccttatcgatctttaggtaagtcagattcaatgacggagaaattggcaaaaaactaacagtttagtcctgatggccatgtgtttcaagttgagtacgctcttgaagctgtgaagagaggaacctgtgcgattggtgtgaagggaaaggatgtagtagttttgggagcagagagaagaacaactctcaaattgcaggatcctagagtaactccttccaagataaataatgtggacaagcatgtgctgctggcgtttgccggattgaacgctgatgcacgtattctcatcgataaggccagagtggaggcccaatctcatagactgaacttggaagaccctgtttcgatcgaatacttgaccaaatatgttgctggtgtgcagcaaagatatacacaatcgggaggtgtgcgaccatttggaatttcaaccttaattgcaggatttgacggaaatgacaacgtgcctcgattgtaccagacagaaccatcaggtatctattctgcatggaaggcagttgccattggacgtagtagcaagactgtcaacgaatttttggagaagaactacttgcaattagaagaaagcgatgtcactttggatcgtgaccggacgatcaaactaacaatcaaggcattattggagattgttcagacgggagccaagaatattgaaatttccgtcatggctcctaacgaaaccatccaactgtcaaacgatgagatagctgcagttgtagagcaagttgaggccgagaaagctgctgaagctgagaagaaacagaagaagaaatagatttatataattgaggcaacaattgattaatttccaccctttctcattcacccaagagactctccaattttggattggtgatggtcggccctcggttactggttgaattttgttctagaaaaaacgtagatgattactaaaggtgcgcgattacgcaatagtaaagttggcactagttattgcgatagtttgcgaatatttgtaatccacatatgcaacgaaacaatagaggacttgtgaggacttggaactcctgaaaggtataaatagcagctcaatgcccctccctaattcgtttacctcattcaacgttatagaataaaatggtttctaaggttttattgacaggtgcttctggttacatcgcccaacacatcactaatgaattactttcccacggctttaaggtcattggaactgtaagaagacaggagcaggcagaccaattgcataagcaattttcagaggaaagttctgttttacaaaaagatccctcccttctgacctatgtccttgtcccagatattggtgcttcggatgcttttgatgaggtattgaagtcaacccccgacatcacttatgtccttcacacagcttccccatttattttcaatgacgacagagctcttgaggacgtttatttgaagcctgctgttgagggtaccagaaacatcttaagtgctatcaagaagtttgccaatgacagtgtcaagaacgtcgtggtaacttcctcctttgcagcaattttgaacgctgacaagtttgaagacaagagtttcattcacactgagaaggtgtggaataacaacacctgggatcaaaccaagagtggagacagaggtgttgcttacatcgtttccaagaaggaggctgagaaagctgcctgggacttcgttgagaaggagaaaccaaactttaaattgacaacagtaaaccctccttatgtttttggtcctcagaaattcgatgcttcggctaagaaggaatctttgaacacctcagctgagatcgttggatctctgttgcacacaaagtatccatctgatgacaagttgtttgatgatcccctcaatttatccgttgatgttagagacgtagctctctaccatgttctgccacttttgaatgctgatttggcttccaggagattgcttgttgttcaatccaagttcagcgctcagagaatcctgaacattatcaacgagaattttcctgaattaaagggcaagatcgcagttggaaagcccgaggaaacggcaagagtggaagctattaagggcccggagtataacaacagtgttactgtaggcctaactggagttgaccccatcccactggagaaaacggttgtggactctgtcaaacagatattgcgtgctaataaataagtagagtatattctgtgatatttttacctgatagatttctgtttcatagtagttccttttcgacgaataccccgcaattgaatgaaaaacgttcgcctttaagagagttttttgagtgcttaggttttctatgacagctcgatgaattcccagctaatgaaacaattacgtctatgctttttatctgccagagaaagaaaaaaccattgaaatctcctcgacacatagagaggagcatctgaagcatacccattcctttctatttcccaagactaaaggaagcaaagccattgcagagaatcctatttcaaattggcggctttagtcgtctaaggtaattcggttttaaaagcaggatgattactaaaggtgcacgattacaccaacctgccaccaatctgcgatggctgattattagtaatccacatatcctagattagagcacatttaaccttctaagaagtataagtagcagctcaatgtttctccctcattcatcttgattcaatcctacggaatagaatggcttcaaaggttttattgacaggtgcttctggctacatcgcgcaacacattaccagtgaattactttcccacggctttaaggttattggaaccgtaagaagacaggagcaggcggaccaattgcacaagcagttttcagatgatgttccggctttgcaaaaggacccttcccttttgacatacgtactggttccagatatgggtgctccagacgcatttgatgaggtattgaagtcaacccccgacattacctacgttctacatacggcctgtccagttggtcccaatgatgatagagcccttgaagacgttttttttaagcctgttgttgagggtactaaaaacatctttaatgctattaggaatcttgccaatgacagtgtcaagaacgtcgtgttgacctcttcctttgtcacccttatgaacgcagataaggctgaagacaagagcttcatctacactgaaaagtcttggaataataacacctgggatcaaatcaaaaacagagatgagttgcttgcttacactgtttccaagacggaagctgagaagggcgcctgggactttgttgacagggagaaaccaaactttaagttgacaacagtacatccccctcttgtctttggccctcagaaattcgatgttgctgccaagaaggaatctttgaacttttcagctgagatcgttggatctctgttgcgcacgaagtatccatcggatgacaagttatttgatgatgttgttactttatcagtggatgttagagacgtagctctctaccatgtgctgccacttctgaatgctgatctggcttcgaagagattggctgtcgttcaaggcaagttcagtgctcagagaatcttgaacattatcaacgagaattttcctgaattaaagggcaaaattgctgttggaaagcccgaggaaacggcaagattggaagctctcaaggcacccgagtataacaacagtgttactgtaggcctaactggagttgaccccatcccactggagaaaacggttgtggactctgtcaaacagatattgcgagctaggaaataaatatagtaaattcagtgtttcaattcgacatacgatttgttccactaccgcccttgataactcaatttgagaaacggttagatcatctccaggtgtgaattgcaaactcatgcatgttgccacttttgacgcttttgactctcaattcttttgagttgtcttgggtaaattttcgaccgtagtgggtgatgggtgcttgaagccttagttgggctcaaagaactctcgttcgttcaaattttactaaatacaatgcaagaagttcctgtcctggatgggtagccgtccccagccttccttcagacacctcctagagaaagaaggttatgattacaaaaggttcgcgattatggagtagagacttggcaaaatcattcgccccagttgagcatttgtaatccacatttgcaacagtagacataattgaggtcctgaaaggtataaaagcagcacgatgtcccttgttgatccttttatctcaattgactccataaaacaccatggtttctaacgttttattgacaggtgcctctggctacatcgcccagcacgtcaccagtgaattactttcccatggctttagggtcattggaactgtgagaagacaggagcaggcagaccaattgcataagcaattttcagaagaaaatccagccttgcaaaaggacccttcccttttgacatacgtactagttccagatattggtgctccagacgcttttgatgaggtattgaagtcgacccccgacatcacttatgtccttcacacagcttccccactcattttcaatgacgacagagctcttgaggacgtttatttaaggcctgctgttgagggtaccaaaaacattttaagtgctatcaaaaagtttgccaatgacagtgtcaagaacgtcgtagttacctcttcctttgctgcccttatgaacccagataagtttgaagacaagagcttcatccacactgaaaaggtgtggaacaacaagacatgggatgacaccaaacccagggatgaatttctcggttatgttgtttctaaaaaagaggctgaaaaagctgcctgggatttcgttaagaaggagacaccaaactttaagttgacaacagtaaatccatcttatgtttttggtcctcagaaattcgatgttgctgccaggaaggaatctttgaacgcttcagctgagatcgttaatcttctattgcgcacgaagtatccatctgatgagaagttatttgatgatcttgtgagtatatcagtggatgttagagatgttgctctctaccatgtgctgccacttctagatgctgatctggcttcgaagagattgtttgttgttcaatccaagttcagcgctcagagaatcctgaacattatcaacgagaattttcctgaattaaagggcaagatcgcagttggaaagcccgaggaaacggcaagattggaagctattaagggcccggagtataacaacagtctcagtatagcgttaacgggagttgaccccatcccactggagaagacgattgtggactctgtcaaacagatattgcgggccaataaataaatatagtagcttcagtgttttaagttgatcgaatgtttacttcagcgtagctctttttaagcatattgctcaatcattgaaagaagtatgttcttgaaaaagctctctaagtgtgtgggtacttcttgaattcaaactcaagcaggtgggagctcaggtagcagattaatgggtaggatatattggagaacgtagggccataacaattggcattcatcgacttcaaatgttctaggccgtgagttgcggacaaaaggacttcagtagggaacaataccagcacataaaatcagaccagagagttccggagacgatagaaaattccaatcaagcacagcagttggaaaacttttgggcacagtttaacttagtttcaaactcataccctatcatcagtgaacgattagactaggatgaaatcacttgtttcctcactattgtgtgaagaagagtgtgcgttatttttcttgatgttagaggtgttgcttaattcctattcttccacctttagatgcattagtaatccacacgagtttgactgccacaaagtaaccagtactttcaatagcatcataattgaaatacgaatcaatctcaatctcatcagacaagaccgtaagcgctgtaaatcataacggtgatagctgaaaaacaatatgctacttcgtttcttcaaagcttttttattttcaatctagtgttgtagtttttcctttacatcaatgactggatcgtcttcaaactgtctaacattggtgataaaaacaggcctgataaaccttccaaactaaatttcaaaaaccatctttccggattcagaggggccttataaatttccaaccaacgaaacaactacgtttgccggtctatgttttctatctgtcaaggaaatgaaaagaaaaaaccattaaaatcacttcgacacatggagaggagattctgaagcatattcatccctttctgattttcccaagactaaacgaagcaaatccgttgcaaaaattccaattttggattggtaccgtcagtccctaatctgaaagtaatctgtttttaaaaagaggttgattattaaggtgcacgattacgccacatcaaacctggacaccagttatttgggacaacagactatttgtcatcaagattgccaacattagagcacattcaaactcttgaaagctataaatggcagcacgatgtcatttattcaaccattcatctaaatctagatccataaaatacaatggtttcaaaggttttattgacaggtgcttctggttacatcgcccaacacatcactaatgaattactctcccatggctttcatgtcattggaactgtaagaagacaggagcaggcagaccaattgcataagcaattcacagaagaaaatccagctttgcagagggatccctcccttttgacctatgtgcttgttccagatattggtgctccagacgcttttgatgaggtattgaagtcaacatctgacattacctatgttcttcatactgcttctccagttgctctcaatgatgatagagctctcgaggacgtttatttaaagcccgccgttgagggaactaaaaacatcttaagtgctatcaagaagtttgctaatgtcagtgtcaagaacgtcgtagtgaccgcttctcttgcttgtatcatgaaccttgataaggctgaagacaaaagtttcatccacactgaaaaggtgtggaacaacaatacttgggatcaaaccaaaggcggggataaaattgttgcttacatcgtttccaagaaggaggctgagaaagctgcctgggacttcgttgagaaggagaaaccaaacttcaaattgacgacagtaaaccctccttatgtcttcggtcctcagaaattcgatgcttcggctaagaaggaatctttgaacacctcagctgagatcgttggatctctgttgcgcacgaagtatccatctgatgacaagttgtttgatgatcccgtgagtatatcagtggatgttagagatgttgctctctaccatgtgctgccacttctagatgctgatctggcttcgaagagattgtttgttgttcaatccaagttcagtgctcagagaatcctgaacattatcaacgagaattttcctgacttaaagggcaagattgctgttggaaagcccgaggaaacggcaagattggaagctctcaaggcacccgagtataacaacagtgttactgtagggttaacgggagttgaccccatcccactggagaagacgattgtggactctgtcaaacagatattgcgagcaaacaagtaagtaccatgtattctgtgttctaagttgatcctagattcttgcttcaatgtagttcttctttgaggcggaagccaagttagcagaccaattggtaaagtgtattggaggagggacagtcatagtagttggtgttggtgttttatcaacgtcaaatgttccatactgttatgtcgaaacaaaaaagacttgagcaggagcaattccagtacaaaaaatcagaacgaagaactccgaagacgataaagaattgaaacatattcatcagacgaaaaactgaaaggaacagttcaagtttgcttgtatacatattcaatcatcaatggacaattagactggcgtgaaagtactagtctctgcacaatatgtgttgaaatgtatatgttattttatttcttgatttcataaactttcataagttttttgttataatgcgattagtaatttactgcgagtttgactcccatgaattaatcgacatttactattatatcgtaattgacaggttatcaagtaatctcatcaggggagactgttgtggatcctgtgataaaaccattgaggatattgatgataggtgaaaaacagtatgttgagtattttcaaagcttttctctcttttaatctcgtgttgtagtctttccttttacgtcgatgacgagatcgtcctcaaattgtctatcattggtgataaagacgggtctgacaaagtttccaacttgaatttcaagaaccatcttcctggattcagaaggactcaatgaatttccagctaacgaaacaactacgttcgccagtctatgctttccatctgttaggggaaaaaaaagaaccattaaaatctcctcaacacctggagaggaatatctagagtcgtattcaattctttccgcttctcccaaggctaaacggggcaatactccatcttggtctaccttcaatccaaggaggtctttcagatgttgctcattgtcatccacagcgagaactaatcggtccaatactgcccttgatagttcaatttgagaaacggttagatcatctctaggcgtgaatttcaaactcgacgataaagctcgctgccacctctgttgcatttgactctcaattcttctgagtcttaatcttgtagtaaaatagcctcctagcaatatcgggggcaagataacaaatagcaacggagctgcaacaacaaacaataaagaagctgttccaactaaaccaattagcaccttcaaagggtcaggaaccaattggttgagctttttggttgatctactggaccatggattgtttcctctatgctgtgagtatgacctagtaataatggctctgacaaccggatatgtaattagtggtgagttgaagtgaaaaagggcccgcttaaaggaaagattaattggaactcttttgttaaaaataactcctttggagtgaatggccaatctcctgggtatgaggaggggtaacatgggagataaatcactacgctaactcggacctcctgccctaaaaataggggacgcactggtgtgctatgcgcgagtttcactactcctgatagttaaatacgtaatgtgataattgctaaaggccatcacgctatggtcgaattcactcttcaaaagtcagagcctgttaccggaatagtccattctattcacactcagatcccaccaaaggcgtttgagtttgtggactcgtcgttcaaagacatcgttttgtttgtgggtggtctcaccaatggtatccttggagttggataccttccattgctggctaaggcattggctccgcttgggttcggacttgttcaagccctactatcttctagtgatagaggatggggaacgtcatcgttgaaaaaggatgctgcggagcttgctcagttggtgaaatatttgcgaacaaaagcgggcaaacgcaacattatcctaatgggtcactcaacaggctgtcaagatacaattcactatctgctccatcaaaatcctactgaaccaactttacgggtcaatggagccattttccaagcccctgtatctgatcgagaggctttttcaaatgaattgcccgtagaagaattggatgcattgaatgaagaagccagagcaatcttggagtcaaaaggacctaacgaattgctcccccaaaagttccgagagttggctttcaatacgcctatcactgcttatagatggctttctttgatggcccaaaggggagatgatgactacttctcatcgtatcttacagatgaagaatttagcaataccctaggagcaattaatgttccctttttattactctattctggaagtgacgagtttgtccctcaaactgttgattcgaacaagctggttgaccgttggaaggcaatagttcagcgaaatggtttgtcagattggagtcaatattcaggtatcattgatggagccactcacgatctgggcccccaatcagatgcaggtgtagatagagtcgtcaatttcatcaagaacctctcctgggataagaattaaaattatctattgatttctataggcaaatgtcaaataggatgtgtgcgacttgacttcaggttctgaacgtgtaacattgatccaattatatgccggatcaccttctcgtatacgcatacctttgccaaacggattatacccacgatccttggtattttggtccgactttggtttaagatcagtttcacctttcccagcaggctccttatgagaaatgtcattttcttcagtggtttggatgtcaatatcctcattctcaaattcatcagaggtctgattcaattttctcttgcgttccaggcctgctactgccctctttttgatatctttcagacgagcgaccgcttcatccacatctctcaccatctcacgatgagcttcccacttacgtccagaaacttcaaccatttcaatgccattccagtttttcgccgttaatgcttctatcgttttcacaacttgttctatacacggggagaaacagcatatggacacccgacgatcctttgccactacttcatcaagatgctcaattgcttcccaaggagctgggagatctaaaaatacggcatcaccatccacgttgactccatcaactttgaatccgtctgtgcatacatctcgatgagttaaggtgatattgggcaacttgtgacattcaaactcccccttggcctcttcataacgtggcttatgaaactcatagctgaagagacgtccattgctgtgtatcgtacgggcaaaagcatgactgaaagacccagatcccgtaccagcctcaatcactcgactacctggaagaactcgtaacctctgcacaacatatgaactatcaaaggtatatacaatctgagttctatggggtaaagatagggtccatagctctggggtaggctgaagcaaatgaatgaaaccgtatcccttagcgctggctatttgttctccataacgggctccaatcatcaaatcatgtggaaacacaccgtaacgtgtgtttaaggtttccccggatttgactatcataggcttaatgtcattcctcgatataaatgccattaccaagtcctcttcctctataacgtctttataatacaggaacgacattttcgtcttttacgaaagtgaaatattgtttgaataatttttgattcagactaaaaaaaaaaactaacgtagaacaatctgatcacaggactatccacgtgacagaaccttctttttcctttcctgattatgagctatgcaatttacctgatacaaaatgggttctaactctggggttcaaaccctttactcaacattaattctcgttctttggtcgtcttagcttgtttagcagcaaccagctccttgcgaattctttgggcttctggaaagggaatctgggatctcttctctaaatccttatcttgctggtcaaggtcaatctctccaaccaaggatacgttctcacctctgatcaaaaagaccccttgaggagcctccgcatatttatcatcaccgatatagattctctcaacggtatcttggagcaccaagttggcaaactggtcaaatgttcgaagaatcccaataaagacacgaccctctctaagtgttactgttactattttatcaatgcttccaacgagggctgctgctgtagtgtacatatacgactccagataaagatccttctcagaatcgttctgaaaaacgtccgacaaaccggccgtttgtgatctattttgattctgggtcatatacggttgtgttggggaggttgatggtgttgatgagttcagttttggtcgagatagtggtgttgggaggatatgaaaaaaaaaatatcagccttctgaaaattgtataagacttgaggtgcctttttagttcccactaaatcagtaattatggctcagaatcacagaaccaagggggcaaatgacccaaaagtccgtcgtagacacgaacgtcggctggacgaaaaagctgctatcttaaacccttccactgctgctccttcatcgttgtcttcaatttccagatttggagttgtaacgaataacaaactatctaccaaggcagttagaaagttagagagacaaaaacgccacattgcagctgataatggtaattatgcgtccaataagaccgctgatttggaccaggatatgtctgatgtgcaagctgctgctgctgatcgaagcaaggcaacggccctagtgagggaagctctttggaaagttgtggatgaagttgaggctaccggaagagttcttcctactcctactgctaatggaactactcttggagaacctgtgttttaatttaagaatgtaaatgtatactagagagaaataatcagtcaaatcggaaatggagtgagatatattttggtttgtacctattcatctaaaagacctttctttttgagactatcttggacagtgtcacgcaaaaattggataacctcaccggggtctttagcaccaaaaacagaagatccagcaacaattacgtttgccccagcatcggctgctactcctatggtttcctttccaagaccaccgtcaacctgaatatctaagtttggaaatttggcccgcaatgcttcaactttgggcatcatatcagccataaacttctgtccaccaaaccctggctcaactgtcattaccagagccatgtcaagcttgtctgctagagggtacaagacatcgactgatgttccgggcttgatagcacatgcagctttcagtccatggctcttgataagttccactaacttcactggatccttagttgcttcgtagtgaaaagtgtactgatcaccacctgcctttgcaacctctgggacccattgttcgggattggccaccatcatatggcagtcaaagaagtgtgtcgtctgtccatctttctctcccctcggaacagcttttctaagggacgagataattggaggacccatggtcaaattagggacgaaatggccgtccatgacgtcaatgtggacccagtcagcccgtagcttaaacatcttgtgacattcacatcccaagtttgaaaagtctgccgacaggattgagggagcgataacaggtttgaccattttttcgaatagctaggtgatatgaaggaaaggtagtaaaattggaaatatggtttgagatctggggcagattaattggtggatggaaaacccactagacggaacgtttgttcgcgcagtaaggaatcgcattccgcccagcaaaaactcattcggtctttcaatcacctctaaagacgtatatcaaatcctacttaatatactattcagtcataaattgggtttcggtttggctttagcttttttctgagcattttctaccgtatcacgaagatatcggataacctcaccggggtctttagcaccaaaaacagaagatccagcaacaattacgtttgccccagcatcagctgctactccaatggtctcctttccaagaccaccatcgacctgaatatctaagtttggaaatttggcccgcaatgcttcaactttgggcatcatatcagccataaacttctgtccaccaaaccctggctcaactgtcattaccagagccatgtcaagcttgtctgctagagggtacaagacatcgactgatgttccgggcttgatagcacatgcagctttcagtccatggctcttgataagttccactaacttcactggatccttagttgcttcgtagtgaaaagtgtactgatcaccacctgcctttgcaacctctgggacccattgttcgggattggccaccatcatatggcagtcaaagaagtgtgtcgtctgtccatctttctctcccctcggaacagcttttctaagggacgagataattggaggacccatggtcaaattagggacgaaatggccgtccatgacgtcaatgtggacccagtcagcccgtagcttaaacatcttgtgacattcacatcccaagtttgaaaaatctgccgacaggattgaaggagcaataattgttttaaccatgatctcacacagtattcaactagttttactttcccatcttcgcatatagtatatatttctttaactacgaccccccactcataggctatagtttagcccatcgcgacaagcctgataagataacgaatgtagaggtgtagtattagtaatttctaagaagtaccctaatcttacttatttccttcaaaagcctctactttctcattgcctttctcagaaaggtcctcattagagacagcctccattaactgaacatcttcgatgaactcagtttcaattccttttttgttgtccagatctttttgctcccaatcgtcaatgtaatcctggagatcatcaagattggaggctcctcttctttctggacccagcaacatcacaataaacaggaaagcaaacacagctcccataaatatagccattactttggcatagtcataaacaccctctttccgcactccattctcgtcgtaaatggggaatctttctccaatatcggccaggatagtagatgatccagatgatgccaggtttcctagctggtaggtggttcctgtaacaaaagctcggaaatggggcggagacatctcagcaagatgaactggacatacaccccatccaccttggacagcaaattgtaagaagaaagcaccagcattgatccctgaaccatttataaatgcccaagggtaaatgaaagctccacctactatacaacagagcaaaactgcaagacgtcgaccaatgaagttggacatatgaccccagaaaatacctccgacaatggctccaagatttgccacgacgttagtaactgtagatctgtctttaccaaattcatattgaactgttagaagagtagggtaaagatcttgggaggagtgagaactaaagttgaatgcggccatcatgataatcatgtagataagcatcaaccagtagactctcaaggcgtcttttccctgtttgacgaactgttgtgaggcagtctgtccatcgctagtttccattctcaagttttgctgggcaataaatgcatctgtttctggtagaaccagtctccataatatgataagcactggcggaccggcactaaaccagaataacgctctccaactttttgaagcattatcagtgatagcacgttgaaacaccacaaccagaaggtaaccaaaggcatatccttgttggaatataccactaacaattcccttggctcttggaggacagtcatctaatgctagagaggatgcgttaccaaacacagcacccatagcaataccaaatacagctctcactcctaagaattgtttataagtgttcacaaatcccagtccaatttgaagaacaatgagaagaatcatgttgaaaataaaaggccattttcttccttttctatctgcccacagaccaaacgaaatagcaccaactgaccttagcatcaacaccagagttaaaccccaagtgacatctttggtggtgacattcaggtctttagcaatatttgttacattaagagaaacagagaaaaaatccacagcatcccaagtccaagcagcaaaaccacacataaagaagttccaatttttgggtgtcaactcacggagcaccatgaaaggattgaaaatgtatcgcttatctttgaaatcttcagcttttggcaccaacgtggaaagtctagtagcaaagtaatgttttatcgattttgcagacaagtctggcttttccaaaggagtaactgggtggtcatgaggatgtattctgtcgtgttgtttttcaatatcagtcatgacactcttgtgagcagcagaatggattgaatgcgacatggcgttagactctgtctagaggatatggaagaaactactacatttatagccagaacaagtcacgaacaagagaacggtggacaccgaactctttacagtcatgcgtgtcaacattctggagctgcggagattttactatggggcattgtatgaaagatggaattacggggttcggagcgataaaaatgggggtgcgcccgacctgaaaaatggcttggcatttatgcaatgtgcgtgctaggtcattcgatattgaaaacaacagtaagaactgctagtttttcttgattgcttaaacgattcaacgaagaccaaagttctttctagtttcattccgaatcgtggtctagtaaagtgatgcctttcccattttttgttgggaaaatttctccacttttcgactgatctgcacgacggtaaacaggttgcttgcaatcgagcaataacatgcgtgttgctgcaatagactcggagtcgggagaaaaagataaaggaaaggagcggttgaaccctgttcaaggattggtccattggtacctacctacagcgtggagaatgcttcgatatgccaacatgaatacaagtcgtaggtcgtgatactacctaaaaatgcttgctatacgaaatttgtgtttcagatcgtgtataagcttttgtgcttggcacgatctaggcaacggttttgcaccccattatttagattttccgaatgcctcatattcgatacggaggattatcttaaggataaagcaacacataccacaaatctttccccgcagtcaattttccccacaaggaactcttcgagaatgtatggcaacacacattgattactgtatctcagttccagttaaacacctatttgctctaaaaaaacccataaaaataagaaagattgattatcagttctggttgttgtgaagcccctgaaactgctgattttgatattgatgctgctgttgttgttgttgttgttgttgttgtttgtaaaaggatagatattggtcaggtgctgccgttgacgcaaaatactgttggtaagtagtaagcatggcattaaggtttgcattctgatttaatacgaccgaaattttggactgaattcttctgctgtacggtgtagacttgatgaacggcaacattggtttaactgtttgaattaaacgaaatttgtattcgtcatcagccacatctatggctgtttgtaccacatagttcccgtattgatccttgatcaaggcatttaaattctggggtctcaagatttcttctaacatggcattttgagaggatctattgggagcattttttaagcacttttccataacattggaagagaacttttggaccgacaacattgaaatggagggtaaaatctgataaacaagcttctcattgataggaaggttgttcatagataataggtattgtactacatagtttccaaattgatccttcatcaaaacaattgcattggcaatgatctcatcacccaactggacaagttgctgctggttacatttattgagacacttttgaagtacacagcaaccatgcttgtgagtagagatacggacaatatggagacatatggcatcaatgatgaattggaaatctttatgtgaaaacttattgatacatttctgcaccacatgattaccattaagatcttgaataagctctaccacgtgattcttgagtgaatcacgtactaaagaaaactggtagttagttccgaggcaatcaatgattttttgaagagctctggtaccatgctggtttagtgcaacagaaaaaagatctggtgcactttgttccagtaacaaatccttctcatggttggtgcaatagttgagaagtttttgaacaaggtaattgccaaacgggtctaccattagttcggaggcatgagcacagatctgaccaaatatggtaggaaaatacatggtactgttctcgtctaattttctttgcaagaagcgacagccgtactggtccttggataagctaacgatctcatcagtgagtgcctcgaacggagtggaattgagccgcgtaactagctccttttcatgagacttttttggatatataggagtagttgatgatgacgtaggattgaaagtatccaagttattgttgttttgtaaactcagtgatgctaagctcttgtcaatgttaaacgttactgcaggttgtaattgcggaagagagaggagcctggatcgagggtttgtgttcgtgacggagggagcagcgccaacaccggggttacctgcagtatttgaaaaggggaacacctgagccggaaactgagtggtggagttgcttttgagcgctccattgttatttgtgttccaaggggagaaatgcttggtactgttattagcgatctcaggtggtgttagtggctcaccaccaaattggtacgccgaatcatggatggatgttgaagtatttgagttaaaagagtttaatgagttgagcgagttgatggagttgatggagttcaccgataggcttggctggtggcgaaactgtgactggaacgacactgtattagcagtcgatccggctcctatgggtggtatgccagggctcagggcatttgcaagggagttctgaccctgtggcgagctcccgccgacgctcagaaggttcttagtcatgtatggttcttgaatgtcaaagtgggaggactaatggttagtaaagatatctagggctattcgggccagggctgaaacaagccaacaaaaccacagcataggcctgatccaactgttcggctccggctggaaacgagtccggttgaaaaggagcagacgccggaattgggctgattctgagtttgagagacacttaccatcatctggaccgttggcaatatatccttgctgtcagtggaaggagactacttgggaatggaatgaaagatgggatcacagaaaaggaacgcaaagggaactgggaacgagggtcgcgagtgcggctggatgttggatgttgatagaaggggcacaggaggaggaggacgaggtgaggtggatgaggtgaagcgaggtgagtggtcgaagtagtcgaaagaggtgattatggattggtgaaaaatgacagggcaataaaaggtgtcaagagaacgtcaatggatattcgttggcgaaaggaggtgacagatctgaagagccccagcagtagtggtgaattagatatggctctcccaattttgcggaaacagtttcggccctaggatctaagcaagtttttcaggaatgagtggactttctagtggctacttcgtcgtctaggaacgtctaattacccccgtctggttggcagttttacggattcgaggttctaaaaatacatataacccctctaccacgacattgcaacctgctggtttcagccgacaaaggtacgatgaactctggatgattctggaattcctagttcgtacctgtcctcatctgggcaatcgctgtcatcgagccgtctaaaaaatcgtttgcgtgcagattgttcttgcgttatctgatgccaatggctcagagttgtgtaaccagcatttgcacattctcccctccaactaatattataaacctctactacatggcatcatctattggtggttatcacttgcatcccaacctccagctctggagtcgtggaaacgaatgctaaaaaagaaatggatgtttccatgacagcataagatttcgctgtgttgttaactcacttgaaacggatcgcgccaagtaaacacctctattatttggttgttcaattatggggcccaggctgccaagtgattgttgtgcgatgagaagcgtaaactttgtttcgtcatctgctctgcatccttaacgttttgttgcaaccatagcttatcttgtaaagaaaatcagaaaaggtagaaaaaatttacgggtgacacgaaaatgggaatataatgggtggtacactagacgtgttgtttttctctagtgtatgaaaaaaaaaaaaaatcaaatctcatcatgcggcgcgagagcaatcctttctaggttcccaattgggtacataatctggggtaatggatagtgaacaatgtgaccaaactggacaccttgggaatgagaccggttcagttgaagcgctgttatctcagcagctattcttcttatcattgacgtttaaatcagttctctgccgtcagaccatgctgaagtttacccttttttgacacaacgctcactccatctctcctttttttttgtgcgccaatcattcttccaggtccttccccacacatctagatcacgcacccaccttttttcgtcgtgctccaaccataactttcccttagtatttctcttgtatcccaccctagcaagttttgtcataaccccagactgagctctaggacccggtgcacttatatagtttccacctttgctctgaagttatgattggaggcccccaagttatttctgaatctgaatcaaagttgcgatatttctgccagcatcccaaatgcgataagaacttcaccagaaaggaacatctgtcgcgtcatgaactaaatcacaaccccaaagttctatacaagtgtcagctgcctgaatgtgggaagtcgtttgttagaaatgatctcttaaaacgtcatattcggcgtcacgagctaaggagggacaaatttcagcggaggaacaataaggccgctgtccacttcaataataccccaatagtcttgtctggaccaggcctgaaaacttctcatgaaaactctagctcaagcgaaatcgatgcttttacaaggtcttccattgatacatctgctccactggaagctcgtccttctatttcagagcagggcaacatgaaacacgacgattcgactccaaacggttcttcccagcccacccaagctcatgtcacttccattccacaaaggtcgactctggttactccgaaaaacgatggacttcgaggtgttcaaaaatctactagctctggaaaccttttgtcttggctttttgatgatctcagctccaatgataacaatattgagcccgccatgaggacaaggaatgatttttcagacttcatgttaagtgaggatatgctttttcaggaagctcctggagtttcaggaggctttgcacatataaatggcgtagacatggcttggagtgcccgtctacctccaataacttctccgttggcagctggtcttggaaatgaaactaccaatgattcaacagcacttgataaccgtcggattaatgcacccatagaaaattctcccgcttcgccctcagatcatatttcctccttggttctgaatgatttgctgaatgtgatacccagtcttagccagcacccggacttcacagggccaaagattgatttctttttattcaactattggtctctttatcaccctgccttcccgattcttcacaagccatcattttccagtgcccgctgtgaatctctattgctactttgtatgctgatgattggtgcccacgtcatagctgcatcgccctcgggcacagcagggtgccattttctagacatctgtgatcctcgttcgttggctgactgtatagccgaacctgtgaggtgggcgctgttcacatctcctgactttcaccctccagcaaagctatacgttattcagagtttattgctgttggaatggtatgaaaaaaactgctccaccagaagaatccacgaaaggggccatttacatcatggtacaactataaacctactgcgtcgcacaccgtcacttggtggaaaccccttgaaaagttcgcaggagttggaacctaatgaaccagaaaccgtgtactcgcaatggctagaaatggagtccatgaagagagcaacattgatgtgcttttatatggacgcagtcgatgctattagttttggccaccaattggtgctccattgtcaccaaatacagttaacgatgccatgtgatgatgctttgtgggaagcgccattacccgtcaggagaatacccaaatccatgccctttttgctagccatgaaaagcactctgaatagaacgtcatttaacgcaacaccctttggtcgtaggatggtactagctggtctatgtgccattctatttcaaatgcaacagttagatttgcaatctgctattggcttggaggagggcatgcatcctattaaaaactggcgagaggtcatcatgagagctttcaccttttggcgtaacgaattgggcgaatcaaaagggttagattccaaaggaaggccttctcgtataattgctgggtctttggcgaatagttcgtccacatgcacgagcccatacggcagtctctgcactagttcaattttagaacaacttgaagctgatacttcttgcaaacatccagtattccacatggcttatgtgtttatgtcaatctctcactttgatttgaccacattcgcaggagctccatggagaatgaacgtcaggcctagtgacagtgatcatgctgccgttaatcgccgagtcaaggattgggctcgtagtctgcatggacgaattgctgtaatccattgctatttaatgctatttgagctgttcttgtccccagaagatgcaccttatgagtataatcatccatttgacccaaacagtgatctcttttgtagatccaatattttggcacttttgactgttgtcatctggaactataattatgctgtggatggaactgagtccaacattctatttggatcctctgataagaagttatcagatatcacacctgtagaaaatggatatgcttacttgcgacgaattcgcaaggagctttcgcagctatctggagtaatgatccatacaaaagtcaaacacatctctggcgatgagtttttcaaattgacctgtcgatatgcagatcttctgcccaaagttcgaaataagcagaacatgagtggtctttgcgtcatggtatcgtccatgttaatgcaaagcagctttgctctaccaaaagaattagccaaattgctcaatttatgtgctgaacgaagtttaggctcaccaaggaataccgaacttcatatgtatgaccaataaatgctaagtaaaatgctattattaataattctaatattactgccgtgagatctgtcgtttacaacatcgttgatgtcgcgccgcgtgttgttatcccaacggtgtttaccaaggcttcagcgtcttcctcaactcttcactcaggcaagcatcggtccaatgtcagacacaatccgtttggctaaagagattgatgaaacctcgaggaaacagtctctccttttgggtcagcttttggaccgtctagacgagaaggaagccaatgaacagagattattggccaagatcagagtattggagtcaaatcattctttgttactctccaaaatatcagaatgcccctcttgctccggattcaacgaccagaggttttatagttcgcagacacaggtctccatgacccaagaatcacagcttcaacgcgttccatcatccaaaaggcccaaatatcaacctaggtctcctctgaaagaaataaccaatttagaaccaaccctgaacatgaatgtaaatactaatagcttcgatagctcctcttccggctcaattgagtatgtcgcagtggcatctccagaattgatcacttcggacatcgaagagatcatatccgattctcaaccggatgtcacacacgacgacatcttgacgcataacacacctaaaattaacccatatatcacaccaataactgattcaaagataaaaatcgatctgagtacgaacccaaagtttaatagggaatggtttttggaagatttcaaacgcaatcccgcttcaaaatccagccataccgacaattgcatgtgtaatgattgctccaagcttttccaactggccccagtctcaaacttgaaaaatggtatcaaatgggacagcaatagcgccgaatctggagaaaccccttcaaaacgttcgatcccagcaggtttcaaaagaaggcatggaaatggtggagataacacaatttgggacgacccttgcacaccaccaggattcaatagatcagagttccccaccacccaggaactcaaagaggatcgtaaagaatccagtaaacgagtgaaaagcatagcattgtacagactgaaggaagcgcttaaagtcgacgaacatggaaagcagattggaaaattcatcttcaagaacaatgagttcaatgtcatagtaaacaatgggaattttctaacttgattggagtgattttatgaggggtttatataaaaggtatagatttacaaaagtctaattctaatcattaatcatttcttttcgttaacgtagttgaagtaattgaagctgttcagttttgggttgagatcgaatgacgtgttgacgactttccttgcgtgttcactgatagaatagtgaacgtctcgggcattatccagcttggaaatatctacaggggtcagggagttcaaactgtttcccttcccatctgtgatagcaccggcaactttacccagagtcttggtctggtttggatctggatagaatgccgataatggaatgtacgtttggaacaattcatatgaggccaacgtgaaaccgaactgaggagaagaacggaacactcttgctagaccacctttaaataatgcagaaaaaccttcttccttgaggatcgtcttgaaggcgttggaaataccggtataatgcatatcgccggccttgtgttcaacctgcagtcttgtcttgatgacatcgcagggtgttgtgaagtaagcagcaggcataccagcaagtgcaccagaaactaataattgccaagattctaaagaactgttctttgtggggtctttggggtcaaagtcaaacaaatgtttcttaaggttagcatagcatgggaaatagatagcagaaaaaggtacatctctcagtaaacatgcagatgcacctttgtataaaccacgaatacctaattccctaacgatgtcgactgcagttttttcgacaacatttgtaccttcagcaagagattgtttaagagcttcaccttgaacttgaagacgaatcttggtgatttctaatgggtttgtgaagacaacttgagctgcacccgcagaacaaccagccaaaatctcccatggcatggtgatttctccgttagcagattgcttcacacctatacttctgactatatcattaactgtaagtttgatagctttctcaggagcaacaccgactagttgaggcaacagaccggagtaaaaccccctgagaccttcacttctgaaagttttcttaaaacagtcgaagtatgagctgtatttggcattacccttctgattttgcattctggttttaacaaggtcaatggggtacacaatggtagctccaatggaaccagctatcgagcctagcaagaatgaatatgcagagtttaagattggatacaaagagaatccaccatctacggtttcctcggtagtgaccatgtcatccgttaaaatagccaaaagatcacccttcaataaatgattctggttggtagaattaacaatgaatgtggtcagctggtagtagtaatccaaaaaggaatctgagacattgtcctcagtgttgattgtctccttgagggcagcaatgaaatcttccttgcaaagggtgtccttgaagttgttggatgctctgaacgtgtagtagtttagcttgggtatagcctggacaaagtcaaacagactagcggcctcgttgaaggttaaactttcggtgcaaagtcttccgatttgatcgatagctgctgttggcagcctagaagagtaaatagaggatacgatgttacggaagtcctcggggagtattttaccatcatcggacacaactctgtcaaactgcgacttgaattgatcattcaagttggtagaaaccaaagatttgaactcatcttcggacttgtccttgaaggacgagtccaaattctggaacaacttataggtgatactactctcttcctcgttcaacagtttttcggaaaacgctaaccaattatccaaagaaatctgaccattggcgtccttgtccaccaaaaggtacaataaccccagagaactgttcggaatcctcaaaaagttgttgaaatattgcgaggcgtaagactcattagacagaatatctataaatccgttgtagtccagtttgccctcctttgaatatgagtcgaagatctcagtcaatgattgggtaagctccggcattctttcttctatagagctcaacgcagaatgaaaactggaatcagaaaatcaatttagaggttgggattgtttgcttgaacgaacaagaaatagaagcaagaaaaaaaaaaaagggggagacagctgaaaataatctgaaaacttccttgtgtccttttataacggcggtcgactaaaaattaattaaccgacaggtttggggttgatttaaagtggagaccaggaaaaataaaaagaaaaaccacaacggaaaagtagtgcgatgagccaaagggcacaattaatgggtgaggggggtgaaatattacaatccaacagatccggaagaagatattgagatgagacaacggtcaaccaaggatggccagtagaagcccgagaaatcaaggcactcgttgaacccgtcattggctgaatgtttacagtgctcattcagcatgcccttgcaaaaaccagtgaggaatagcctctctgaccgcgttccgaaattcaccggcggttatatggaggtggcctcaggcggtatgtcccagaagggtgcatacggcgcagatgttcgtatcaagggggggggttcatgaatatttcgtgaaccccgggaaagttagggtgtcaagtttgtccctcggggaattggatcttcctgctttaaagggttaatgtggggagccaacaatgtcggtataaaatcaagtccctcattgatgatgagatgaaacgggatattactcgtaagttaggatgaggtaattggttgcttaatctattaccttcaaacgtaaacgttatttgctaagataggggtcacgagataagatttatctctttcttgttttgaaagttccactgctcctgccctcttttttttttcttgatgcccgcctcactttaaaccccgataaacctcaattaattccttatcacctttaaccaagggcagtctgatggaatgatgactgggtcttcaatgaatttggcatgttgtatgaatgaattctcctgttgatctgaacggatagtataagtgatgttcccagtaccattagcttatgtaagcattatatatcgtatcgaatgaaccatcgcacctagtatcgaaacgaatgtcactacaggactacctggattccaaatatggcaaatccaagtccaagaaaagggataaatcactgaagccgaaacccaagtcgtcgatacaaaaacccacaaaacctgcaaaacccgagaatgccactatttatagagacttatcaggaaacgtcctctctcatgaggaaatgctagaacaacagagacagaaatcacagcaagaaaaacagaaagccaaagaagcatctgaaaaattacgcaatatgaatctccccgaggttactcaaacggccactaaaagagtagctccgccaagctatgtagatgacccgttgctagcattttctccagataaagtcaagtcgctgcaaaaagaccgttacatctcacagacaggccgtaaactatacaaatcttctttcccggacaatcgtttctctataatgccagggtatagatgggacggaattgataggtctaatggctgggagcaaaaagttttcaagacgactgctctaaggcaggagaagaaagttcttagttatacaatgcaggatgattattagtaccattaacgcaatacactaatattacaacacaattctattcaatcggagggacaccttcattctgatttactgtcctcctttgcctctacctcgacctcttcctcttctatttcctctgcctctaccacgacctcttccttggttttcatccctagaatgattttgaggggtagaatcagagtgttgttcattcgcttggactccatttacaggggtttcaggtaccggatttgagaagcctctgacaggctgcaactgaggttgagcgctcaacacttgattgaacaccgttccgtaaatttgctggatagaagtccgggcaagaggctcttgagagccttgcgattcactactgtccttgttacctttcagtaagcgaagtaattcatgttcgtcctcagagttgtttgaaggtttagaagttggaacggtagcagtaaccaccgaggtagcctgtacagatgcagtaactggtgcagtgttagcggcaggaaccggaacaggtgtcgtagtgactgacagttcagcatcttgtgcctgtttggccttacctgaaccgttctgcaacttcactgtttgctttttggagtcctgagatgtcttcttaactccaggcttaccttctttcttagcgggtttcctatcgtggtaaatcaattgacgctttgttaagttcaataccaatgaactatcaacagtgacacccctgggggttgcaagtcttccatcaaaggtattaccagagagcaatggcaagtcaaacaatacgttcaaagtcactttcgtaccgacacttcgaaccccaataactgtacctttactgaagttgggtaccttaccagaatcttctacgtagatcactctgtctcctagattaaaagtctgcttggaaagaaattgagaagagttgctgatatccagagtagcctcacgaggaactcctttcaaacccttttggggaatatgttcatgtggttttgaaacaaacttaatcacttcctgttcaatctttccgatactaaccttggtcaaagactcagactccaatgttgcaacaacaaagcttttcttttgttctttaacccaagccacaagttcattgactttttcatccacttggctagcggggacttgaggaaacagttctttggcttcaggaattgaagaatcatttcggagagaaattatcttaaaaacagatgggaaacgtttctgatattgttgcagcaagtttacagccaaagcgctgtatgaccaatgtttctcgtttcttttagtgtatcccagaacctttaactttcttccttcaaacttcaaatctaatccgatgttaacagttttcttagctccattaactattctataggaagaggttattctggacaaggctagcgccgtaattccaacgattttggcaactttaaaggagggataatacacattggtgtgtgcctccctttgtgcttgaatctcaccatagttaaattcatgcttaattggctggtttacgaatctgacggtcattaagtcattttggtggtcaacaacagtagcaggagttccgtaagcaaaagctcccaaacttatgagagtagtaccctttgggaattcttcttctaatggcacaggaggtttttctaataatcgacgatccttgttaaccacgtcgtcaacaagcaaattaatagggtatttctcaatcttgtcactgtatgtcttcacataggcacccgatctagtgcgaataacaccattcactttctttacaaacacaattccttggatcgcatcgtcattgtgaggggatctacgaggctcaggtgttccttgcaactcttcctcagtgtagttcaccagtaaaacaccttttctcttgaatagcgtctcactgatatagcgaacgtcactggcaaattctgagacttcagagctttccatacgagtcgttcggatagacttgtttccaggctcaaaaacgttcaaaccgtcagaaactgcaacaactttggcctctttcaaataaggccagttgacatagattgtttggcccaaattctgagcagcaaactgctctacagtgagtccttcaaacggattctgtgtacttagaatcatcgattccgattttgttggctggttaaaaatatggcattccgctaacatgagctgcgaagtgaagggaatggtcttcaaagttgggaatccagccaatagatttataccttgtttggcacctttcataggtttagcataagttgaagagtgcagcttgtcaaattcgaccactatttcgtagcagtgatcctcagtgatatctgggaatattgttggaattggggaagaatgaacttgattcacttgaggatgatagctaaactcgatattcgtgcccaaagagtttctttgacgttcttcagcattcaacttactattatacggttccagtgcctctaatagtcgtttttcatcgacaaagttgattttaacaacagcctcccaagaggcagtctttccattcttgtcaatttcaacctcatcagggtaaaattcaataatgggagagtttggatcggtcatcaacggtctataacaagcaggaactaactgttttgatcttgcaggaaggacagccattaattgttcaaatggcttgaacggtgtacctttgtcaaactccaggcaagccttaatccctaatttgatgtcagagattctaggagcatagtaataaggatagtaccattgccaagaaggaactcctcgataatagtagaacaaaacccattgaagaccctgaatatacgactccgtcaacttcaaaatgtcctctgtgtcagaaagagtaaatccaaacttttctttgtaatatttgtttttccagttgacgaacttggtatcataaatgttcttttgttcctctaaagtgttttcatcttcaacaaaaattgagttttcatattctttgatcttcttcctgatatacaagacacgagcttcaaattcttcatcagattcattgacatttataccatcaatgtctatcttagcatggtacgtattctgagatttgctgtgcacaataaagaaaccaacatcaagtgcaaactgctttatgaagggtaacttgatttcttcttccatcaattcggtgtccaattgcaaagttggaattaaggagtcatcatcatgagcagaatatatattgtctcttgatgaataaaactcgagaatccatggtctaagttttgaaattaattcctgttgacgtctaagcaacaactttcttccagctctttccctctttcgctcaccatctagggatatgttctctagctgcttgttaaaccattctacatccacgtcgacctgctcaaaattttgaagctcaaattgtgacaagtggtcaagccacagaccgaatcgttccatattgatgacacctccttcttggagatatccatccgaatctatcatggtttctttgatcgttgctaagagtctggggaaggcacctttgttgatatgcaagtcaggtaagttgggtaagaaatcatttccaataacatacatgataaaaataaaatcgtccaagattctctctaagtcataatcaaactttatctggtcttctaaatctttgaactcaagagcaaggtattcacgtaacaaggagagatgtagaaggtagaattgctgttctgacacatctgttgacgaggccttggatcctcttccgaacacaacctcttctctcaagatggcaaaatgaggatcgtgaatgaccaatcccaacatgatcaagtctgcatccagcccgtaaatacaatgtctcgtattcggatcatacccctcttgagccttcaaaaaacgaatatagtccataattttgtgctctccttctccggggacttcatgtccactgagaataacctggactttctgccattttgcatctgaagagattttctggtggatgaaaaacttcaagttagtggtaaccttggccataaactccgttccaggagtgatacagttactgtcaaaattctcgtctttgctagtaatgagtccattcttttgggctatctctacacttttttctgcctcaatggccgtcctgaatcttctagatcgttgctggttcatctttgctctaggagcaacaccatcaatggccatgaaaaacgtctttccaggtttgatcaaagtgaaaagatgttcaatgtaagcaaaaatagcactgaacatctcttcttctttcattaaatcaactgatccatcgttactatgtgtacaattatgaagaattgagttcatgtccagatacaggttatcaaactcggcaatttggctgtcttctattggctcagatatcatcggccatctctcagagatgtaccgaaaaaactttggaatacccattttgtaaaggcaatcaaagcttggtggaaatatgtaatgaagctgagcgtgtgttctgtgaaatggaagaagagcgagggagtatgtgagttacccgacttagttggaagggacctcgcgagcttggaaggatttttatgaggaaagttagagggagttcatgtaagcagttgctcctcccaagtccttacatcgaaaaatttagtgggaacttttgtttcccttgtcaaaacaacgttctttaaaaccttaaagtcaaatgtttggaaattccaacaagaaccccgccaattcaggcggtatgtttggaaacgcctcaggtagcaatgttggggcttttggaggtagctcctctggtaacactggaggcttgtttggagcaaagcctgctacgaatacgaataacacaggaggtttgtttggaaataatgctagtacaaattctggaggcaatagcggaggattgtttggcagtacgaacgcttcaggtagtaccaatacaggcggtatgtttggaaacaattctggtaataccaacacgaatcagtcaggtagcttatttggcgccaacaccaacacgggaaatactcaatcgcaaggattgtttggtgggaatactgctagcaacagcaatcaatcaggagggttgtttgggggaaatgctagtaatactcaatcgaaaggactctttggaggtaacaccaacactaactctaacactcaacagggaggattatttggaggaaattctggtaacacacaatcaggagggctatttggaaccaattcaaataacacacaatcgggtggtctttttggaggcagcaatactgcaaatagtaatgcccaaactggaggggggttgtttggaaatgccaataaacctgcacaaagtggtttctcaggctcaaataatccgagtggtaacactggaggtctttttgggagcaataatacgaacgctaatacaactacagggagtctatttggaaacaatactaacagtaatgctggtgggcttttcaattcaagtaataacaataatagtttactgggcaacaatgcagcacccaacaaccctaacaatgcttctcaaccacagataacatcccttacgagagtcacggatctaccagatgcctatcaaaaagaaatagaacaacttgatcagtacattcagcagcaaatggacatcgcagagagcttgaaagacgatcaagcaaaccacaaagaactaattgaatcagttccaagagacattaacttcctggaaaacaaatattcttctgttagtcaggccattcataatgatttaaattttgtaatgtctttcaagtgcaaggtgttagagtcatttaacgactgggtagaaaaggtcataaagctatacttgcaactgacgaacccagttctgctcaaggagatcactaataacgataaaactctgaacatcaaagaagctgaaccacccaatagtgctatacttcacactttttacgtacacaaagtcaaagaaatccaacagaatattcagaagtatcattcagttctacaagaaattgagaatgcagttgatgagcttgataaagttagcagcaatggcattgacaacagttgggatctaatcattcagacgcttaaagaagaatttcgactttatttagagcttgctaacaacttagctgacgtgcatcacgagatcaagcggatatcagtgtgatcacacgtttcactagttgagcttgattagaatctctatatagtacttgaattcaaatggagggaaaattcggcatccctaatcgcggaaattgtgtctcaaacgtcctgtttcgttccttatctaatcatcttatcctcactacactaaccaatttaccccccttgtatcgtatttattaatgagtttcgaagaagtagactccagcgggcccgatatgggctcttggtcgatgatcctcagtgatgaagacactgaaagtaagttgagttccgactctgaacgagctggtaatgctcggggtctcccctctagtaacttccctttaccccaagaaatccctcaaaacgataacagagataatccgtccagtgagatagcaaatgattaccagtcccgtgttcgaagctggcttaaatctttaagtcagaatgatcttcccagggataagaccaagcctcacagtttatgtgtaacagccatagttttattgatggcggccttagcgattaggttccagtccgtcgggactgatgtttcggtaccttcgcaagtaccagtgttgactcagactgagtttattgtgctgacccattcagtacattacacagaggttcttacattccaagtcactgagacagcaacagtaacaaaaacacagacagaaaccaaaattgagactcagacagaaactgaggttgagaccagaacccgtactttgattcagaccatgaccgattctgcctcagtgaaacaggaagtactaagtatactaaaggagcagttcgacaatgttaactgtggtgtggatgttatcaatcaaaaaataatatctgtcgcacgacagttgaaacaccccaccgatgagattgctaaagaggtatccttatacggaaataagggcaagctggcttgtcaacacctagctcattcggtttcagatacattcagcctgttaaaggataaagccgtagatcagcaaccaaaaataatcgcagtaggtaaatggattcaaaaagaaaccgttgatacgattgactctacttctgattctgtgagatactggtggaagtccaacgaacctctaaggcggtactgggctaaagttggtgaagatttgggtagtgacttgcggattcagtcggttaaactgagtaatgacctttcaaacggagtatctaggttattggttgatgttcctgaacactctaagaaatttggaaagtggctggaacttaactcaaagagatcaaaacgctatttgacctcatcctggcgaaaggttaaagctagtcgcctggaacgaatagctgataaggtcaaaagccgctggcagcagcacagctctaggttgcccaaatggatatatgcttctaatggcacccgaatgaggacttcttctctctcttttctagtctcctatccagatgtttggtatccttccatgccaacgtggtttagggtttatgtttaattattatcgatattgttttttctattcgatgtaccgttaagaagatttttcgtgttttcgtaaaccgttaaggttatgcaagtggcagggaggaccctcatcatgttggggactagccctttataaagtcctggtacgccttcttttgtgataatttcaatcaccaaatgagacatgctctgcctatttttgagcaattcgaagccttgcattcttgagcgtaagacttgcaatggatagaatgctactgtagcaataatcttggaaatgccactgacatagatgtactggtaggtcgaaaggaccttttggttttcaggatacaggctgtccttgagtgtgtcgtataacgtgaactgtagagccccttgggagacgtttaataacgccggtgtaagacccttccagaatcctgatataccttctttcttgagtatttgcgacgcaccttcccacaacgagttgtaaccctcgggggtagaatgatgagttgcaaccattctcgtcttcagcacccatacagggttcgtgaggattgaagtagaccatcctgctaagaatccactcatcagatacgttgaggacgttggatttctgaagaacgttttatattcgttataacacataaagtataaggcccaagatgccatatttccaaccaaatttggagtgattcctctgtaaaactccttgactagcactttagggtcaagttttccatttttggtagataaatgaacaatatctttcacaacggaactaataccccctgataaggaagtttgatgggaattcaattgtaatctcaacttgatcagatcaagtggatgattgaccaaggtagagcaaagtccggcattaagtcccgaaataatctctacggacttgataccgaagatgggttggtcaaacatgaagaggaaacttttcagatcctctggtgttagcgagggtcggagtagaaatttgaagcaagaggttgaaagagatgccttgaggcaagtctctctacgacatgggaaaaataaggattctctgagcctaagaaagagcaggattcgtctacgtggtaatattgattggataacggcaagtatcgaaataaaagactcatattcactggatccattcctatatacaattaacacttgtgttcctcatacttaagcagatggtagaggagataaaaggctacaattatgttagtactcactgaaactaaaagttcaaaccggaaaataaacgtacttgattaaagatggtctgtttggggtagagatccatccaacgtaaagaacaaatggaatccatccatagtgaacaacggttgtagtagtatccaagatcttaacgattctctcctaaaatacggttagtaggcgatcttgtgtataatgtagtagcaatggattctcacatactttagattcttcagacaaagctaatcctgacatagtttaatggtttgagtgttttgatatgggattggtaaagaggaagatgatcgatgacgatttttcactttcgagatttgctcgttgcctttcagtagccgggcgggcactggacgtttcaatgctgggcgggagagcgaactattccagagagtaattgttccagtctcacttgacataaagaccagttatcttcactcatccacttttacgttagaagattactagtcgcccttacagctctgtactatgtctgcaaatcctggaaacaagctttcttcctggaatccaacacctcctcaaagaggggctttccctttagatcattttggggattgcacggaaccaatgaaaaaatacatggaatgtttgaaattggtaaaaaatgataatgctccaaattgtcgccaattggcaaagaaatatttggactgtaggatgaacaatgagctgatggatagagttccgtgggaggatctggggttcaatgatgagcctaagaggaaggatgctccagttaaacaagatgcaggaacaaaggaaaattgagcgtttctatccagaggtgcttaggatatagtaaatagagatgtataaagacaaacttgtacaaaccataatgtttcatagtttatactagtataaaaaagtaatggacgagttgggaatcgaacccaagacctctcccatgctaagggagcgcgctaccaactacgccacacgcccaattatgataaaagatgcatatgttctgttataaccaagctagtttacttctaaggatggtatttgcaacatagaatggtatctaaatgttactaggaaagtttaaaatgcgttggagctggactaggcacaattttgtattacgattgcaaattatgaagagaaatcgctgtgaattccaacatctagttgctaaagcttcaaaagttttcctgtacctatcgtattagcaacagatttcaattttactaaatggtcgttaatcaagacgcaaaagcgaattgagaactggtagcattaggttgacaaacattacacatgctcgtagtgcaaatttcattatcagcttatcaattatacctcatcaatgattttatatattaaatcttagtttattattctggtttacatgctagtcagaggatgaaatatgaactattgataacgttaaaccctctataacttttctcatgttggtatcaactccagtagcggtcaaactgatcttagactgaaattataaattctagtatggttttttaactaaagtctaaatttcttcagtcctttttgaaatactttgcattcagttgtatgttttcaagcacaagaggattttcgttgctcaagcaattggctctaaacactagtactagtgtaattccataagtgactagcaattgggaactgctcattgagaaattgccaaacaaacacatccgtggttgaaactttcagcaaatatatatttgacatttgggtctacaccaaatccacctcttctctctattggctgtcaatgacttgttagaaatgtttgctagagtccatttggagtaactttcaattcgcctgtaccgcgatctaatcttatcttatcaacctaggttgaagacagccaggagagagtgcaatcaagacttttcttattcaggtatcaaataagaaagtcaagtttcccttaattccaacaagccttgtgacctttaggtacactttaaaatgcccatttggtcctggatgcgtggcggattaattctcagcaagtttcacggtaggttgaacgattccatctaatagcaacgttccaattaattaacagacagagagagcacctattccaatgtcattgatcgttctgggatgacccatctctctagcattctgaggtataacttgcctatctcaaaaccaatccactcatacaatgtgaagcgcgaccatgaaatgcctgtacttccctaatctcatctcttatacctgcagacacttatggaaacagaacccaacgacttacagcaattcggccaggaacccggctcgacgggggtatcattctttggtattatacctcttcttggattggcaactttctattttttctggagttccaaagtgctctatccattagttcccaaactctttggcctaacccacgtcgatatgagtaagttgaaaactatcaccactatttctctggagggttactatgacaagaaaacagtcttgcccaatgagtatacacccatggtatatattgctaaactggtttttagcattgtggtgagtgcaagtttgatggtcatttctttagttctatttgagattcaaggcttctttgatcttgattcgaaaatagttatatggaaattttcactgccgctgctagttttcttcctgatatttgttgttccaatgttgtttgtgtaccatcttatcaacaattgggaacttcgccgagagttcaagttcaatagtaacataaaagctgttcttttgatggccatcacagttatttggctacttgccttgcaatttttgaaaaaagcattcttttggatagatgactcaggtgaaggatatctggtcagatttttgaaccaactggctttactgggaatcatgtccttaggcgcactatctggaatcatcagtgtttcaaccccctacaacgcttacagaaaagatcagcaatacatatctgtgctggatctcaagaataaggctagacagttggagtctattcaagaccaactaaataccaaactcagtcgtttagagactaaaccgaaggcttcgagattcaggctgtttagtttctctagcaacgatagcaattacagccgcatagaagttgaatctctgacatctatgagagactcactgaagcaagagcttcaccaattgtatgagaaatatcaggttcagaaaaacaaagactcatttctaggaaagattggaatcatgtggacgaaggttttctccatatattgtgtttacaagtttaccagcgtactgttatacaaaatccctgtgagctactacaagacctattcaagaccaagcgatgaagagccaaatgtggcatctgacgctttatcagcaacattatccaaattgatagtttccttgaatatttcgtcttttcagccagatgaaaaggaattgactaaccaaataacgtttctgctatcattgggcttatttgcatcgtcgatttccagtcttcattcaacttttcattcgatcaaaaaagctctcccctcacatttatcggtttcagtttcttcaccagattctacaaacaacaagtcggtttttcgaagtttatttatctcggaaacactaggtatctacacaatatctacgttagtactattgaaaactaacattcctgaatcactctccaaaagcttcgtttcatttttgggcaaatcctcttattttaatggagctcgcgtggattttcttttcgataaggtttttgcaacaagctgtacggtttcactagtcatactacttctttcctccttctttggcaacgaggatgaaatatatgatgaagaaatcttgttggagaaggagctttaaataatcgagataaacccaatgtggatataaaatggcagctttcttcttccctctccgttcgaattgtccatccacacaccaccacaaatcacttcccttcaacgaaaatttgttgaaacagacctctacacgagtcatccgcaactggaacccagcaataatgtcaactaagctgcgttcggccaagtggattcaaaagaacggattcgctccacaagtttttctttttcgaaacattgaaaccaaccaggtgttatactctcaacttcctcatatctccaactaccaaatcaagcaacaattctggagacccaactggcaagaccgtaaaccacagaagagacgtgacatttggagatgtatggccgtagcagattttcacaattatgacaatgctctcaaggcttaccatgctttggtagaacttagatatcttagacaagttactaagaaagaggaggcaatggccatgagaagaaggaacaaagatggtaatatctggttcagcgcccaatttagacccgtacattcacaagaagctgttgccgatctctccacagtgatagatgagtttaacatgccctcaaagatatattgggaaagtttgtggagacgaggtgatgaaaagtattggaataaagatctgacaacccatgaagagatggatttgagagatcctaggttccgtactgttgtcctaaacgatataaaggagaagtcgaaggcagagattggcctgaaccaagcacgagcggcaacatcaaagctacaatagaaactgtaaatagagaaaaatattaaatattagtggttaaaacaaaaatcattcattttccatacaatacatgattactatattaaattactgttctttcttttggtgatccggttcatcttcactgtcgctgtagcgttcaaccttggagtgttgctgttgttgtttttgaatgcgtgatttctgtctagaggccaagaactctttgtacctttccagagtgatcttctgttgagactgcttatattggtcgaccccatggaatgttgtaccaaaaaacttgtcccaaaaggtgaaaaatggttgagaaaaattagatttgattccaaaatgttggtgatggatatcgtgataaatggagtcattagggaatatgatttggaaaatgtcaaaaggcaaagagtatccacagtggtcatccacagttttaagagtagaaaaaccatatagaaccatggactccctgggagttagtcctgtgaatatggcagctaggcctgccccaacagtgtccaagagaaatccttcaaatgggtcattgaaaagggctccaaaagcgtacgggacatacagcttgtgatgacgagaatgaaactttcggtataaagttttattcacatgcattaaacgatgcaaaaaaaattgccatgtatcgatgataacgaaagcaatgataatttttgtagcagataaaccataccaataaccataatatacaaaaaggtttgctatcgtgtcattccatttgaaaaaaggcggcagtctctgtttcaagtaccacatttctctttgttcgtatcccgtagtggggacagggtccaacttgtaaaaaactaaaccgactaacgtttgaataatgtgttgtacaatgacgtcttggattaccacccttagcgtgactttgttacgttgaagaacttcttcagacggatgaattcggtatttctctgccaactcgtaagtgtccacaatatgaaagaaagttgaatagctccagtacaatacgatcggaacacagagacttaagatgccgtcaggaacgccttgaatcaagtcaggccgcctgatcacaaccgaagttggagggtatggctggttgagaaatccggtcgtgtttttggggatatactgactgaacttgtccatcgttggtggttggttgtgataaggtgatgagatgggggaactagtggttagaaaaacaaaacctcctgttttcctataaaaagaaactctacttgattacgtaataaaattacaagtaagaagtcaggatactttgtgaagtagaaacaatggataggaaaaacaggcaagaataaggaaaatctgggtgcgtgcagcccgagaggatagaatgtgcaacacctgcacactaaacctcaaacagtgattttccagacgcctagacgcataaactgtagtctagcaaacatttatcgacattcctgcagttatcttgaaatttaaagagaagctacagctgcctacgattgcctggctatatacgttacagcacaccaggaatgcgtactacttatcgtgtgtatcccttagctcccctcgtacaacctgaatcgaacttcaaaactttactatgaccagagcaaccttcgaattctttctcgctgctcgtttatttgggtcaacgtgacagtaacaacttccaccatcacggtatctggcccgccgatggcctaccgaaggtaatcataaccgcattgtctccagacaattagtccacgctaattccattaaaagtatcagccgagttttctcaaccgttggagcataatttgtggggtttttgtcctacggtaacctctagcacctaggtgaagtaaatttctttaagtgaactccgaagctttgaattaacgagactgacatattacatccctcatcaccctacgccttgacaagtcggcttttttatatcactatattgttccggtgggttccgaaagccggaccgtcgcgtctattctttctagggaacgaataagctggtggcagatctctgctactttgtagctgttacccagtaaataatcgcatcaagccttatgcctcgcgcccattaagccttttctctctatcagtcctcaactccatccctctacattcgttatcaaaactacccacctctccctaaggtttactggatgagcacgataggaagcacacggaatttttcatcagtatccctacaaagtctccctgaggaagggttcaacgaactctccttggaggacgacaaggtgtttatggaagataaacggggagccaagcacactaagcatccttctccgtcaagtctgctgaatggacgttcgaagagttataccagcgtcagaaggctgggctccaatacacagataaatagtggactaggaattaaggtacggcgtcctgatgttaccggtactttgaagagaagtacatctggtgtcgaaagtgaagattcagaatgctctcggtcgaatacttccatcgacacagcttcattaaccatgaccaccttagcttcaaatgatccaccacctttggccaacaggcctttctactccagagtggctcactcaactccagtattagttactatgaagtcgaaacctaaaccaaaaccagtgtcaaggaggaagtcacaaatggaagccgaaaagatcccagtcagtttttctgatgatgaaattcctgatgatcaactcatgtacaatgttcctgtgaccaatggatgcgctctttctttctatggatcaaacaatatgccagcaaaaatagttaagctggctttacaaagcgtagacgatcttcaaagtatgcctccgtctcctctcccaggaagattagaacaattcagcgatggaagcgaaccttccacacccacaatagagaattatgaaaggaagtttcatgccctgtctccggaagccaagaatttaactaaattttatgagaatagttctacgaattttgttcaaaatgagcttttgaagagaaaagaatacaacaagctaaaactcccaagcggaagcgaaactgtggaagatgcaggattagagaagctagaccttatatctaaagaaaagctggatacattgtgcaaaactaggccgttatggttaccgcccaagagtttcaaagaggccaagaggcatgagaagcaggcctctgccatgcttgattctgctgcaagaaagcaaaaaaggatggtttctatcaggcgccaaagtgagcgtgatttattaatatggaaggagagattaccgtatatactcagtcacgaaacatggaaatcaagttacaagaatgaagtggtcaaaaacacatggaaattccccatacaggatgaattgaaaagtcaagtctggataaagtttttgacggacatgaaaggagataaagtggtgcctgaaaaatatcaagagtatgatgacttaatcaagatggaccatttgatattgaagaaacttccaaaggatatttctgaggaatctatgaagaggttaaatcagattcttacagcaagatcgaaaagtaatcaagatctgaaaaatggtgatgaaactataattgctactattttccttctacctggattttccaataatgacgtatttgagataatgagacttcttaatgcaaatctccgtagcggggcgtttgtcagcaagtttgacagaaaggtttccaagatagtttctttcattaaacaccgagttgccaaggatcaatatacaacatttaagacgcaatcttctgaagtgttaaacttccagtttatattcaacgaattacttttgaatcatttttccaaggatgacatgattcgaatcttggagttatttattttgacagaggattatcgattgctttacgcattatttatcacagtttatttgcactatcattatggttttagccaaatctctgatttgctatctaaagagaatcaaaatttcacgattgaagtggactctaaattttgggaacggttgtattattattattcaaaggtttgacatattgaacattcctttttctgtcggtggaacagcacaaatttcaaggatgtatagtatttaagtaggtcaacaatacaccattgacagtattgttatactcttccctctgtaggaattcatctattacataagcgccaacaccatcactccacgaaatgcgcaggaaaaaaaaagcttactcgcttcctgcttcctaccccaaatgctcagattgaacccaattttaactcgcagaagcctattcagaccacaagtgttttcaaggtgcatctcgttgaagccagatttctcaaagctaaagttgaaggagcaacctcccggttacgtagttggaacagtcaatgacgcatatgttcctccagaacctgaccatttccacggtggttaccattggacctatgaaaaaatcatcacaattgcaatgattcctttatttataacaccttttgctgcaggagcggagtatcctctggttgactccatattcagcgtgctgcttgtgttccattgcagagcaggattcgagtcttgtatcattgactatatcccgaagcgagtgtacggagtttggcacaagatggccttgtacttgttggatgctgctacaggtcttagtttgtatggtgtttacgttttggaaacggaaaataatggtatatttgatttgattcagaaattgtggggtgcttaatgaaaccagttctttagatacctaccatattaatgtacaagattgcaacacataaagacatgatagcacactttttaatgaatactccaaagtttagcttggtaaacagtgaactgccaatcggagctctagtgtggtgtttaaggttccaccagcttgtggcaaaattattagacgcaggagtttcttgatcagcctggcccacaagtattgtcgtagcaggtccaaaattgtcgacttctatgcccttcacataatttgccaatttgtttctgattgacctattagctaatggttggtatcttcgtcctctaatgtgagtgttattccagaagaatatgataacgacagtaagagcggcaagtagaacataagttatcacttctctgtatggtctttcaagatgacatatggagaaataaagcttctcgttttgtagtgttagtagttcgactgcaggtctttgaatacccatggccatagatatggatttcacggtgatttccttcgcaatatatgatgtttcattgacgtgatactcgtggttgtattcgcagtagtcatggtcatctcccgtcagtattaaatctggcttgaaagaagctaaaatctcttcagaaagttcattgtctaatacggtttgatattgataaccttgagtaagaggaaatttaccaccttcacgcataggaccgcaatcaatatctggattcctgaatagtggaacatgtgtaagtaagatcctaggtttgtccttccgtctgtttttgaattcttgcatgaagcggcttgaaggtccataaatagattcatcattagtgttcgacagtgatagtgagtccaagaatatgaattcatgattacctcttgtgattacagtgtttgattccccaaaatgcatattgaacctcccgacagcgtgtttcttcacgccgttggcccaacctacgtcgtggtttcctggaacatttgtcaacatctcataagagtctgagtcagggaaaatatttttgaacctggaatactctctttcgtaatagttatcctctgatgatctcccattgtccatcagatcaccaacaaacattacagaatctggatgcaacgtgcttattaaatgcctgaaatttcgtgttaaatatgtgtccacggtatgctttgatagacccagcaatatcttgttcctgccggggtaggtatgattgtcaatcaattggggatccgctatcatcagaaccgtgaaagttgtggaatttgattgatggaacgaacattgctctattacctttctcggtatataagtttgatgaaaccaaaatacagcacaccacgcgagcagtagcaacatgacatctacattgcgtaaggttgaagacgcccgtgtccttagtcccatgatccaaaaagtggcagagagttgacaggagagaagagcgcgtgcgaaaaatctaaagtttcagttgagtctactagggaaggctaaacctagcagtggcccttggtttacctctactgaactatcccctaattaataaacaaaaataaatagttttacagatccattgttctaataccatccgtaggtggctgccaatctcttcaatagatgttctttggcggtgattgcctttgattgagctccagctcctctaccgttgacagctctaatgaaaggtgaaggaactggttccaacaaggtatcatcggctggatgagaaaaaaagacaatagagtacctagatttcccctcccttacagattcttcaggaaacttgacacgatgaacagtagactttaagagtccgttcgtccaataactcaattggtccccaatgttgacaattataggtgcagcagctcctttttctttgaactgggcagaggcatccacgaatggcacaggggtccatttttttgttaagggcgagtgaatctcaagaccggcctgtccatcctgctgaaaaagaagtgttactcccccgtaatcggtgtgggctcctgctctgatggtctcttccgggttgagagacttaggggatggataatgcaagagtctgaatgttgtcccacttggatcagtcaatttatgacgttgaacaaaccaatctgcgccaccagcttctttatctatttcaagacctatggcgaataaagtcagcagtttgtgaaccaataaagaatgcttcttgatcacagattggacaactttagcatgttctgaattttgaaagtactcaggagtagagccattccatgtgccctctagaaggttcaggttactgaaattgtaaccttctttagggtcgccttggggtttatcagggttagactcatccaagttctctccgccaaaagtggtatagccatggttgtcattggcaggaatagtgtatttctttttctcttccagtggttcttcgaagaaacctttggagactttgaaaagctcagccacttcttcttgagagaacccatggccctctaacattaggaacccttgagaaccagcagcactcacaacctctctggcagtagggatgtctatgtttgaaatatcaataatctgaagaggattttccattgttgttaattgtgttagaataggagtggctgtgaaatgattatggctatttcaatcggtgtttccagccaattttatacatgaattcccccagtttctagataagttcaccttaaatgagtgacttcgcggactaataaaaagagagggcatacatatcggatccaatgcagctattcatgggcctaaaaactcatccaaaaacgaattgacttggaatagctaatgtctttgccttaactgtggatgtgacctctgaaaacaagctatcgttctcaaaatcatcatgatttgttcttgctgaaccagccgcgggttttcctcggacccataacgagtcacagtgacacctctagatcagagataaagatacgatggataaggaaaagaaataaaaagaaattagaggaccataaaactcccccgaaccactctgaaccaacctcatggtagtctcccccacatatctaaatttagaaagaccagacttcaactatatctatccttcgttcaaccaacatcaaacatccaaatccaaccacgtcccccatggttgtctgtagtgcacaacccattatttctaggcaggtcttgtcgcgggctacgcggttcccaagcctcttccctcttacaatatagtaaaacgataccaaaacagagtctctagttaaagggaagcactcccccgcccacattgtcatacttggaatcaatattcattttttccaatcttctttataaactacaatggaagcattggatatcagatccaagtcctacttcataaaatgggtagaagctcccgccaaaagtgtcttgcactgggagataaaacccttgaagaaaagcattgactttggaatttattcttgcaaaaaaggcgaatcttctcatgagactaagaacaactcagcttcctcattcaacacggaatctcccagtttcagagcttcaatacctcccatcattgatgaaggtgaccagttcaatctgtcttctggtagcgctgtgctaccattggaaagaaacccttcactgaaggagtcttctaacgctacgggaaccggaaggcgtcggtcagattccaatatttcagcaatttcatccactaattccttatcacttgagcagagactcaaacagtctaatttaaagaaagaacaatgggttggcaaatgccaaggtaatgagctgattcaaggaaccttccaagtacaggatagctgtctgctagctttcgtctttgataacacttttagtaagactactgcaaagaaggtatttttcaaccaatacgtggaagatccaagcatgcctaaaaaggatcttgatagcacgatctacaggaataataacaaaactaactccactttatcgcttaagaaaattgacacttcgtcatctacaggtgtgagatttgacctaccaaatgaccacgataagaagattgacaattctacggttttgcatgtcaaaggtggtagatatctgcaggggttccttctcaagaaatctcgtaaaggtcgacagaaatcgtttcataagcggtttttcgttttgaacttcaagtatggcattctcaactattttgctaatgacaattccaaacaagtcagaggaaacatgttgattagatctgctgctatatttgctgacgagaaaactaaggttataattttagattcgggtttagaactctgggttctgaaatcgtctaatgagaacgactggagtacgtggattcaagcattcaactttttgaaaggaagttcaagtttgaacgaagaagcaaagccacaaatcacgagagtcaacacacttgatagtaccttaccatcgtttgtcgatcgtgatattttcctgaagatccatgacaacatctccgctctacgttcgaaatcttcaaacctggtgtctgtgcttgacgaccagcaaaccacacaagattctatcagatcaagcaacagaaaaagctcattttggaaaaagtttaaaagagaaaaggatgacgtaaatggagatcaactgagcatgtcatcttttacatccgaccctttatctttagccaaagatataaaatccagaattgataccttgatgtctttcatggataatgccaaaaacctgcaatcctcgcagcaaatttcaagatcaaacacagtaaccacaggtggagcttccatattctcccaagaattttatgatgctcaggaatacctccaagaaattactggagaagttgtgttcctgaatgagcaaaacgataccacaatctctacgaatggacatggacacggtgctcttccactaaaaaatattgaagaaatagctacggattcttctgattactcttctttggaggagacagaggagtccctatcctcagagtcatcaactgaacgagaacttgttaaatcgatcatgtcccaacaggacaatttagagatcaacgatttgtatcccctgggagagaccgagaatgtgactagacggacagatataccagagagcgctagcactcctccaagtattctatcttttattagaaagaatgttggtaaggacctgtccaacgttgcaatgcccgtgacagctaatgaaccattgtccatgttgcaaaagtacagcgagtttgtggaatactgtgacctgataaatgacgctttagattctgacaaagcttcaggttcacgtttaatgaaaattgctgcatttgctacaagctatttcagttcactgagggtaaaggaaagaaacagtagaaaacctttcaatccgatgttaggcgagacttttgaactagtgagggaggatcttggaattagactcatcagtgaaaaagtggttcatagacctgttattttggccatcaatgttgatagcaagcggtggaatttgaattactcaccttctccatcgcaaaagatatggggtaagaatgctgaggtaactgttgaaggtgttgcaagacttactgaccgcacaaccggagatgtttatcattggtctctacctaactgtcttctcaagaatttgatagccggtgaaaagtacatggagccaaccggatccatgactgtgaaatgttcagatggtcacaaggccgttgtagcatttaagtcaggaggtgttttttccgggaggtctgagcagttgagtatcaccttgactgattccaagaataacatagttgggcccaaggctaccggaacatggacggaatccatttcatggaatggggtaaatatctggaaggtaggtcccctagttccatccccaaacttgaagtttgggttcacacaatttgctgcatgtttaaacgagattactagtctcgaggaaggaaaaattccgcctacagattctagatacagacctgatcttcgaatgtatgaaaacggggacgttgatggtgctgaagataaaaaaatcgaacttgaagagttccaaagagcccgtagaaaggcgaatgaaattgccaacgaggaacatcaacctagcttctttcacaaaggtaaagatgactgctggatccctatacagggagagaacaattactgggaaagaaggaagaggtccgattgggacgatgttttgaaattgtggtgattgaatttatattctagattctatttttgcattcatatacaacgatgaatttaataaattcaaggtttgagtttttttgccgtgggcaattccgagtctgtcgatagcttccgctttttttgaactccctcaagatcgtttgaaagatcggcttgtgaggtggagcttggttgcttggtggaagattcgtcatcagactgtagctttgtgtcttcataactcaatttaggtgtctcgctggccggagatgcagtcctgggggattgaattgccggtgatttgttttctactggcgactcatcaatttgggacggttcaagtttctctggcaaacctttctctgcagcatcattcgttgtttcttcatctctcttttcttcaggcgctacttgactttcttgggtttccaatttatcggcttcgttcttagtttgttcttgctctaattcatcagcctcctctttcttttgtttctctattttctcattctcttcctgttgaatcttttccatcatctctttaacttcggagggaatctcctcctcaaaatcttcgtccatcaaaagaccatcatcaaacataccctcaagtccaactttctcattagtttgtttcaatttcagccattcattatttgatctaagaaatctcattgatttccaattcaaatagtctttctgaccttgaatttcttccttgtgtttagaatccaaatccggttgttgtaattgggaatctagtggatatagttccattctaatatcttcaacaaattcctctttatcaaaactgtggttctttagatgcggtaaactggtttcaattttccatattcgtgataattgaggtgtcccaagcttgtgagagtactgtggagcatattcgtacaaacttggcagctgttcattgaataaagtgacatggctatcaaactttcccgtttcaataattgctagagagtactgaagcaatttccaatcaatccaggactcttctgatgcggcaatgctttgtaaggtttcgtaaaaattactatcaaactctttgtaatgctttaatatcgtgtttcgaagattagaacatgcatcagataaatccctatcatatattacggcaggcattttgttgtgtaactgttgcgccagttttggatcctttgtggccttccttaacctggcaatcctgtcatcaacttcttttttcttgagtgataaaatgtatgtagctccaacaacaacttgtaggagaattaattgtctgaatgtataatcgttgagctgtttctgaaagagctccgcagtaacaggaatttctaactgaagcaacttcctggtataatgttcaaccacttgtgcaatttctctgtccgatctctgggtttcaggtagaaaaaaactttgattctgcaatctaatcccgtgtttttgtttcttatccatgtcaatgagagtcttcaaaaactcaaaaacaaaattcaatgagttctccatatctgataaatgcctgaaagttcttccccttttgtcggcttcaattagaggcacaggatcattcaaaaaaatcatcaaatcaacaaaccgcttgaagtcttcttgcatttttctattcagcttattctcagcactggatacacctctagtttgtctcaattgcttttgcaaacccgtcagaaaagttttagtgttgacattcgtttcccatttcctcgtgggcagtaaggagtcatcaagagcaaaactagttctgataaacgttctaaagtatccaccaaatagctcatgtgattcaatgtgtttgaataatctgtttaatatcttttgagaataacttaatagcactaaaccaggtgatttttttccgatcaaagatccattctgttgcaggatccttttgcgttcatttgagtgaggacctaacaaaattgggcccaatttgtcgcaaattatatcaatatccaatttggcaaacgcttgcaatacaataatcaatggcaaacttttgtagacttgcttattatatccatgtattgccaaatctaacagtatcagaatctctgtcactaatacttcagtgctttcattcttttcaattacgttgaagaggacgttcaatactacgttttcaattacggcagatttaaaactgatggtgctagtctggtcttcttccgtgaacttgtcttcaaaatgcttggtgtatatagccgttagatctggatggttgttgatagatgaggagaaaatttgatcggatgaaaaacgttccctcaatactaccaagtcggtttccaatgctggaattatcgaactggagtattcgtcgtaacccgatagcatgctgggaagatcggtgggggttacaacgtaggtttctctgcgctggatattagaaatcccgctaggcacctgatttctgagaaggtagattgtggagcctgagtagtgcacgtcgaaacctccacttttactgaccttgcgggtgtggtaaacctctttgtaggaacgttgacaagaatgctctataagaccaccttgtcaatagcacacacgagtgtgatattgttgtcattgataaccgccataagttgctttgagttgcatcttcctcagaaggtttctcatatagtagacagtttacaatatacttgcggccaatttttgcaaaagcagcagatctttgcactctataacaagcaaaatttcaccgaaatagtgaaccagaatatcaagggaatagaggagagagttttgtctgagttgcttgaagaaagattagagaatgaatcccagaatgattattataccgccaattctcaaaattggcctatcgacttggatcagtactcagaatcatttgtaataaggatcacatctgaagatgagtttatcaagtacttgatcttcaaggaagctaaagctttgcatatttccatatgggagcaatctgttggtttgatagatttgaaggttgaccgtgatcagatgcaccgcctactttacaacgtggagtcacgcatactggaacgaagaacgagaagtgttgacagtccagtttctgaatataaagtacaattgatgattggagatcttccacagcgaatctacgaaacatatccttcgacaaaagtgacatctttgcaagccctaggagagttcccttctttccagaacctaagtaatgctttttttgaggattttagaacgctggaaactatatacgactggttcgaagaaatacagaaggaatttcctaagctagtgtcgatcaactggattgggcaaacttatgaaggtcgtgatctgaaggctcttcacgttagagggaagcactctggcaacaaaacagtagtcgttacaggtggaatgcatgcgcgtgaatggatatcagtaaccagtgcatgctatgccgttcacaaactgctccaaaactatgctgacggacaccacaaggaagcgaaatacctggacaagttggactttttgtttgttccagttttgaatcctgatggatacgaatatagctttaacgaagacaggttgtggaggaagaacagacaagaaacttatatgccccgatgttttggtatagacattgaccattcatttgattatcatttcgtgaaatcagaagacttaccctgtggagaggaatattcgggtgagtcccctttcgaaagtatagaaagtgaagtgtggaataatttcctgaacagaaccaaagaagaacataagatctacggctatatcgacttacactcgtattcgcaaacggtgctgtatccctatgcgtactcatgcgaaatcttaccaagggacgaggaaaacctgattgagctaggttacggtattgcaagggccataagaaagagtacagggaaaaaatatcaagtgttgaaggcatgcgaagacagggatgcagatctattgcctgatttgggaggaggaaccgctttagattatatgtaccacaaccgtgcatactgggcgtttcagatcaaattgagggattccggtaatcatggctttctccttcccaaaaagtttatatacccagttggaacagaggtttatgcctcaattcagtacttttgttcttttgtgctgaatttagaaggctaagctcttcgcagcaccagaaagcctgtcagttttttttggtaagacacgccacggccatggagatggcttgatatttgatatatattccatgcatggatggtcgttgtttcgcgctcggttcacttatcatgaccaagccatgcctgaattgtatggagcagaataccgaaaggagtaagacgcctaagggggttactggcttgatgtcagctgaaattctgatctgctcaaatctttcccattgtgttcaacaagtttttgaatggctgggatcagttcaagaaatttgtatttatagcttatatatcccctgagacccctcttttccttttgatttctcatatatcttaaagaaacataagctgtctagaacaagcttgctgaagtatcggatcaagccaacctaatctcagaaattttaaactcttatcaagctgatcttagtaatctgtcaatcccagatttaaagacacaatttcgcaccttttcctgattacaataggaaccccccaatcgttatagcaaccatacatcactctactacaggaagcgatagttattccggactcaccagccaaagtagtccaattaaacccaaatcattgacattatgagcgttttaatgagcaacaataatcatttcaagaaccatccagatttgagcaacattttccacgtaagatctcgcagtgatcctgcaacgagcttaacttctccctcacaaccccgatgcatcaaacaggccaagcatgagccgaactcatcgaaacatgtgaaatctacatcaagttgtccagcctcagttgccaactttagcatcccgagctgcgccatcgatcagagagctcttccaaaaaaggagaaacgccgcttctcagaagtgcaccacactgaatctccgttgtcttcaaagagaagactggaaccgagcgaggtgaaccaaagcagaaagagagtctcactaccaccagccaccccactgtttaaatccaaagttgagaacgagtcagtatcttcagttccagcggtggccaggatcttggcgaatctaaagccgactccagcctcatcgcactcgatacgaaactcctcattgttatacccagacacggcttactcttatattaattacactacatcctcatgtcataacttcgaagttatccagaacaccagcaacaacgaatggcgggccaacatggtgtccaacttgaaatctgggaacctgcaggggttcaaaagatacaaagattactgtttggaaaactataaagtcaccgacgacaaagccggtgcaaacttgaggactgactacgagaagtcaaggaacattcctaggacacgtaataaaatggtacgatttattgaggctcaattgcgggacaaagaaagtgcctctgaagccggaatttacaacacagccaatatcataaactatccttttgtcagcaactacacctaccagaaagatggctatctcgatgatgtgagcatgctgtgcaacaacgttgaactatacaagaatcttgatacttctcatgacgacaaaaagtctgaggtgcagcacgaaaagcacccagatggagggcgattgcaactttatcagactattgacactccagtaaaccaaccgttgtccatcccagcctcccacatggttaccccacctttatcgtctaagagttctgctctgaccacttcagaggacgccaaatcaacccaacctaagatgagcacattcaagtatgtttcacccaactcttcgcctatgaaaagcaattcttgctctgaccaaatcactgtgttcagggctgcaaagtcaccacaatcaccaaagaagtcaccgaaatcccccagcactagattggcgaccatatctcacccaaaccgggtatgcatttcctgtcattcaaatcactctccttgctggagacccagctggtctgccctggaaggtcagctgtgcaactcttgtggactgagatataagaagactggtgctagatgcaccaacaggagctgtttgcgcatacccgccaagggagaatggacactgatgaagaacaagggaaaactcgcaattccagtttacggaaataacgagcacggagaatttacgctgcttggcgaggagcttaagtataagtgtcttcactgtgaaggaactgtagaagttggggagagcgagaggtagctagggccaataccccaagcataagtatttggttatatgactccccgcaggtaggaggtccgggataaggaaaaacttcatagagtgtatacaagtgcatattaataaataataccgatgaaagcgactctaagaagcgagctggctatttttaggcggtttacaggttcttccatttgtaccttttaggtagttcatcgcgaagtgggtttctccaacttttggcgatgtgctccaaggaacagaaaagaaacgcagcgaaacgaaaattgaaaaaaaaaaaaatccatccgaatagttcgtctcttccccctttttgagtttcaacaaccttcaaagttacactgctcgctcatacgctctctgtccaccttatccagaaatccagtgaaggagaggagttttctatctgcaagtaaaccggaagatttttattagagcttacagaggctaggaaaaatcttcaagtttttcactacggccttttcatttgctctattgcttttcagtattatttgttgatcgctagttaacgattagacaagttcaccaatccataagttctacggtctgacaggctattgattggtgctactgcctccactggggttagcacaattcacacttgaagcctgtttcttaacccagtcacctcaagttaacctccccggactgggagtctttagaacttcatttattcaagctgagtttctcaaaagttatttcaaggccgcttaatcgttggtccactatttcattccgtctgcaatctgtaatcagaacccacagctatcacaatatgactgttccttccatcgttaactcgttcagcgatgtggctaatgacaaatttcgtacttctcttttaaacagcgagtgcaatgaccataaccatacctatgctgtggatggcctaaacaatgtcattactaaaagggtttccaaaccaaataccgccgaggcacttgcaaaatcccgcaagatggttggccaggcattgtacgaccatatcagtgcaatcgacttggacacatgtttgcccgaggaggaagaatcgtttttcgtatgcgatcttggggaggtactccgtctctacaaaaattggtgcgagaagttacctcgtatcaaaccctactatgcagtaaagtgcaacaacgacccaaaattattagaggttttggctactctaggaacaggatttgactgcgcatctaccggtgaaataaacactattctcaacttaggcgtgtctccagatagaattgcctatgccaacccttgcaagtcaattagttccgtgagaaatgccaaaaaagttaacgtcaacctaactacatttgataacagtgacgaattatacaagattgccaaatatcatccggaatctcgcctactgctcagaatttcgaccgatgatgagtccgcccaatgtcgtctttcaacgaaatttggagcttcaatgtcagaatcatttgacctcttgagactagctaaaaaattgcagctgaacgtggcgggtgtggcatttcatgtaggatcgggagcttctgacttcagcgctataacgcaagcaacaaaggattctagcatcttgttcgaagaggggacaagattaggattcaagatgaacattctggatgtaggtggtggatttgtattgcaaacttttgacgaatcgtcgagatacttgcgagaagcctgcgaccaatacttcccggagaaattatttccagaattaaagatcattgctgaaccaggtagatactttgctgcctcagcatttactttggcctgcaatgttattgctcggaggatgaccacacaatcgtcggatacgacaacacccacagcccatgccatgttgtatgtcaatgatgggttatacaacaatctgaactgtgttctctatgaccatcaattgcccaagggaaaagctctgactattaatggccgtttcgtttatgatttgcagttctcactacctgaatcagaaaagaagatacccgtttcgatttggggacccacatgtgacggtttagattgtattagtgagatgacctatgtctcatctttaatggaagtaggggattggatattttttgacgaaattggtgcatatacttctgcggcagctacagctttcaacgggtttcaaaaggaatcccacactatttatacatgtagtgaaagtttaatataaaagtgatttgttttttttaattgttcttttgattttgattactacaacgtattatgctagtcaatgtgtatgagtctttttgtttatataatgcacaccgtcttgatcgctttcatcatcatctcgggttcgtatgcctactatttgaccaagaatattaactgccatggatgcggatttacctaatgtaggcgaatgagataaaggggctaaatcatctgcttcgccgttagtgagatcggtagtgaaggcgtctttttgttgaagactgttgtcttccctgtcatcttcagtatctgaactaggatcttcatgaaatgaggagcattgggcgattgcctcataggtctgatttatagaattgggaaattgatccaataatgcgtcagagcgcactccgtcatatgtaaccttgagctccactagagccgtgttcgatcctagagttgattctggacttgcagttagatctcctctgggttctatttgcagatatatgccctctggatcagattgcaacgctgcaagtaaaactaattggtagggaatgctcagtccaaaccttccagattcaaaccacaagacaagacacgtgttaagaacatatacaaaacattccgaacattcggtgttttgtacgccttgaatctcaaaatctttgctgataaatgctaaacggaaaaatccacccccatatatcacttgcttatcttccgagtcagagggaagtgcgccttctgggaaagacgattggaaagccttggaaggaaccgaattctctatagtgggacgttcatgaatgcaccgcactataaacatatgagttcaagtgtgaagttgttccagcaagctggcaaaaaaccctacaaggggattgggcccatgggtgggggtttactggagggagaaacgcgtgccttcctcccgttttgatcctcgaccccgccgcactttgttcgtacatgaatgtgcatcaaacatctaacttttgaattgttcaattcaactctgctaaagtatggatatataccgagctagtactcctcaataactaaattaattgttattttcagcgatttatgtctatcgagcctttgcagacgatacaatctccaaagtttactggatttactgggccttctagacatattttttctgatgagcaaaaactaaagtttgctgagatttttgtccatttaacaaaagaaaatggcaataactgcaactttcctgtgacacagagcattcggcaatttattcgtcaggaaatgaacaaaagcatactacactgtacacctgtgaccgaccggaatgtggtgagtctcaaagatatgttgaagaaggtcatgaaaggttactgtcaattgagcaatgatcccagttttgtctacaactctactacctgtttcatagaatatccagattataaatggaaactctccgaggagagatatgggcgtagcgtcatttgtcaaattcggaacaagaactgcttatatcttgaacagctaaaaccctttttcaaagaatcattagcggtgggcaacgcagagaaaaaggggttttttactgtcaacatgcgcaagttggcgtctgattatacgtctgaacctcagaacacacctcgggaagcccaagccgaaagaagatatgtccatctgtcgccaaatcaacaacctcaaacacagcacacatcacttcccctgaagattgcgcatcaacaatctgaacccgatgcacaacgcatggtggagtttctacctcactatgccaattcatctagcatgcagcagttgaacatctctcaactaccagtttctccatcacctctaagtgattacagaactatatcacctacaattgcacaccagtcgcaccaacagcaacatgaaaatttggacgattccgtcgtacctagaaaaagacatagacagtcccagacgtttccccagatcatgccagagatatcatcagttttcatgactccacagtcatctttgccaagagcacggccttcagatccctccaatcgcaatgacgaatatagtaacgaggagagtcgatttgaggttgacatccgcaagaaaatagctaagaaattgggagagctttgcaaaagagattctttatcctatgaaatctttagctggatactgaagcagaaattaagctttctgatttccaacgtagcaccgctattggataacgttgacgatacgttattggtgagattcttgaatgacttatacattgaaaaatagcgttacttgaatattgatattcaccccaacgatatcagtttagttgctatcacattttgcatagcctgaagagactggttaaaatattcccagtataaaagtctatttacagaaatcctgagatgtttctcaatgtgatcacgccaaccataacgaaccgaatctacgtacgttagctgtaatgaaaactctatcggttgacttaaccatccaaatatatgaattgaactttaatttccagttaacgaaacgccttgtttcacttgactctcttgagttctgttcgaaacaaactatgatcaaggtaggaaaagttgcaaagaatctttccaaccacttctctacacttgtgtaaacatctacagccgtggtggtacattcgtggaggttcaaaaatcacttagtctttgggccaatgtgttaaactttcggtcttgtttaacctgctgttcaatatcgcgtcttatacgttcatcctctagtttctgctggtatgcaaagtccgtgggcaaaggcggtagtgcctcattcttgagatccattttacgtgcttcatcaaacgagtgaatcttttggcgaattccttcaggtccgtttaacaatgaaccaggggggagctggccatccacgctcagagacttaagtttttgtacattttctgactcttgacggagaacttgatacatcctggatactcttccaattgccagaatcttatttctgagtaccactttcttggcttccaagtccatagggtctatctgagactcttgggtagtctttgaagcgtttgctttcttttgttttattagtttgtctacattttctaaggcactagcaggaactttggccaaaggagtctcttcatccagttctttctgagaacaaacgttaagaatggaaactagcatatccaccatcttgtcgccagcaaaaggaagagaccaagtaaatacatccatgaacttgggaagataatatgggtgtggggatgagctgaattgtcttatattcataacgttatcctggtacttcagcactgcagccttattgttgtaactgtccaagtagttgggagctgaaaacattgttaaaagtgaaggaaatcccatcgtcttagtccttttgtacattcgaaatcctgcatcttgcgcttcatgggcacgaacaatcgataatagacctgtcttcttcaaaaacgcagaagaggcctcgtaggaaaacgcataagagcagccccttaatgtgtttggaacaaaatgatcctcggtggcgtcgtcctcatcgtattcctctataggatctgcccatagcaaatcgcacatcaatccttttgtaggaggttccctgaatctatcgatacgattcacatcgtcaatagatttcaaatggggtgatatacctccgtgaacacaaaaaaactgcttattcatgattgctgctaaaggaagcccttggaaggatcgaacgcaaacctcatacaggtcttctgagtacttatggagacattcggccttgaaggtgaagtactctgtcaaatgacggcactcatgatttccccttagcatccaaaaagtgtcactataattcaactttagagaatacagataaatgaggcattcaatagaaaaacatcctctatcaacataatcccccagaaataggaaactggtatctttaggatgtcctgaaacttcaaacagtttcatgagatcataatactgtccatgaatgtcaccacacactgtcactggggcaggtacctctagcaagtttggctctttaataaattgtgaagtcgccatttcaatgatacgaatggcctgatattcatgaagtcttccttggcctatgaaatgagtcctcaaaaactcgtggtcaggcaatccgttctccaaaaataactcgctatcagaaggtttcgtagcaattggtggcggtacggacgaaacttgtctctctgtagtctttaaggactggccatccttggtaatatggattgagtaatctcttttaacaagcccctcttcatccttattctttagcactttgagtgcattgtcaagcttagccgtgttttcgttagctaaccttttctgggccagttttttccccagcattatgttcatgtagttggaggggtgagcttaagttgtggggcggtaaacctgagatcaatggtagcaacgatttatgttaatacgcgatttgaggcaagaaggctttggggtttattattaggacagatttttggtggtggtgttaagcttttgctgtttgagctctgcaaatattttttttttctatcaagttgcgcgcaccttagaaactcactaatagttaaatctgaaagattcatcttgatttcatgtcacttcaaattgacgaaactgactttgtagaagccagcgaaggagccgattcactcaagttcttgaatgaaaaatctcatgctctgtttgagctgggtgtcagcatgctagtgcacaaatgggatgctctatccgttgccgtagttaatcagtggggtggaccaaatagtaaggataagagagattggatctcagctgttgttgtcgacctctttttgcagaattcggtcgtggatgtagcaatgatagaagaaaccctgctctacgccatgcaggatgagtttgacgtcatggtagaggatgacagtgctttaccgttggcagcgcaagttctagattgttacaggaacgttgccataggagaggtagacaaaataaaagaaagctatgccaagtggcaggccaaacagagctctaacagtgatgtaaaatatcaagtcacagtgggagaagacccttcaaatcctgatgtatctgagaatgaggtagatgactatgatagtgatatcgatgctcatgcgccaggcacgcagcaagatgaagactcggaaatgaccgaagcaacggagtcagtgcctcaggcaatagtagacgatgatggattcactatagttcaacgcaaaagatgaaatgctgcatttagagtaagtagtgttaagtaatgagtgtatttttactaagttgaaagagttgaaagagttgaaagagtagagtctttcctatgaatataatttctcggggtaacttttaattggacagtctcagccaagttgtgatggctttcagggtgtggattttgatgctgctgggaggctggcccattggcagatgggctagagattcggaaatcgctaatcttctttaccaaggagtctgtcatggtatttattgcacctctgtgattcaataactttgagtgttgacctgagcctttgattctaaatgttttgacgtatgttccattccaagttccggtgtcaaccatcgaacttgaggctctttctacctgcttttcaattgaagggtatgtggactctgctcttggagacttccacatcccgaagctccaatctgaggttgccttggtaattgctgaaattgagttgtttagatctaaaagaaccttgtttctgtgaatgatttcattgctgttataaatgagtccccaaagaatgctctcgtaccatcccaaagacgcgttgttccatacaaacttgaggcacgaccagggccggtatgagggcagaaattccctgtgaattagtttttcccaagatttctgctttatagatgtatttgcaatggacacaacaacagtattgaagtctgtaatatgtagcagttcagtgtgctctttattcagatagtttgtgaagttcaaaattgacttcagagccttggtgccagtccaggtctttttcaaaggagcatccagaggctgctttcctttcaccttagttgacattcctacaggcatcttcaggttcattagattgtactttgcttcctcatcttcggattcatcttcagacgggtcaatactctccaagtcatacacatttgactccgttgaatgaaccgacaaagtctttttagtatccagttcagatatatgccctaccgattcaatcaccttctttacttcattgaaaatcctgtaattcttggtcaacgtgtaggccatggcggcgacatcgcccaaatctgaagagtcgacaccatgaaagttctttcctaaataatgagcaatcgctctcagaacgagacctagaagatcggagtgcaatgagtttgaggctaagtattgtggtctggatagtttcactattacatgcatcaaatttgcggaagcactgtgtgatatttggccattctgttcacagacagtaacactgttgttaaacggccgttttcggaaaacagtcacttcgtcagtatggctggaaagatagtccgctctagtaattgggatcaaattgtacaacatctcaatcaatatggaggtcaggatcccaggttcatcatccagcaacatcgtgcatattcggacaataaagaaatctctatatgttattggggttgttggagttttgaatgattggggtaagcttgaataaattgcactgttgaaaggtttcaagagattgaaagttatctgctcatcattcgttaagtacaggaaaaagtaagaacatattcgtacttggttacgatgatgctcatccttgcggtaatagttgatataaaacagcaagatgagcgacaattccacagagtgttttgcagatataagttggctaaactttttattagattggtacagttcccataccaatataacgatttcagtacaccacagagaaggctgaattgtgtatgtctttgctttaatcatagctgtaagagatgtgctgttttccagtttggacatttctatcaatggagcttttaaaataccgaaaaggctgaccttcaaaaatgccaattccgattctttatggagccttcccatgtagtatcggaccaagttgattggagtagagtcatagattcgaagctcttgcagaaacagaagattatttttgggcagagggtatacaaacatgagagtaagcagatgaattgccgccgttacgttcagagtccgtaaattattcaactgagaattattcatttccaaaccgctctctttgggatctcgtgcagccctagcagtcagattaagcagggaggagagtagtgtcaaaatctgtaacctgggaatagctgtcaccaacaccgttagaaatcgagacccttgagcaacgagttctgacgatggtatgtataaacaccgagagcataaagttatcaatagtttcatcgtttcatacctgttgctgtcgataaaggtattaggaggtttgaatgggccattgaacccaataccgggctcccatattgagaaatccacaatgggttttgctcctttgcttcgaactgaactctgggattttatgcaaaaattttgggtgaacaagagctggactagggtaaaaacaagctttgcacctaatggcacagtactatagtccggagaaccgacattggcttttattgatgcctgctcaatatgattttgggaactttgaaattcaacctgagccgaggtgcttgaagaatcatgaagttgatttgaaagcacggacgaggaggatatttcagttgctactgtagcaacatcggagcactgtgatccagaagttgcatccctgttgtacaatgtgtccagagaccaaaataaacttttttccacttcttctagggaggggtcttcatacagggatggcaggaacttcgtcagaacccttatgcaattgagaagagccgtgttttcatctagacttgtcactgtgttactttggtgtactaactgaagggcaatgaccctaatcaaagtaatgaagtttgacttatttgtttctcgtatgtttctaatatctgtggcacttaataggtcaaatatatcgcttgcacacgtgggacagttccagaatatgccccaatatggatcatcaaccgatatactcgacgtttgtttagtcaagcgaaacacttcgctcttgaaacgaagtttctcctctaatgaagccataggttatcgtccagagaaatccgagggaccagagccatgagtttgtgatgaagggtctgattcgcgaaggtattatggtgagaattgcaagcaagcggatgggaagaatagcagaaaagaagaacgaaaagaaagtaagacgaattgctagagaaggaagacaaaattccgaaacccatatcctagtgcgttgtcaactacttgaccagagatttgtaatgcctattccatatataccatatatattacccgtgatttgatgctaccatacgctaaaaatcctcatcaaatcgaagagtgccgtagacttgctggaatccctgtagatccctattcttggtcaaaaagtcagaatctgggccttgaaaatccttagagtcatcataatcttcaaactttctcttattagtgagagtaacatcattctgccattcactcaacgacgaagcagttgatcctccatacagcaaggaaggaggttcttgtaaatgatccggtagcgcagttcgacggggtccaaatggagttgtaactggctcagggggtggtacttggtacccatcagcaacagcttttcggattctcattccgaccgtttgcagtgcctctgttgattcatcttgccttttcggaagttctgagtacatgttctgttttttgtatctggatggatctgacatgtggtattagtgtatgttaaatagtactgcggagttagaaatcaaagaaagaagactgattttttggtgagtatggcatgatgctgctaacaatactgaaacgacaggtagagcaatttattactcaattcggaagtgagtgtttgtataattcccacctcgctgtgccttgcacttcaaaattctcatatgcacttcttatgtcagtggagctggctagagcttacccttcccctaatggaagtaatcagcgatttttgttcacttggtatggttataaatatcaggagcaattccggtatttcaaacagaattattcaaactagaactagttgatatttttatattcaatgtcgccaaactataacatctcatctgaaactgctgtgcagtatgaaaacgaatattcggcccataactaccaccctcttccagtagttttccacaaagctaagggggctcatgtttgggatccagaaggaaaagagtacctggacttcttgagtgcttattctgctgttaaccagggtcattgccatcccaagatcattgaggctcttgtggaccaggcttcaaaactgactttgtgttcccgggctttttcctctgatgtatttggtgtctatgctaagtatatcaccgagtactttgggtttgaatctgtgcttcctatgaacacaggtgcggaagccgtggaaaccgcaattaagatagccagaaggtggggatacgtcaagaagggtattccccaagatgaggcaattgttcttgccgcacaaaacaactttcatggtagaacaattggtatcatctccatgtcgacagaccctgaggctacccaggactttgggccttatttgaagaatgttggtcctcagattccaggtgaagctgaaggcactcctttgagatatggggtaattgaagacgttgaaagggccttcagtaatgctggtgacaagattgctgctattctattggagcctattcaaggtgaggcaggtattgttgttcctccagctgactatttgcccaaagtgcaagaactatgtaaaaagcacaacgtcctactgatttgcgacgaaatccagaccggtatcggtagaacaggtaagctactgtgctatgaacactcaaagggagttcgtccagatatgatcttactaggaaaggcaatttctggaggtgtcttgcctgtttcagccgttctttcgtcgaaagatattatgtctgttatccagcctgggtctcacggttcgacttatggtggtaatcccttggcttgccgagtcgccatcgctgcactagacgttgtcaaagacgaacgtttggtagacagagctagcgagttgggtgactttttgttccatgagttatccaagctgcagagagaatcgaatggtgtcatctcagaaatcaggggaaaaggcctgcttaccgcaatcgtgattgacgattctaaggccaacggtagaacagcctgggatctttgtctattaatgaagaaccatggtgtcctggcaaaacctactcatgaccatattatcagactcgcccctcctttggtaataagcaaagaagatctgctcaagggagtagatgccatcagaacttccttggcagaattgccaaacgctccccacgttgaacattaattaattcatttcgttaataagtacatagtcagctctctattgatagaatgagcgtagaagcaattctgaacgatacccattagttttagttttaatctacttcataggtttggttgctttaaccgggggtccttcttcatctttatcgtctctcacagaagtatgaagagcagctaatcgtcgtgctctttcaacttttgattctttcacttcattctctgcaggttcacttgagatgctcaaggtttctgaactagattgttgattaagaggggcgttggaggaggtattgaccgactcagtgagttccagttccgatggctttttcctgacactaaaactagccgttttagtgcgtcgaaacggtgcaattagagactgaacagtattgtcaagcttttgtgacattttccttgttagcgtaggattattaacctcttcctcttctggtacgatgtcgttctcttgcttttcaaggtcaggttgttcagcattactgttgtctctcaaccctcggatatccgagttgttgagaccagctcgtaattgggaatcacttagttcggattcacctttatgcggattaatcttgtaccgacggaggatttctccgtccttgttctcaataacaacctggtcacctactacgaaagcatagagctttcgtctatcgccaccctcagtcttagttccacaaccaacaagaaccttcttagcattcttgatgctctgcgaagatgtagataatatcctttggagtttttgtggaacctcaggttctaactctgttgatattttattaagagctcttttgaacgacccatagctatgcacgctcgtttggtcagtttggctcttaggagtgtgatcttttagctcatactcatcaataacttccccatgctcatcttctacgatcaaacgatttccctcggtataaccagtcgtagggactttggaaatagcctcttggtcttggtcggtatcatcaaccttaggggtattttcaccagagggagtttcagtagaagtttcctctttactacgacgatgcatcgtgcccaagtccaagtcttctacttcaggcacacgtctcgcattttgttcttttcctatccctgtttcttcatggaacctgtttcttatcctagatcgttttgtcttctttcttcttttcatgccaccagcaggcttagccgtcatacccgatatattgatattagaacctgagttttctaatgttgcagcagagcttaacattgatggatttaaagtgtcgatcctctccaatgatatgtcacggcctttagcgtcaatttttggcaatctattcaaccagttggacgagtttttgttgccttcagtatgagtgaaagtcattgtaaactgcatcgtatgtaaatgctttcccagggtgagcactgccacagaggagccatgaactacaatcgatgtgatgatgataaatgtgacaataggccagatcgagaccagcagttgaaaatgtggtgttgaagaatccggaagttcggccaggggtcctgtgctgccagtataatgtgattcaagttctgattttgccaggatggatgcaaaaattgcacctacaccaatgggtccaaaatgtccgcagaataatgcttccctccatgttttaacatctggtgtgacgggttttaacattaacattccagggattcttcgtaggaatataatcaccaaagcaataaggatcagcctccaaatcggagtgccaatcgaagcgttattgtaatcttcccagggaatgatagacccaaaatacacgaaataggccaggttcaacagcaggtcgataacagtcgaaacttgactctcttcagttttttcagagaaccagccgtcccaagcaaatgtagtcccagcagcaaaagatgtcaacagatcgtccacaccaagtatagcaccgaagcctgcacagacaaacgaaaggacgatgtaaaaagcaaggaaagattctctatcaatcagacccttgttttctgcaaatttgattgcatatcgaccggatagacctatagcccatcctaaaacacagcctaagagacattcatataagagagtaacacagatccagtcttggacaatcaggcctccatttccctcatgaatgattaaatttaatgcaagatatataaacgggaatgccataccgtcgttacatcccgattctgcactcaagatgtttctcaggtgccccggaaccctttccgcaaactttcctttaccaacgattgcggaagctaagacgggatcagtagctgtgacacagccgctgactagtaaagcttcactgaaattgaatcctggaatgattatccacaaaaacaggccgactatcagccaaccgaaagtcataattggaaccaggaaaataaaaaccgagacccagtgtttcttcatgtactttgtgggtagctcaaccgcaacagcaaagatctgtatgattaggaccattctagagatctctaaggtaatcagatccaagtttccccaatcttccggggcaaaccaattcaggcaatgtggtcccacgataaggccgaatataacggccacagaagcttctccgatatagagcttctctttaataaaaagagagcacagagaaaatattgtggaaaaaacacctatacatgcgtaggcaatatgggttttggagggcgctaagtgctcccatatagccatgttgtaaaggattatgcaaaatttggcaggagaatctgtggatccaaggtataattataccgaagggaaaaaaagagagaagagcataaaaagcttatttttagttgacgttcgcggacatagattgctggcttgataagataggacttttggatagttacagaatataagggcataaatagataataaaacatccgtatacatacaataaaactaataaatactctctaaataatcgtaaggtgttcataaaacgagctcatctctttcccatccgacagctttgtgggtgctcaatctgttattcggctgtgccgattcgggaactgaatcaacctgcaatgcaaaagggttacggtcagttccatccaactttaagttggcaaaggtgtggttgacttcacgatgctttgcctcatctgcacggatgtagctgatcaaatctctcattttggcgtcttccgacagatgccagtaatctttagcaatcttagggactttgaaatgttcaatgtcgggcaatagacctctctcaatgtcttcaagacaggtagtgtaagtatacacagcttcctcctctaagtaaccaacgaatcggtgacatgcatttggtgcaagcatgtatgtgaaaaagaacagattacaaaacacaccttgacttgcgtacagtagaactttcataaacggtcctggttttccaatttctaaaaacgttaagagatgcattctttcgttgtatgcttcatcttgtaatgtttgaatgaaagccttatcacgtttcaacaaccgcaagctctgcaggtggcgcagaaacgatgcaactgaccctggcaccccagcaatactttcaagaattatgaatctagtcaaccatttctctggggtcatctgataagtcgcaggagtgagtttttcaagcccctctttagtctttgggtgtttgtagcccgaaaagaagtcgaagcaaaccctgagactacgcatcaatccgaacgcaagcttatctctgatcaaagtgggttccctgtgttcgtagtggattttctccattagatcttgacgatagccatgatgtggcatagccggaggagtcaagaaggaatcatctcttttctctgtgggcagtctctgccgaaccatcagtttctttgtgatgtattgccccaacgtgtgtccgtgctcagctcctggtttggaggtggtatctgtttgtgagtcttttatcacatcggctttgttggacgtgtcgactttcaccgaatagtgcctgaaagtggaagccacaaggcatggcttgattggcctaattggccttattgcgtacagttttaacatctttgagaatagattagagcaggccaagtgaaaggaaaagagagagtttataaacctccagttacctatgcagtcactttcccgtcaaaggccgatttgaattcacggaaggtaagtcttcatgccatttagagttaattgttaaggtttgaactacaatcgatgtagttttaggaggagttgcatcgaaacggtccagcgattattacaggttgttgttaaccgacaccgtagagagtaagaatagcctcaaggacatgaaaaacgaagtgaaggtgaacctctagaaacctgaacttctgttcgggatttgagtgtgggcatgttggtagttttgcataaagtaacgacctcaatgaccatcgggggatctaggcaaggctgctggtcatgatggcactgtcacgatccagcgttgataccgcgacctgatggtgcagtacgtaacgtcacattacattgccaaaacccttttagaaagctctaagaggctgtagtcttgacggtgttcatcgattgttgaggaagcagagaacaattgaacctaggaagttcctactgcagcttagaagcaatcgcaatgaagacccagagtatcccagtagttcagtttttttttttttttttactggggaactcagttcgatgaacgcccgaaattacccggtatggcttcaacacccaaaatcgccttaacttacaggcgaaaaaaatgggagaaaggtacgaccgtttagtgattaggtttctgaccgggtttgatattcggaattgaacggaaagagcaaatagccctatgggtttcggatagcccggatattgcgaactttgggttatttgtagacgaatgactccctagtctttgttcgatccctggtctctacttattgtggagcataactcttttcccttcattctgccaaatgtcttactttacgacacttcatctcgtttcctattgttcctgaagccctttgatctctctctttcgcgctttcatatatatctgaacccctagacccattgtgcgagacatgcccttcaccccgcgccaccatttgtctgaacagaatgccaaatggaaaacgtgagaagagagcagaagccaaacgtcaaagggtagccaaggcttgcgactactgccgttcgaagaaagtacgatgtgacggagaacagccgtgtaataactgtatttcctgcaaaacttcctgtacatataaccatgtcaagaaacgacggaccacagataagaaaagttcgccaaaaaggtcaaaggaagtggatgacagattggagcggctggaactaatgattgagtcacttgttacgcagttaggctcttctaactctgtagtaccagtttcacgtattcaacacaatgaagaaactaccgatgacgatgagagcgactctacacaggccgagaatgatgcccatttgcaacccagtacgaataagaaaaccgaccaaaaggagttgaatggtctttccagagaggttaccccattttcttcaaatggaaagacaagctgttccgatgccactctccagtttgctcatcgaaagaccgagtgcttcgactcattcttcgctgagtactgttcattttctttattttctaaagagggacaagaatggttagtctcaaaaatgaaaagcgaacatttagaaataatcaataagaacttaagacatatgttcgcaaactatgtttcatactcgttcactctatggatcgagccaattcagcctagtgacttacagccactttttccaaaaaatatatctttaggattattgaagtttcttttttcctatgtatcccaatcactataccccatcgatacaaatgagcagctcgctttgctagaagtatattgcgaatcacagggaagaggcaaaggcaaatcgcatcatctatcttatgctaatttgatgatgctcaacatgtttttagcattttcactggccctttatcgtgattcggttttgaaaactagtgttaggatcgaaggactggatatatcgccagagaaatcgagagagtatgaaagtggcttcctaagaaacacaattttttattaccagcgactatttttagttggggatgggcttaactccattcttgcaattttattactttacaaatattgtgaaggaacgcttgcattccatgctgcgtatatgttattgtcgactggtgtcagattagcccaggaaatgggacttcatcgtgctgaatcatatgcgggtctctctcaaaaagaacaggatagtagagcaataatatggtgggactgctatacagaggacaaactttactctattaaatcggggaagccttcgattattaacgatcttgatgtttctgccccgctaccttcctattggcgaaaactggtcgtacttccccacaaagtcgatgaatttcgtcgagctattgacgaagaatacggtccaggtctagcaattcctgaatatattcgaatcaatgctcttaataccagctataacaagggaaaagctgctgttttacattacttcttgagcttgagttttttagtttcctacatctatcaaactgtattctcggtgagtaccaccaaccatcgttctttggaggagcagatgattcaatttgaggtgataaacgaaaaattagagcaatggagattatctttaccagagcaatgtcgtccaaagtcacgcaaagagttgaacaatgaagatatctacaaaaatcttactgttgaaggtgtggaacgagttctccacgagcaaaacaaatattcgacttcaagcgtaataaatccctttgaaattgatggccctacagaatcagttcattttagattgttactgaaagacttgcatttggcatactatacaatactatcctcagtttgtaaggtatttattgacaaatcgtcaaaattggtaagcgcaaatcatagtcattcaagagttgttggagagtatgttgctatgcgggttaactcttgcagggaagttttgttcatgtccaaggaagttggagagggtacaaccttttttgctaatattttttcattctacctgctggctgcatttattccactgttttgcaatattttgagaaatccagattctgaaactaccgcctttgactttgcgctgttgtattattctgaaaaacattattttgaaagattggaaggcccacacacagcagagcctacgctttcacgccatccgttgagtttactaacggctttctttttattagttgctcacaacttgaccaaaagatcgtcaaactttgcaagcatctcaactaagttcgatgagtttgagcgtaagaattttgacatatttaagacgattgggctgacttcttattctcagtcaaagagtaacaaactttcctcaaagtctgacccttctcttacggtttcagcaagtgaagatttccatcaggatctaacttctagacttgatttcaaacaagataacaagataacgtcggacagtgtgacgttcgaagcttctagagataattatctgccgacttataccaaagattcactgattaacgggcatagtctgtatcgggaacccaattttgcttctcagattgtcccccctatcatgcccccagatacattgctgcaacacgaggagtcaaatcttgctgatgcaaattttcaatctattcaccccatggtcaattctactgagagcgcatatatccctatcgagtatcagaatcaaccaggcatctctgaaaactccaagcttgttaatgacctgaatcatgaaagctttctacaagacgacagtgccgatgagagagcatgcttgtttcagaccgtttttgatgtgccaggcttttatttagattcataattatgtaaatatcgagagtgaagacaacttgaatttcctgtaactacttgcaaaaactcattcatgtagtatgagctatctgtttggagaaaaacttctgtttgaatcatttggcagcttcaaaatacatatctgtagcctcattggccattcctagccctgattggtatccatatccagaagccccataattgtgaacgatatatctatcttttccgttgacctgatcaaagtgttcgacttcaattcggacacctccttttctgctgggcctcagtccggccgcctctctaatgattttcagctcatttcttttgccgatctcagggtagagctccaagccccttttcagaatatcttcggtctcatatccatatgtatttccactccagtttccttcctggaagaagccacccatgacaatcgaaccgtcggagaagggtcttgggatcacatatgtgtctgaatcaggcctccacctgaatctgttttccctgatatgtggagctcttactacaactacttgtcctcgtgtgggaaagacattctcatctttgaccccacctaaagaagcagcaccaattccagtacaattgaatacggcgtccacagagggagaaaagacagagctaatgtgatcaatcttcgaacgctcgaaggtgaccccaattgcagccaaatgtttttggaagttggctaagaagagtggacaattgaaattccaagttagaaatttaacaccggaaacaacaccttctggcatttcctccttagtcattggacggtactccttcaagtactgggaaatactgtctaacttggcgtggtcgagttcctgctcaaacatttctgtggagggaagcatgtctaatccacactcgggaccacctagtaactcttggatacggtgcaaattggtgtaagtaaacttgtcaaacttcatgctgcgctcatcagttgaagtaatcagtgaaaagtttcccccggcccagggcgatgtatacaaagtggactggtctccagggaggaattcagcaaccactttaatatcgcttggcccagtccccttatcaatcagagaccaagcagtgtagagaccagagatcccagctctttttaatcgttagtagcggatggcgaataatcttgacaagacatacccaatgataacgtatttggaatcagtcatttcttgccagtgttcagagtttttgattttgaaaagtactaaaaaccgttcaattggcaaattggaacgactaacaaatacatatatatcgctcaaaactgatgtcgagagatatcggttggtaaactgttaatacactaagatttgaggtcaattgcggtaagaatgaacgaattactattcagtggggatttagagatggcatttttaggcgagctggagataagatgagaagctaactctcgatctgtcaagctcccatgcttaacttgttcttagtattctctcgaaccaccatcgagccccatttggacgtttgtatacatggagccaaatggggtaatctcattgtatttttttttcttaataggatcatcaatatcccaaaagtaagcgtgataattagtgttgccttgcacgagtaagcatggattcaatactcatggataaagaagacagcattagtttgactccagtgaaaaaatttgccacattgaatctaagttcagctcaaaaaggtagaaaaccgttgtacccttctctggaagggtttcctgacacgcatgagtcgcctaatcagatacaacatcatctatcgttgagcatgggatttgatacggacaaatctttagagagtttgtttccgaggagactcaacaaatctgttctagaagaattgaatgacagaacggagaagatcaaaggatctttatcgtaccgacaaaaacttcaagggagctcgctcaaatctagctcattgaaagagaaatcccggttttctttagctcattcctcaatcttcgacaaaatggagtccataaaagaccactgtgctgcgcagaggctagagcgacgagtagtagagcaatctgaccaaggtgatggtcgaccgtctctactccaaacggcgacaaaacgacgccgaacactgagaggccctcaagaaatcagggagcctttaaaagaaaccaatacccttagaacatccaccaaatcttacaatctgaacgaaattctgcataaaccatccgatggtattcccaagagtcgatccagattacagttgaaaaatggcagctctagggaagttgcctctggaacgaaggaagcttcagctcctggactcaaaaagattcccccaagtatagttagggccaaaactggagactttggctatcccagattggatccaaatagtggcaatccttctagacacactcgtctgcaagaaagaaagccaaagacgatcgccaaaccaacaaataatacccccattttgcaaagacatcaaaaaacgctcctaaaagctaattctagtcggaaattagaacaagagcctgcagttccagccagaactgacagtatcaagtcaattccaagaagtgtttcttccaaaggatttgatagattttccagaactgcgatgcaaactcttggttccattccaagatcgagaacaatgcataacgaactaaatatttcgagttctctagagaagtcaacgtccaccagctccagaaagacgaggccagcttggaggtgacgtatggctgaacaatactacagcagttgtttccccagattcgtgtgtaaccaaaaaataaggtgcgatacattttcagccattgcatcatccattgaataattacgtaataggtattgatttccctccagtctcccttcactcttttcatctatatctttcaaccatcagagctgcaatgggtgaaattcatcatgcagagtacgccaatttttcttcctcggataaaagagaagctttagagcaagttcttcagtcctacgatgcgctcgtcgaaggtcagacaaattgggtgtgcaatctgtccaacgcttcgtcgcttatttggcacgcataccagtcattaaatgttcctgttaactgggcagggttctacgtgttaaaccctgaggttccaggagaattgattctgggtccatttcaaggcaaggttgcctgtcagaccatcaaaattggccatggagtctgtggaactgcagtatctcaatctgagacccaagttgttcccgatgttaacaagttccctgggcacattgcttgtgatggagaaactcaaagtgaaattgtcgtccctataatttcatccaactcaagtggagaaaagaccgttcaaggagtactggacatagattgtctagcgttacaagggtttgactctattgaccaagaaatacttgaaaaaattgttaaccgtattgctcaaacatgcaagtggtagaacttgaaggagcatgtaaaccttttctttattcgcagagtagtttttatgaaagggactcaatgttccaagatacgattgatacaaatttgcgtaatgtaatatcttctttaactgtgattaaatcttgcacatccagaatatctcttatcgtgtttctttgataaacgtcacttatatatatggttggcatttattcactgtctgtgaacgtatatctggcaactaggaattaccattcaacattcaaacattcagaggattttaggacgctgttaataagagtttaatcacctttccgagctgaaggtttccactagaccctcatttgacatagattgcaactacaaagttaccctgccaagcatgtcgattgactatcttatggagtctacacagttcttgttgaacgttgcttgccaagcttgatgtacaagactaattgacttagatttggctcctatcaatgcaataaacgttagcaatgctattcgatgttcccgtataattaatactaggctagccgcggttagagatgcgccatcgctcataatgtctggtgttaggcttttgaaaatcacatgctcattaaaaagcgcgcaaatagtaccatactgtgcgcagcccgagaactgaacatgatcaacctcgtcgataaggaagtgctttacagaatcgatcgccgttaggccgtgagccggtatcacggtatcagcttgtatcgagatacaactgtacctatcaaagtgtcgtccgcccatgcgaccttgcagtacattatatatataagctggggtagattccagatacaaaaactctgtgcgattgttgcaactacgtaaataaatacaagaaatctctcaaggtgcgttttatcccatactggcatacgaatatgcaaattaggtccacgttgagccggtcatcatcttttccccatttccatgcatatgacaatttggtgaggagggacgtgtaaaccgttttgaatattctgacatgctataatggcccgcttttaggaattttgttgcatgaggtcgttcgggaacgacacccccccgccaatattttcgaggcactggtcatttttttaacccaaatactaactatcatagtaatgacttttccagagccaagagaacacaaagtggtgcacgaagccaacggcgtaagggctatcaaaacccctcaatcattttatgacaagcaacctgttaagtcattggaggcattggaacattatcaagagctgtaccagaagtccatcgaggacccagaggaattcttcggccaaatggcaaagcagtttctagattgggacaaagactttggtaaggtctcctctggatctttgaaagaaggtgatgctgcgtggttccttggtggagagctgaatgcttcgtacaactgtgttgaccgacatgctttttcgcaccctgatcgtcccgccgtaattttcgaagcggacgaggaatctgaatctcgaacaataacttatgcagaacttctacgtgaggtctctcgtgttgcaggagtactgcagagctggggtgtacgcaaaggtgacactgtcgcaatctacttgcccatgactaccgaggccattgtggccatgctggcagtggcacgtctgggtgcagtgcactccgttatcttttctggattttcgtcaggatctatccgggacagagttaacgatgctggatctaaggcaattattacctgtgatgagggacgccgtgggggtcgtattgtgaacaataagaaaattgtcgatgccgctgttgacagctgccccacagtggaaaaaatcctggtttataagaggactggtaacccagaaatcaagatggtagaaggaagagacttctggtggcaggaagaggttgagaaattccctggttacattgcccctgtccctgtaaactcggaggacccactatttcttttgtatacttcgggatctactggttctcccaaaggtgtggtacactccacaggtggttatttgctgggagcagcattgacaactcgttatgtgtttgatgtccaggatgaggatattatatttactgctggtgacgtcggatggattactggtcacacatactcgttgtatggaccacttgttctgggtgttccaaccattgtttttgagggaactcctgtctaccctgactacggaagattgtggaagatttgcgccaaacataaagccacacacttttacatcgctcctactgctcttcgtcttttgaaaaaggctggtgaagaagaaattaaaaagtacgacttgtctagacttcgtactttaggatctgttggtgaaccaattgcccccgaattgtgggagtggtacaatgagaaaatcggaaacggaaactgtcatattgctgatacttactggcagactgaatctggttctcatttgattgctccattagcaggtgccgttccccaaaagccgggtgcagctactgttcctttctttggtattgatgcttgtatcattgaccctgtttctggtaaggaacttgaaggcaacgatgtggaaggtgttttagcagtcaagtccacttggccatcaatggctcgtacagtctggaggaaccacgctaaatacctcgacacatatatgcgtccttatccaggctactactttactggcgatggtgccggtagagatcacgatggttattactggatccgtggtcgtgttgacgatgttgtcaatgtatctggccaccgtttatccacttctgaaattgaaagtgctttactggaaaatggcaaagttgctgaagctgctgtgattggtatttccgatgagctaactggtcaagctgttattgcttttgtcgccttgaaagatgccactgactctgagaatttagacgctctcagacgtgccttagtcttgcatgttcgtggagaaattggtccatttgcagctcctaagtccgtgattgtggttgatgacttgcctaagacccgatcaggtaagatcatgcgtagagttttaagaaagatttcttgccatgaagctgatcaattgggtgatatgtctactttggccaatcctgaatcggtagactctataatcggagctgttgataaccagttcttcaagaagtagaatttatgcatttttggatttatacatctttatatttaatagtaccttttctctcccagctaactatttacatggcaccgtcagcgcctatctaatcgttcttattctttgacaaggttctcattttctgagcagctttccccaccgccttcagtgtttctgtttgaagtagttgttgtgacgattctaaaacactgatatcttctaatttttcatcccgggcctgccgaattacttcccgtaggtcagaaatacgctttgtcaactcttgcctgtcagagtcgtccatatatccaccccattgagataaagcattatcacagtcaaacagtagtagttccaaattgttggcttttgtgtatatttccttcctaatacgatcagtttctgaattactctttgattcggctacaattctttcaacctcttcagaagtcaaacctgtggatccagatacagttattgaagcgtcttgattagtggtcgtctctttcgcatttaccttgatgattccatccgcatcaatttcgaaactgaccttgatctgaggaacacccttgggttgaggttccaagtctgacagtttgaactgtccaatcatcttattgtctctcaccaaagatctttcaccctgatatacgttaacttcgattgaattctggccatctacagcagttgagtacatctgttgtactttgcaaggcactttggtgtttcttgggatcaaaggagaaaaaatacctccaaaggtttcgataccgagagtcaaaggtgttacatctaaaagcaagacatctttaatctccccagataaaactgcaccttgaattgcagcaccaagagcgacggcttcatcgggatttacagaagtgtttggcttcttgccaaatgtttcttccacaactttgcgaatcttgggcatacgagtcattccaccaacaaggattacttcatcaatgtcggaatttgtaagatctgcatcacgaagacattttttaactggttgcaccgtacgattaatcaagtgcaagctcatttcatcaagttggtcttctgttagttcgagatttatatgttgagttttagtaataaaaggcagctctattgttgttgttttaacagtagagaggtcaatcttggccttttcagcagcctgacgaattctttgcagggccaaacggtcagtagatagatcttgtcctgtctgcgattgaaactgttgcaatatgtagtccaccagcaaatggtcaaaatcttcccctccaagatgtgtgtcaccattcgtcgcaataacttcaaagacgccggcttcgatatccaatatggagatatcaaaagttccaccaccaaggtcgtaaacggcaattatcccgtcattttttctattcaatccgtaagccaaagaagcagcggtgggctcattgataactcttaaaactttaagacccactaaatcaccagcaatcttagttgcttgtctttgcgaatcgttgaagtaggcaggcacagtgaccacagcctggctaatagactgggaaagatttagctctgcaatctctttcatctttcccaatatcaaactaccaatttgagagggggagtatttttgacctgagtgcatgttttgaagccacgcatccccattttcatgttcaattatactgtaaggaacgttggaaatatcccgttgaacttcaggatccgaatacttgcgaccaatgagcctttttgtagcataaaaagtgttctgatagttcagaatagattgtctctttgctggttctcctactagcacagtttctggggtaaatgcaacaatagaaggtgtcgttctctttccctcttcgttctccaggatttttggttcttttccttcaaaaacggcaacagcagagttcgtagttcctaaatcaattccaattaccttgctagacatgtagcgcagtaactgacctacttgtcgacttggactctgctttttacatgaacaccatcttgatgacaacattatgagaaagagcaagaaaggtggagtaatagtatcgggaagaataaaacttatgggggcctcgaaaggtagttagtggaccatgcgaaaggagtagaacgactccagtaggagaagatactaagagaagtagtgaacggtgattagtattatcaggcgagtcaattaatctatgtattggttaatcaataagttccaatggtgtgtgagttccgacacgccagtttagagatacatggtgcaatgaaattatcgtgagttgaagatcagtacccatctaaagtaagtgaaaattcgcaattaacgttatgcctaccttctcccggtagaaaaatacgactatcctctcaaataatgaaaggccaaagtataaccatttccttccaaaaagacctagacctttgaaaagatcattcaaaaaaacaatctcaaaatctccaggacccctcccccaatcagcaagaagagcaatatgataacccacttagtcgaaactggaaattcacgcttggatctagccttcttcaccttaccctgctgagcttcagctctctttacgaatttttcgtttgcgatacgttgccttggtgtttgaggagccatttgatcagaggagaaatgttacgtggtaacatctgtggagttggtatttcgctatcgtgaggattcgcgcggcgtgtctattttgaaaagtattgtttgaaggcctctataatgaccaacccttcactagctagggacaagcagctttttactgatctgaaatcaacggagttgaatgatggctctttagaaaatcaccgaactagcactgatatcatcactttagaattcaacaagggaaatagattggcgtattcaagatctgataaaaccctctgcatatggaaaaggttcaaggaaaatgtatgggactctttattgcagatcaatacaacctctaacaagccagtctattgcattgcttgggatacagttgatgaactgatatttgtcaccgtcgccaaagattcgacggctcaaatatggcaacttaatggttccaacactcagtgtaaatgtttgaagacaatccaaacccctagcccaaaaaactccaacttcatagccaagatatctcccgacggaaagtatttggttattgccagcttcaataacacaatatcattttacgatttccaatcgaaacatgaaccagtttttcttttccagtacacttttaatgagaacgtgtatgatttgcaatgggactctaaatcaaggtttctactattcacgcttagcaatggtacagctcctatatactcaattactaaagattcaggaggattgcggtttagtttgttgcagacattatcgggccacaatgcctctgtcacttcagtggccattactggagatcgcattattcttggaacaaatgaaggaattgtatctatatgggacctttcgacgttagtctgcatttctgtcgattcatccattgacgttccagttacctcagtacaagcttcatatgatggtgactaccttttgataacctatgagcatcacaatgcaaggataataaggttgtctccgtttagcaaagactccgagacgatactagagttagaaaactcaagcaggggaatttattccgcaaaatttagcagtacacgtttagccctggcttatactgggatgaacaataattgcgttgtgttggggaggaaggaacattccaagagacggtatagaggtagttagatgtatgtagataagatcaattatcagccatcaggcatccgaccttttgacgaaaaccgacattctcgcgctccagccaaccacatcaaacaaaattgtaactcgcccaaatctccaagaaagccaatgttcagacaagctagatttgtatcgacatttcccctcaagagtgatatcaatatcactaaaagtggaaaaacccttttgtcggttggtcagggtggacgttcctcaagaactggtttcaccgcaactgttttcgggggtacaggtttcttgggaagagtagttgtatccaagctggcaaagcatggtaccaatgtcgttgttcccttcagaaatgaccgtgctaggcgtcagcttaaggtcaatggagatctaggtgttgtcaactttgttgaatttgacatcagaaatctcaagagcattgaggattcagttaagtactcggacattgttatcaacctaattggtaccgagcacttctctaagaatttttccattgaagacgtcaacattggagctgctgagcgtattgcaaaagctgccaaggaagccggagtttctcgtttaatccatgtttcttcttataacgcaaacccatcgtcgagctctgatttctacgctactaaaggtattggagaacaggttgtgcgagacaattttggtccagatgcaactatcgttagaccggctcccatgtattttagaaactcccctttcctgaatgagctacttcaaatcaaggcacttggtggaaatgttattttcaagaaggaagtatacccagttcatgctttacaagtaggagaagctatagagaggattgcttttgatgatgccactgctgggcagacgtatgaactttttggaaaagaaaggtactcgaagaaagaactcagagaaatgatcaagcatatcattcacattggacaaagggggtactacccatactctgcaggtttttacttgccagctcctgagccattcttgtatgcatttgctttaatcagacaatatatctcttctcaaccccgttttaatgttgatcaattaaagagatctcatatcaaccaagagattgaccagtcagccaaaactttcactgatcttggaatggtgcctgacgaattgagcgagtatctctacagatatgtcaaaccacatatctcctacacctctcaaacgcagaatcgaaccgtctactcgaaggaagacattgagaagctgcgggattatgtcaacactcccaacgattctttcaatctgtttaacgtttagaatgatatttatttattagtttagtgaagtatttatgttgcttgaggagttaaaatagcaaaatagaagcttttattgatcctttttcaacgggaactttaatcaactttggtaggctccaaactaccttatcgattatatagataggtgggcagatacggaatttcgctcgccctatttttactagtacgcggattgatctctttcgttcttctatctaaagtaccaatcatgtctgataaaccattacttcagactctctcaagagctattataacccagagtggaatacagctatcgggtaattggcatgaatcaaattaccaccctcttttttgttgcagtggctccagttcagacagttcaatacatcgtacgattccttatcatgacattctattcgccgaagagcttgattcttcagcatctgatggcgactttggtaccagggaaattgaactgacatatgtcgcaagaaacaacaaaatagatttaaaaaaagagatagtcatcgttactgattacgaacccaaccttagtcaaaccatcctacagaaagcatatggtcagactgaccgaacgcatccacagagaatacttgtcttaataaatccgcatggaggtaagggaaaggcgttgcgattatttgaagacaaagctgaaccaattctgaacgcagcacaatgcgaatatgaagtgtgtacaacgttgaagcaccaacatgctacagagctgatcagaacgaggaaggacattttagattttgacactattgtctgcgcttctggagatggaataccgcatgaagttataaacggactctaccaaagggatgaccgtgcagaatgttttgagcacttgacggtcactcaaattccctgcggatcaggaaatgccatgtccttgagttgtttggacacaaacgatcccgcagaagcagctttaagcgtcctgaaagcaccaagcgttcgtatagatttgatggccataacccagccttctcaacctgtgaggctttcgtttttgagtctcacttatgggatgattgcagacggagatattggaaccgaatggctgaggtttttgggtccatttcgattcgaagtcggtatagtgacgaagttgttacaaaatgccaagtatccatgtgatctgagtgtggatttctgtgctaaagatcatcagttgttatctcaacactattgtgacaacattaaatcagattattccaaaacgcagcaccttccaattacagatcagagttttgaactcaagagcccttcactcgagaatcctccacccacggactgggaacgtttagacagtcaaattaccgacaacctatcgatattttacgttggtaaaatgcctatagtttcagctgacacaaatttctttccagcagctattccagatgacggatgcatggatttagtaataaccgacaatcgctcaagtgttttagatactgcgaatctgctactccaagtcgataaaggtacacatgttcttcagaaggatgtgatacattcaaaggtaaaggctttccgtcttacgccaaggatacccaagggatatatatccgtagatggggagagctttccctttgaaactactcaggtggaagttcttccaacactacttaaaacagtcatgaaagagggaacatacgcagaaacagggtttccaagttactcgtgaagtatatatgctgctagtgagaataaaaaaaggaatccatgaagatggtatgctgatagtgatcatccaggggcatgcaaagcgtgctgatatccgtagtttttcgtcaactttctgtcaattttccttctagttcctccgcgactgtgaacaaaaattttactcgtaccgtctcttttcccttctctaaagaaatgtcgaagcaacaagacaacaacgacctgtctcagggagtgggcaatatagacttaaacaggaagaatgaacaacgtttcaatcctaacagtgcttcctcgtttcagcctagcttcaaccctcaagcccagaactttgttcctggtcaatatcaagaatcccaaagttaccaaaactaccaaggttatcaaagctaccaacagaatcagggatttcaagctcagcctggctaccagcagccctatcaacaggggtatcaagcgtaccaaggttataacaacttctatcaaccaccagctgaacctcagactaaggccatgtctttggaggactacaacaaacagaaggagcaatccaagaactctttgaatgcaaaaccaaagagaactttgaagctaagctccagttctggaattaagataggaggtaaaaaggaagaaccaaaaaccgagaccaagcctgaaactaaaactgaggcaaagactgacccaaagcctgctcagaaggaagagccaaaagttgaagtacctaaagcgaagagtgaaaacaaaatagagtctaacactgaatccaagaccgacagcaaagctggatcgaaaaccgaaagcaagtcggcatcaaaagtagagagtaaggcaagtctcgctgccgatacgctccccaaagaagatgacataaatgaagaggttatcaacgatttgtttggtggaaaagatcatatttccattctttttatgggtcacgtcgatgcaggtaaatctaccatgggtggtaatctactctacttgaccggctctgtggacaagagaactattgataagtatgagaaagaagctaaagatgctggtagacaaggttggtacctatcgtgggtgatggacaccaacaaagaagaaagaaatgatggtaaaacaatcgaagttggaagggcatatttcgaaactgaaaaacgccgatacaccatcttagatgcccctggacacaaaatgtacgtttctgaaatgattggaggtgcttctcaggctgatgttggaattttagttatttctgcgagaaagggtgaatatgaaactggatttgagaaaggtggtcagaccagagagcatgctttactagcaatgaaccaaggtgtcagcaagctcgcagtcgttgtaaacaagatggatgacactactgtcaactggtccaaagagcgctatgacgagtgcactgcaaaacttgctgcattcctgaaagctattggttacaagaaggaagatgttttattcatgcccgtttctggatacactggtgcaggattgaaggagccagttaatccaactgaatgcccatggtacaaaggaccaactctattatcttatttagacagtatcgatattcaaaacagaaaagttaatggtccatttatgttgcctattgctggaaagatgaaagatttagggactgttgttgaaggtaaaattgaatctggtcacatcaagaaaggaagtactttgattatgatgcctaacagagtctccgttgaggtgttaaccatatataatgagactgaagaagaagctgatcaggctatttctggcgagcaagttcgtttgcgtataaaaggagtggaagaagaagatgtgtctaacggttatgtcttgacttcccctaacactcctatcaaaacagtgactcgtttcgaagctcagattgcatttgttgagctcccatctattgtttccactggattctcatgcgtcatgcacgttcatactgcaattgaagaggtgactattgtgcaattgaaacataagctagaaaagggcaccaatagaagatccaagaaacctccagcttttgctaagaagggaatgaaagtgatcgctgtacttgaaacccccgagcctgtatgtgttgagacttacgaggattatcatcagctcggacgtttcactcttagagatcagggagctacaattgccattggtaaaattactaaattgttgtaatttttttaggattcatataatcaaagacccatttcgcaccgtcttataatcaataaaaaaaatcttcataatcttgaacatcctaggcgattatgataacaccacaagagaatttcaaaggtaagaaagactctttaaaacgaccgagcgatactgaagttagtccagctcctgatagcagtccctccaaaaggtcaaaaccagcatccaaggtggacccaatcagttccaccacatggccaccagtcgttgatattgttgagaataactggaagttcacgtttgatgaactacgagaccgaagtcccagcagagtaaagcaggttccatatcatgttgagcttgagagaaggtggaagggcgtgaacttcatcaatcaattggctcgtgccctcaacttgtcccgatcagttgcaatcacaggatcaaccttatttcaccgattttacatgagaagagattttaacatgcatcaccaataccctgtggctgccgcttgtctatttattgcgacaaaaactgaagaagcccgcaggcctctaaaaaacgtagtcatagaagctgtcaagatcagttccaaagatcctcagaagcaagtggatgaacagacaaaggatttttggcaatggagggatacgataatacgaaatgaagaaatagtgttactatacttgtgctttgatgtttctccagagtctccataccgaaagtcccaacaagcagtacgagaagcagagtttcccaaacaactgaatgctggtattccactgaaggtttctccagagctcatattcagagaatcatgttctttctacgaagagtgttgcaaactagccttattagttttgtttggagccaatgttgtagctggtgttggactagtacatgcctgtattcaagaggatgccaggttttcaccccagtttcttcagaaaagcctgaatacgtcaatcaatgattgttggaggtgttacaaagtattcgtagaaatgatgaggatcctcaaagatcgaattcctccctctgtcaaggaaagatatggtcagtatccaaaagatcgttttttcagagttgctggtgaggacataccacaggagaaaaataaaacaattcctgttgacaaaagtgctggagccgtggaattagatgctatttcaactaagactgcaccacaagaattaaatgaagaagttaagaataatgatggtgatgacatttccaaaaataccaatggaactaccaaggaaaatcccaaaggcaatgactttgacgactacccgaattcaaccaaagaaacagtgaaagaatttagtgattctgaaacaaatgctacaacgcctgcacccaatggtacgtagaaaattgaaaatatacaaccgataggattactttaccaacacagcataaccaggttttgtcagctccgccagcacgcactctctattcccttcccccaccccccccccactcacttgggcgatatcaaaattcgatgttggatgtcggaagcactctcatcatacaactctgtctggttgtgttactcctcctatagacgcaacacaaacaccaattaggtctccgcccgttcattcttttccataagagtactagtaaattatagtgtccaatgaacaccttcacttcgatctcccctgaggagatgcgacgtcgtaaaatggtcaagagaggtttggacctctctattatggtctgcggtgttagaggaactgggaaatcaagtttcatcaacacactgtgcggtcagcaggttatagagcctacttctgaaactccagcggataataatgtttcgttcaaaacatataaagctgaaattactgaaatcaactccactccgatcaatctggagattgtcacaacaccagggtttggggataagattaacaacgaagaaagttcattagaggttttaaaatatttggaggcacaatacgacaccatcttagatgaagaatgccgcgttgagcgaaatacaaaggcaaaagataaaagaatccatgtggtcttttatcttattagacccacaggaaaaccacttagagagcttgatttagaattcatgaaaatggtcgggaccagggcaaatgtgattcctttgttgtccaaagcagatttactaaccgaggaggaactccaacttaacaaacaactggtgatggacgatatcaaggatcacaatattcccatctacgatttcacactgagctatgactctgttgctgactcagactattacaatgaagggttggaaattcagaagatgcttccgtttgctgtgattggtggtaataacgtggaaatcatcaatggtcaaaaatttcatactcgagattacccttggggaactgttagggtggaggatcctgaccactgtgactttctaccattgcgcaatattttgtttggctcttacttacaagatttcaaggattccactcattcggttctttacgaaaaatacagaacagagagactggctggaactaaatcaaaggatttaacatttaaatccgatgccctatttgacagtgttaaacgtgaaagtgcatctcagcacttagatatttcagtaacctagattttaatctttattattagctatactctaagaagcattcagattactcgatattttcgtaccaaaagttggaaatgacctcgggaatttctctaccattaaatactttgaactgttggatccataaaacaatccaatctcggctcttgtgaatactctttgaaacttcttctgttgtttcttcttgggggtaccgcattaatcttcgcagaattggcctcagatggtgctgttgaagtgactgaaactcagcatatgaaaaataaccgtccatcatgagacacttgaacgaatcttggtgaagaaatacgtgaggtgccaagaaaacattctcctgggtaacgtcccacatttgagacttttcatccgaactaaatgagtccttaatgttataaatgtgatctaataacttttgggcttcgttctctattgaaaaaaattggccatgacagtaatactctacaagcctttcagtaatagattctttgtgatagcaggtctgtggctggtagcaatcaagtgtcaacggtgaaatatcattctccaatttatagtagtccctaacgaacttgaaaaaccaaaaacattttacgtggacacctccactcagtaacatggcccacaagatttgatcatagatacgaaccaattcaggatcatgattctgtttcattgtggccgcccaaatcaagttagtaaccatgcagtctaggttttcttcattcaatttaatcaagttatctggtacctcaacaggctggtgattttcaaacatgcttgggctggagcgtatccaacgtaggttatacacggccaatctttggtgaattaatcccagcattttgaataagtgtcctgccagttgcttgttggttatcaggttcacagaagaatcatctaaacatttgttaagaaccttttgaaggtgctcaatctcttctctactagttttatggttcctctggagtgcatattgtgcagcatagatggcacacaccatgaatacctcgttgaacccaaattgctcaatgaattcgtttctagtcttattaatcatatcaaaatgcatacttagcatctcaaagagcaagagaacttctctcatgatgctggaggacctttcaaggtcgtcgttcaagaaggagataattgattgagtgaacctgtgcagcacagcaagcctgcagatcttcactagcttctctttatgctggcttctagataatgcttttaaggatttacagaagggctttgctggggcagtcaagttaatctcaaaatagatatcttcttcctctttgatcaaactttgaagtgttggtttatgttcttcgagtaagctaaaaaaggaccatgggggaaacttggatgctactttgaagactcggcctaggaggcaatcatctatgattttttgacgttccaaaaagttggatattgaaaaaagaatcaactgattactgatatactcaatttcttctaactgggtaatacgagactggtagtactctttctggtgcaactgttccatttttcgaattttctggatcaactgtaattcatcttcattaggctctactttaacattatttgtcctctgcacctctatcaccagttgtagtatttttgtatctagagatatcaaataggcctcgttcaaacatagtctagctttttcaacatagcccaacttcttcaattgttgggctaaaagtaaccatttatcttgtttactcatacccgaggagaattcacaggccaagataagttgctgaactcctactccgtatttctttagctgaatcagggctagcccaatctgaactctttgctccagtgggatcggctcaaacaacatctctggggttactagccaaaccacctcaaaaaaacacctatcattgtagagctcatccagacgtctacaaaggacatcaaattgtgtcttcatatctgtgcactatgattgagtgagtgccaaccgttttcctagtgtgtgacagttgcacaaaaagctaaatatgtggagaaatgggaagtgctgacagaaattcaataagaacacaaataagtgtaatcgtcacacgcaattttaggttgaggataaatacgttaagacgctgttaaaaactcttgtctactcaatcccattgactgtcgttacatatggcaatgcttgaatgcggacatccttgaatacatttcaatgttgtaatgcaaaatcagattgacacccaacatctgcctctcagtcgcggtgtctagatatatccaacttatcactactattgaagtcaagttttcagttgtttctatagctcccatcacctgctactcaatgcctcaaacaccatggctcaaaaagacgaaggatccatttgaaagcccaaatatgagcaaatcttttgacaattctgtcttgaaagagacccaagttacacctgttcctgcagccaggagtaagacggctcatgggatattcgaacaacttagaaaaaatcacgctgttgttcaagaatttgaagttttagatggtatagtagttgatggagttgatatggaagatcaatctaccagttctctgaaactgaacgatcggtcgctgaagcaaaacgacacattcgattctacactgtctcatgacaccccaaggcatcgtattccgtttgatgcaacacaaaaggatattttaccttcttcagacacacttgcagtttctgagaaggatatagttccaatcttggatacgcaatcaagcactcaaaaagattcacattccaattgggagtctcaagagaaattgggaccaatgttaaaggacacgcaagtaattgatacatctaatatgccaacgtctactcaagcggatgatgggcataagtatatgacaaaggaatatctactgggaggagcttctcaattggccccaactcaggttatcgagaagagcactcaaaacattcatggcacgcctaatcaaaaatttatacaggtccctggtactgctgaacgtgaaatagcatccacaaatgcctctcgattttccaggcgtcatgaactcactgatcccgagaactcacaaataatcgagtcatccttcagtaatatcaagtctcaaaatggtgacgaagaggagaatgatgaggcatctgcttttccaaacaatttgttatttgataccttggaaagacttactccaaaaagaaataaaagtggttccgggagtacttccttttctcctggaaaacagaatgtgtccacgccgaaagagaaagagttcctttcttcagaagtcaccgaagaattaacagacattgaagatgaacgagcgcttaattttaaacatgcccgacacctcaaggcccagcagacaccatcaagctttgataagatggaagagcagaacaagcacattggttccaattacctttctccccgtaaacccaattattctcaaaatgcagatttcatgttctctcaacaatctttcaaagggtctcctactcgtagaaacttgtttgatgcgaatgaagtcgaagaagagattcacagtgactatgaaaaacaccagaccctagatactaattctcgtacttcttcgctttcggatctaatagagaatcatgatgttattttcgacagttttcaaagtccgcaatcgaaagacctaagagtttcaaataaatttgatatagaattgggtcagaaagaagttattcaccgaaaggagaaacacgaggactatatcttatcccagactgacatcgcaaacaaagctgcagtttgggtgagaattgggtctaaaattattcctgggaatatagttgattttgctggcacatcagttgatgtttcagatggtgtggatgtcttccggattagggaaatgaacgtacttggcatcttggatatcaaaatcggagacgtcattaagtggaaaagtctgaagcgtagaacatgcattgtcacgggattagcgtttaagggaagcattgcatcggataacactgatattcaatgtgctcgtggattcaatacagtatatcttaaggaacataagaagggagtggatcttgaaaaggatgaagaaaagaaagttaacttgaatgaaatttacttgtcaggtactctttttcgttgccctactaggtcgaaactatttaatgacacagacttcttcaaagattatttatgccaggtaaaggaatcactcggcctaacttcgaaatatttaaataatgaccatggtgtgttttccggttgtttatttgcgatcacaggcaccacagataaaaaaggtaaagagattttggatttgaaggctgaaatcgattcaaatggcggaaaaattttggagaatgggtttagaccctttcttctagactcgaggacccaatttattgacagcgaacataatttacaattgacaccaaaggacagtttagactctttttcttttgctgccataatttcaaacggagttgtaagaacaccaaaatatttggaagcgttggcgttgggttggcctgtattagggcatgaatttattggtgattgcttaaaggattccaaaactttttctaggtggaaagcatatcttttgcctgcaggaaagaccaaactggtatcagggttgaagagtatagagatttcccgctttataaacaactttgaggctggaaaaagcttagtctcccagttgcgggcaaataattacaaaatgaacggcatgagactcttagtcatccaggatggtgaccaggtgaaagccggtgtggttgaatttctagcttattgttttggtgttaaatcgttggacaaacctgccaactacgaggaagctttgagcatcatagaaaaataccacccctctaatggaagggaagataaatgtgaatgtgccttgtatgacgacaagaccatcaaggagataactggagcactcaatttggcatacgataaaattgacaatcaaacccctaacgatcaaacagaagagcttgcttccggggcgaccacaaagaagagggggattgactcgcaagatttgattaccacccgacgacgacggacagttaagaaaatcaattataatgaagacagtgacgatgaaccagaaataaaatcaaaaaggtcaaaaagcgtttcgaagcttcaagcaagaaacttgcccgaatctaaaaggactaggattcagcttcttaattgggaatggatgaccgaagtgattgtatctggagaagtatggccccccagtgggaactataattgattaacttcatatatatatatatgtaattttgaatcatgacattttacttattactttctattcaattaatttacagtagtagacagctcacagtcaacagactggccaatgatgtaaagaaacacaaaactaaagaagatcctgaggacgatgagttcgatccttcagcctgtgaaggtgatgcactgaatgattcagcaactgcagttccggaaaaggggtaaggctctgaataaatagaaccattggaaatgaatgctgttgctatgttaggattgagttcgtccacttcggaattggtgtatattgttagagtcagcgttgaataatcagttaaattattccctagagctcctggtatgctatctgtttcgatggtagctatgcctgatgtttgctcggtttgagttcctgaagaagttatggttgaagaatttctagacgagctgttagtgactgaacttgatgatattgcagactcttcccttttgtcaaaattggctgtactagtctcatctagtgtggacggtctctccgatgttcttgaagttgaaacaggtggaggaacataaactcccattgattccgaaacagaaacgttcgaagcgggaggaatgctatctctattaagattggcaacggcgaccttttttgaatcatgattaacggcaaccactgcattccttaaaaagggggttcctagcagtggataaccaatgtaaacatcaggagccatggcaagaatacaaacatcttctccattagcaaagctcagccttttgtctccttggtatgctggataaatcaactccttgataggagcatgaacggtaaggttacccatgtgaaagtttaaagttgcgtccagttgaccaacagaacagttcacggcccatttatgaagtgtatcaagatacagtgcattaagctgcactgctatatgtatgattgaagagaatggaagatggataaagatgtttcttgaatctaacatcattggaagtgggtatgttcccgttaagaccgtgttgttccactcattggggaaaaagacagttctctgtttgtcattcgaagacatgcttaatccgctgatcggaactgtagggaatgtatcttcccaatcgaatccaaaaactccattgggatctgacaccggaataaaatcgaattctaccagaggctcgacatacttggtagagtttattgtccccaaatagagctctccatatgaagaatcgatttcgtttaatgccaatgaaaacgagttggattcaataagaccaccgctttggagtctttgtaagaaagttggcacgtcctgtgaggtgtaactccccaacgccaaagaccccacagcggcgctactattgtgggcattcaaaaatttcagatctgtagcagtcattcttgctccattattcaatgtgacgtaaaaattgtcttccatataaacgccatcagcaaataagttgtttgtaagatttactctctcggccgatgcctcatctgtattgtttacagttgtgtttgcgtagacatcaacgaaatctgcagttggactattggaagcatcgtaaacgttttgagcagaattgaaacacagggaagacgaaacatttgagccattacaggagtagtagctactatccagagtccaagagagaccttggttaatatccaaacgcaaccagaactcttcatctgaacgtggaactccagccatagtatcataaaacataccagcgttgcttcgcagcttaacaaaattagccgacgaaaagcatatcagagacaaaaccaacaacgcctggtacatgcttttcggcctggtctgggattaatcaagggaacaagtcactataaatttttgatgacaaatattgcaattcgaggggttatgcgagcctaagaaaagaatgagggaaatacgatcactgaaaaattcaggtcatgcaaggatcaagaaaaaactccagagtaaacgtacatgagatctcttctaatcgttcaatcgttcaattcatcatttacacaactaaaatgtaagatcaggttggctaagccacgaaacatgcatgtttggatgaaataatggatcttggcctaagtgagcaggcttggcgcgctctggccttgaatcagggagctgccgatgttgttgtaatagggcaatatacgcattttctccatccaatgcaggaaaatcatcatcgcctattggcatagctagtggtacagaattctcaaagttttggggaatctgctgaaagttagtttgaaagtttacctgtttctgggagtcgctctgagacacctgtgaatctgcctgggacttcatgtaaatctgtgcctgcacctgtgcttgcacctgtccaccaaaaggatcaacaactgagtgcaaacttgactctcttgccgtccaagacctcccaaacatttccccattggaatttggatgggcgaataacgaccgatccactgggtgtccaatgggatttatcgcttcatctaaagactgagagctagaatcgttagttgagcctgcaagcgattccccactcgtatgtccgcttaaagagtcactagcagaggagtgatcacttaagtcgtgtatcgaagaagttcggcttgcattttctgagttttcagtccatgtgttcgtggagccagactcaccaagtagatgtgtcacatcctccaacttgggggctgaaactacttctccatccataactagtttgagcattggattttcgttgacaccgttgttagcgacattcaatagagatgactgctttcctgttttctttcgatttcgtgtcatgatacgactactgtaaccttctggaagacctcgacagacacccttctcgatatgcctctcaacccagatttcattgttctgaaagctctgaccacatgatccacaccaccccatcataccagttcgatcagcgcatttcacacctttagggtacttgaagtgcatagctttcaaatgtaccttgtaggtatcacgtctggaaaaaccctcacctaaactgcatttgccatggcctgattcatagaaaggacaatgataagccttacgttgtgaatgcttcttggaatgccgcgttaagtatccacgaaacttaaatttagaaggacattcggagcaatggtagtaggtttctccattggtaactgaagtcactacactagagacacgctttcttctgttccttttatgaatgttaagctccttggacgattcggccaaagaactgtgatcctgactaccatccttcgaattacttgagcttggaaggttttgttgatgttgctgatgctggtgttcttgctcttgttcctgtagttgttgttgttcttgtttgtgttgttgttgttcttctttaactaaaaacggggtgccaaacattaggtgaacatcagagtcctgagtactatcggccataaatggcgataacgactcacttaaaccatcctccatcaaactgggagacttctctgcactttcgttatcctcaacaaatttccattccatttctccgtttgagtttttgaagggaactaacttggtgttgaaagtcaaggaacatggatgaacgttcttgaaaacctttatttgggtgatacgttgttgactttctggaaataaagattttttgtcatccaactcgtgtgattcctcactgtctgacgagatttttctggtaggtggcaacacatgatttagcccatcagacagtaaagtgagtaaggggaaaaaagacgctagcacattccagtaatatcgaaaccgcagttgcacaagtttgaagaaacttatgaaaatacttgacattttgtacagcctcaataaaaaaaaaggaaaaagggcaacgatcaattattgggggcagaagttttagtacaacgcaaatgcttgttgtcgcgactaatatggaagataaggtttagattggtacagaataggcaactatttcctaattaacttctacttggtcattttccaattacccatttggatttcgacggtgcacgccggagaacctatccgatctccacttttctggggagggagccgtccatgcgatagaccactgaactgttattaagctgatttgcattcagtaggcaaataccacggccattggagctgggacctaaccatgcgggtcgatgttattctaatcagtgctggttcattcgtttacctcttccagttccacatctgtaagagtgggtactgttgaactctcagtcaatctgtaataattgtaccacaatatgtcaagtagcgtaatcagtaggccgactccgttgatcagactgagtgaatcgccaaagaccaggtgacctaagagtatcgtgagtagttccttaaagatccctgcaattgacagagtcaacagagaggcataacttagtaagataaactcacttaaagtcatcaaaaatgctaagatgcctggaatcactaggagacaaagcgtgactggcacacccttgatatcccagacttttgaagcagcaaacgaaccaaacccttccagaaatcctcccgtaatgaacaaagcaatgctcatagcaggagataagtagaatatggttaatatcggattctgggtatgggaatgtcttttgagtaataattgagttaaggcccaacgcaatccggacataacagcagaaatcaggactaaagaacatccaatgaagatatgggtaggtctgttgtcaccatctttggaatcatggccatagaccatcatcaccaccccacctgtcataattgccacaataagcaccaatctggtcgaaagggtttcaagcttgaaagctactccccagaggagcacaaaaactaaactcgaagacttgaccatggtgtacaatgagagggtgataaatcgaaacgaagagttacctgcgccaatatcagctgctgaggctaatgcacaaggcaggatagtacgaacgtacatttgccagggcatggaatatgacagtttggagtcatgagccagacgaaattgtggtgttaataagaggcatgacccactgagaataaacaggaccatctggtgcaaacttgttatgatgactggaaattcaaatccaaggtcgggcccaaacatccacttgttatatagtgagattgacaatgaaaagaggtaccatgctaagatagaaaaaactatggggttgctgttggcaggaaacaaatgtgttaaggccattattggttctgaaaatttgtgaacagggataattgatgcaagatctaatgatggggaggttttctagcgggttgaatcgagtgaatattgaaatgttaggtgtctagctccatcagtaatcttcgccttctttgtagatgtgttgttaattcagaacaaacaactgagaaatgagtttagggatttcacttttaggcgtatattgcgcgaggaaggcccccccctggatatcgatcaaaattttatttatttagctatttaatcactttcctcttcagcctcgcgtaaccactggacccatttgccagcaggggcttttacttctattagctcttcgcttgcgtttgattctggagcatcccaccaagcatagatctgatcttcttctacaatatcctcgtcgtagaggatatatagagctcgcatcaagatactggctgcgtcagatctgttctccaattcaaggcattgttgttgcaagacattcagaagatcgatttgctcttcagtttcaaacacttgtctgcggaatagcaggccccattttctaaagatcttgttggttgcctccgtcaaagatagagtctgcgtagcaacaaaatgttcgattcttgccagtaaagcctttgtagtagccagtcttagctcatgataggaaacattcatagacatacggagagtattgagctctagtaatgcggtatctagatcatggttgttctccattgatctggtcactgtggccatggcttctttgtcaaaatcatcttcatctctgagaccatcggcatcactgtcaaattccgagtagtaactagttgtagataacgttctacccttacgacgagacccggtacctggtaacgaagtaattgaagtgtctgagagatcaaaaagaccgtcgtcgtgggccgcagattcggagaattttaattgtggcatcttagattcagatgctgccacttcagcaccggcaggtacttcttcattgaatccaacaattgctccaggaagaagcttggctccagcacggattattgccccagaagctactactgccccggtggcttctacgccattttctaaaacgacatcatcccaaatatacgagttcttcagttggacaccttcaccgatacgaacattttttccgacacaggaacagacaatattcgtctcggctccaacaaatgagcctccgccaatgactacgcaccgctgtagcctagatgtctgtgccagtattacatcattttctttgtagatgtgttcacccacgtgaatgtaggaagttccatcaattacgtttgactctggggccacagggtaagtccagcgctccataatatcctgagatattgcatgatatgtggaccaactctcaacccttgcggcgtattggttagtgatgtgtgcgtaaacggttttttgtaaaatatctgatgccaatattccacggacaaagtcattacgtagttcttgataatcaaaattttcctggaatattagtggtacctgaggggcacaaatgtcgacatggcaatcgactaggtcatttctgatctcaaacttgtcaatgccagttagaagctccgggtctatagaaactgctttctttgcacccccaatttgttcatagtataagcattttccagtggctctgtctaccatgaaagtagccggttcagtgttagatctggatctgtgatagggggacgcttccatcaaaaccattgttaacatatggtctttatcctgggatctgcgttgtctatgagtcttgagcactggctccaaagacatatttgtaacgacgtcaccgctgatcagtacaaaatctcccgttattagtcctcggttatctaagtctcgcattgcatcaccgaccgatctggactccaatgagagcacagtttgaaccttgaaaggtgaatttctttggctccactttgatttttccaaataatcttgaatttgtgaagcatgcgatctgcacattacatatacttcatcaacacctgaatttgctaaaaactccaatgtgtactctatgagagggacgttagccaaaggaagcaaacatctggggctttgcgaggagactggttcaaatcttgtttgataggaatccgtcagtataatggcctgcaaacgttcatcctgaactatctccttttgtttcttgttctttggaggcattaatactgtgagaagagtaaaaatctaactgaacattttcagcatgcaattctcctaaaaaaaatcaatgatggatgctggatggcaagaagtttttatagtatcactcgaggattcaagatatctcattgacagttagagcaccgcctgacacttgaagtcagaaagtctcagaataataccaccattctctgtctgcttagattccagttttgttgaagttgttactacaatagctactttattctatacttggtttattttgagacgagaactttcagctccagtttcgggaaaattgaagacttaattccttagggtccatgtcaaagcggtgtagaactttgttctggtcgaataacttcttttcgttgaactgcctaataggctgccgtaactccttatccactttttgaggcctaaactctaataatttttcttctaaaacgccatatcgagaaatgagaaactctttgaactgttccaaagtcaagaaagccgtaactaaaaaactcagtcctcgccatgataatccttcaccgtcatgctcattctcctggttatcaatttctgcggaaaggggtgcaccttgtttactaagcaacccatctatacctcgtattatcaggtaaacttcctctaatgtgataaaactaacatttgctaaattcaagacaacgaagcagacataatctcgataggcttgggaatcactttctgttaaaattcttacatcgttgataaaagaccgtaaaagattagaaaagaattttcttcgggaacttttattgtcgcccaagattgttaaaaacaagggcagaaaaaatgtctctttccacatatccttagaatgggctttgcggtattcagttgccattctgacaccctctacgtagcttgattctatcaggctttcgtgtttgttgtgcagctcacggtgtatctgaagagcaagactccttatagtcctgttggaagaagactctaagcaaacaattgtagaaatacaaacttttgggtttgccatacccaatctgacaacaaagtcgataaatctaactggcagcaaagagtagtatccttcatcaaagatgcacattttcagaatgtaaggcatatacttgtgaaccaatgagacacccagactctcattcacaaatgacggtgattttccatgaaacacttctacatccaaggatatctgctttgagtttttgttagaatgatctgaattgttaatgctagtttcttcatgctggctcaggaactcaaaaatcccttgtataatcacttctttagtatccacgtagtcagactgtaattcttcatccatgattgtcaccaagggtttagagaggaagaacttgggatgcgttacacataattccattagatttcgaatcgcaattcgacgtattttacggctcatcggaggcttcgtaaaaagtaacagtgaacgcacaaatacactaactactggctcgttaggttgtatggtgatattattcttttcaaataagtcacgatacgtctcaaagtagcagcatcttccaaatgatcctgcaaggtaaagcaatctggttagctttgcattcaagtctccctcatggttagaattaacaaatggtcgtaaaagacgcaagcacgatatagcagcattgacgtatctagtatcgttttgaagtttgctaaggtagtaaactgtcggcatcgcctcaaacagctctttgacattgaacttggtgagtttctccaataacagggttaagcactcataagtaaaagaagaagccagatttttcattaatggaagggagtgtttaaacagtttaagcgtgtaataacaagtaacagtattcgaatgttcatccaagtaaggtttcaaaaacacaagctggtcttggttcaaaatttccccattgatcaagactaaagttgaagttaagcacatcatatgctccgccttcccattgccttcgttttcaacaatagattccaaggagctatctgcaattgctttgatggatctgagtaccattcttgaagaattagtatcattatttttttcatcgttcaaaaaagaccttataaactccacaaagctgtccttattcttattactcctggccagaagctgtgccattatttcgaccctcgcatgaacacccaatctatatgctgcgggattgtcctcattattcattacgtccagagagtagaaccatagttctaaaagtgtttccccagcaagcatgaccatcgattcctcttcatcctccagtagctttaaggcaccttcagcaatttgtacctgaatagatacatcttgtgtgactatatacatggatttgagacacttaagagcacctttcctcacagagatactctcatcaaaaagtttgtccagaatcagtagatagaagtcagtcaaatagggctctttgtcaatatatttagaggcttcttgaataatccaattgtttatgataggcgaactgtcccgaagacctttaataaagatctttttaactgtggaatagtctaaaacttctcttgaaaggagaagagaaaccgttttcatagctttaagacgagttttaggctttttgctgtccaaattgttaagcatcataaccaaaaatcgatcgtacaattgtagcaaactttgggagttcaacacttcatcatataagctgtaaatattaacgtcaacgtcaggcggagctttcccagtagaattactgaaatcaagctttgatagagtatcttctgggctcggagaactgacaatacagttgaccagtattgtggtagcagcactccagtccagttgtagcaaaaggttgggtagcattgataggtcaaaacttttttctctattttcaaaattcaacttctcattcaaagacttggcaatcagcccggcaataagaattgaaatgtcgttatcactagactcacttaaacctttcataaaccttttgattagaagagaagctccaggaaaatgtgggtcggaaagtacttgtagcacgtcttgaatcagatattcaagtttactcctcaactttggatggtccactacacgttccatcaaagttgcaaatactatttgtagaatattctgaatttcatcgtgaactttagtcacttcagacaaactaagctgcctaaaatcaagagtttcaacttgaatcattctaataagggtgacagtgaaaacatctagtattacactctgcaccctgtatactttggagtttctctcatctagtttgtgtattgcatagcagaattctgtgagaataaactctctctgatctgggaaaaacctgaaaatagatagtagtaggtcggaggcagcaactttcaaagggctaaatcgtgagtagtccattagaagatttttcctcttatgatcagtatgatgagttatgattgtgatgcaaacgtactcgagtctggtgaaaagatagtcatcaagcctatgattgacgcagtatattgaaagtgccactattgattgtttgcataactcaaaaatcagactaaagctatctgtagtcactgtagattcgccgatggatagtgtacttagaggttcaataatgtcttcatacttggtacaaaaaaatgtcactaaacttttgagacaagtatccaagtgcaaaagtttgtcgttatccaggtttaaaatagttaaattgattagaagacaataaaaacctttgaatgtcaagtcccagtcttgttcattctctaatgattctgttattagttgtagagttgccttttgaacgtttcttaatacctgagtatctagtttcagttctgcacgatttgtatctaattgatacaagagatccattattctcagtaaatgatggtgttccagatgttcctccaaaacgatctcttgtaaagtagaaatgatctcctgtgtatatttttcattctcctgatccggttgaaaaatcaaggaactagagcttgcagcaattgtatcttccgtggctgtctttagctcaagcaagggctttttagtgaaatagagctcttttacgtcaataggttcaacgttcattttgagtctcttcaccttcaatttgggtttcactattttagggctggaactccgattatacgtctgcaaaacctgcctaataagcaaattatcacgatgaggctgtccagagttgcaattaagctctcttgatttgactataggtttcctaaagcgcaatccttccaattgtggatccatatcttgaatccgatgggctgtcgtctggagaactgagtcctcacattcgcatgagaagtgactaacagaaggcccccctatatccacttgataggggctcgccagcgataccatatcctgaagagcaactagtggcacaggatagttcaccaatactgatggcaaatccatggaggcacacaggagtggatttgatatcagcaggtaacggtgtcgagcgacagaggtgcgcagatcagactcaccttcaagaaaatgccctctgggcggaaaccttgttccctcgaagatttcaatcacctcctataaccccaccattatcagtcatgagctgtagagttttcgttccttacggaataacagagactgatcccaaattgatcagcaaatctaacaaagaaaaggagggtccatggtttattgagaatataattttgagacaaattccatcaattcaggagacactggtatcctgtaaagatatgatagttgatgagagcaacgagataaagttacctatttcatccagaaactctgatgtaatcaaaggagttattatcagaaaacagtgtgagatagtaggaatcaacttgattttgaagggctttcccgttaagcatttggagttgaaagctaatgagagagttgttattcctcagttgaatgacggagtgcatgaaatcgatcaggcattgattagtatcgaccgtttgtttcaactttatagtgatggaactcactttgaacgctacttggatgttttaactgagtttcatggacatatcaaactagctaaggatagcttgaaactgccatcaccagattatttgttccctcgatacagaaacgtaaaagctttggagccagaacttccagttagcatgtccttagacttttacatcaataatggagatatatgtctggaaatcaacaagttgcatcaatcccacgccgtcccttggagcattattgtcaacaagaccaaaagacaaagttttgttgatgttgtcagaactcaaattagcaaaaatcgggaagactccataaatgagattgtagacatggagtacaagaagctactaaggtggcttgatagtgagagtggcactgctatcgaagatgacaataatcatcacaagaagtcattacagggaagaggtgttggcggagtgcttagcggtcttttcttcaatggagggtccagtttcagaaattgcaataagtatttgcagaattatttgacgtatttggacaacgataaccaaccaattgttgttatggtggaggaaaagtttgaagttctgagctcagaccctatccttattagtacaagtacaaagttggagaccctggagcgcgtagttgaaaagatgatagaaaatttccaggtggtcaactataaagataacagataagatttgcaggcaaaccaagaaagagcagtatttggctggatcaaagcctattggtttgtttttcacgttgaggccactgagtgttgagtatacggtgtgaattgacactaataaacaattgaggaactgagaaaaggaaattgacaaaataggagatatgggaagccaagtgtttgattcatgaatattgttcgtcaacgcaaagtattcatgtattcatctatttcgaacaatgtccttcaatgaattgcaaaatattcacttattcttgtcgttcagcctttcctccgaaacagttttgaagcagataatttacattaatagtacaaaataaatatccaatacagattaaacatctcgtttgtcaaacaaactcgactacatgacctcaatcttctctaatttcctctgtatgtttgttttcttgcaagctgttcctctcctgcacttgatattctagctgccgccttttagatcgaagtagctccaatctggaaggaatgcccgatgataatctttttttcctcaacgaactaacattctctagtcgaattttgtttaattcacactttcgtatcaggctgttacgttttctttcaagcttgaccaattcatggtccagtcgattgagtagcagaacgatattcggctctaccgaatgtcgcagagttttttttgattgcagtacatctgcttctgggatcaacccaaataccctgttggtcttgagaatggtagataacttgggaaaagaggtagtcgcccgactcaagacttccgttgaagaatccaagagctcaacggaagcctctaacgagttgatacagctttccagaaacatcaatagggctcaatgatcaatctttaggcgtgataaggaacactctgtatttacttgaagcgcgtatcgagaagagaaaacataaggtaaggatgtttgtaacaccaaatctagaagtataacagttctacaattgccaatacaacttcaccaattgatcatatatacgttgatgaccagaatgtaaacagtttcccataaacacaaaagaaatcggctggctgaggaaacaaaaaatatggggctttttatagtcttgagatggcaccgcctggcgaagtttccgttctgccagtgagaatctccacaccatcttccgtaaccaaaagggtatgttcaaattgggcacttggtcctccatcagcggtaacggcggtccagttgtcgggccaaaccacgtcacgatgagtgcccagagtcaacattggttcgatagtgaataccactcctggtttggctactccaacagctttgttacgagcgtaatgcggaatggttggttcagtgtggaacaaagtattgataccatgaccagtgtaagaacgaacagtttcacagcctctttcagtcacatagttttcgataacagtaccaatttgacggaacggcatgccgggtttcactaaacggatagcttcagcaagagcttctctggttgtctcgacgaggttgaccagatctttgttagtcttggccttctctccaacatagtacgtttcattcagatctgcatgaaatccatctttataaagggtaacatccaggttcacgatgtcaccatcctggagcggtctacgatcaggtataccgtggcagatgacttcattaacggatgtgcaaacagatttgggaaaattgaagtaatttaaaggggaggggtatgcttctctcttgattgtttcactatgaacgatttcatctatctcatcagtggtaactcctggtttgatagatgcagccgcagcatctagaacctctcgtgctaaacggcaaacattttttagcttggccaggtcttctggctccgttaccaaattgatcttgttcattctgttatttttgatttctgagactggtactccatcaagagcataatctgggagagtaatgttctctggaacctctcgtctcacagacaagggatatgctggtctgagctcaccggtgtaggcaaagttgggaaaggggttgtacgaaccatctatatcaccatctttggcgtgaaccgctttgtggatcttccatccattcttgaaacatttttggttacaaaaatattggatctgaccttgttttagacacaagggacattttaaggtagattcagtcgcttttgagcactcagcactagcacagctgtgaatcatgaagttttttttctgaggtagaattgatttctttagcgcgagctcttcaccagagaccatggccgcaaaaacgacagtacaccaaggaagttgaagaagcaacctcttcaagcgacatataaaaggattacagctcagtagagatcttaaattcttcctctttactcaagttttttactacaatatgaatgtgtggtaccgcttttatactctgtaacgctccccaattacggaaccatattagtcgggatcgatctatgccaactcttaaaacaaacaactcggttatcaatgcatctaatcttttcctggtttcctccgaaatatctcccagtggtgaatgaggatctggagggatctcagttttcagccaagctaccaagtgaaccaaatccggtgtaaaaaagtaaggaaactgattacgttctacatggtagggtcgagacgactctccaaagtagtttccgtcatctcccttgtgccacttcaatttttgaagcacatagttctcaacagaactgccttgataaatgagatgttgtttgtgcatgtcgtagcatttcttgcaatcgcgtgatcgataaagcttgtcaatatcatttctatttactatttcaattagttgatcccaggatataggcaaagaaccaatcatggaaggtgtcggtgatgatgagtttgaaataaagagagtaagtcaggttccaatttctcgaagtcagttagttagcccgccggaaggaggtttggagggattgagtttgtgcggcgaatccttcaaatctgccccctaggatgatcctggaaaggagattcatcactacctcgttttttaaatctttcttcctctcttccctgaccatctccttacagctatcccacaatgtcggaagttcaaattgcccctaaagaagtcatatactgtgaagtttgctcatttcctccggagtactgcgaatttggtggaacgttcaacaaatgtaaagcatggttggaaaaggaacatcctcagctatttcaaagtctctacagtgcagatgcccttgcagctgccacttcgtctctttcgttggaaaaagaagaaaagatttcccaggatttgcagaagaagcgtcgaaaggaggagaagaaacaagagagagaattacagcaaaagctggcatctaaagtcctgataaaaaagattgctagaactaagaggaagcaagtcattgccatatctggcctagaagttttcaatattgacatgaagaagttggcaaagacttttgcgtcaaaatttgccaccggggcttcagtaactaagaatctggagaagaaggatgaaattatcattcaaggtgatgttggtgatgaggttgaacaatatatcttggagttgttagaaaaggacgggctaaccgaagtcaaagtggaacaggtcgatgaaaagccaaaaaagaagaagcctactgcgccaggtactggtactggcaccgctacttcgacatagttaaagtaataagcatttggcgacacgtcccaaattaatgacttactcattctctaatatttgtgtgaatgttcaacctaaggggccattgtacgttaattttgtagattaaagctattagagtaatttctcagtctagagatgactatcactgttcctcctgatacttttttctcgcgctttaactatccttaacattagtagctctccacctgatcaattcaatggaaattaactctaggaacttactgacgatagggatacttcttcgtgtggggtttttcatttatggactgtatcaagattctcatttggaggtaaaatatacagacattgattactacgtgtttacagatgccgccaaatttatcgctaatgacagatcgccctatgctagagaaacctacaggtatactccattgctagctcttttgctactcccaacaaccttggggggattctattttcaatttggtaaggtattgtttatgctctttgatttgctcactggaattctgattcttagaatcctggagttgacaaagacaagagagagaaacagattggttctcgcaagtttatggctactgaatccaatggttatcacaattagcagcagaggaagctccgagtccattttgagtgcattggtcctagcctcaatctattcgttactgaagggaaatatatttgcctgtggactagcactggggttatcaattcacctgaaaatctatccaattatctatttgcccacaatgattgtgtttttgagtcgggatggaaaggttgtgaaaggaatgaaagaaatgagtcaatattttacaaaggatgccatatacttggtgtgtgttgctggctttacgtttagttcgttaacagttctaatgttccatctatatgggatggcttttttgcgagaaacttatatttaccatttcattcgaattgatcacaggcataacttttccctttacaacactgcattgtatttcgtctcttctttggagcatcaagggctcaagggagatctacttagttttgagaaatgggctttcattcctcaattagggttttcagccgtactgattccttggtatttgaccaaaaaagatgtcacatcaaccttttttattcagacatttgtctttgtcctgttcaacaaagtcatcacttcccaatatttcgtctggtacctctgtttgcttcccttttatttgagacaatacagcagttggaaacaatggcccgaatgggccggtttagttatctggtcagcttcgcagggtctttggctttatttcgcttaccaattggagttcaaaggaagaagtactttctatccacagctttttggagcggctagtttgttctttgctggaaatatataccttactgggctttttgtaaaaagaacgaagtcgctcagcgaggcagatcaagataaggagaaaaagcttagataacgcagaaagatacgttagacgggatccagcctgatatgccacactataaatatcatcaatgcaaatttccgtaatctcatgtccttgaagacctcagttcatcttgcctaatatcttcaacatcgcgcgctcaagaaaatttctcccttgaaatggaactatactctccagaaggtctcagagtagacggtagaagatggaatgaactgagaaggttctactgtcgtataaacacccacccaattgtagcagatgggtctgcttatgtggaagctggaaatacaaaaattgtgtgtctactcaatggtccccatgaacctacgaggtctcaaatgaacacccaaaagggatcactagacatcaagttgcatgtatcacccttcagtacaacagaaagaaggaaagtcacacgtaatgacagaagaatccaagaactaagcactattttgaagaatacattcgaacaagtggtgattttgaagaattatcctcgcacaataattgaagttaacgtcagagtactggcccaagatggtggattactagctgcttgttgtaatgctataacattagctttggtagatgccgggattgctctttacgattatatatctgccgtgtcggccggcgtgtttgataaccaaatcctgttagatttaaacagattagaggagcaagatctgtcctctgtaacaatcggagtcgttggtaagaccaaaaagctgtcattagtactgtcggaaaccaggctaccacaggatagactggctaaggttttcgaagtcgctgtgaatggatgtcatcaattgaaagaccaaatggatgcgcaagttgcaaaaaaaggaagggagaaggccatcacggaagaattgaaaactaactgggtgcagtgaaatatgatttatgttccattttccttcttgccaatttggctggactttttctccctgtattgtagaattagaaggtctctattatgagcctccaatcttagtttcatcaaatcatcgtcaattagatcttgcttcttgaataacgttctacactcgggacaaaagccagaaccttgagattgttgcaagaactctaaaatatgagttctttcgaaacagtggccgcacaccgttatcttgacggggtttttcatcggccgtttagatataggacaaattagactaaccttaccccctgaaattgccacgtcgtcatcctctgcatctggaagttcagattcaggattcagcgtcacaaataaatgttcttgtagcagttgtaatctgttgtttgcggtctcaaaagttgctgaatcaacttccaatgtggacaatagcgattctaattgatcagcacaactaatctcctctctttgatctctcaacacgtccagattatccaagctgacctcagccgattctctgtagttgattcttttttgcgccttgatagcagtcagcgccacctgatatcttgatcgttctaactcttcttcagtgatttttcttccagaactggtgaactcatcgatgaggttcttacaatctttctgtatactttctctaaccttttccaagggatcatcgattagttggagtgcctccatttctagcttattggagatgaacttggaggcagtttgttctagctgatccgtgtatctagaaaccattgatctgaactgggtatcatagagattgactttcgataattcctgttgagcctctggaactagtgggaaagacgtcggaagtttaattgcgctcaggcctgctaatcccccatttccagtgggttcagttttcatagcgtggagtagtgagttgtaaacaggtaaagtgtacagtagttatttcgaggattacatattttgttggaaaagcacccacccagaaatagagaatacaaatcattagtggcacaatgacggccttaccggtgctgtataaggtaataacattacagaatctacactctttgtatatacaatcgtatcaaagacaggagaaggagatcactcttgatatggataaacttcggtcaaacataaacgctagtccgttgatagatccagcctacgatctatgtcagatagacacacaaaaagttcataaggataaccagactagccaagtgattagtggcgagcagattgtcgaaataatcaacgaattcttttcagaaaatggtggccaagcattgattcctatttcgactaatgtgttcaagatttcagaaactatcagcataaatacgataaaggatcgacttattaaagtcttaaaccattacaaaaacacaactctgagagaagtagcagctttggaggcgcaatatcacctattaaggacacaaaaagagaaagtaattgcctcagaagtattgaaagaggatgaggatgagtctatagatgaagttgaagacaataaacctgaagaagcggaaaccgccaggaaagattacaaagtggatgagcctcaggaggagcagcaagatgaagatgagaagagcccagctccaaaggaaccatctaaaagtgaactgagcactggtggtgaattttccaatggcagtaaggaggaagagaatatggaacaggcggaaattttgaaagaggaagacacttctgaagagcacaaagagaacaaaaatgaggaacctgttaaggagcttgaggagacggaaaacacaaaagatgagaatactgagaagaaagttgaaagtacagcagaaagccaaatagaacaacaacatgatattgatgtcaagtcagagaaagcagatgacgaaattggtgaaaagtcagatctatctgaaaagacggaggaaaatcattccgagaaagaagaattagtcgattcaaccttcaattctggaatacaaccaactgaaactaccgacagtgaccaacagatggttgctgataggactaagcaagatcaggcaattggtgagaagaaacccatagataacgactttgatggtgattcttccagtaaggaaaaatctagtgaagtaatcagtgagacacttaatggtgaatctagcccagaaaagtctcaagaggaggacaataatcaggaggcaaatgctacagaggaaagcccggaggaacaggagggtcaaccagaagaatcacgggcagaagaaaagttgagtgtggaaactactgatgacaagagtttgcttgaccgagaatctccttctaaagaatctgaacgaaaacgttcccatgatgcagatgaatcagaacaagagatctctccatctaaaagacagaagaaagaggatacacaaaagtccatcaaaaagttccaaacaattgcatcaaatcttatctcccaaatctcctctaataggtttgcgtctacctttttggcacccgtgaacaaatctgaggagcctgaatattacaagattgttaaacaacctcaagatctgaagaccattctcaagcactgcagaaatggggagataaccacctttgacgaattgactaaagttctacagatcatgtttacaaatgccatcatctataacgatgaagacagtgatgtttcgaagctaacgattgaaatgatggaagaaactactaagattatagagctgttcagagaaagtctggattagtcctggacaatgaactttatgtacaaaaatatggggttaacgtcttagctgttgcatcataagttggttttgttcttggaaacgttgaccaactctctcactgtgcttgaggaacttttctgcacacttgttgatgcagccttcctccttagaagtcaacttgttagatgtaaaatcattgacacagtctgtaaaacatttgctaaccaaatcggagtaaagacgcatgaagtctttcatttgtttttgttcaacgagtttctggaactcttgttgttctttagcgttcaatgcgtccattttgtgatgtacttggttggggtagagttagcacttgctctctctgttaccagtttttgtcaagattgaagaaaaaagttttttggacggtacacgtcgcacctatccttcgcattgatccactctaatgagttaacatcaacctgatcaaagggatagatacctagacaatggctcgcagttatgccgagagagcaaatactcatcaatcacctgtggcacgacgactgtttgcgcttatggaacagaaacagagtaacctatgcgcatcagtcgacgtgagaacaactaaagaattattggagcttctagataaattgggcccatttatctgtttggccaagactcatatcgacataattgatgacttcacgtatgatggaactattctgcctttattggaactatcaaagaaacacaagtttttaatttttgaggacagaaagtttgctgatataggcaacactgtcaagcatcaatatcaaggaggtgtctacaagattgcacaatgggcagatattacaaatgctcatggtgtcattggtagtggaattgtaaagggtctaaaggaggcagccactgagacaacagatcaaccaaggggactattgatgttggctgaactgtcgtcaaagggatcaattgcccatggtaagtacaccgaagaaactgtagaaattgcaaaatcagacaaggaattcgtcattgggtttattgctcaaaattctatgggaggacaagatgaagggttcgattggattattatgacaccaggtgttggtttggatgacactggtgatgctctaggccaacaatatcgaacagtgagtcaagtattttccactggcactgacatcataatcgtaggtcgtggtttgtttggcaagggcagagatcccttaaaagaaggtgaacggtatagaaaagctgggtgggaagcttaccaaaatattctgaggtaaattacaagtatgtacaggggatcaattgtttcgggcgattcaactgaatcgatcttcaatttcatcgctcaatttttgacgcagtatttcaaacaccagaagccccacggatgttgctggaatggtagttaacgcattcctaacgaaccctttataaaaccagcgggtccaagatagtttagacttctcatgtaagctcaccaactggtggaatgtatctaagtatgatcggtaatatagacggaatttacttttcttatcccaggagttctcgttgaaaatatccaacgcttccaaccttgctaaatgtattgactgaactttagaaaatgggtattgaacggctagtaacgaacatgcagcgctagcaccagccaaaagaataaaagtcgtcctcaggatattttcacttttcgttttcactgtgtcaccttggggccttccaagaagactatttttcatcctatcaattctctccatagtgttctcggttatcctgtaacctctattcttaatggcttcgaatgttgtgaaatatatagcaaaggatgtgctttctttgaccagactcaaggagtagccagcaaatacccccagaaaaccactagtttttagtttatgaagaccgtaaatccataagttgtcattcttgcccccaataatctcggaggcattagatcgggcatatattgcatcaattggggcagctaccaatgactgcgcagctccagctagaaacccagctcgaaatacatccactagtcttggatttgctatcgatctgccctcttgaccgtcagtatatgactgcaaacatgataaatacgttgtgtaaagtacaattcccatcacagaattggctaccaatggtggcaggaccttgtttggtatcaactcccaaccatgggttttgacggctcgtaacaatagagctggatttgagtgggaaaatgggctgtaaggtttacctttcaaatgagctccaaagaagatgcgtattggtgccatgtagtcaaaacgagtgggacgaaacagtttggctggtgtcctcaggtacagtgaactaaattggactagaacagctctgatcccagctgtcgaagcagacaccacttgagtgtttttgttgctaagagtagcctttttagaatcatcgttgtcttccataggtttctggaacacaatgccagagttcatagaggatcagaggggaattgaggtgtgtgtatatgtatttataggggtaccttaccctggactttcacgtattcatgtctatctatcgtcgcgaaaacggttactatgaagaaattgattacctcatcaatatcagatcgatctccttgagtagttggagtaacttttccaagcaagtttccaatctttgctctgaaggttaccattgttgatgtcaaaattgtacttttccagcttggatagatataactgagtgggaattgatgacatgaatggaacgtagagaacatcaggcacttttttagtccaattttgggccctagattgcagaaactcattgtgtgcctggtccacgtccaacacctgacagatgtcctgtttcagctggtcaaacttctgacgtgctgtaagaatatggtcattggcagttgttgcaacgtcgaataccacattagatagttggtccgaggctcttgccaaatcagaaccctccaggtatccatggaaaagcctcaaaagctgttcctgtgacaaatcatgcttggccatcaagtccaacggcaggggaatatgattttgtgttgtagcataatactttaatcctatcaacatagtggcaacccctgtcgcttgacctagatgggccgccacttcagttaaatttgtctctaggaacggggcctgctccaatagttcaacagcagatggggagatgttaggtgataatagtaatcgctgtgttaaataattgctctgtgaataaatgccttcgccataggaacaaacttcatccatgttcttgaaccctaacttagaagtgttcttcaagtaatgcaatctagatgtcaatatctgttgaaacatgccaatgtccaagtttaactctttgttgataccatcccgtaacaaagtagccaccggttcacccaaaggcttctggtacccgcctagaaacactttttgaagtaattcctcccaaaatttgaatttgacgtcaagtaggccaacccccacattagctcggaattgactgttggctcttgtattggaatctgatatcttgttcacttccaatagaaagcatcgtatcgccatccaggtatctcttgcaggttctggaatgtaatgagccaataggtaacttgacttgtcaaacttgttcaacatctcggtgcaatctgtccttgctttcatcacagattgtctatattgtagatctggtggggacgtgaactgttggtggacagcatgaacattcagcctccttgcagcggcgtgaaaccttctccttcccaacatgctaggatatttctgggtaggaatgtctagcgttgataggtaatcaagtaaaatatactcaagacggagaaacgagtctctccgaagttgcttacttttcgcttccttactggctagagtctggaaagaaatccgatacggggggctaccaggaaatcttgcgcgagctgaaggatcatctctctctacaaggattgtagattgaagggtttaatcgcaaatgtttgcctttctagatgtcactatcggaggcagcaagattggcagaatagttttgcagcttgacaatgttaactgtccattggcttccactaattttttgaatttgtgcaaccaagtgggaaagacttttcattcgaaagagtatggagatataaagttaacctatcaaggaataaggttccacagaatcatgaaaaattttattgtccaggccggtgatcttgtttttggcagggacgattcattcaatcaggaacaggtgggtggtggaggggtttccacttacattaatgatttgagtaacaacgaaaagggccctatctatggaaagtttgatgacgaagcgctggacaataatccagtaagtaaatttgaccgtcctttcgttttggcaatggccaacagcggccccaatagtaacagttctcagtttttcattacaacttacccctgcccacatcttcaagggaagcacaccgcatttggatctgtagttcatgggaaatctgtagtgagagacattgaaaaagttgacacgaccaaggaaaacaacagcccgcttcagccagtggtcatagtggcgtgtggagagtggaaagaaggagatcctgttcctgttttcaattgctctaacagtcaaatcgggggagatgtctttgaggaatatcctgacgatgacgacaattttgacaaagattctcttgaaaaggcattggaagctgtcgagataataaaagaatctggaagtctgcttttcaaacaaaatcagatccaaaatgctttattcaagtacaaaaagtcttatcgttatctcaatgaattctcccccgaccaagatcaaagcccccagttatacaacaggttcctagcattgaaaaagaaattgtacttgaaccttagtcttgtttattaccgactaggacagttctctagagcgagagattatgccgaatatttattggagatggaggacaaccaagcgataactgataaggatagagctaaagcatttttcagaaaaggattggctcaaattgcattgaatgattttgagaatggtttacacgctctgaaagctgctcaagacttgactcctactgattctatgatctcaaatgaaattttgaaggcatcgaaatcttttgaactattcaagaagagagagaaaaataaactggaagctttttttaagtaagatttattggttgaaaaggatttcagaaagaaacgcactttttggcattggttaaactataggtcctctgtttgctgaggttataaagaacgtgcagcgggctgatcgcttggattgttgaagcattaattagtctgtggactagaggattctagctgttaaagatcttttctgtgtctcgcattaatttctaagcagaagcggtggattacaaatgcaaaatccgaaaaattgtcgattgggctccattcgtatctaatcagtgctattcctgttctgatatgtaccgcttaccgaaaaagccactactagaggtggctattgtttgcacatgacaaagtcacagaaatgtccacagataatctttgtctagatatagcgtaggagcatcaaataagctgggaatgggcatcgctaagccactattcacgatgcacgaattgaccgggctttcagtgttgattactaagtttaagtttaggtttcaagtgcatgcaaatagacttcatgcagggaattaaagttacatatgcgccatctttaaacggtttacgatttggccaagtaggaggaaatcgaacagtgtgcaaatttttatttacagccaacgtctttcatcattctttcaataagggagcttagtatatgtcatagttaacactcagtatccttggaaaatagatcaagctctgcatttttttcaattgattaataatactaaaggacgcacctaagataatactaacagcttttgattactgcacgcgcccgcgcacagtctattaacaaaataacgcaactgaaaggcattattcagatcaccttattgttaaggtcgaccccctgaattattgtggaagtatcgcctgaaacgaagcctcataggttgttccgtttgaacttggagtctctatctctagccatcatcgccctttgatctcccaaatcatggacctcggtaaaaagatttattacgtaatcattttattttgggaacgtgcagatgaacggaagaacaagtagctgagttcaatcagtttagaccgtaatgaactgttgagcctttcaattcggatgttcttgcgatcatcagtcccgtgttttcgtgtccttgaagaattattaaataaatgttctgcatagcgcttgtattattaattccaacccataaagacgttataccatagcttactaatgatcaaaagcggtccatgttatcatcggtggtatataaagatcggtatcccttcaacttttatgttagtcactgtaatttcctgatactttaaataagatgactgtgcctgatctgaaagaaacaaaccttttcaagccaattaaggttggtaacgtcaacctgacaactcgagtcacttttgctccaacaactagaacccgggcaacagatgattttattccctctcagctacagctgcaatactatggtgaccgttcaaaggataacggaggtttgatcataactgaggcaacatttgtttccaagcaaggaggtttatatgagaacgtgcctggtatttggtcagagagacaagccaaggcttggagggctattacagacaaagtccacgaaaacaatactgccatctcggtgcaattgtggaacctaggcagagttgcttctccaaaattggctaaggaacatggtctgaagttgttgggaccgtccgccttttacgaaagtgaagccagtgaaaaggcagcccaggaggcaggcattgagatccaggctgctaccattgaggacatagagaacttcaagaaagagtatgttgtagctgcgaagctggcagt

SEQ ID NO: 107 - DNA, 703929 bp, Pichia pastoris
ggaccatccgccttttacgaaagtgaagccagtgaaaaggcagcccaggaggcaggcattgagatccaggctgctaccattgaggacatagagaacttcaagaaagagtatgttgtagctgcgaagctggcagtcgaagttgcgggatttgattttatcgaagtacatggtgctcacggatacctattcgaccaattcttgcaagggaaaggtgtgaatgaacgaaccgatcaatatggaggtactatcgaaaacagagccagatttttgcttgaagtgattgatcttttgatcgataccgttggggctgaaaagctggcagtcaggctttctccttgggcagaagtccaaggttccgctggagttaatggcgaccctcatccaattgttctctacggatacgtcctttcagagcttgaaaaacgggcaaaacagggaaacagattagcatacatttcgattgtggaaccaagagtgagtggtgttactgacgtctcagcagaagaggcccaaagaaagggtattgccagcaatgatttcgtccttgacatttggaaaggtgtggttgtccgttctggagcctacctttcaaccccaggatttccctctttgattaaggatgtcaatgcgaacgacagaacgttgattggggctagtagattttggacctctaaccctgatctagtgcaaagactaaagaacggaaaaaagctgactccttatgaccgaagcactttctacctccacactaactatggctataatacatggaagaagtatggggacgatactgtggtgagcgaggacgacccagaggccaagaaaactcccgttgcgctggcttgaaaaatgttgcagaagaaaatcaacgtttcagccttaaggggtaggctagagctgcatgtcttgaatacatagaaagctcgttttataaaggtaggtaggtaatcgttatacaggtaaactatgaatattagatatatctgcagagtcgtgttttactcatttgtcacttaggtttgagggtattttttctcttctagtcatctacgacagctgttagtcgcaaagaacaaaactgtttaactgtacacttttgacccctttgctcagaaaaaatcttttcacaggttacagattctattctagatttataaaatcagtttcggaaagaaaagtaagggacatgacatcgcaagagacaacagctttcactttttcaagagagaagttggaaagtgttttgaaacgaagattcttcttcgcaccagcttttgaaatttatggtggtgtttctggtctttatgattatggtcctccaggatgtgcctttcaggccaatatcgttgatgtttggagaaaacacttcattttagaagaagatatgctggaagttgactgtaccatgctgactccgttggaagtcttgaagacatctggccatgttgataaattttcagactggatgtgcagagatttgaaaactggagaaattttcagagctgatcatttgattgaggaagttttggaagctagattaaagggtgaccaagaggctagaggtcaggttgtctctgagggaaaatcagacgataagaagagaaagaagaaggtcaaggaaatcaaggctatcaaactggacgatgatgtaaaggaagagtatgaacagattttggctaaaatcgatggctattctggtgaagaaatgggtgaattgatagtcaagcacaatatagggaaccctgctaccggtgacccattggaacccccaattgagttcaacctaatgtttgaaaccgctattggtccatccggtaacctgaaaggtttcttgcgtccagagactgctcaaggtcagttcttgaactttagcaagttgtacgacttcaacaatgagaaaatgcccttcgcctctgcttccattggtaagtcatttagaaatgaaatttctcctagagcagggctgcttagagtaagagaatttttgatggcagaaattgagcacttcgtggatccagaagacaaatctcattccaagttcgatctcgtcaaggatatcaagttaaactttttatctaaatctactcagattgaaggtaagacagaatgcgccatcaagtccattggtgaggctgtttctgaaaagatggttgacaatgaaactttgggttattttattgctagaatctaccagttcttaattactattggtgtcgatccttctagactgagatttagacaacatatggacaatgagatggcacattacgctcaagactgctgggatgcggaactgcttacctcttacggctggattgaatgcgtaggttgtgctgatcgttccgcttatgacttatccgtacatgctgcaaggactaatgaaaagctctgtgtcagagagaagcttccggaaccaattactgttgacagactggagattgatattgagaagaaaaaatttgggccaaagttcagaaagaatgcaggcgctgttgaaaaatggttgcttgctagaactgagtgtgaactagaaactctacagaaagatttgtcgacagatggtaaaattctggttgaaataccaggtattgaagagaagattgagttggatgattcactgattcatattgaaagaaggactagaactgaacatatcagagagtacactcctaacgtgatcgaaccttcattcggtattggacgtataatctattctatttttgagcatgctttctacccacgtcccgatgatgctgacaggtgtgtgttgaagttgccacccattgtagccccaaccaaagtgttgcttgttcccttgcaaaccaatgccgagttcaagcccattgtgaaggaaatctcccaagttttacgtaaagaaaagattcctttcaaagttgatgattctggggcatcgatcggtaagagatatgctagaaacgatgagctcggtacaccatttggtatcactatcgattttgataccatcgctgacggaacggttactctgagagaaagagattcgaccactcaagtcagaggcagcgtcgcagatatcgtaaaggctatcaagactattacatacgatggtttatcctgggaaactggcaccaaagatttaaaaccttttgagagtaaatctgaggaatagtttatatactgaaatgcactatgttccctcttagttcctgattgatgtaaaggatggaattttgctgccagctttatcctttgtccggtttctcagcttttcttccccacctgcgctctccgtaaagggcaggaagatcgcgcaaggtatcatcgatagtggactggtcccctccactcccctttatgtggcaggcccaaaataagtttctatgcatggaagcaaggtagccctgaatccgctctgataatcaaacaaaccttataaatggtaagcttgcgaaatgcgtttgcaccctttgacctggagatgttgctgaaacattttgagagatcatccacgttgcacaacctgttttcaatggtaactaaagcactgattctgatgatcccgtacctgctgcatatttatgggaatgaagccatcgtgaaactcggccagtttcagcaatttcacactggacatggtgaatacttcagtacattgccccaaattctgtcagtatgcgccaccatgactatcggtctgatttctcttgtctgtttgacgatatttcatggattgtgtcagattgaaaatctcaagaagaatactaaagtagttagcatgctgctgaggcaactacttgattgggagtgaagactgttggtacaaaacgtcgcaaaaaattagaagattgctgatgatacaacggaaaagaagcgtcatttctggtaacaactattcaacagctatgttgagcaagattgcagcagtacttttgaaacctcatcactcgccttggagaaccagcttcgtcattgatgaagaatcgttggatcactaggttcctttcaattgctggctagatgtcagatgttggataggggttctcaaaaaaagaataaataaaaccaagagtttatacatcgtactttcatagaaacccataagtacgcactagtgtctcattctgcgcattgactccttttcaaaccctttcccagctgttactgttcgtcacgttcgttttgttaaacctgatttttttgaaggacgtgtaccatactatatcttgaaatcaaaatcattagagagacattcttttatttttgctttattaccaagctttccaacttctcaaccctctgggcccacttctttttcacaaagtccagctatgagtcagggaagcacgccgcagaaaagctatcctcaaaggaggttttatgggataagtgccttgcgagactacaaaatagttggaaaattaggtgaaggaacctttggagaagtttccaaggcgcttcaaagaagaactggaagggtttgtgccttgaaaaaactaatggttctaaatagcaaagatggatttccaattacttcgttcagagaagtgtctatcctcaaaaagctcaagcacaagaacgtccttcaacttgttgatatgatttatgaaaagccagagaaacaggagtctccaggtatattttacacagtctcgccgtacatggcgtctgacttgactggtctcttaaacaacccaagagttcatttgactcaaagccaaatcaaaggtattgtttaccagatgctggagggcattaactacgttcatcaaaatcattattttcatagggatataaaggcttccaatattcttatcgatagtcagggaatagtcaaaattgccgactttggattagccagaatatactatggtcccaagcctacgccaaacgggggtcctggtggctatgacagtgctactggaatggggctagcgtcatatactgggttggtcgtgacgaggtggtatagacctcccgaacttgttctaggagagaagaactatactacttcagtggatatatggggaattggttgcatatttgctgagctcttcaaacggaaaccaatattggaagggaaaaccgagatagatcaagggcacttaatcttcaacctttgtggtcctttgacccccacttctttcccaaatgcagacaagcttcctggttataataactatgtatccgcaaggtatactagaactttagagcagaattatagaaagcacctttgttcagaaggactccgcctgcttgcttcactgctggaaattgaccctgtgaaaagaattaatgctctagacgcattggctcatccctattttaaggcacatccacatcctgctcccaccaaaagattagctgactttgaagagagccatgagcttgatgtaaaacggtttaaagaagaaagaaagaccaccgatctccaacctcctccacctcaacaaaccagagggtttcatagcgcacagcagggttatagaaaggacagacgtttaaacaatcatcatcaaaattactccaatggaaggaatgccaatttttttccttctggacccagaattggcagatctgcacaatcccaatacacacactccaatgatgaagctaaccaacataggacaaactacgatcactcaagaaaccaagacagacatcggggcggttcatttaggaaatcaaacagcgtaacctctcttacgtcaataaatccagaaaccgatacagcatcgacacaggtggtaaaatcgtatggcttcgtcgggttatcaaaaggcaagaaccaggaaacccgttctgagattgttaaaaaaagttcaccaaagcatcaagagtcgaatgaaaatccggaataaaattgtagatatataatgtattacgacattgttacagagaatacaaagtttcaggttcaaagtgaaaaaataatgatttggttaaaggcaaaaaagaataacaattacgccctacacgggactcgaacccgcagtctcccgattaggagtcgggtgccttaccatttggccaatagagcgataaagctattaatttttttcgctgcctactataaaggccactacttttgattctgcatttttcaaatcattaaaaccctatattctatcttgctggatctagagcgtgatattaatcattaccacaaaaaagtagagtcttcttttagggattttcttttcaatatttaaaatgttcttggttggatgacttgtaattcaatatatataaactaaatactataaactccatgaaccatgtttactccttattattttaatttacaaccatctaaagggcaatggatcgctacttagacctactgaggcaatgtcaatttcatcgttgcaatgcctgcacctatcgttacccatttgtagcatctgttctacgcaatcagtatgaaaagcatgcttgcaatagagaatctgacatttctgaccttcctcgtagttttcctcacagatgccacattttgcattgatcttattttcggaaatgttgatatctttaaagcagcaaaccagttcctcagttcttctatcaaaaaacctgaacccacctgtgaataagcccctgtgttcaaagcggactctttggagtaccttggctgtaaaacttggttccctctttgataaaatcttatctgcaaactcctttactgctttcgtattcttttcgtctttggtgtcatagcgcaattcttgtagtgttgaaagattatcaatttgaatctcttcaacacttcgagttctcaaaatgctgagcttcttcaatttgctaccatcatgaatattgataacttcaacagcgctattactgatatctaacgtttccaaattcgggaaatttccttctagccttctgaaacctgtattgttctctaacgtgatgcttctgatagaggagtcattaagggaccatgtttccaatgagttatttgaaaacttcaattgcagaagactcaaagagtctgactcaaagcgtttcaaagcgtagcagccagtgaagtcaaccttttcgagtctaatgcagttggataactttacagtttcaatgttagagggtcccaagacatccagcgccttcaaggcgggcatgtcgtcaactttcaaaacagttgcatcgggatcgctgcaacccaggtgaatcaatgatttgctgtttgaaaagttaaaaccctcagtgttggaattgaagacatccaaatcttctaagctgttccaaaactctggaatgtcagacactagattggacagcaatgagtttgcttttgatgaattggatatatccagttttttgagctgtggaattctcttaataaaactctggacctcttgcacctcttgatctgtattgactgattgccaaatcaatgacgaccattctttatcccagggattgctcttctttctaaaaatatgtcttaaaagaaaatctgtcatatttgttgggatcctggaatttgataaattcaaagtttttagttgccgaagggtgagctcatcttcattgtcgttgtcgtcaattacaaactctttaatagttgcgttgcccaagtataaagcaccaagatgctttataagagatgaatgaagaacttgtatcgtggaattacttaaatcgacagtccgaagcttgggatactgccctctttgaaaggatatgagattgggacagttgaccaaatatagaaagaacattctcttgaactgaaatttttcgtcttcatatggcaataaggataccgattccaagctggagttgtctgcatagatatagttaatcgccggcagttcacctttgattgcttttagctcttttgtgttcgaacaggagatacttgccaggacatctcccttaatatcgataagttcgatattggacccatcagcagttaacttttccaacccgctcaattgatctccatcagacacaagtttcttcaggtaggataaattggaaagattcaactcttgcaaggttggaaaactataatctttaaggtatcgtagatttgaatctgaagcatcaaggttctttaagtagtggtagtcacctgtcatgccttcgacgaattcatatgcagtttgcttcaacgataatgtcgtcattttcttatcgaatgtgctaccctgtagatatgtaaattggttggtctctacggtcataaaacaagcaaaaacccgcagaacaactatgaaggcgatggcatagtcatgtgcttgtttttatagacataaggtaagaggctccccacatttttagtaggctattattaagcacagcagacgcgaagaagaatgcggataaagaacccatgactcactctaagcatcaaaatgaatcaccggaaatgattcaaaaagaaattagacctgtcaaccagttttctgtggagtctgccagagaacagaagtcaattgttaagcttagggcatattagggcatattagggcccattgccatatcaaagtcaatgttcaagttcgcgttacgggatcaaaaaaaatccaggggtaatctcgcatagtcatcaatcagattctcatgacgagaaatgacaccctgaacagacaaatacgcggagcacagcatgaagacaataggtgagtttataatgatcttagtggctactgctcgtgcgaagtaaggtaaacactcgtttatgctgggcatacgtagcctccctaggcaacgcatatttcttttctattatgttgctaaagcaggctggagaggctactacgctcctctatcgagaacaatctctatctcattttgcgcaacggttttcccgatgtcttacaaaggtgattagtgtctcacacagagaaaccgcaaaaagatgacaaaaggcgggcttgctattggccgacagaatgctttaacggctcctaacaccacttacataatcatgttttttctgacaccttctccctgattatcacaaacagaaacttgctaacccttagcttgaccaagtttttctttttccacctctattgtgctctttaagtgatagcatttatttggcatcggggatttcaaaatattcgttgccttcaaggatattttttgcatcctttcctttttaaactttaacttatttaccagaaagtaacaagtttcattggtacctccaccctacttcacctacaaggtactattcacatcgtttaacatataagaatggcagtggtcacattaaagaatgcgattctatcactttttccagcaaacacgtcggattcccaaaacgagcctctactaggggaggattccactggtaatgccggctatgctgctcgggatgtgcagggattagagagtgaaatagagtcgaattcaacaaagacacaaaacatcagcgaggataatcaaaaccagactgtcctttggggtttatttgagaaggtagacccaagagtcatgtcagatattattattgggctttcagacggattaacagtaccgttcgctcttacagcaggattgtcttctttaggggactccaagttggtgattactggtggtatggccgagttagtttccggttccatctctatgggtcttggtggtttccttgcggctaggtctgaatctgagttttacaaatctcaagttcgaaaggagaaacaattatttttcaataacaaggaactgctggaagaagaattagaagacattttccttgatataggtatgtccgaaaccacaacagaatcagcaatcagggatttgtcaaagtctccaaaggcaatgattgatttcattattagacacggaaaaggtttagaggaacctgctgacggaaggcaggttaccagtgctctaacgattggattgtcatacttcttggggggcttcgtaccgttggtcccgtattttttcacggctattgtgcaaactggattgatcatttcagttcttgttatgggagtcacattgttttggtttggataccttaaaacagctatatcaatgggagaggactgttctctgtggatgagagtcagcgagggtctgcagatggtacttattggttcgatagctgctgggtctgcttggggattggtgagagtaattgacactaattgagcgttacctattatttgcatcaatcactgtacatttacccatttctctaattacttcaatatttttattagcgcatctacaaaacttatcttcgtctatttatttggcatccaatggttttctggcaacgtataacatcatgggtgtaaagagcttaagttcaccacccttcaccaagttaacggcggcatcttccaatgcgttggtaacttgtcttgaacccttgggggccaatcccaacttttccattaatccaacggtttcagtggtaactgttctaccaatcttactagttctgaagatggtgaatatgtcacccagagtctggacatactttaattgaccggaaagaggatagtaccatgggatatcgtcgtccatgtctgccatgtctttctggtactctacttcaaatccgacatttttcagtgcatcttctgcaacttgtctcttgtacatctttgggataccgtcaccaacttcaataccgtaggcaatggcacggtgttccgggtttgtttcgtcatatgcatcggtcataacccactcatacaccccaaatgctcctcctggtttcagcaccttgtaaatctcactataaacaccttccaacactggggcgtgaacagtggcctcaatggcgtacacagcatcgaaggtctcgggctcaaagtccatttgcatgaagtcaccttttacgtatgacaattgcttcgtcatgttgtatttcttggaatagaattctgctctttcaacctggtaatcgttgttgtttaaaccaacgacagaacaaccagtgaaacgggcaatctctcttgctggaccaccgacaccacatccaacgtccaaaactttcatgttttcggtgatacccattttcagggccaggtaatgttcgtgcctagcggtagcctgtctgaaggcctctcctctgtagtatctagaaaaatgaaacgaagaaccccaaccgtactcgtagaaatcagtaaccaggttgtagtaatgcttggtcagctccgaataatcactctttcttgagtgttcagcttcctgatcagtcttaccattccagtgcttgaagtagccatcgaccgctacttcttgggctgaggcgtcctttgtgacccaagctccgagaccggttttcttagcggcatccttgccgtgcaaagcctttgcaaattctctatcttgctcatagttctttggggcaagtggctggctttcttgttcagttgtagaggtagtcattttcggtaataaacgagtgttgagtagagtaaagttgaccttctaaaagctgaatattataggttttcactatctaaacgatgggaacgacaaatctaccaggcgcgcgtatcaatttttagagtgtaaacgagatgtacgaccgattcaattcgagtgcgacaactgtcaaattgtcacattggacaaaaaacgcgcttgacacgatggtttcaatactgacaggctgttcttatatatactttacgaactgaccgaagcaattgcgccagaaaggcgcgagatgaaatttcgaaatccatgttaaagccgcatccgatcaagggaccctcatttcagttggtttggttccacatgtttactgttaacgagcgaaggcctcttgaacgctctcaacagaaaaacacgtgctgtcgtagaacacaattgttattcacctaggttgccgtaatcgtctttgtaacgccctcgttggggtaaactttccatggactgtgcacgttgtttagcttgctctctgctctactccacatcttctccaccccaattgtcgtctcttacccaatttgtatggaagtcttaacaccatttccacatctcagaaccatccgatcccatataagttgacgtatacggctccactaatttccatccgcattctgcattcacaataacttcccaatatgtttggaaagaggaggcaggtaagaaaattacttatatgggttgtcttactgttgatagtttacttttttggtttgcaatttagagccaaaaactcagctcatcagtcttccatcaggagcttttatgcggataacaaagagttttttgatcggcaatacagcagatatgacgagtatgatatcatagacaacatgaatagccataacgagttactacaggaacagtttcgcaatggaaagctcgctgcgggactcagaggtgtagccgaagaacctaattccgatgaggttacagatgacactgccatcgaagaagacgagcaagctgcaatgattaatttcccgaagagatctccccagagagagaagagtctagttgagttacgcaagttttacaagaacgtgctttcgattataatcaacaacaaacctgctatgccaattgaaaatcctcgtgatcccacacctaacgaaaacgcactcaagagaaagttcggtaaaagtggaatcatcaacattgctttacatgacaccgatccttcgctgcctattctttctgaagcgtatctccgggactcgttgcagttgagcccctcttttattgcctcattgtccaaatcccacagcgccgtggtaaaggcgtttcccccttcctttcctgcgaatgcatataatgggacaggaattgtatttattggtggtcaaaagttttcctggttatcattactttctatcgaaaaccttaggaaaacaggatccaaagtacctgtcgagttgataatcccatttgcacatgaatatgaacctcaattatgtgaagagatactaccaaagttgaatgctacttgcgttcttttgcaggagactgtgggaattgatctgcttaaatctggacatctcaaagggtaccagtttaagtcattagcgcttttggcctcctcttttgagcaggttctactagtagactctgataacatcattgttgaaaatccagaccccatatttgattcagaggtttttcaacggacgggattagtgttgtggcctgatttctggaggcgcgttacccatcctgattactataagattgctggcatcaagttgggctctgaacgagtaaggcatgttgttgactcctacactgacccctcgttgtatacctctagttcggaagatccctttaccgatattcctttgcatgatagggaaggggcaattccagatggttccacagaatctggccaaatactaatatccaagaccaaacattgccaaacgatccttctatctttgtattataacttttttggaccagattactactaccctctgttcacccaaggagcaagcggagaaggagataaagagacctttttagctgctgctaactactataaactaccattttacaacatcaagaaaggtgtggacgtcattggatattggaagcctgaccaatctgcatatcagggttgcggtatgctgcaatacgacccaatcgtagattatcaaaacttacaaacatttttaaagactcataaaggctcaagggtcaacaaacttgaacagtcggagctagacaaacccggattactatccagattaataccaaaatttttctttcgcaaaacttttgatgagcatcagcttcagagtcatttcaccaaggacagatctaagatcatgtttatacactcaaactttccaaaactagacccatttggattgaagcttcacaactatctttttgtagatcaagacactcataaaccaaggataagaatgtatgcggaccaaacaggactttcatttgactttgagctccgtcaatggattatcattcatgaatacttttgtgagtacccagatttcaacttgaaatatttggagaacgctaacgtgaagcctcaagatttatgtatgttcatcaaggaagagctaaactttttacagaataacccaatacaattgacgtgacttgctactggtttatcacactaatgacgaaaagaagagaaataaagaacaggtaaatgactgagaatgtccttttttattcgaaagacaagaatcaaaacaaaatgaccgtaacacgaaaaataaatacacataccgaattggaaaccatgattgactattttgaactgccaataaaaattgtacgatataatgaaacagataattacttgtaataagaacattggttatggtgaaccattggatgaaacatgttctttaaacgtatggatactttcaaagatcgagaatatcatctttaaatgtccccctgtagatatgctatactttaccacccaaaatatgctcgttacaaaaagagagccctcagctgtcacttttatatcaagcagttattcgaaattcttgccactaccataactagttgagattagagtagccatcaaaaactaataaacacatttcaaaggaatggacaacaattgtcgtcccgtaatgtttataatgcaatgtgatgtaacataattgatacatataacaatacagatcatttgatacaagctagccaggatacaccgaaaagtttcgaaaataaacaggatacataatgctacagtgtcgtgtctatcaacataacggttttggttcctggaaataggttagtagagaacagactcgttgtcaaaaatggcagatccttgtcaagtcaaaaaagatgtgtcatcctattctttatctttcttttcttcattgatacagagggaagaatacaaatagagttgtgcggtgtttctttgtagtggtaggacacaaatgaagaaaaaagtttcatgtggggtaaatgggttctgtactggtgggagcgcctgaaatatgtctcaccactcaacgaataacaatgttaaaatacagaagcagaccagataacgatgcaaggaatagttcatagcctatcagaacaacaatagcttttccatcagtgcaatccaaagtgttcaatgccatattgataacacctgttgacaaatttgcagccaaaaatatcaacaaactattattgttcaaagcgtgcaatattggaggggttctttgcacatatatcaatttggaaacgttgttgtatctttcttcttgaagaggagtcaatggttggtctgtaaacttgacatcgctgttcggccaaaaatattggtctactagtacataacccgccaagaacgttgtgttgtagccacaaacccacaaaatgtagagaagattggcaactcttcgactgacagtataaatgtagcatgtgtttatgacatagaatgagacgtgatagaaggttgccaagtacactaagccttgaaaaggtgaaactgaaagggataataatttgaaagggtgaggcgatgattgaaaacgaaccacttcattcttggagctcggccaaaacaaattgtttctagttttgcacactggaagaaggaataatccggttgcttgtccacccagaaagatagaaagataaccgaacaaactgaaaattccctctttgttgtcactgatcaggtcaactcttggagccagtaaaatatagtgcaaaagattggtgtttaccaagataaactcgtagaaaccaccaatcagtaaacttaaccaaaagtgcgggatgaactttgtcaatggggacagtaaaacagcaataggtggaagaaagcctaaggtaaaaaagaaattccaatgcttaccgtattcagtgacatgttcctgataatccaaagatttaacagatattgaccggaacaggccaagaacaaaaactggagtgactccgaccaacgtgtgaataagctgggaggcagtgaatgttttggattttgtaaaagttgcagctaatacggagcggcaactcactagccccattgaaaagacaaaagaaccaacgcccaaatccatcaaacttgttccccaagtctcaaccttggcaaatcgccttggaaatatcttgaagtccacggccaaaatggcaagacaggttatgaccatcatttgcgaccgataaacagttataaatggtttatgaggaagaaactgtttcactgacagcgattgaagagacaaggctcctctaatgtgtctgttactaggctcattccctttcttccacttgatgaagctgagcgcaaggcatggcaagatgataagcacgttcagcgttaaaggtctggcactgtatagtgtgatggagagcagcaaactattccaattgagggcaaaatcaagcagacttcccagtatacttcttgtgtcaaatacactggttctctgtttaagccagcaccaagcgatataacttaactagattgttagataaactttcagtggataaatctcatttacttaccaatgacacaaaagtaactacgtatatttcggagattgagcctcctgtaagatcggaaacaaactcctcttttcgttctttaagtgttgacattgtatctgagaacaattctccgcctaacacacgatgacaataattgattcgatctcctaccaggaattttcactcttctcgctaatgatgtcacaaaataccttccactcttgggagggggacttctcgcgctctcaatcacattccgccaccgtggtgtagtgctggagaaaaaaaaacctggttgttcacctctaattatcatcatccttaaacctgttgtacagactttagatttcaatacccagtatgtcatctattgtgaacaacccaacggtgcttgatgcaaagttgctagttccgaaagctcttgtggccaggccatacgtctggccttggaccataatatatcccatctggggcaatatctatttcaaccattacgatgagtatatcaaaggtccagaatggacttttgtgtactttggaacaattctttccttacaacttctgttttggttaatgcctcattggaatttgaatattagagcaaaattccagtataaccctgtcgataagatttctgaggctactcatatcagaatcacacctgcaccaaacactggattaggtgagatttgtgagattagaacagacaagtttgaggatggagagactcaggtttcatttctttaccagaagagaagacatctgcttcattcggataatgtattttctcctccccagtttattgttgatgagaaccctcaacttggtgttttccaagaatccacaggactaagtggcccactatcaaagatgcagagattgtatggtaaaaacttgtttgacattccaattccaacattcttggagttgttcaaagaacacgctgttgctccattttttgtgttccaaatcttttccgttgcattatggtgcatggatgaaatgtggtatttttcgttgttttcgttgttcatgttggtatcctttgaatgtaccactgttttccagagaagatccaccatgaatgagttccacagtatgggtataaaaccatatctcatttatgtcttccgtaataagacctgggtcaacattcaaagtgacgatttgcttccaggcgatttggtttctattactcgcacagctgaagatagcgctattccttgtgatctaatccttgtggatggatcttgtattgtcaatgaggctatgctttcaggtgaatcgactcccttgttgaaagagtccatcaaactgagaccagcaactgattcgtttgaccctgaaggtctagataagaactcaattttacacggaggtacatcatgtcttcaagtgtccagtccagaagatccatctgttcctcttgctccagacggtggtgctttagctattgttactaagattggttttgaaacttcccagggttctttggttcgtgttatgatattttccagtgagagaatgagtgtcgccaacaaggaggcattcttcttcattttgtttctgctagtgtttgccattgttgcttcatggtatgtttgggtcgaaggtagtaaaatgggtcgtattcaatctaagttgatcttggactgtataatggtgataacctcagttgttcctccggaactccctatggaactgaccatggcagttaattcctcgttggcctctttgggtaagtactatgtttactgtaccgaaccctttaggattccacttgcaggaagaattgacgtttgttgttttgacaaaactggaacgttaacagccgaggaccttgttttcgaaggattggctggctttgatgaatccgatgtacactctttgaagaaaccaaacgatgttcccgaagaaactttgcacgttctcggagcagctcacgcattggttaagttggacgatggagaagttgttggtgacccaatggaacaggcaacattgaaggctgctggatggaagctaggtgataaagaccaattgtacaaaaccgatggaaagaaacaggagaaaattaaaattctgagaagatttcaattttcttctgccttgaagagatctagttctattgccactgtacataagaaaaattttgttgccgtgaagggtgcccctgaaaccatcaaagaaagactagttgatgcccctaaacattacgagaatacttacaagactttcactagagctgggtcgagagtgttggctttggcctacaaaccattaccagacaatttatcatcgaacaagattacaaaattcaccagagaagaagtcgagactgatctattgtttgctggtttcattgttttccattgcccaatgaaaggagatgctatcgagacaatcagaatgttgaatgagtcaagccacagatgtgttatgatcaccggtgacaatccactaaccgcggtccatgttgctaaggaagttgaaatttccaaacgacctacacttatccttgatttgcctgaagcccatcacggggaccacgaactaatctggagaagtgttgatgaaagtgagctcattcctttctcgtccacggacaagattgatgagagcatttttgataagagtgatatttgcctaactgggtatgctttagctaagttaatggatcatccccaattgacgaagcttattagacacacttgggtgtttgccagagtttcaccttctcaaaaggaatttatcttgaattcctataaggagatgggctataagacactgatgtgtggggacggtactaacgatgttggtgctttgaaacaggcacacgttggtattgcactgttaaatggtacggaagaatcgctgaaaaagatccaggaaaacaagaagattgaagccattcaaaaaatgtaccagaagcaggttgatttgatgaagagatggaactctcctccacccaaggttccccctttgattgcccatttatacccacctggaccattgaatccccactacttaactgcacttgagaagaatggtaagacaatcactgatgaaatccgtgcttcggtagctgctgccaacgacggacaagtatctgctgcagtgggagcatctttgaatgcttcgagcttagctgattctcttactgggtcaatgactgatctagaggaggagatggaggccccgaccctgaaattgggtgatgcttcagttgcagctccatttacttccaaactagctaatgtcaacacagtcacccacgttattcgccagggaagatgtgctttggtgtcgactattcaaatgtacaaaattttggcattgaattgtctgattagcgcttattccttgtctgtattgtacttggctggaatcaagtttggtgatatgcaagccaccgtaagtggaatgctgttatctgtatgcttcctttcaatttctcgtggtaagccaattgagaaattgtctaaacaaagaccccaacctggaatttttaacatttatatcatgggatcaattattggtcaatttgctgtccacattatcaccttgatctatatcgcaattgaaatttacaagttggagccaagagagcctcaagtcgatttagagaaggagttcaagccatcattgttgaacacggctattttcctgttgcaattagctcaacaggttgccacatttgctgttaactaccaaggtaaaccttttagagagtcaatttctgagaataaaggaatgtattatggtctagtaggagtttcatttttgtgcatcagtggagcaactgagtttgtccctgaactgaaccaaggtatgaaatttgtgcctatggacaagttattcaaaactaaacttacttcatgcattttgttagacgttggactttgttttttcattgagcaagtgctcaaatatttcttcagtgatttcaaagcaagcgacattgctattcacgacgaggatgaggaggagattgagatcaagaagaacatttaggtgtccatactgttgtatcatgtatttttggaattaaatattatagagttgattaaatttagtgatgatgtggattgtggctagatataattttgtgatcaccttctctgtctagaagtgatatctttacgaccttgattgcgttcttttctatgatggatagtttttccggctgattgagggtatcacacaacttgattagcacatctaggcagattgaatcgcttaagggtaaacttattgagtcctgaatagtggaaattagttgctttgttgaaaaggtttttagggtaactttgctagatggcttgggggatagttggtaaagaatttcgtagaatttcaacatttgacttcggacatagttttcatgttttaatttttcttccattctggaggaagtttctttggtcgatttctctttgagtcgaattctatccaatacggacatcttgtagtccccgaagttagacgtttcaactttcctttctttgaagttgaattttgcgctgtcattccgtagccttttctttgtgtttgatttctttgtgtagtctatagtgtatggatctggaatgacaggcaatctagctgtggaatatgctgaaatggtagaatgagattgaaggtacgagtctaatgtggcgttgaacagctcaacacggcttttgataagccgtattcttgaaaggttaggaatcccttgcatatctttgctgaaattgattatatagtttccttcgtcagtgattgttagctcaaatatactatcattcatgttatagattttcaagtagtggtctaaggagactgtaaacccacataacctatcaacgtggggtgaaagtgaatggaggtatggagcattaaagcttttcgaaaaatggatggataaagcgttgaacgtttgcctaactaccttcttcaacaagctggcttctgactctaaatccatgctattggcgctctagagaagttcggtttctgactctaattataatgtcttgagtcacgtggtttattacatttatcgaattataattatttaccctgctatatgaccaaagcacagactagtatcacagtcaacaagtatcgactatttcaagccaaaaaaacacctatttgcttcatagtatctttgtactcttttggataccatttagcggcaacatttctgtgggacttgagtctgttttggaatacagtccagccaactggtctgacgtcctctgaagtgtcatcagcaacgctgaattggtacccgatggcttcgccttttatttctttgtctcttttgtctctcagatcaagtaactcctggggaatatcctttagttgtgacttgtaacagtttacgtcaatagtttggaatactgggatcgacagacgatcaccggaaccgtttctgggagtgattacacggtggatggtggcatggcatacgcctttggtcagatattctaaagtctgtccaacattaacgactagactgttttcaattggaggcacagttatccactcaccagaatggtagatatcttgaacctgcaatgcttcgtgagcagtggcctggaacaaataagtcaagaaatcggagtctctatgaggtccacatccttgagtctcgtccagcggtacgccttcattctctggaagtaagtccaacctactctctgcatctttatactctggatacttgatgagtttcattttacattgttgtcttggtttgaagtacttactgaaagcgccttcagggagctgtagtgcctcacgtaccaactcactgaaccattgagaaaattgatacactttctctagatagttctcgatagtaggtctaaaatcgggcagtagttcctgattgggccacaaattaggtccttcaatgttcttccagatttcatcatgggaagcaatctttggagcaggtagctcagtggccaaatctatttgctctctgatatcgactttatttgacgtaacttcgtttcccaggcgggtatagcctaaaaagtgcttggaatttatcatctcaattttgtccttttcatcggcaggcaagtcgtggaagaatttgaaagcttgttctttgactccgttgataagctggggaaagttttcaataggaggattaatcacataaaaaaatcccacctcggtaagggctcgtctaagatcctccacaagcttcggtttagtgtcctcggatagagccaaattcaagtcgataactggtaggcttttagttcctggcattgctaaagattttcttttgattcagagaaaaactttcgggggcagttggctttaaataccaaccgtatgattattaacaatgtggggcataaaaatttggtgccacagtttttaacgcttaaggtattatataagctccaaaaatccatcaaagacaagatcgggtacacggtgtttgacagtgccaaatgccgaggataatcgctcaagtccagaaggttgaggacgagcatgaccaaacttattcaacaggtagctcacgtttttcctaaaaccatcggccaggatgcaatctgagaccaatcaacttcgacaaccagttcgtggtaaccacagtttagcttcatcagtctgaatattcgtaacgaaggcttattattgccttattggattttaagtagcattttgcgagatcggtttcggaaataccttgttcgccgggtaatagcgcagagacccaaacatcacaggagagaaaaagttccagcaagttcgacgaaaactaacatataagtgaaatttttctttctttctatcatttgtttgttagacactgatacagaatgctttcaaatttttctaggaacatcagatctcctgtttcacgagctgctttgcaagctgtgagatacaactccaatgctaagatttccggtcaagttatcggtatcgatttaggtaccaccaactccgccgttgccgtcatggagggaaagagcccaaagatcattgagaacgctgaaggtgctagaaccactccctccgtcgttgctttcaccaaggaaggtgagagactggttggtgttgctgccaagagacaggctgttgtcaacccagagaacactttgtttgccaccaagagattgattggtagaagattcgaggacgctgaagttcaaagagatatcaagcaagttccatacaagatcgtcaagcacaccaatggtgatgcttggctggaggccagaggtgaaagatattcgccttcccaaattggtggtttcgttctgaacaagatgaaggaaaccgctgaggcccatttaggtaagccagttaaggatgccgttgttaccgtccctgcttacttcaacgactctcagagacaggccacaaaggatgccggtgctattgttggtttgaatgttgctcgtgttgttaatgagccaactgccgccgccttggcttacggtctggaaaagactgatgctaacgttgtcgccgttttcgatttgggtggtggtactttcgatatctccatcttggacattgataacggtgtgttcgaagtcaagtctaccaacggtgacacccatctaggtggtgaggactttgacattgctttggtcagatacattgttgacgccttcaaaaaggaatctggtattgacttgcacgacgacagaatggctatccaaagaatcagagaagcttccgagaaggctaagatcgaattgtcttctgccgcttctactgaagtcaacttgcctttcatcaccgctgacgcttctggcccaaaacacattaacttgaagatgtccagatctcaattggagcaattggttgatccacttatcaagagaaccgttgagccagttaagaaggctttgaaagatgccagcttgtcaacctctgatgtttctgaagtcattttggttggtggtatgaccagaatgccaaaggtcgtggaaacagttaagcagctgttcggtaaggagccttccaaggctgttaacccagatgaggccgttgcaattggtgctgccattcaaggtgctgttttgtctggagaggtcaaggacgttctattgttggatgtcactcctctatccttgggtatcgagaccttgggtggtgtcttcactagactgattccaagaaacactactattccaaccaagaaatctcaagtattctctactgcctcatctggtcaaacctctgttgaaatcagagttttccaaggtgagagagagttggtacgtgacaacaaattgatcggtaacttcactttggctggtattccacctgctccaaagggtgttcctcagattgaggtcactttcgacattgacgcagatggtatcatcaacgtttctgctaaggacaaggcctccggtaaggacaactctattactgtggctggttcttctggtctttccgaatctgaaatcgagaagatgatcaacgacgctgagaagtttgccgaagaggacaaggttagaaaggaggctattgagactgccaacagagctgaccagttgtgtaacgatactgagaactctttgaacgagttcaaggataaggttgacaagaccgaggccgaggagatttccaagaagatctctgagttaaaggagattattgccaaggttaacagtggcgaggctatcgaagctgccactgttaaagagaagaccgaagaccttcaaaacgcttctttgaagttgttcgagaagatgtacaaggacaacgcttcctcatctggttctgaagagccaaagaactagtgactatcttcctggtttagttagtcatttgtttcgtttgtacatctggttcgttccagtatctctgtatatagataaatgaagctgatgtaatgtagtctaatttcaaagaatctgacataatgttggagaaacaaaatcgagcctttcgtcatttagtgttctttttttcttcctataccaaatgaactcacagcttggtactgtcaagtctgaggaaccctcccgtcagctacagcaggattcctcagagaagccggcgagcattaattcttcgactgctccccggttagactcgttcaatacgttcaatttggggaatggtttcatctgccctccggttaacttggatgtagctgatcgaaaccaccctctggacaaagttcagtcagaaacaaaaccagctaccactgatcataatttgccacctgccaagttgaagtcatccaaaatatcactggccagcattatcaaccctcctgatcctgaaatcactgcgttctccagtgggttacttatagctccccgtcctccaagtactgcattatccatccacgaattaacgagcaatccagagccagtcaagcatgcaagaatatgggagtcaacgcaatctagccccaaaccgatagctcagaaacgaaagtcacctgaaaaggaggatcttgtttctacaaaagcaccgtcgactccaactggccctgaaccaaaaaagagaaaacaaaagacgactacaagtaaagacacagcagtaacagcaggatcagcagaaacggcgactaaaccggttcctcctattctttcgaaaacgcctagcgtaaagtctaccaccaagaatgccacgaaacagcctacgaaacaacctacaagaccaaaaaagaaaagtcaaaatacaacgccaaaattaatatctgctacaacgggaggtacgaacacggcggcaataggaccaaagttgcaaggttctacttctgtggacgaaaagaaaacgaattccactgctaccagtactacacagcagaaatcactggtagagctacccgttccatcacttttggacactgaatcaatcaaaggaaagaatataccagctgaggaacctgtggttgctttgaatattcttttatccgattccgacaaacccaatcctggatcggctcaactggtgttcaacctcatgaaagtttgcgaagaaaagtatggatttaaggctatgcatccaaatgccaaattcgtggtcgaatctgacgaggatgacgatgatatagcggaggacgatgaacagacagaaaccgacaccaaagaagtagctactcctcctcctgcgattcccaaaacaccagttgcggctcccattagagaagactataatgatgctgagcgacgacttcgaaaccaaaatagaaaaattggtaagtacgacataatggatccgttcattgacgattcagaactgcaatttgaggaggagagagctgctacaaaggacggattttttgtctattatggacccttgattgaagaaggtcaaatggcaagaatagaacgggcagacggcacactcaaaaaaggaactcaagggaccagctctcgtggaaaaaaagtgtccaagaaggcaactactagtacctcaacgggcaatatcactcaaaaaaagacagttactcagtctacagcgcctcaagcagtagcgcctcaagcaatagctcctaaagaggataaacaactgctgggcagtgttttggcaaaagattaaagattaattaaagacaggtttttactgagaaactctttccacagccagtttgatcaaatggccattgttgtcctcaggatctatgttttttagctttttgtttacaagctcgatgaacctgttaatagactgaggttcaattttggatttcagagctgtaataaaattgatgtagctcaacaataaaataacttcatcttctttaacttctttgccagccagtgtcttgtttacagtatctgtagccaatcttacaatgtcgtcacccctggcctggctcaaagtaatataaggaatgtctctggctggaatagttggtttggtattcaggtcaactttttctaatttatcgttcagacttgcaacagtgatattcctacttcttaggcacaaatctttcagaatagataacaacactgatctagcgttgttgaagggacaagtagtcagtgaatctttgagaaaattccagctcgtggactcgtgaaccagagacaatacacggctgattaacgtgtacagaatgatgtttcgactctttgcttccaaaggcgctagataatcactgaagttaatggtagatttggtgatgagcagctgaagatacgttgttatgagtatttctggaatttgggataaattgttctctttggacactgtgacccatgcccaagcatacagggcatcgtccaaactgtaagaagttaagtttggatttagcatcgaaggtaataaaaacctcaaagagagtttaaccaccttttcaaagtctaaaatagagtaagacttggcagaaggattttctatcagaacattgaaagtgtaaagaataatacatccaatactggagaggggtaattccttcaaatctttgtcatgtaaaccggtgccgttaaaattctcaatcaccagagaaaatattttatcattcagtgtatccaactcctggttgtggtcaagctgagaaaagagcgtttctgtctcctcaatttgctttttaatctcttcttctaggtttatatcgtaagattgtgacagagtaacgaaccgtcccaaaagaatcatattttcacggtggaattctgagttcaaatgcaagcctaacttttggctgtgaacacttttctccaacttctcaaaaacagttggagcaactagtaccttaatcgtatttgattgcaattcaatagaatgtgtcaaaaacgttgttagaagcttcctttgaagataattctcctgggtatgcaaaagcgacagctctcgtatatcctcagcagttgtgttctcactcacatctggtctcaagcaagggtggtaatctctcaataatgtatatattcttcttaaaacaaagattgggctttcaagtttgttggaaagcaagtttataactgggggtatcatcatcgcaagaaaacgagaaggataattagatactattcgtctttgacttgctaccattagttcaaatagagaatgaaacctcaatttgaaaataatgtcattgttctcactgcttgaatcgacacatcgaggaagcaactcacaacatttgagcaaaagctcctttgcattacccttctcggctaagagttcaaatatatggaacattgccatcctacctttggagttttttagttctattcggagatcatcccattcaagtccatggtattggaacaaaagagcaggaatatcccaaccaatttcatacaagagttcatcgttctcttgtaaaattttcaaaagcttttccaaaagttgaatcctttcctcaacggaaaacttttctggatcagtagcaaggtgaatgtcgatcacagttagataagacagataatctttggtctccagagcatcttgcgcagcatcgtcaagatagtggcaaatggtgtcaacagtaagaagctctttgctacttttttcgagttcagagtcagttgaatttgagtcagtcatctggtaatattattcaaataaagctcgctgtcgttagaaggtagaaggtgtctttgactagatgagatgagggatggtttgaattttcgagaattgttggtgttagctacaggggaaccaagggtgcgtgagcaactgagtcgactagcttcccaccaataaacttggggaacaggagcgggataaattaaacagccccatttaacacctgtttacgaggaattaagttttcctcctcaggttccatgagtgatgatattaaagaggcttcacctcccgtgaataatcccactttgtcggaatctgcagtacttgacaaagttcccaagacttcttctttgttagacgagattaaggaaagacacgcacaagaggtttgcaagatcagtataagattcatacctattggatcagccccagaaatcacacccaaagtattcaagatttcctcttccaacaactttggtgctttgctcagtttcttggataaacgattgggaaacaaccttatttacaaaaatcagatcaaccatttgactggaggaagaatattcggttatctacacaattcgtttgcaccatcccccgacgagaacttggacaatctatacaagaattttggcatcaatggggaactagtggtgtcatattctgacagagtagctttcagctagatataatattcttacgtacacctatatacaagaaaacagaaattaatttacttgatgttttctgttgtgacggatccatcaggatggatgatggtcttagtttctttggagcgttctgttccatccacaaaccattcatgcttcttttcaattttctcaatttctccattaggtagagttctttcggagtaggaagttgaagaacccgaagacttttgaggtttagagaacgaaactctctgttttttgatgttctcctccataaccgatctccagttcaagtagtcagagaaattagtaaaaaaccttcctaacttatgagaatcatcctgctccacgtcttccttacttataatattggaatcaatgctcttatagttctcaggcaattgagcctttggaaacaaacatctccaatacccatgttcgtcccaaacggacaaaccttgtttggagttgcagtctttgtaaagctgatgcgaaggaattgggtaggcccacaaaccatatttagaagacaccaacttggaacctgtgaaaagttctgaccatacatcttgatcaaaaactggggcaatagcattgaccaaagagtcaactttattaaaagtcgtctcaaaatcgtctccaaagacggccctgaaaattgaatctggtcgatttgtgtcgatattcttgttaaacaatgttccgtcttctccaggtagagcgacatcttcgatcttgcttgcaagggaatgtttggcctccctggcaatggaaagatatctgtcaagccaattgcttgacgtggatgaactgctttccgataatttatctgagttgtctttgtctgagtctgtaaacaatcccatttctttgaatctttttagcacagtgtggagggcaacgatcaatctgctcatctatatataccatgcttcgcgcaatttctagaaagctccgtttgccgtgaggcacgagccagtggggtgagaaagatcagaagtcgaacccttcatcgtcgtcagacatgtggaagaacatgctgaatagtatgatgcttgcataaacaataaaacctccagataaactcattatcatagaccagaaaacaatcagctgcacatgccaaaatacaatcggaaggaccaggccactaaaaacgaagatccctgttacgaattctccgaaatctttgaaaggattgccgtttggagcactatccgagaggaaatctgattgatagttagcgtttagattggaaaatatagcgttgggtattggtgccaccaagaacactgcgactggacgaaatgttagctttgcttcgaggatcattggaataataagggtggtcacttactgacgtataatgggtgataattatgaaataatgcacatgataaaacaaccagaaggattcctatagataatagaaccgaaaggaagataatcttcgtaattggtttcacggtcattgtccttaaagtacaactaaagaggaatggttatttactatttgataataatttcgctgccgttgtactctgcgagatgtgctcccagggattgtagcttggagggcggaccttcgcgatcggcaacactcctggtgaggttagtcaccaatgttaccgaatagttctctcggagagcatcactggcagtgtgaaatacgcagaaatcaagagcaagacctacaattgtaacatttcgaataccatgccctttcaaaagcgaatccagttcggttttgtgcagcttccaaacgtcactaaatgcagaatagtactccctatcggaaagataccccttcttcactagctctttaggccctgtaaactgttcccaaaaggccttgaacttaggtggaaattcacttccattggagttttgaacacaatgatccggccacaccacctgaattttcttttccgcttcattttctgggtttgtgaactctagctcggtatacggcttgactccgtggttagaggcaaatgacgtatggtcctggggatgccaatccttagtggcaatgactaaatcccaatccttcttctgagctagctcaatgattggatcgatgatctcatttccgtcaggaacagccaatgaccccccttctagaaagtcgttctgtaaatcaataataagtagtgccgatttgctcatgtgaggattgtgtggtaaagttaagttcaggggaaagagacaaataatcttccgatccacatttaaatatttggggtgcgatgagcatcgaaagtctcaagccctatccaactgtaccttatcagagttgaaagaacctagcttacttaagcgcagataagtgtcactaccatagccttccaaggagtgcattcgaagatctccattccagtaatcagtgtaaactttgcacatgggcaaactgacacctaaggtcaaatcaaatggtctagctataagcgaacgcataaagctctttttcctggaataaagtccctcttgtgattctttatcttgaattcccattctttgggtgactatttcttccatgtgagtgatattcttgagtaaggcgttggcagacccatcaagaggtggctgttttttgtgctgaccactgaaggagtctttgacttgaaagtgaggattcaggtctaatcctggcaatgaatggaaagtgttcaaataaacctgtgctttcttcggagactttccaaatgaccagatatcttgcaatacttccttcggcatcccgcctccttgatctgaaaatctaaacacaacatctttcgcattgttggcaacagaaacaactatgggaggtggtttgattttacttaactggtcttctcctaggtgatcgttgatacgcaaacagttcgtaatgactgctttgtaagaatttctaagaatctctccaaatatgaaatgtaaatggctgagcataaatggaaactttgcatcctctccctcaatgatcagctctggcaactgcaaattagggtataagccacgtaaataatttatcagaattccagtgcaaatttccaactgttcgaacgcagaacattcactaaacagatcccccaaagaatctgaagacttgtttttttgaaatctggtagtcaaggatatgtgttcctctagaattacccttctactaactcttgagcgtaacatggacgacatgaattcgtccaactctttctgtggtaaactgttcaaaatactattctcgagagctcccatcattagatgtggcagtacggtgagatgttcgtccaaggtatccttgataaactcacaaaacttgtcgttctcctctaagttgtcaatccgactatattttctgaacgaattgaaacaatgatagtagcactcataaacctgtgcgaaatggaaattgttcaccacgtcgaatggtagcttctgcaacgacttgattctcaaagccaatcggacgggaatttcatttcttacaaaattagcactcataatgattttatctttgttcaatgtcttaccatagttggccaagtgcttaagagtcacaggatgagcgtttctttccgcccaatgcaacagcattgagttttgatagaaatgatatttgttcagcagcatagagtactcgggatacggtcccagcctaaatatattatcggctatagttgagagcttcggcatatggatgggacgttgacttaggtttaagctgtgtttgagctcaagatctaggctaagattctgattatgtaagaagacaaccccataaggtcgcgcttccataaagctcgttatttctaattacctaacgtcatcactgcctctagaagataaagacttattcaatacaaaatgtctactcctgcaagacgacgattgatgagagatttcaaagtaagtgttttccaaacgtcttatcagtatgcactttgaactaacaatttatttagagaatccaacaggatgcaccgggtggcgtctcagcatcaccattaccagataacgtaatgacctggaacgctgttatagtgggaccagctgacacaccttttgaggatggcactttccgtttggtgatccagtttgacgaacaataccccaacaaaccaccatcggttaagtttattagtgacatgtttcaccccaatgtctatgcatcgggtgacctatgtcttgacattctgcaaaataggtggactcctacctacgatgtgtccagtattcttaccagtatccaatcattactgaacgaccctaacatttccagtcccgctaatgtggaagctgcaaatttgtacaaagatcatcgctcacaatacatacaacgagtgagagacacagtggaaaaaagctggagcgaggatatcctagacgaggatgaggacgatgaggatgaagatgaaggcgaagttgataatgaggatgctcagtaacatcaagggatcgaatcacatcaggcacgtagacacacactaaacaaacattcaatgatattggacgtgacagaggttctatggacaaggaaatacatatttctacatacactactataccgtacataagagtctctctctaaaacatgttagacgctgtacatcagtggataaatcacctgatccacaaataataccatcttcgcttttgagccttggaatcgggattaaatggttgcgggttatccctggcctccagcatctctctgtaatctctctcttcttgttctagcaccttctggtattcttcgtactcgttaacgggaacatgatcagtattcaccaccttacgatctcgtttgaagttgatcacagtgaggatcagcgtggagaaaatgattatcttggaaatggggtccattcttctttccttttcgtactgttcttttctcttttctccgcaggttttgtagttaactgggggtaattttctaactagtgtagatggcttggggttatgagtagtgatgatggaaggcaacctgaatggcagatcaaaattaggctggtctgactcaaccggttgaaatccgtctctaggaccgtagtttccataacttatgtaatagtttagtcttttcatagactttggaatctttccccacggttttctgaatttatcatctttaaaactgtctataatatatctttgttggggataactaagcgagtcatactttctgtagtcgtcatataccggggtgggatcatattttgtgacatcgtcgtcttgaacactgcctgggactatggagtctagaatatctcttaacgatgatttggcaaggatatttctttcttttctcaattgagcagcagacagcttcttcttaggtgccacttgtgcagataaaaatctcacgtttggggctttacaccgtgtagatattctgacagaaggcatcatcgaacttgcaagagaagggacctgtaatggagaaaaagtgctaaaatatttcccagttgatacacccgcgacaagtacatttccgtaacaatgccggtgagatctgaaataactttatttatatcgttatttttcttttttttcagtcgaagcttctttcattccaattgatatgcatctatccgacaaagaataatgataatgcagcttggattgacttctttggcgtttcttgcgcttaagtgtgatgcttataacatcgccccgaaaatcgataccccaaacgttgaaccgtttgcaccatcaggaggacttaaactcttggctattgtagcaataatttggtacgttgttgttttattagttgcatattacgggttcttcgaaattatgcaaaagttcagtaagagaaaaacattgcctgttcccccacaagtggaaggtgtcaccattttgagaccaattaagggcatagatccggagatggaactctgcctgcaaagtgcatttgatcaggattacccaaagtttgagatcattatttgtgtggagagtgaaaacgatcctggcattggcgttgctgaggcattaatcaggaaatatccacatgtggatgctcggatactcaagggtgattcccacaacccagaccattttggacctaaccctaaggttaacaacttggcgaaaggatacagtgctggaaagtatgacatcatgtggattttggatagtaatgtttgggtttgctcgggtgcattgtctcgttctgtggatgcgttgaacagatcgttagacaatggacgaagcactttcgacttccaaactggaaaaggaaggaaggtgaaccttgtacatcatgtacctatggcaatctctatcaatccgcaaacgggtacaaatttggacgaaatgtttttgttcacttcccactcaaagttttatatttccataaacaaagcagcattagccccttgtgtcaatgggaaatcgaacctgtatcggcgaagtgagctggatttggcagtgaaaaggctgggaaagggtagcgagccaagtctagacgggaccaccggtatcctggcaaaggatgctgcatattacgggtccaaacctggccaaggcctacgattttttgcaagatacattggtgaggacaacatgatagcaacagcattgtggtttcaaaacggagggcgcactggcctaacaggcgatgctgccattcaaccactaggaggtgtcaatagtacatcattgaagaactaccttcttcgaaggatccgctggctccgtgttagaaaacatatggttctagaagctacattattggagccaactacagagtgcctgttatgcggcacgtttggaacttttgccatatccacgctattccttcagtcatatttcaattggaaatttttcatctttcacttgctagtctggatggtcacagattacacacaatttcatatcctactaaccaatgcatctcaagacacagcgacttgtaacgtaccatattttgcggaacctaacttcaatgcttacggaagtcctttcgaaagctcaaacttaaggacatttcacagatgggttctttattggttactcagagaggttttagcccttcccatatggatatccgccatgttagggactagaattatctggagaaatagaccatttagaatcaatgtggatctaagcgccgaagaactgtagatagcagataaagtgtgtctcacgtcagtgacattttaaatattggcacgtcataatcattcgagattttatataaaccccgaccctcatagtataagagcaaactggggtacttctcttttttcttcttccaactaccatcccctgttctcaacaaacgaaaatgtctttggcccccaagttcatcccctcacacatctacaaggcttcatcgggcacagttccagccaatgttcaccgtatccagttgtttttggactacgactgtccattcagtgcgattctgttcttcaagttttataaatcggtgattccggagactgagaagctgtatccaggaaagtttcaattcgtattctataatgttccccaaccatggcacccgacaagctcccttttgcacgaggtttctttggctgtggcggctgtggctccttccaaattctgggactattcgaacattttgtttgagaaccagtctcaattctttgacacagagacctacaatgagactagaaaggaaacttatcagcgattgatcgatttggcaactccgttaggaattgaggctgctgagctgtggaaatttgttgaaatcaaagcgtccgattccccgtctaacgctggaaatttgatagggaaagattttaagtattttatcaggctgcaccgtacaattggtgttcatgttacgcccactattgcaatcaacggaatactgaacacctctttagaaagttcgacctccgttgacgactacctaaaggtatttggccaacaattagagtcatgaattgcattccttttgctcttttgtcctgacggctatccttgcaagataatggcctctcatataagtaggagtatctgatttgcagctttacctatgacatagtatctgtaggaatcccaacttagggctcgcgaggtttgaaatatccatactacatgactaatctctcttaactaactgatgtcagtgatcaccccacaacggttggtccacctttccacccaatataaaagtcttactgatagctggtttcttatttcaattgtagctttaaacatttgcaatctccctgaagaaatccccaaagtttatcattatgcgttagagctctacgctaataatggctctcctaccatacaaacggcggagaggtccttgaaaacatgtcagacattaatcgaccgatatgcagtctcactagagttccaaaatgataaggatctcatcaagcagaaacacgttacttcaagagctagagaagctctgctgaagtcagcagccttgggaggattaccaaagtgcataaattctatgatgcttcttaaagaagccactccattatcattaagagagacagcggtcaaaagagactttttgctttccgaagaggcagtaagaactgaaagagaaagaggaaggcagttttggaacagtgtttatggaaagatttcaaatagagtgatgggccaaatgaacaccgcctaccctgatctatggcactataccttcaaccatgtgtacgctccactattgagttttacagatgtattgtcagtaaaggagacaagtctggttgtgatctcatgtttaattccgcaagatgtcaatccgcaattgaagggtcatcttaaaggcgcagtgaataacggatgtactctggaagagattagagacgccaggttgttaactattcaattatcgaattggtgtggtgttaaatggaaaggagaagtagcgagtctatgatatctatattagtatggctattctttaagctcaacttgactcaataacgtttgagtttcctgcagttttatccccatttcggtagtctcattcttggtttgagactcatagtaaagactagtatctatatttccagacgatgctgagctttcattcaggaaaccattgagttcctcgtcagtccgtccaaacagttcgtaccaaaacgaaatcttcgaaagatcgggatatacaacttcatccaaccttttatagtctggattgacaaattgtgacttacgagctaaaaagtaatcccacacagaacgagtcttttcactcacttttgcctgtcttcgttcaagttctgagtcatacaaaaatgttccatattgacatgagtagaggtggtagagtaaccttcgtagaaatcgctcgttgaactcaaatattgttgggttttgcttcagtaattgatagatacagtccaagaactgatggaaaattggtgaagtatatttgacgtgtttgcgatgtctaaagtgagtcgttacttgcttaatggcatgttgggcctggttggtgctgctatactccgaattatcaacaaattttgtttcactttgcaaatgaccagatctctcgttgaatcgatgaccaaaagaaagccagtccttttctatcaaaaccatgattccttctagtgtacgataatagggatccagcagcaattgagctagcgctgctaattgtgatgttctatcccaaccatcagaacaatgcaacaataagtgttgtttatttaaatgtagagacttaacaatcatgtctagcccggtcagtactgtgtaaatcaacttaagccaaccgctttttatcaacaaatcttgattgggtggttccatggaaatgtcggtgttttttaaagcttccgtcaccttatttagactatccctgataacatgtatgttgtcaatgttcaaaaacacctttttagcattggggtaatattctacaatttctgaacctgctcctagggcagtttgtgcgattgcattagctacaggcctggcgtccacaattaatacagacgaggcgtcatttgtcttcgtgacctccaacaaaagtttctcatcttgcatcgacctattctgcttcagtcccaccaaaggttgggagcaacgtattattgaacagccgttatatttgtgatagtatgttaaggcaggcattcttcctttcgatctgaactttgaggcatgatgtaaaacgctattagatatgcttgctggcgtcacaattacacttggatatgaagtgcaaactctgtatgactcgttgatattagacattctccacatcttgtcaccgggatgctcactagagctattcggagaattaagcttcaaaccctgacgtgcaaattccctgacaggttcgtatattttccatccatttaagggtgcctcaattttaactggactgtataagaatgcatataagttctccaaggaattgacacatgtaagtttcaacaagctctcaaagacatcgttgcattgtttgacatccttaaaatcaaatgccaaaaaagtataatctctacatatgattcgcagatttgcacctttggtcaattgaaaactttcatctttgtctggcgcatataataaggcagaccctttggtgaaagtgactcgttcaatcataggatagcacaaccatagctcctgcgaacctcttggtgctgtttcaacttgtggcaaagtgaagattaggtgatgagtggttaaatgcaacacacctttaacggtgttacctttcttgtgaagcacagcatcaggaacctgtgcaatcttgatgtattccatcggaagtcaatggatccgtagaggacttttaacggaagacagcaggaagatccaagagggttcgaataattcgagggaattagaagtatgagatagaggaggagatgacacagatgaaatttctgtgaactaccattaatggggccagaagtgactgaatgaggaaacagatgaaagtgttgtggcccacacatatagagatagacttatagtccctcgtctaacttgaagcagtaactgaaaactgtaacccgagcctggtgtatagccccgaatttgcttatcgctctcgagatgtcttaggccctatcgctatcggcatcttccctcccttctgagcaaactgtaacgcaaataaaaccatgggtttaagaaactccgtattattagaagcgccccaagtggtattcggagaaaaatgtattacttttggatgcaaaaactgctctacacatttatcccagtcaaaacaggttatcagtgacaaatataggggtaggctggggaatgcttttttagttaataaggtgtaagtatcttgtactttctattagagttcaaactaactttagtgtgaatatattaagaggacaggcagaaaggcgacacatgactacaggtctgtacatggtgtgcgacattaagtgccatcaatgcaagaaagtaatcggatgggagtatttgtcagcggatgacgatactcaacaattcaaagtgggaaagtttattcttgaggcaaatgggatcatatatgtgcaatgagagtagaaaaatctacacagagtatgatttgacccgactgaaagtgaatggtctctcttttgccaaagaaaaatgcttcatttctccatcatctttattctggaaatatgcagatatccaatgtaatttgtgatgtttcattcgccccaggtttttgatctgaagtgtctctgaaaaactgtatccctccacggagccttcccctgtgattagtacttggccatccatggtcatcttccaagtgccccgaaacacattctctaagcccagttcgtgataatttttatttagtcttggaacaactatcttggggcttaaaaacgtcaacaacctttggcatgtaccatctggatagaacctcacaaatcgataataagtaacacaccttatcgggtttgaccatgagtttgacatgtctggccttcccccttctctataataattgatgatacttatatatgcaccattgaatttcaaaaaaggtctttgacttagcataaggtgccaatcgcccttccacgtattctgacatatttggtcttggctgcagggagtgtcttcatcgtaccgttgtctggaataaacaattttacaaagtttctcccaaattgatttgttatggaacccgagatacgatagttttttgcaagtgattgcaaagtaaaaccagctggatgagtcagcgtcgcatagaagttccattatatatatcaacaagtcatcagaaagcaaatgtaatggtgacggctcgttttcttcctcgggtgtaatttgatcttcgttgaaactattcaataactcttgaacattaatctttttaactagttcaaggtcaacggccggtttttctatggtattcttgttgtggggagaagcctgcttcgtaatatcttgataccggtaccagcgatcaactttttcgtctagtttataggcctttctataaagctcaacagcatcgctcattgcaccctccatttctttctcattggcctggtgaaatagatcataggcccttctttgcttgtcgtctagttttgagaggtccacagctccatcacttttaattgaaagcgtttggagttgactatcaagcgtcattttggttggtctatgcggaagttatcgataatacgcggaaaaatgagatcgagtaagctgtatgcaggttgaaattactactctggaattactaccctcaaacaacaacgttggagtacgccaaccagcactcttaatgtgacctcacattacgttttactgactgcgattctactactatctcgtacttagctattactcaagatgccaattttgttgtcactgtttcaggcatgtttcaaacatctgactggtgtactacttaaagaaccatagatcataattcctcatcaactgttaatggaagaccccgaaaataagtttgatgactacattgtgattggtcaagttagagataagctggagatacaggcttcaccaagatttcaaaagtatttggacaatttatcattggtgtttcaatatcttttggagaatccgaatcgtaacatactcaatgatttaactagtaaaacttctccaattgaacttagatctccgccgccaacaaatggatttcaaccaccaatgaacgaacctacacaaatgttcaccattgacctgcaaaataagttctctatgaatgagcaatacaagatgtatttcaacctgcttcaacaaattgtctgcaaagaaattgcaaagctatggatcaaggtgattgaacccaaaaaacagacaaagtttccgtacaaaggaggatactgtacgaggcctccgtggtggccaaatgaagttccacatagggaacctgaccaccttaacaaatctgacagaattactcttttgatcactatttgccatcttgatgtgacgtacttgcaagatctttacaaatccactcagtctgtggaattcacacctgaaaaaagggagttatacaatgagttattttatcttctctataaagagtttgacttccaaagacataggactgactcaaaggtggtggtgagtttgttttctaggaaacaaaaacaattgagtaaaaataggaccgcaaagagtcaaccaagacgaaaatcgatttcgaaaccaccgctcaagaaggccaatgatgagaatctccaaatggccaaacttttatatgagcacttgaatcttacagcaaaccctgagaacccatcatccattaacgatattgatatcacaaatgagtatttgatttcttcggctccttcgcattccaatgtaaatttcaataattctttcggtctcggctttaatgagggccacgatttacctgatcaaacggaccattactctatctacaacaaaagcccaattttgccaacagacaagcagccaaatatacccctgtgacaatatcagaaactgcgatttgatctttgatgaatcagacccagatcccctcttatcttatcttatcttatcttatccgatttgagacactgaaatttctcgctacagtaacctttttgtgttattggaagactatcttgaaatattaccaaacaaaatgaaagtgctgttgttgctctttatgggatgcttctttaagctgggatcaagtaaggggatcagtgatgaaactggagctgcttgtctctttgtagcttcaaatttcagcaactatccatttgattgtgctcaaccagatctagaatataaatgccgatgcttgagccctgagttcttgggaacagttttgctctgcatcgatgataatactgatgaaattgatgaactcactcgagcctttgactatattaaggaagtctgtggtgtccagggaagtaagaagtactcctttactcaattgatcgatgtatttgacaatgcaacatctcacgcaatacctgtttcagtggtgaatggtttgaacaagtcacagctccataacccagtaatacctgatgctcaaaggttcgcatcttcccaggaatctgttcggcgtttgttgaaccacagatataaaagcacaaagtatggcgtaggattaattggctattggggtttgagcttgattctggccactacaaacaatgttttacaatggtgctttccttacatttatatgaacatgaatggagacactactcgttggctaagagagcacgtaatttgtcctcaactgatctcggagagtcatttcagaaaaaactctagaataaacacattcgtgaactctttgctaagaagttttcctataagagttcaatcaataacagtggcattctacatggctctggtgacaatattttgcactgtagattatcaactataccgccctaactcaatatttccgtggaagaatgctcaactgtttgcttacattgctgatagaactggtattttagcaattacgcaattgccgatgttgatcttattttcaggaaggaacaacgtacttcaactcattaccggatggccctatcgaactttcaacatttttcacagatggattgctagaacagtttggattcttgtactattgcatgccgtgttctatgtagcctttaccgcatcttgttccaattatagagaacgttggatgataaacaagtggaggtgggctaacacagcttttgttgccgcttcaatatccatatttctgagctcacgatacttcagacgaaaatgccatcagctgttcgtatctagtcatcaaatattggcaattatttttgttttgggatgctggtaccattgcctgacgttgggctggatggagtttctctatatcactgtagctatttgggctctagaatacttttctagatttggaaaaatcatgcttagtggtgggatagttcagggtaaatgcacattagtcctcaacaaaaagcttgaacctcattccttgagaatcacagtacatcatagcggttggtggagaagttttcctggagcgtatagttatctttacttcctaaaaccgaaatttttttggcaatctcacccattcaccattttagggcctgcgaggcaggaagatttcaacaaattggtttttttaattcgtatcaagaatggaattaccaagaaactcggaaactatatcatgaggcaggaaaacctcatgtgcacgcttcccatgttggttgaaggaccatatggctcaacgattccgtttaaggcttatcaacattcaatattttttgctggaggtgtaggtataacagtggtctacacgtttgccatggatctggcacatacatatcttgctgataaggccaagaatcattcgatcaatgtaatctggtcagcacccaccatctctgcaattgaagagtttgtggacgagattgaagcactgtcaaggtttgaaatggtgaaggttataatttatctgactagagaacttgaagccattctgcccattgacgaccaggagctgaaaattgcgccaaaagaaatgggagatcctattgagttggtcaattcgtgcactgatttgtccaataatgagttagtacatcttttggatccactctcaactggctcaaaagaacttccaactgagctgaatcaacgtatgaatgaaattatttctacaacagaggagcgagtgtcaccggtggagtatgatgctacgagggagaagctgcagaatgtatttttcaggtgtaaggttaacttaggaagaaggccaagcatcaaaaaagagctcccaggattattgaagcttattccggatacaacagctgtggtttcatgcggtcctgataaaatgaaccgagatgtcagaaatgcggtagctaaaagtctacgggagcccaataagggtcgaattgactattttgaagaagagctagtctggtaaaaagctcatgctagtcacattcctctggtccgtgattctagagatggagaatgactaagagctttgagcggcaggtttttaagcaatcaccgaacatctagtgcggactccttcgtgtgcgcatgccagtttattgtaccccgaagaaatcgagcactgaaatttctgaacctcagcacaagttttccagacagccgagccgacatgattgtagatttcatacatagaacactattggaaagacacgtctccaagaacaactctaatgagagctatttctagagttacaacattgtttcgatgctatagcacaattccaataccaaaagccggactgccattgggcgactgtacgatcgaatgggtcaaatctttgataagtcaagaagtcatgttgcaagatcaacaagacaagttgatgaagtttgcaatgccatactatggacaagaaaaaggtgttgatggtttcaaggctgtgaatgagaagattgtgataaacggctctggggatactatcaacggaatcagagtggaaaacttgaaagatcaagacaccatgggaaagaaacctcttccgttggttatgttgcatggatacggggcagcattggggttatttttcaagaattttcatgggttagtcaaagatcaaccaggatctacagtgtatgcattggacttgcctgggttcggattgagtagtaggaaaccagagttggatgtaatggatgaaactctgaaacatctgcatattcagtttgattctcaaaccgtggagcattataagcatatccacagatctttgaggatgccagacatgtttagcttagactataatgagtttgaaaattacaaaaaaggtcaaaaggaattgattgagcatgtcgaaagtatttatattgatgtgctcaagagatggctagacgctaaacttatagacaaaattgatttattaggtcatagttttgggggctatatgtccattgcctttgctttaaagtatccagagagagtgaataaattagtgctagtttcaccggggggaatcgaaagaagcccttatgcaatcactaacaagttacgaaaaccaaaagagggcacattggttgaattgaaaccatcaggaaatcctgcagattacaggtttctggggcgattacccgtgatgagttcaacttttatgaaattctgggaaaaggatatcaccatgtttgacttattgaggcttagtggacccattggagcccaaaaattaactgaatacatcttcagtaagtacaaccgtaataatcagttcaacagctatgaagaactgaagacgatgtcactatatatgtaccattgtttcagcaaggcaagtttcagtgatcgcactattttaaagatctttagtcccaccgttgtcgcaaaataccccatgctagacaggattcatgaactaaaagtgaaagaaagcctgtggatctatggtgagtttgattggatgttcaacagttgtggtgaggaggcagtaaaggagctcacaggatatggcaagagcgccaaattcgacgtagtgagcagaagtggccataatctgtacctggatagccctgaagaatttaatcagaaggtgaaaaagtttttgcagtggaaatgaattaactctataaattttatactaatcctttttcctgtatacgtaacctgcacctgcctggttggtaggaaacactagtgtttcagcaacgacagtattttctcttctagtggacgcaaatactatgagttcagcaatatctagtgcgttcaatggttctgcaccctcatagactttagaggcagactccttcgagcccttgtatctaacaagagagaactcggtctggactgctccaggatcaatttcgatgactctgatcttggtgtcgatcagttcctttctaagggaatgcgagaacgatcgtacagcagccttggtagcacagtaaatccctccgccagggtacggatctcttccggcgatcgaacctagctggataatatcacctctgttacgagccttcattcctggcaagatcagctgggtcaacgaaataaggccaatgacgttggtctgaaacatcccatctatgtcttcttgtaggatctgtccgaccctatcgattcccaaggcttttccagcgttgttgaccaaaacgtcgactgctttgaactcttcaggaagcgactctacatactctgtgagttttgcaatatttgacacatccaacaaagcaatgtgaactttgatattgggccattgagtggtcaatttttctttgaggccttccaatttttcaaatcttcttgcagaaagagccagtttgatttctcctttggctgcattagcatattccagagcagtggcttcaccaataccagacgaagcaccggtgattaaaatgacttttcctgccaatcttgaggctgcagctaatccgtaagacattattcagtttgtcagcaacgtaacttgcaaaggttgttctttatataggaaacggtaattatctctatccaatccaattacccctaggtccatcacattagatgacgtaagcagtgatttgtatggcgtttccaaagataacgacatagggagaaaaaagtaaaaatgtaattagtaacacttagctatatagtaaattgcagtaatcatgataaagtgtcccttttgagaatcaccattgccagttagtgaaaccatgactttttgggggtgtgtcaaagcatccttagacaggagttgcctctgtttacatttagtcgtgtcctaacgttgcattgatcccatgtgaaacgtcgattagagtcaattaggtactcggcacagactacccatttagagtttgccactatacacccgtcgaggtacaacgggtcggcgcataacccgataagcacacaaaaaaagcaaggattgacttagttcgtgcgccggttatttcacaaatccagtatcagctagtagccagtcacatgaccaacgccagtggcatctcttctcctcacttcatcacatatttttcggaatgacaaccagtgtcaagttgtggggtaccgtatttttatgcctttccagtccgaaaaacggaacctgaaacagcaagggggaaatggtatctttagcacaccggtggatagttctgaaacattcttgctggacctcgagtcctctctgtgctacctatgtcaatagtcgctacgctactctttgtctcttcgcccactaccaaacgattcgaatatctcgtataaaattgtgccaatgctcctcacgtgtaacccccaaacaccactgaaaaagatgatcattttcacatgcgcatttctcttcagaactccgaactttaagtgtttattaacgcacagcatcgcctcagtaaaaggaaattaccacttactaatcacagagcaattgcaaccaaccatctctttctattcatttaaaagtgtcagaattcctaatatcctgggaaggcagactctctaacgattacgtaacacattgtatttcccaaaaaaaaattactacgctcgcccatgctaaccccccaatatcgccaacatgtattgtctccgtttgagtatgtcaaacccggaactgctattgtgaacaactcccctgatgtcactatgacccataatacaatagataatagtacttcggatttcacgtcagagatggactttgaaacggcgtataacatgctcatgactcacgatacactgccctctatgggaacttctccctcaagttcgcatggttttggaactctggcgacaagcccaggggcaggtcaacaggtgtttaatgggtttcaagggtactcctcttcatctccagatcagcagcagaaagttaagacgccttcaaatcaaattatccccgatccaagcgcagagttcgaatatcaccgcaaacagatcctaaagaattcaggtgcaaatggctcccagccttattctacggcaaatggagtgtctcctaacacaagaaacttgctacattcaattaattcgaagagctataagaatatgttcggtatgttttccaatacgcccacgtcttcatcctctggcccaagctctgatctcctgtcgctttctgagagcagcgtgttaactgagtttttggatagtcttgttgacgatgttaaactatcttcactttccaagcattggtcatcgattgatcccttggcaaccgaaaaacctttggagactggctctcctctgaataccatgacattgcccgagttgaagcttcaaaactcagacttgaaaaccaatttggcttccatcccttcaatgcacaagatcaacctcaatttttcaaataattcaagtgcagacacatctcgatgtcagtcaccttcgattttaagcttcaaaacaaagtcagatagcctccaaccaccattaacaagcgttaagaccgagattacacacgaaaggataccgagatcacccaacaagtccacagctacaaagagaagagcaacaacatgtacaaatgctaataaacgcaagcgctcaaatgatggcagaccccttctttcagaagacgagaagcgacgcaaccatacttcgtcagaacagcgacgaagaatgataattaaagaagcatttgaagaattctgctcactgaccgttaggcctgatgagaaaatacgaactgcaccctctgcttcttccaagcctgcagcacaaaaaaccagaggtaaagatgctaagaagagtctcagtaaatatctgattatgacaaaagctattaatgaaatcgaaagactggtcgaagttaaccagaagttaaaagaattactaagttaatgaaactatttaagtttatttatgtatcagttaatgataaacgacactaatgagccatgggaaccatgtattgtggaactataaattcaattcttgtagcagctttgacgccaaccttttgtaaatccaagcatttcccagaattttcttgaacctcacaccatatagtccaaccagagggactttgacaatatgaatttcaaatttcaaaggtgtacggtgtgttgatccttcgttgatactaccaagatcatcatcatctgtttcctcttccttgactgtgtctatctgtctagcatttctttctggaacatttttcaagatcatatcactgccacctcttatatcatgcagcgactccatggactcattatcactctcggtatgataagacgatgaacgagaatgaacatttgcaggtgcaggagtaacaggggtatttacggttgcatcgtagtcatcaaattctgtcccgtcaagcgtgggtttccttatatggttaaggattccgtttccaagagaaaactttcggcgatgtttcaatcttgctgaggacggcgatgaactatcatcctcaataacattgactctggtattggctgttgacgaagatgacaatttggaagagtttgcaacatcggagtcagtgtcatcggtcactcttgactctataactggagatctgatatccccaatttgtaaattttcagtttttctgtaaacgcaaacaaacccaccgttaacttcagtgaattgaatgttaagtttgcagagagctgctataatgttgtatcgaataacaggtaacggcttcgaggatgtagtctgaacagagaaaaatcctttgagaaacaaggtcctggggtactcaactgagggcatagttccaggtggagcatgttctgcctcaaataaaatttgggattctgtcattggtttgatatgcacgttagtattagcagagtatttcccttctgggtttaataaattgttatcggtaatttgggcatcttcaaacacatcataattttctttagtaggcaacgcaggtaattgattgtttgctggtcctccgaatttgaaattaagcgattgcttgcgagaatggccaagtgacttggctctcgcagtgggatgtagccgtctctgttgactaggagccaatgttggaggcccacgttgttcgtttggactagtcgaagcctgtaacttctttttgatttcatgatcattggattgaaaggttgtacctgtagtggtaggttgggcatgtatcggtatgggagcattcttaggcggttgctctggaatcgtaaaattgggcagtcggggaaagtcagatgtcacttgttgcttttctttgttggtaattctcaaacttcctacacgacgaactaatttactatcatcaacagggtccaggtagtttttggagttattggaggtcacattcttcacagcagctggttgagtaattggtgaaacgccacgtactgaagtcctgtccgcatcattaactgaaaatggatgaacttgaggtgggggagatgaaggctcccattcagcctcattcttatggggtcgttttccactgagtcttcggaataaagagttaagaccaccagagttattcttgtgtacattatagccgccacgatcttgtcgttctggagcatgcttgatatgggtctttctgctagcatgttgttgctgcgtcatatccatctcgaaaggatgagcactagataatggctgtgccggttcaatcatcgcttccagttcagctggctgtccatgcggagatgtataagcaggtgggacagtggcaagcaatggctgttccacatccgtagtttctagtttctggggaatagctggtgtctttggaatgtctggagacaccttgacagtgtctaataccgaggtctgtcccttgagagcaccttttgctagcttcctcttcctcatttcatccacgaggtagtacgttgaaagtaacgggtggaaggcgatgatagcagaatcgtcacgcgcggaatagcccttgatattagctttctgttgatcaagtttccacctctcaacacacgcttcatattctctgctcgagatcaggtttgtgatatctcgagcaatttgttcttcatttcctaaacccagatttgcaatctctcttactacacttaaatccaacggtaatacaataggtgaccgctgagggagatagtttgatggaggccctgcaaatcctaaggtcatccaagggtgctccattgcagctttcaaagtgactctatgatctggattaacgactaacatctgagatagcaatgaatgacataaaggtgaaataaactcaggatactcaacttttcctcttttgattttagcatgaagctttggcacgctgtcgtcatcaaagggaaccttaccggaaacaaggacaaataatacaaccccaaaagaccagacatcaatttcaggaccaatgtaaggacggcaagacaaaagctccggtgctgcaaagtatagggagccgcaaaaggttttcaggagatttcttctatcatacatgttggaaaggccaaagtcaatcaacttgatttcacccttgttgttaatcattatgttttcaattttcagatctctgtgaacgatgttattagaatggcagtaatctaaagcagaagcaatgcttctggcaaactggcgaacgcgtgtttccttcaatttgccatgagaaacaatataatccagtaactgtaccccctggactatttcaaaaagcatgtagtagtgattagacattgtatagcattcgaacaaccgacaaatatttgggtggtacattatttttcctagtgctgcctctctgacagtacgttcatcgcgttccaattccttcttgtattcatcacgcagcttctttcttttttcttcagtttcaggttctggatcgttttggtgatttctctgccagattttggctgacctaatgactattttgatggcacatacctcgtgagtgactctatgtttggcgactttgaccttacccatcgagcctgccccaattgtattactaaattcccagtctccaatggaggttcggtggaattgttttgtggcagattcaactggaaccaatgctgccggggcatccaatgatggttgtttctgtggagtatgttgacgttgagagtgttcatgtgtgtttaattctttcaacaaagctgctgacgtacttgaacttgcattgcgaagcatcctagcagtagcaggagcagaattttgtattacaggcttctgtggctggccaccagaagaagctctcaactttggtacatgcaccgagttggagaagggatcctgtggcagaataccctgttctctatccatggttgagtctgtttatctctccctcagaacagttgtgccaataaaaagcctacaaacttaattgattggctgggtgattgtgaacaggaagataaattacagatgtgtgtctgtcaacctactttgagcaagactgtactcaagacgtagaaacgataagccctctgggtgcagttatgtgtagtacactatttgcgcacagccgtttatgtaatacgtaaaagatggcatgttaaattctcaagtacatagtgattggtttcgtacgaatcggaaaaggagccatcgataaaccggtcatgaagtttatgttatccatcagctaaaaagatagataacgaagactttcacccttgaacaagaatatttattagttgcacgtgacgtacgaaagaaatatcggggttgtagtatctaatcacattattatcgcgtcctacagatgagaagagacttttcagatggcctctgatcaacccaaaagaccaaggttttttgatgatagactggaacaacttgatcctgatgaggatagtccaaagaaagtgaagctttttgtatctgatttggcgtctgacgaggaaagcccttccagagaggatcttcattctgatgatgaatttgtcttgtttcaatcagagatcagttctatcgtcaccaatatttctgaaacagcaatcatgcggttatatgataaagtgaaagggcactctaatattctagaatcagctttaaacttattctatgaccaaccggagacctttaccgaaactgacgaaagtaagagaaaagacctgaaagagatcagaacaattgaaagcaaaattaacaatctggccaaccaacgatttacagagaaacagaaagagaaatacaaatacattggcactctggtctgtgatggttggtgttctaggcctcgggtacaaaaaattcaatatggtagtaggcttaacatttcaactccgccgaaaagctcacccgcaaaaacctccaaaaagaaagcatcggcttcccttgtaaggctaactattccagatacttcaaatcaaaactaccaaagagaagtcggaaggctcccagaaaacatagccaaaaccataagtccccttattgaaatgggcatcggaaagtttgaagtcacagttatattcacagatcaaagaactatacgtatgggggactcttttttgattcagttggattgcttcatcaaagactcggcattcaccagccctgattcagaacactgtcttactagcgatgaaagaaaagatgttttgaagaaaggtgctaaagaattggacactgaagtcttgatgagaaagaaacaaaaatcactttttgatttatttcagctattgggattgaaagaattgactgaacataataaactggaaggtgaaaactcagaacctgtcaatctggattccggttctgacaatgaagacgaaaaagcaccaaaaagttcaacagctgatcatctagatctgaaccagcttaaccaattttacaaatcagctcaattatctcatgagaaggttcatcttccagataccactccaaataaaaccgcattttccctagacttgagaacttatcaaaagcaaggtttatcatggatgctgagaagagaggcatcatattctttgatcggtaaccctgaaggctctcaggatgcaagattggtgaacagctttaaagatcacgacttaaacaagctccatcctctttggaaggcttacaaatggccagaagatcgatcctggtcaaatgttaaactatccgagaactctcacgattcttcattttcatcaagcaaagagttttattacaacatctattccggaaatttttcattcaccaaacctctgttaaagaacgcatctaagggtggtattctggctgatgagatggggctgggaaaaactataacctctctttcactaatacttacttcaagcgaggatacagaacttgcaaatgagagtaatattcctaatgactatgcatacaagactacgcttataattgtacccatgtctctgttgtcacaatgggaacaagaattcgatcggtgcaacgcagatagccaaaaacgatgcttcatttattatggcaacgagacattgggtgacatgaagcaacttctttgcaattcgaaagaccctcctgtggttgtgctctcgacatatggtacgatccagaatgagtgggctagaggtcacaaggtcacagatggtaatcttctcaatgagggactgttttctgtcaaattcttcaggataattcttgatgaaggtcacagcattagaaatagatcaaccaagacctctcgatctatttttgatctaaaagcatctagaagatgggttcttaccggaactccaatcgttaacaggcttgatgatttgtattccttagttaaattcttaaggttagagccatgggacaacatttcgatctggaaacatttcataacaatcccttttgaaactagaaagaatttggatcaatcattggaagtactttctgcaattttagagcccattattcttaggcggacgaagaaccaaaaggatgaatttggaaatcctttagtggtgttaccgtcaaaggaagtagtcattgatagactcaaattcaacgaaaaggaacttaccttatacaattggttcagatatagagccgagaccacattcaaagagagtttgtccaagggtacagtccttcaaagttatagtgatattttgacccatattttgagattgcgacagatatgctgtagtattaaacttgtcggaaatttgtttaaagattcatttatggaagatgataattttactttggatcaaaagcttattctgacacagtctgacgaatcagtagaggttttagcatcatttgaaaagaaaatggaagaggaaaaactaggccctgatgaaatcatatccatcaaggaaggcatttataaactttacccgtcttttgaggacaccgagtgtgctatctgtacgacaagtccaatctctattgaagattgcatgataactgaatgtaagcattgtttctgcatcgggtgtctcatggagcattttgaatttcaacagagaaagcaagagaatgaagttttatgtccaaactgtcgttccaaaataagcaaactgcgtctcttcaagacacatttagtggaggatagtgagagaggctactccgtgactttattccatccttatggcagttctagcaagataaatgccctattaagacatttgaaaactatacatgagacaaaagaacatgtggtagtaatttctcagttctcgtcattccttgacctaattcaggccgaactatcaaagtataaaaaagaatttaaagtgatgaagtttgatgggcagttgtctttaagtgagaggcaagttgttctgaaagaattcaatgacaacccagaaaacgggggtataaacgtgttgttactgtcccttaaagccggaggtgttggactaaacttgaccaatgcttccagagcatttatgatggacccttggtggtctcccagtgtagaagctcaagctattgatcgtttacatcgaataggacaatcgaaaaatgttaatgttgttcgattcataatggaagggtctatcgaagaaaagatgttaaaagttcaagagcggaaaaagcagttaggcgaagctgtcggagacgatgaagaacgacgtcaaaggagaatcgaggagatcaaattgttgttcaatgacgatgagtgatgatccaattgaattcctctgtagattatttacatttagtacaacaccaagctgtcctcttgaatcaacttttgacaattagaactttctccctttatccattgtttgagaacactccttgatattgccagtggatactgatcaagagatttagagttctcgatgtcagatgtggtaaaccacgatcccatataatctaatgttgatatcaaatctttaactcttatgcatgtgaactttgataacttttgcaaggtgatggattgacagtcactaaaacggccatatagcaattccctgcagatgactttggaccagtattttagataccctatctttccaaatgctgatagcgggaactcaggtccgctaacctttccttcgaacctagacagttcgtatgaaaactctatcaataagtgtcccaaacgctttctctggaaagggggaaagatcaatatgcaagctaaattgttctcatcccaggacaataactctttgctgaaaaagcccattggcactcgacgtccattagactccccaagtaccacgtagaaatcaaagttttctatggaaaaatagactgacttactgtccaagaataacttggcaaacaaacaaagattttgacaaaggatggtatgcctgtacccactaaccttcttgatagtgaaattatccttatacatggtctttcctggaaatctgtagttgtgcttgcaaacagacagatgactgttcagtaatgcctcatctctggtgtacttgaaacatagatcacaaacatagagcgtatctagccagtatgaatctgtgtccccatttatctgtggctctgaatgcttcctgtgatgtattctttgatgggcattaactgcctcatatcctaacatatcgtggtgaccctccaagaaataaacactattaccgtacaaagtatcaaactcgttatcaccgagtcttacccttcttatgtttctcttctgtgtaactccgtaatagccttcattatcagacattacttgggcagatgcgatgcctaactttgatgggttcttctactttccaaggatatgtaatgcctcgaatactagtcaaatgaggggctagggaaatacttactaacgaggtgataattacgtactctaaatagtcttcacgaaaaaaaggggaggtagctatgaaatgacaaagaaatacaggtaagagggaggtgttgctaagtatttaggggaggttgtctagcgttccgacatctcgcagacgatgttctgtcaggcgaagttgggtgtctctatttgtgcgtaaacttggaaatactagagcgatgcttgcttgccaatctttgtctatgtttaaactgtaatcataacatgctgcgtgtccaataaaaagcacgctgcaacctgttgtctgacagaagtttatttactggcatcttgatctttccatccctctttgtcattttcgctaagaagtatttttttcctcatcgcttgaactatctgaactttatctctatctttcgtatcatgggtaaatacagaaagagattcaatgaaaaggcccgttcaggaatgcttctgaagcaggctactcttaaacgagctagaaacaagcagtttttcagacagcctgacgaaattcctgaagattctccggatcaaaatgaatccaaagatgagattgtagataccaatgctgagtatctaaaaccggaaactgacaaagagaaagaagaacgtaaaagacaaatgcatgagatgttatttgagcaacacaaagaatccaaagtatcaagaaacaagagaaagagaatggaaaagtatattgatcaccagttgaaaagagaagaaaagcagatcttgcttcaaaagttacaagaaacaaaattcgacacgtctttgcttcaatcttctaaaagacttggatccagcaagctaacccgtaaagaggagatagtcgaagctctatcactcgagaaacaaggtagaggtaatgatagaactaatgacatactttacgaagaacgagaggtgaaacaatgggatgaaattaatgatggtgacgacatatcagaggactctggaaaagatgaaaaagaggatatggctgcggctcgtgtgtcaggtttcatagatcataggccgactgcactcggaggaacaggttctggattctcttttcaaaatatccccaaagtagccaagcgaaagaatgaggtaatcaaaaaatacaactggagacaaagacttgaggaagaagaaagtaagaaaaagagacaggagctggaaaatgattttcatgattctgatgaggatggaaatgaaaatgagaacgattctgaagtccctgatgaggcaagtgaaagttctcaacccgacggttcaggtctagatgacgaagatgacgatttccgaggattttctgacaatagtgacaacgagaatggctttgaccaagataatgccatcgagaatttagaggatacctccgattcagattcttccacttcagaggattcccaacactcatcttttgaagaagattcggatcaaacagaaatcccgacttcttcaaggggaaaatctttcaaagactgggcagaaagccagcttaaagaaattaatggtgaagcaaacattatccagactgaacttcctcacagagattacactccattggatagaccagaagacaaagaagacgatttagaagattcgtatattcctatcgatggaaataacaaaaggaaagtgttctatgtaaccgtcaacagatctgaaaccattcagaacattagatcaaagttaccagttttcggtgaagaatatagaatcatggaagcaatccacaataatgattgtgtcgtcatctgtggtgagacaggttccggtaaaaccacacaagtgccacaatttctctatgaatcaggttatggacatcctgactctgaaacgcctggtatgattggtattacccaaccaagaagagttgcggcggtatccatggcagaaagagtcggtacagaattaggagatcatggatctaaagttggttatcaaatccgatttgatgctacgattaaagaggacaccgctgtgaagtttatgactgacggtgtgttgttaagagagatgatgaacgatttccttttgttgaagtattctgctatcattattgatgaggctcatgaaagaaatatcaataccgatatcttgattggtatgcttagtcgtattttgaagcttagagcaaagtatcatgagcaggacccttctaaattcaagaaattgaagttgatcattatgtctgctacattacgagtttcagacttcagtgaaaacagggttctttttgaagttcctcctccaattcttaaagtcgatgctagacaatttccggtttccattcatttcaaccgtcgtactgctttcaattacgttgaagaagcggtgagaaaaagtataaagatccacaagaatctacccaaaggaggaattcttattttcttaaccggacaaaacgagattaaccaggttgttaaaaagttaagaaatcaatttcctacaggaaatagccaagaaagcgttcctcaagtggctgtccaccctgaaaatgcagtcgtggaaccggaagaagttgatttagacgtgaatatcgctgaaatggaggatgattacgattcagaaggagacagagaagagggtgaagaggaaggattcactgaagaactggaagaagaccaaacctctaacgaccccctttacgtgttgccattatactcacttttgcctacaagggaacaaatgaaggtcttcaaagcaccacctaacggtgctagattgtgtgtggttgctactaacgtagcagaaacatccttaaccatccctggtatcagatatgtggtggactgtggacgctccaaagagagacgattcaacgaagacactggagttcaaagttttgaagttgattggatttccaaagccagtgctgaccagagaagcggtagagctggaagaactgggccaggtcactgctatagactgtactcatcagctgtgtacgaaaatgatttcccccagttttctattcctgaaatattgagaatgccaattgagagcgttgtgctgagtatgaaaagtattggtattgataatatcgtaaactttccatttcccacacctcctgatagaaacgcactatccagcgctgaaaaactgctctggtatttgggtgctttgactagagataagaagatcacctcactaggaaagactattaattttttcccacttagcccaagatactctaaggtgctgataacagggaaccaacacggatgtttaccatacctgattgcaattatgtccgcattgtccgtcggagatccattcttatatgaacacgagcttggaattgatagcagaattcagcagaaggatgaagacgacgatagtagtgacagtgatgaagatacaaaaaaagaacgaccagttagagaatctgtggaagatattgaagcacgacgaaacttgagaaggaagtttaacgagtctaggaaccaattttctcagttagataaaaacagtgatgcctttagattgttatcagttgtttgcgcagctggtcatgtaccaagggataaactgggacagttctaccaggaaaactttgtgaggcctaaaataatggaagaaatcgaaaagttgcggaagcagatcacacatatcgtaaaggttaacactagcaaggacagaattggcatagttgaagaggtagatctcaaattgggagttcctacaaaggtgcaaattgcagcgatgaaacagatgattgcatccggtttcattgatcagattgccatcagaggagatcttgcatcccaggattgttcagtaaccaataaaactgccattatgaacattccatatgcaactctattcccctccaagacatatgatcaggaggatattgaccaatttgtctacattcacccatcatcgatcatttgctcatcggcctcagttcctccagattacctggtttatttctctttaaacttgggttccaaccgaagggctgtcaataaacttcgcatgaaacctcttgtcaacattgctggcaagccattatccaatgtggccaaaagttctggtctcatcacgttctcaaagcctttggaatacccttacgcaccgaaatacattacctcacaaaagcgagaatgctatgttatccccagatttggagcttctattggctctggcgggattggatgggatttaccagctatgaaggtcattcaagaaaaggagaacggtacctgggtagttaaatagagacagatagatagaaattacatttcctgtaacataataccccactaaaccctttttaggcaacagttagtcaagcgcgtagtgcgcgaagaggcacatttgttgttggaaaggtttccaaatctctctcattttctcaaggtcccaacccgaacatgacaagaacaaatgagagttccaaagatattttcaacgaatttactgcagactactttgaagtcgtgaaacatctgcaaaaaccacaaaatttcataactgaacttcaatttcctaaggtgataaatgtccaggatccttccttgatagctggatcatactatcagcttgttgatggtaaggatctcaaacctacagagctggttaccatcagcgacagaataaagagtggtcactacaagactatttattccatatttcacgacctaactttagtgtgcctgatacttataaacgaacggaacagagattcggaagactacgtcaagattgatttgttctacaagtcgatggttgagttattgatcagagaggcaggaagatttttgttcaactacagacaactaagagaaagcgttgactctcgtgttttagatgattacaccagtgagtttgaagaatcgatgacaaaagacttcaataaagtgtccacattttttgtttcatccaacggagaatgtttaactacattcatcacacctaatgcgccattgttttcgtccctgaataataaatcaagcttggatgctagagaagctgtagtgaatgaaggcgattttaatctgacgaaagtaatcccccatgtcccttccattagttcacagccgcttaacaagatttctcctcaatacaacaatgaacctcacccagccaccaaacctacggatttattgccaaacctctttcatttgaactggtacgcgttaccgatgggtcaatggctcacccacaataagggtaacgatttcagttttgcacctacaatagacgaagaaaaatctgcaatctccagtgaattgaagggcctgaggtggctggagcaagctggttttagaaagcttggtgatatagcagaaaaactgagcagaccatctaaaaatgagacggataatgaacttcagaaggacgaaccaaaaagaattgaaaaagagcttccggcacctgttgaccaggagactaagaatggccatacggggacagatacatcaactaaacttgaaaacacagataaggaagtccaggtcaatggatccgaagactataagatcaagctagacaacctcctctcctggactccgggaagcttcgttgaggaggatgagatagaggctatccgttccaacaaagagcaagaacttataagcaagttgctaatagatctgtcacaattacgtcaagaaaggtataaggcatcacccaaaatcgatcctgctaatcccgtcactgtcttgaaacccagtctcaaagagaagagattgtacttcaagattaagagattaatacaattggtcattcaaactcgcaatgtgactcctaaggacttgaaacttgatgtcagcttcaaactacctatttgtcaaacaacgtatagtggtactttaccagcgtctgtaccaatttacacgaagaacccttccagcagagttagtgctctgactaaaaaaagacgtaagtactagtatttattttactgagtatataaattgtcttaattcacattaactccgttatacactctaaagtttggagtgtcatgaggtattctgtcttcagtgaataggaaccttttctctcccctgatattctgctcaaccagtacgtcaccgaattttgtcctattgtagctgtacacaggaattctgaagataaaagtgtcatggggtgaaatctcaccagtgatcccgagctctgggggaccgtatttaggaaatgtttgaaatatgagattcagttcttctattgatatcacgggagggttagacacatcagtgatcaaaatcaacctgaaatctttggcccctaagaaccatttatgggaaaggacagatatttggtagtctgccaaatttatcattgagctatcactcgagtagcaatcaatcttcttcaaaggctccaaaaatccgtactgaaaaatggtatctttgaacttaggaacattgataagaatttcatattcgcaggtctgtatttcatcggcggagacaattcctagagtgttgagcttgttaacgtattgaaaccgtatatttgtctttctaggagtgaaagtcaaatcacaaatggcaccgttttgtaagctgagtgataaaaacaccgattggtgcatattcttctccagaactatgtcttccctcgtcagattcttgggtatattagccaggacaattcgcaagttcccgttatattggtacaattttccatttattatttgatatgtccaatatctgtccttggttggctgagcatcgttgaggttatagttttcaagtatattgaatgcagagtttatttcagtttgaagttctggtatttcactcaagttgtattgagctggaagagttttcagaatctgcttttgatgtagtttctggtcagtatcaatttcatcattaaacaaacactcaaaatattgatcgtccgttgatcttaatgtcactattttttctgaggtgggtgagatggcatgatttaagtagtttatggtatactatagtacccagttagcacggcatgatcttgtgaaaacaaaaattaaaagacttaccacagaattcttatcaatggaatcatccaaagctttcacaagacttgatagggagagcaggaatagcaggacctttatcataatgtccaatggcctgttaaccatggttgacgtggatgaaaaggataatattatcgcactgtaatcactatccatcgcgatagcatttatcaaggagaataactcgccgtctacttatcctcaactattcgacaatggctactaccctacaaagcctcgtcacgttgtttcttttcttggggtctacatttgcgtatcagttgaaggctattgatttcgctcagaactcgttcaacttggccacactagaatttgactcaaaatggaaattgcacaccggtgaacaactagacctgccaagtgatctttacagaatatgtttggacgaaggctgcttcaattacaaaagactaagttctccaattgcacaggatatcaagctgactatcaacaaacacaacgacatcgaaaatgtagccttcttcgatgctagtcagaaaggtcttaacctaatagttgaacaaattcgacaggcaccaattcccaaactaccaagaaaagaaaagaaaatcaaaaaaatcagatccgataacaagctggaactcaaggaagtcatagacgaggaggcagaagtaaatgttgataaccgttcattcattcaaaaatattggatgtatattgttccggcattgctaattatgctaatatctggaaatcaaaaccaatagcccttctgaataagtcaggtcaacatcatcaggctgcttggagttcagcccagttatcaaataggtcgttatgcttagagagacactactttaagacagaattggtactagttccccgatttgtcattacgtaatctcttatgtgacgaacaactcatatggtttcttgatctccttgtagctttgttattatctactgaatatatccacatgaataactttatagtacctcttagcagtacacttgctacacacgggtaaatctattacataaaccttcaaataaggcatttatagattattcactacaactataacatcagaacaccatacagtctatctacttgtctttgctcgctgcacttaacatctctacactttgccacaaccatggaaaaactgggattcacaaagagaaatgctccaaaggtgcatgtattgaagatagtcaactctccgggtaatgaatttgccatcatgaacacacttgctgttcatcccaatgactttcccgataaccattatgttatttgtgataacagatatgtcttgaccaccaaaacctctaacaagttagagccaggtactgtcggtgcttacatcaatcagaggctatgggcatcatggtctattggacaggaaataccggtctcgtcttttgacatgttcaaaagtacaggccaacaatcatacttgggatccatgaacttggagatcagtttccgatccaaaggaaaagctacacaaagggagtttgatcaagaagagctggctgaacaatttattgcaaggtttgaatctcaaatatttcaacccacccaactgatgattttcgaatttcagggaaacctgtttgatatcggagttaaatccgtacagattgtagatttgggccagatttctttggactctgtgcctacttccacgtcgattacttcaaagggcatattgattaagcaaacacagataaatttcttcaagggctctgatggactagtcaatctaaaagcaagttcaacgagacccaatgcggatgccgttattagaccggatttcaagtttgaggacatgggaattggtggtttagatttggagtttaccaagattttccgaagagcgtttgcttcaagaattttccctcctggattaattgataagttgggaatcacccacgtcaaaggtctcctcttgtatggacctcccggtactggtaagacacttattgccagaagaatcgggtctatgctaaacgcaagagagccaaaaattgttaacggtccagagattctttctaaatatgtgggttcttccgaagagaatatccgtaatctattcaaggacgcagaggttgaatacaaagccaaaggagacgcttcgtctctgcacatcattatttttgatgagttggactccatctttaaacaaagaggctcccgaggagatggaacaggagttgcagacaacgttgttaaccaacttttatctaaaatggatggtgttgaccagcttaacaacattctggttatcggtatgaccaatagacgtgatctgatcgacgaagctctactgagacctggtagatttgatgtgcaagtggaaattcatcttcctgacgaagcaggacgtaaacagattttagagattaaaacaaagaagatgagagagaacaacatgctagctccagatgtgaacctagatgagctggctcacgtttctaaaaacttctcgggtgctgagctggagggtttagtaaagagcgcctcatcatttgccattaacaaacatataaaagttggaaccgtgggggacatttcaggcaatctggcaaatgttcaagtaactagaaaagatttctttggtgcattggacgaagtcaaagctgcctttggtgttcatgaagaagatttgcatacctctattgctggtggtattctgaagttctcaacaactatcgatgaaattcttagccatggtcaaagatatatcaagcaagttaaagagtctaggaacactaaattcatttccctacttatgcatggtccgtctggatcaggtaagacggcactggctgcttctattgctttggcatccaaattcccgtttgtcagactaatttctccagaggccatggttggtatgtcagagagctctaagatcaactatattgacaatacgttcagggatgcttataaatctccgttgaatattcttgtcattgacaatttagaaggcttgatcgactgggtgccaattggacccagattttcaaaccctgtgttgcaagcattgaaagtgtatttgaagaggcagcctcctgacggacatagattattgattatttcgaccagttcctcgtacagtgtgctaaaacaattggatattctcaactgtttccacaatgagctggcagtgcctaacttgaaatctttggaagagttcaagagcgtgatggatgcagctgaattcatgaatgatgaaattagacgaactgtagtcaagcagctgtatggagtatttggtaccaacaagctggatattggtatcaagagagcgttggtgaatattgacactgctcaattcgatgaagatgaagtaaacgaactggttgaattgatggcaccttcgctagtaagggagaaccagagcggatctccaagtcattattaaagtagacacgtaatataaatgcacatattatactggtggctcttcttcctgtaaactgactaacttttcaaattccttgcgatggccctttgttagatgtttttctaaaatcatgaaattcctggagtttgccttataggcgatatttatgatatctcctacgaaagggatcaagccgattgcaaagtcgaaaatactattcatggtcatctgtgacaccaatacctgtggcaatccaccctcaatcttttgggcagctctgatcaacctcagaccgagcatgagacttatcacgtctcctatcactggtatcagttgcactatcgcactccaaccaaatctaaatccacagaggttgaacaccaaatccaaacagtaggctttattacgaacctgtttcaaaactttctgatcgtgcttagataagaatttaggaatgggcctctttctcttggcgcctttcctctgataaaatttcagttcactatcaggaatcggctcgttataagggtcttcgccctttccgacggtcaatcgtttagccataggagtcaaaacattttagtatacatagttttcttaggctctcacatctttccaacacttactttgctccagacatacttcgtcaagatactagtcatttattgggctagcaatccaaagccagatgcaccagttttaagcttaccgatgccggggctgtgcgaatttccctattcagaaattgtcaaaaattcactagtttcaagggtaatttgatgctaagaagacaattcgacaaactaatagaatctagcagtttaatctacttcagaaaactaataagacaaaaccagaacactaaatctcctaaattgatacttagggtcccaatatgggcaaatttccttcaatagtctacgtattgtctagcatgcttaggtaaatttgagttcgctcactatgaaaaactggtggaaaaaatttgtaactaccaaacaacccaatagtgaagagagatggctccaaactacaaccattataacttccgtcctgagaatatcctcaagagagcagaggacttgattcaggtagatcagtctgatgcggctttagagaccatctacgaattcttcacctccaaaagggttagaactgggcaagtttccgaattcgaaccaatcgcccttttgttcgtcaaactgtctgttgatctgcgtaatggtaagctgatcaaggatggtctgcatcaatacaagagaatagttcaaaacagcgaaaatggttttcaatcagtagaaactgttgtcaagaaatttctacaattagctgaagagaagttggtcaacgctcaagaaaaagccgatgatcttgccgccgatgaagaagatgatgaagatcaagatgtctctcctgaagccattttgctatctgccgtctccacagatgatacaaagggcagatcggatagagcgttggtgaacccttggatcagattcttatgggaatcctacagatctgttttggatgttctacgaaataacaaaaacctggaggttttttattctgttgttgcccaacaggctttccagttctgtttgaagtatcaacgaaagaatgagttcagaaagttgagtgaaatcttaagataccaccttctcggtgtccagccacaacaaggtatagtgaagaacgactacaatgtagacttgaatgacccagaaactttaaagaggtccctggatttacgtttccagcaattgaacgtttctgtcaagctggaactgtggcaggatgcctttaaatctgtctcagacgttcataacttgatgactgtatcgaaacgccagcctaaccccgccatgatggtcagctactacgaaaacatggctaaaatatttgctgtgagtgacaacctgttgttccatgctgcagcttggagaaagttctttaacctgttttcccaatcaccatttgctaccaaagaacaactgaaccattacagttctatttatcttttggcagctttgtcggttcctgacgaaattagcagtgaagaatctgctagcagctctctcaagttagcatctcttttgaactcttctaccattccatccagagaatacattttgcaaaacctggtaagcagaaagatcctgcaacatgttgacgaagaacttttacaactatacaattacctggaagtcgatttcaatttgataaccttgaaacaaagaattgctccaattttgagcaagattgaaagcaacgatagctacaaagcctacgtgaaacctttatctcaaattcttctgcgcaagttaattagggctgttggtgatgtttacgacacgatcaagttagagtacctagtggctcttgcaactttcgaaggttccttcaagttgtccccacaggaagttgaagatgttgtattggacgttgcccgagaaggagctatccatgttaaaatcaaccatgacagtaagatagtgacattcaagtggaatccatttgacgaacttgatctggctgattccaaaaaatcttcattgtcgcctgccaatctgattcgttatcaactgagtgctttagcagaaacgctctcagttgctgtcgaccgcaccaagggtggtgctttggaagttgaaaaggcaaagtctcactctttggtagaggaaagaatcaactctcaatttccttccgagcataaggaaatttcatctcgtcatgaagtcctaggagaaagagccaaacaattgaaggctagggaagaagagagaaaggctcaagaagccaaattggagcaagaaagactgttggctgaaaagaaggctcaagaggagcgtgctgaggctgaggccctgagaaaacaggaggagatgctcaaattagagcgtgaaaagatcatcatgagcgagaagaagaaggtagctgatgaaatcaataagaagggaattatcaaggtcacagatgaacagctgaaggaaatgtctgccaatgacctgaaggctttacaattgcaacaattgtcaaaggataaagaacaattggacatcatgcttagatcgctatccaaaaagtctgactacttagaaagagcattaagaaagtacgaggctccattgcttgttaagaagctggaggagaaagaggctgaggatgaggctgctgctgagctcatcaaaaaggagattgtttctaaggccaaggaagctcatgaccgtaaggtcgagacccataacaggctaaagagaatggaaggagagttcggtcaatttgttggtgagctcagaagggaattcttggatgctaagagggataaagcaaggcaggcactagagaaagcaaagcaagagcgtattgccgaagttattgctgagagaaagaaggaaatagctgaagaggcatctcgtaaagctgctgaggaggctcgcaaagtcgccgaagagtctcgtagagtcgctgaggaggcacgcaaggctgctgaagctgaggctgccaagcctaaaccaatgacctttgcccaaaagatggcactaaagcgtcaaggaagaatataagacgcccactaacttcatatatcaataatatattattggatactaaacattatagtagatttcgtcatttctcgcccagatggaatgggagtgcacttgataatttaggctctattacccgtgcttgaatgattacacaacgctcgcctgcgtgccctaatcgttcctagtggtcttttcagtcataagactcgattcttccctctgttcaattcaggtaatacatccgacgagtcacttcccacaaagtggaaccctgcgagcttccactcacgtctgaatcaacttcttcagtaaagacctgctagtgaatagaacaccttcatcaagactttcagactatccgccacctaccacatcttttctttttcactaccacaatcatgaatttgtagaaaagaaaatttgagataaacggtacaaaaagattacaaatgagtcaaaattcaagtataggaaaaggaaatcaaagtccgcctttgttcgacctatacgagggccaccaggagggctcagaaacggaagccacatcagctgcgaaatatcccaacttgttcaagtcagagacaaccatcacagatttgcctgaattggtgaagctattgcataagtttctagaaacaaaaaatgtcacgggactggcattaattgctaggcaaaagggacttcctcctagcatgagggcgaaggtgtggcctttgctattacgtactcatccatttgtcctgaagccgtatatcacctccgatgatgatgatggtgatgacgttgacggagaggaagaagagcaagaagacgatttgcattcatcaactccagataactcaacaacaagcagtaatgatactgagggtagcgataatgagtatccctcaagtattcctatccataggataagatcggaattgcaaaggtatacgataaggagcaattacaataaagatattattatgtctctaagccctcaagtcaggcaactatttgaagttcaagaacagattttccacaccatcgaacgtgctgttgctagattcttaaaaaaatggggttctatcgttcattatgacccaggcctggtgtggttagggctagctttagccgaatggattcctcctttgcctgaatatagctacattttatgtggtcgtgagcatgtcgcccgaaatggaacgaaactgagagacataaacgacgacaacttccagcgattatacgtgaatgacgatatctctagcataattctgaactaccaatctgaagacgcaaagttctcaatcaatgaaaacaaggaaccaagcaacgacaagtcgaacaaacatcaaaaaaatctttcatttgctgaactctacgaacgaatggtcttagttgtactccattcacccgaacaatcggatgtagtcgaaactgactcaatgcatgaaaggactaacaatattttgcaaaccattcccaccaagggtggttcaataagcgaaagagtatcgttttttcttcactgtttccgtcatttacttcctgaactatcaaattacttttcagaggaagatattttgaacggttacaacaacagcgatgaatgggtcatatggtggctcaaatggggaggtgctcgagcatggtccagatttgaccgaggaagagtttgggattatcttcttggttggaggaatggccttcctgcaaatccaaattcaaaaacggagatcctcagacatcaggaagaactagaagaagtgcggtcctgccttgattcgcacacattggagcttttggggccagatttattttggaacccattagtgaaggaggatgttgattcaacaaaaaaaccagaaccagagtcgtgtgctttgagtcgcaaggagtcactgaaaagtatgttgagtacactatctttgactaacaatacagcattagagtggtcttcgtcttcagttgggttagatgagcgtgagagacaaagtaatcatagagacacattgcttcaaattccttactcccaaatcgatcctcattcggcactggttttcattgcagtagcatttttgaaatcaaaagaatttgcattgctggaacttgagagtacagaaatattggagtttcttaacaagtcttcctccctgaagttcaatggatttcaatctttaatcagcgaccctaagtgggatactgaggatgctgatgttagaaaaattatggactcatacaataacagccccgaggatagggatgttcggcatttaccatcctctggtatatcctatacggcggagaaagatagtaagaccaattctaaaggtaaacgggctttcagtccttcacctccatcagatttgagtttaactggtcgatatcgttcccaacctaaaaggtcaccaagaggaattgagaatgtaattacagaagctggtgagctttggaggaaatggtcgtggcaagagttagttgaagacaattgagctatagtagtttcctcttttttttgttcttttttttttttttggaaatttggttagaagttagtatattatttactgaatgaatagtgccgatagtttttatcccgatagctgtacgtattctctctctttgaaaacctctttgcaatggtcagctacccaagcagtatctcgcataagggctctggggtcacctgttccgacgttgatttgcagtctgatctcttgataggaggcttcaagtcgcttgaactctcttatgacctccagcttttcaaaatctatgtacactctggtatcgtaaaccctgaatataacattatcaacacgcagaaaaagacgttgcaatattaagagacaatctttcatgactctgatcttgatatttagcaaagatattccattgtcacccagttcatcctcaaagagaatcatatcgttgaaaaataaaatggatccagtctgaagcttacttgttggtattgccttggaattatctattgtcatgggcacttcacttgtaatggttcctttgtagtctgatgtataagaccaatcaaatggtctaaaaatctccatgatctcatcgccttttctatgctgtcttgcatttacccagtcttgtgcataactgacctgcagtaactctgagggatccacatttttccttaccattttcaaggcatctatggcattaaagtcaatgctccattcaatacttctatcctctgacagtttaaaaacctgaactttattgtgtccaaaagtcatttcgggaatgggaaagcctagggttttttccaattgttcagtatcttggctattcagtatcggttttctagtagtaaaaacctcccagttcccaatggagatagagggtgcatcagttaacgggagtgtagccactggtgcgggcacaataaccgagccacagtgatcacattgaggatttgaacaactattgtgtgaacttgtcgatgtcttggtcgatagtgcaggcactgagacatgatgtgccacctttggagaactcgaccatttctgtgtaagatttgttgtcattgactggccaggtcttgccggaatacggcttttctgcgttagttgggacatttttctagcattatcaatgtgaatagaatcaatattgatctttctatctgtcatgttggggggaaacaattagtaggaagattctgatgaggctaggtgggaatttacgctcgactgaatttattctgatagccaagtaggtttaagaaatacagagaatatgaagttatagttaaaagaaaagtttaggtgataacgaaagactatacggctctgcacccctattgtgtacgtgaaccgctaactctatgatttgatttgattttcagcggcatccgtagattataattataattgtatatataatagtgcgagcactgatattagaattgacattgtcgcgccataattgtcaccttgaacagcacaatcttaaacaactagatctacaccatgataacattcaacaaacgaatagcaacattagcggcaacgttattttcattcattgtgctttatactctctttaacagtggagctcaattttccaaccaactagatcagcctgttcccctcaaaactccagagctcatcataccgaatcagagtactgagaatgatccccctcttccattcatgccaaaaatggctaacgaaactttgaaagcagaacttggaaatgcttcctggaaactctttcacactattcttgctagatatcctgaatccccatcggagaatcaaaaatcaaccttaaatgactacatttatttgtttgcacaggtttatccatgtggagactgtgcaagacatttcaatttattgctgcagaaataccctccacaattgtcctcaagacaggtggctgcagtgtggggatgtcatattcacaatcaggtcaataagagattggagaaaccacaatacgactgctccaatattctagaggattacgattgtggatgtggctctgatgaaaaggaagtagatgacactctgaataacgaaacaatagaacacttgcaaagtatcaaaattactgaaaaagagagtgaacaatttggtcgatgattacctgattagggcaaatggccaagaccaaattatggagaatcctcaacataccacactttaacaatgctattttaatcttttaagctcaaaccgatgctcatcgccctttcaaggtcatacttaaactcctgtgggttatacttagaactcatctctcaaatgcgtgacgtcatcgcgcatgtcaggtaccctcaaacggtctttggggtaaactggtagacccttggagggtacctatatttggtatcactggcattgatgagttagatttgggtataaataggtcattgaatatcccttcatgaagtatcaattaagaaatcacaaacacaaatgttcaacctgaaaactattctcatctcaacacttgcatcgatcgctgttgccgaccaaaccttcggtgtccttctaatccggagtggatccccatatcactattcgactctcactaatagagacgaaaagattgttgctggaggtggcaacaaaaaagtgaccctcacagatgagggagctctgaagtatgatggtggtaaatggataggtcttgatgatgatggctatgcggtacagaccgacaaaccagttacaggttggagcactaacggtggatacctctattttgaccaaggcttaattgtttgcacggaggactatatcggatatgtgaagaaacatggtgaatgcaaaggtgacagctatggtatggcttggaaggtactcccagccgacgatgacaaggatgatgacaaggatgatgataaagatgatgacaaggattatgacgatgacaatgaccacggtgatggtgattactattgctcgatcacaggaacctatgccatcaaatccaaaggcagtaagcatcaatacgaggccatcaaaaaagttgatgcacatcctcatgtcttctctgtaggaggagatcagggaaacgatctgattgtgactttccaaaaggattgttcgctggtagatcaagataacagaggcgtatatgttgaccctaattctggagaagtcggaaacgttgacccttggggagaactcacgccatctgttaaatgggatattgacgacggatacctgatctttaatggtgagtccaatttcaggtcatgtccatctggtaatggatattcattgtctatcaaggattgtgttgggggaactgacattggccttaaagtatgggagaaataagatgccaacttaatgcaacaagttaatggtattacgtgaaaattgtatggttgagactggatgtagtcaaatatggattatgagctgaaatatattatattgattctaaattattgtaaacagatgcgattacatctccgtgcttctttgtgactttgaagccaaacgtagtagtaatttatataatttggcatcaaaatgacttctcggtttatgactctaaccctaatgaatgagaaatcactatttcgaagaaaatatttgttcttacggaaacgaaataacccattaattaaaatatcctaaaactatatctatcctgagcttaattcaaggacaatactttcgaaatcattttcaggctttgtgctagcacgcctgttttcttcctcatcatccccctcctcaggtgattgatgtatttcctgcgctagcttcctcgtttcagttgaccttggttcatccaaacttatcaccacaggctgtgagactgtgttcgaaagatctaggaatcttggttgattagtcatagtgattgttgagtttgagtttacgaaaataattggggaagaggtcttttataaacttaaagctgacgcatgacgtatctccgtagttcttactcatcatctcgagatgctagatgttaggcttgagaaggatgcgttatcaagtaaaaaggaaaacattgactagtgcactttgcgtcataatgtacctaaacagggctcagctctctttgagtctcaaggtctgatagtgagatgataaggttgattgcttaatcgcttaatctcacctcgaatagttctgctaggctattcagctgggtgagctagtagttacagctaacacgtggaatggctccagttgaacttattgcgaacaggtagtactaaaactgggcctagagagatgctaagcgtcgataggcccaattctttacacgtaatgagatatggccttggtgttagtgaaaggatcttcaatttgtaatgtactattttcagagggcgagagaacgtgacatatcatttattcgtttagtctcgtaactttaaagtttgatattttccagtgactcgttatggttcggaagccaaaccatccctctaaataaggcttagcatcctcataaccaaaaatcaatttctcgttagcgtaccatttcaagtttacaggatcatccttggttggtcgtatagatgctattttcaccctggttggagtgtttgcgtataatctcgtatattcactcataggacctgcatggtcatcgacggtcctgtgttcatctgtggaataacctgttatttggggacggcccaccgatccgtcattgcgacgcagtcgagtagttccattgctgtttgctccgaagccgacgtaatacaagtttaaagaattgtaactattcaagcttgcatcgaaatgatttttcgttacatcaccatcctctgtcgttgggtccgttgcattccagaacatgttcaaatctgagatgcggtcaatgaactttgtaccttctatggtgaacggtattggtgtcgcatcgaaggttatttcatagtttccgactaacttttgtttcaaccagatagttgcaccagaaggctgaataatttccaagataccatctcttgccgttacagttccactcggatcttgttgctcaaccttccagccagtgagaacatctgtgaaggaatcttggacaataaccgtgttatcagagcctctagagctggtagtattctcaatgttcttactcgacatagtcaatctacagtaaatgttgttcttgaattttagttaacaatacattatcgctgtgacccagcgatattgcgcaatctcattctaatcggcacactggtggatcattggcccgaaatgagcattaaggttgtgccagtttggctcgagattgcgccgtgagagttatcgaggtggattgatactagatatacggtgctacaagtttaccacgcatcgcaataaagcttccaccctttatgcatcttgtgcacccacagcgtaactactttcctcttcccgagttcaacctttttggagatttcctctacagtatctgattgagtacatttgttccattagattacaaattgatcatgcctcagccatctctctcaaacgtctgatggtggatctgacagtggcggcagcagcagtggaaacagtgtaagcaccaccagcaacggtcttcttgcaagccttgcaagaccagataccagtagcctgtctcttgacagtcttcttaccacagaatgcacagtcgtacttggcgtgttgctgagtctccaacttcttacattgctttctcagagatgaaccgtaacggacaccatatttaccggcaattcctaccttcttagttctcttagacctaaatttgttagcacttgctccttcaatttgacaaaattggattggaataaactattgaagatcttcaaccaggtcggtgaaagcgaccataagttcgcccataccccttatttggtaaggaataaaagtctcagtgaccatttgtttgcatcttcaaagtgattctatcctcctttaacagttgtctattacatacattttgctttgtgatgatagttaaactagaagtctggaaattgaaaaatcttcagtacaactgaagcgctcgaatcaataagatcctagcattaatgatcagaaaacctatccctcatcacgtgcccactaataatccgaacaccatgaatctacaagaagacactggtgttgtgctctatttgtgccaaaggagccccccccccccctgattatgtaaacaggtacatactcagatctccaataataatagatttgtgtcaagggataagggggccgatacatcccaaatccccccttgtcgtatcccctatagcccgaaccgatatttttctacttctaaatagctggattcctaattttcttgcgagcttcttttactgctctgttcctgaaatgcctttggatcctgatcgattgatcttaatgagtacagagagcgtaacgaactggagcatcgagagtcctacgatactacacctttttgatcatagcattcctgacgaacccttgcttagattatttggtaaaagcgatgtcgacacagcggaacctggtgtattagaagaaaccttcaactatcacgtctctaatggaaacaacaaacacgttatatacaagacgcgaatcaagtctgttgaggcaatgaaacagtattcagtaaggttaacgaaccagcacaaaaataagcaagaccacagttcacatttcagtgacaaaagggtcgtgctggattgcaacagctacttggtagatagtttgaagctgttcaaacaaacagtccgcacaactcttccgagagataaatcttgcattggtcctttaacatctaacggatactcacagcttagagttgagtcaagaccacgatgattcaagaaaaacatccactctacgtagatcgtttggattagacctgcactctcctttgacatagaaataatgctgcaattcggtgttatagtaaatagagcccaccaaattatagtcgccattgataaatatattctcctgctcgttgagtacaaacaagcatcttgataatataacatctgcctttgctaggtcgtgactctcgatcaagtattggtgactcccacccttgatactggcaaaagtactttgaaattgatagcggcatctttttcctctcatccccttcaccaaatccagttcttgtgacagtttaaccatcagttcttgcaagaacgagcagatatcataaccttgattatcgtaattatctaatacgctttcggtcaatacttgcgcatttcctttcaaaagagaattccaagtcagcaacccatcataccctcgggtatcccgcagcagctggttaaccagtttgttaatatccctctcattgaacagttccaccaaacactctgcgaaacagatgttcatagacttgcccgattctgatattctgtattttcgctggttctattttaccatcagtaattctgtttttctcgtaccaaacaacagattgcaatggatgaggacgatgaatatctgtatggctccgatgatgagcagcctcagcaaataggtgcaccggaaacaaaaacagcttcatctgaaaaatcttctaccgcagttaaaaccgaaactggaccagtatcggatgacgaagatgataatgacaattcagactatagtgattcagattcagatatcgacattgtcattggggctttagaaccaagtacacaaccagctgcttctacaactgcctcttctgctgtgccagaagacaatcctggtgaaaatgacgacgcagccacgcaagttccgtcggctgctggtaaactaaggatagctactggttcgttggacgttgacaaagtgggagaatatgacggaaagccaataactcaattggagctgcaggacttgaaggaaaaaccatggagattaccaggttcggatcttgcagactatttcaactatggatttgacgagttttcatggtcgtattactgttcgaaacaagataaaacaagaaaggaatttaaccccgccaaactaatgaatgaattacttcctgcaggtggatttcctccttcaggaatgcctccaatgccagggatgccaggaatgcctccgatgcctggattcatgccaggtatgccaggaatgccaccaatgcaaggaatgcagggaatgcagggaatgccaccaatgcaaggaatgccttcgatgccatcaatgccttctatgccgggtatgcctccaatgtttaataataatccagccaatggatcatcctcttcttctgctcaacaacaacaggctcccaaaaggccggtaaacgagagagatagtgctgaccgggagagagaaagaaacagagaacgagacagggagagagatgcttatcgagacagggacagagacagagacagggatagggatagaagaagaagaagaaactgatttgtatattagacctataaaagaaaaatccaaacgggaaacaaaactaatttacacgtagcttctacagcgactaatttatactttggtcactggatcatagccactggcgacgttgcattggtgcatcaacctattctcgtggggctggaattcacctgtaacagagtgccaaactccttggttgaagaaaatggccaagtcacccttgttccatgcatgtgcatagatgtgttgaggggaaatagctggtctcataagcctgtggacttcctttctggcttcttcaagctccgtaacttctccagtcttattgttgattagctggtaaacgcaacatccatgaacttgaaggtgatgttcgccagtagtagggttggtccacaccataggcaacttcttgactttggattcttcccatggtggaagtttgtctaggccgatttcttttccctcactaacgattgttaaaccatcgctagtagccttggttttgccaatgaaaatgtaaggatgaggagcgtaaacaacagttgtgttcaatgctttctccttgtcttctggagacaaaagcttgaaagctgttgctccactagcaaaagcagtggcacctttaactaactcaaattcctcaccgttgtcctcataaataatcttttgtttctcatcacattttggtacttgaatacctagcaaagtagtgaccttaggaggagacaatccgtaaagggcactatcgatatgccatctgtagaatcttgtttggccgttggccttctcctcttcggttaaaacatccttgtggaaagtactttgagatggatgctccaattcaaaagctttcattcccggagcatgcccagcctcaaaagagccattaccgaccatgacaacttcggttctgtcaggaatgcatttcccgtcctttgcgaggacagattctttatggtggaacaacttctcatcatgaccataacttccttgacaggatgggtcaaatctcacagtaaggtcatattgggatgtaggtggcaattcagcctggtttgggatgacaagcaccaaataagtctccaaggcagcctgaagtgttttaaagtcttcatcagagagcttggaggggtcagtgacacctcttggtaaagtgacacttgcaccaagtggtttgtttggcaatggtgtgatttctaactttcctgatactgtcattataattgtgtgctattgtgtgttacttaaattgatatactctacaattgaaggaaacatggtctacgttttatagctttgtgccttatcagtgaaagggaatcggagatgcaagcagaagcaagcagtgtaagtgcagtgcgggagctgccgcggtaaagaaagtttaccgcggagcaaaaccgggaataccgcggcttgagtttcccctcgtaagttttttgccagtttgcattttgttgtattgctgctgtattactttttttcggattacttaatcttggacctcagtttacgtaagaccttaatactatagtagctgtactgattaggctttagagaacttagacgagtgaactttaaatgctcaatcatgggattgttgtgacattagcttcacccaaggttgtaagccaaatctgtgtcttgctaatgcaaactccaatttatccacccagatatccctttcagctttagaatcagctccaaaataaattacctctccatcaataaagactaacttgaaaccatcattcaaaaccagggagtcactgaatactctcttctccgactcagctccttcataaactttgccgggataagaaatatcggtaactcgacgaagatttattctggctcggggtttcttactagtctcagtatgagcgatcaggtccgaaccttccaatttaaagaatcttctggtccagatgggtgagtctcctccttcttggtacaggaagccctcatggaaagcatcatggatttggttgtattgcctgatttgttcttgagccgattcaatgcttggaggaattatttcgtaaacattagttcttggaataaaaagcatttccatttcaagcttggcaatacagtacggcttttttctttttctctcttgaactccaatgtctttatacgtttcccactcattaaacaagttcaacgtgaatgctctcagttttccacatgttgaagtttcataatcttgaaaactgatataaccttttgcgaatgatccgtcaatggcaactttgtgctcccatgagtcggctttagtttttttgggaacaaccttagttgtggtgatcttatgcttgaaaccaaaaagtcgcccaaaaaagttgcccgatttgacgagttttgtttcagtcacttcagtaaggatttctttttgcttcgtatactcaagtttgaatgttagaaatacttcaagaggtgacgagggcacaatgaactcaaactcctgatcaatagatccctccaaaagagaacttgggggtgttttgatggtgtgaatggtattatccaaagtcatggtaaaagtagcattatgctcctgtagttcgggaagttcaatgtccttaattccttttatattgagaaaaaagcgtcctctttctccacttacaagatcagcagacaaaggtcttggtttgctcggagaactcattgctttcctcttcatttcagctaaagttggtttagatcttgactggggggtcgataaaaccttagtattcttttcaacatttatgttgaacttggacgccgttgacttttgaggtattactacacttgtcaaatgctggtcttctttagaaggactgtatgagttcactatcggtgtgtgtggctcgactacttcatcagactctgctctgattctattcaaaaatttcgaagaacctgtatggacgttagattttgcactttgcgaaacaaatggtaattgagctgattcatcaaccattctagaagtaggggtggtcggataataaagctgtttcttcatagtatgattagacatgttgcttataactgattttgtaggcgagttcttctctattgttcttctaacattcatatttgctgaagcttctaagtgattctgttttctaagttcattgtcgtatgctaacagtggagattgtagtaagcctgatacccttctttttctggtgtactctagatctttgtcaatttcttcagtcaaagaagtgggtaagtaactactgttctttgcttgagtattgaatactgaagttgctttaggtggcgccattgtattgaaatcctcaatttctagggaattatcaaggcacattatacttcctctttcacttatcatatcaaagtcttgcttctggttatttttggctcccacttggattttcctaaacgcaatttgatccgtatcggtgtttgataccaatttcttaagtctatgaagctcaaaattaccttccattgactgatccagttggttacttgaagagtagggtgatccccgattccatatctgtgatactttaagagatggtcttctgatattgttaggttttggaacaggattggtgttggattcctttctgtatttgaactgttgaaactgagaaccaaagtctgaacccaatgacacattacttaactgagaaaaacagctgttgtttgaaatagatctgtaaccagaactgccgctggaattccttgtcgacgtcccttgaacttgtgtatcctcgtaaacgactgtactctcattggacaaaactcggaattttttgttcatcaaagttgatatcttggaaggaatatcaggtttgaaagttttcggcacagcgtgatgagcaactggttgggtttgccaaattgacatgacctcttgctgcggtgaatattcatcgggtaaatgtttcttcggtttttttaatagtggaggctcttcatcatcatcgtatacttttttttctcctgtgtcttcgataaatactttcaggtctcggccaaaagaggaatcctgttccaattctggtaaaccgaaagtctcatcctttttgagcgaagaaactgacgctaacgtttgttcactatcatcactttctttattctcaagtgatattggttcgggttcatcaatattatttatgcctgttgaatttcctagaattgaatcattctcattcaagattgtatcttcaagtttgacctctctcacatctgatgacgacttgtgttcaatcgtaacaggattgcaaatagaataatctatcgtgttaacaatctctgacccatgcaatgattccaaactacttgtatttggggtgaccactttgatgacctcgggtggtttgaattcttctccttctttcgtatgaagctcgggctcattattttcagggctcttctcggccaattgatcgagattcttagaacttgaagttggagtgattatttccttgaatccttttccgacattataaagaaattgagtgatggatgggcttctgctgtgagtatgatctgtttcttttggtacttcttcctcttccacgggatgacttgaaagagctgagtgatcagactgctctgaatcttctgattcttccgattcttctactggctttatctcctttaattgttcgagttgttttgataaccctgattcttcgaggcgattttttagtttcgtatctttggactctttatcctcttcgttatgagagttatcaggttcagcttcgtttgtgtcaagtagttgtagaattgaggattcaatatcattactcacctcggatgtaacaacaccttccaccttatcgagatcttcttctccaattgacactgaaccaactagggtgcgagggctttcaagaagatcttgatcaaacaattcagctggttgaagttcggggatcagttgttcgacaatttcgttggataagcccttaattccatcacttagggttataggaactgaaactttattagtggtggaggtttccagcttcctatcccctgaaataatactagcctgcgaagcgacactattagatcgattcaattgcaaaatgagagaaccgttatttggagtatttctaacatcggtttcaaagatattggtaagtccgatcaaattctcttccatgtcgtttgtgctggtattcttggaaagaagaatctcctgaacgtagttcttcttctttaatctattattatgaatccgtgttggtgttttcaactgccccagacgctcatcctcaaggtaagactgatggtcaaagtcttgtgctctaagtggctctgaaagtagcgcttcaattttttcatccattgtagattttgtaactatctgtttgattgtggcatcatctatactatcatctaagtcttgatctgcctcgtctttcagagaaacttctgagggcgaagggactatgggtggtaatggtttgcctatgtgctgagtatcgatcttcaaaggtaccggtttccaatttagttccgatcgttttcctctgatagcttcatcatctgagcaataacccaggtacttctcctctatttcctcttcggaggattgcaattcatattccaatacttcaggaggactgatgtcgattgttacagattttttggatggggagagatccagaagatcagcggtttcactattgttaccaggttcagctatagctaagctgcatacctcttcctcttcgttcatcaggatcctggggcctcgtagtttggagttggacctttcaagtccagaattagtggtggccatcgactttgtttcgtcatcaatatcctgtagtagcttctccatagaatcgttcctagtttcgtaaagattggaagagctgcttcctcttgaaggtttcaagagtgggatggccccttccatctcaagagagttcatttcttgtccgcttgactagtacttctgtcggaagaaaaaaaatactcaagtgcctgatagtactcgctttgtttgttttggctaaactgaaatctcacgggtgattacttgtttacatatttcccaaaacagagagtctccccagctcgagcgagtagggaggcatgcatcttgagatgtgcttagataagcaatgtgcattgtggctcttcagaagcctaactttaatggggtaaaatatcagcagtaggctgaatatagagcatggcaacgtttacgtcaacagagtttaatagtgaaaactacgataggttcaggcctgtatacccagacgagttgtatcagcaattagtggattatcatgttggtgctaaaggattgtgtgtcgatgttggatgtggctctggccaggcaacgttcaccctgaaaaagtactttgacaaggtcataggatctgatatctcagaaaatcagttggcagtggctaggaaaagacagcctgctggaattgaatttaggttaggaacgggcgaggatttttcttggctaacggagacgccagatgtaatcaccgccgctgaatgcctgcactgggtagacccacagaaattcgttgcaaatgtcgccaattctctaagggatcatggcaccttgagttactggctttatacagaaccaatttttcagaacgaaagggccaatcaggtttacaacaaattcacctacgggtctgactacctgggcccatattgggatcctggccgtacacatttcagaaatcatttaaaggagttgaatcacatcttactggatagcgagctttttgacgaagtgaaaatttctaattttaaacaagaggaaggggtcaaaaacggagatatcttatacttggaaaaagagatgacaatcagtgatttcatcaattttgtatctagttggccttctgtgttttcgtggaagcagcaacgaggaaaggagggtatcctagatgatttttacaacgaactgaacgactgctttgaggggggtaacatgaaagtaatatggaactccgtcctagtatttgccaggaggaagcaaagggttgtataggctttagtacttatagaggaaacggggttacgtgcaagcgcgcatgcctgagctttgaggggggggactttcacatctcttcttctcacacttagccctaacacagagaataataaaaagcattgcaagatgagtgttgtcagcaagcaatacgacatccacgaaggcattatctttgtaattgaattgaccccggagcttcacgcgccggcttcagaagggaaatctcagctccagatcatcttagagaatgtcagtgaggttatttctgagctaatcattaccttgcccggtacaggaatagggtgttaccttattaattacgacggtggtcaaaacgacgaaatttaccccatttttgagttacaagacctgaatttggaaatgatgaaacaattgtaccaagtcttggaggaccatgtaagtgggcttaatcctctcgagaagcaattcccaattgaacacagtaaaccgttatcagccactctgttctttcacttaaggtctcttttttacatggcgaagactcataagcgtactggaagacattacaacttgaaaaagattttcttgttcactaataacgataaaccttacaatggaaactctcagctgagagttcccttgaagaaaaccctggctgattacaatgacgtagacattactttgattccgtttcttctgaacaagccttcaggtgtcaagtttgacaagacggaatactcagaaattttgttctatgataaagatgcttgttcgatgtcaattgaggagatccgccaacgaatttctagacataaggagatcaagcgggtttacttcacctgtcctttgaaaatcgcaaataacttgtgcatttctgtgaaaggttattctatgttttatcatgaaactccaaggaagatcaaatttgtcgtcaatgagggttcaactttcaaagatgtggagacaaaatctcagtttgtcgatccaacatccggaaaagagttttccagtgaacagctgatcaaagcatatcctctaggtgccgatgcttacattcctttaaactcagagcaagtcaaaacaataaatcgatttaatgatatcatcaatatcccctctttggaaattctaggtttcagggatatatctaattggttgccacagtatcagtttggcaaagcatcgtttttatcccctaataactatggtgattttacacattcgcagagaacatttagttgtcttttacaatccatgaccaaaaaatccaagtttgcagtactttttggtactttgaagaacaatgcggctccaaggttgtttggcatgattccctctacgttacctcaatacgaaagttgtaatcttccccaagggttcttcctgataaagctcccgtatctggatgatgtacgccagctgccacccaaaattgccccggtcgatgctgatttggatgtattagtttcacttttcagcaacctggtcggaaagatccacatcaagaatggataccaaccccaagagtatgaaaatccttccctacaatggcacttcaaaatgttacgtgacgattaccttcaattggaacacgatatcgacatcagtgacccccttgagaaacaaaagtacataaacagcctcgatgagacaaaaaccaagatcatgaaactacgggactatgtcaaggaaactgccgatgatgacgacccttcacggcttgccaacactctcaaagagctcaaccaagagctgaacaaaatttccaactttgatatcatcgccaataagaagccaaagacccccacgacagtagaccctgttcctactgatgatgacatcatcaacgcctggaaggcaggaactctgaacggtttcaaggtggatcaattacgaaaatacgtaaggtcacgaaacaactttctggagacggcctccaaaaaggcagatctcatcgccaacattgacaagtactttcagcagaagttcaaagagactaaggcctgattcgtgttccttactttttcctcgcaacgtgtttttttcccaccacattgcctatgttgtaatgcaatgcagatgctggcccagtttttgacgattctcgaaaattggcattttcgtcgatgccattggccaaactgaaaattcaagacaaaatagattggattttatctgcaacgtcttccacctacacaaccactctacaaacttcagacaaacatgtttataaaagcagctactagatccaaaatgacaagttcgttattctctactacgtttgttgtggcatttggattggtggctagcaacaacctcttgccatgtcctgttgaccactctatgaataacgagactccgcaagaattgaaaccattgcaggctgaatcttctactagaaagttgaactcttccgcttaagtcaaataaaactactgacacagatgatgcacagaaacaacggatcacgctcttgactgattagtcccgtcattttggttctcattttcttcacagtcacctatcaatgtatgatcacctggaaggatttccctacgatacttcaaatcttttacttgataatattactcattatggctcaggaatgcagactgcctgattcaagacgctgctcttcttatttaacacttgtacactaaccccatggaagccagggaagggaataaccatctctctggtaataaatcggtctttatttatgcatagaaaaggaatctattatatttcgttcatttggcactctgctaactgtagattaacgggtctcgtaaattcaaaatcttcttccgatcaaaccggggtgaaatattacttctcgtgcatagctaattttcaaataaccgtcctaaaatgaacggtcatttacctggactctcttgccaaatgggcaacaaaacataaagctgatcagaacgtaactagtctctcggaatccatttggttccccaaaaagggctggtcgacgtcgtcctgggacgatgaccttctattcggaagcagctctttaaatacagtggatacagatctttgaaacagttgataagtgctaaagaatactctaataatacagttgaccactttatcggtattgttctcttcaattggtcttgaagaactctcgacattttgtcctgcaaaattgttgagtctggaaaatccaccatttcttttgattcccctattatagacaaaccaagcccctcccaggatggatacacttaacaacgtgaataacgtgccatgtttgtcgttatattgtacaccaccaaagacggtctttgaattccagaattcagaatcgtcatcgccataactgaaacctatcgtgtagagattgcgaatatttctttctctatcaggtactgaatattcattttcaaggacaatgaacttccgagatgctccagacgacgagtagacaaggtcatacacttttatctttttgtccgtaaaaacttgtaatccagccaagtttctccttcatccaatgagtaatgaagtgtatcgaccttcctgtttatctcaactgttacaagcactctcccttggtctccgaatgcccacaggtactcaccttttgcaaccaccctccaagaaacaccaccgtcatttgagaaatataacgcaagattactaggatctcgatctgagtactttccaacgttccccacaccgaaaagaagtcctttacctgaatcacaagaggacttgatttcaatagagcgcctctcagtaggtcccttgaaattcaaagaacagtcctctaacaatttctcctcccctttgcaaatgaattcattcctctcaaggtcgaacggaggtggagttatataactccagctagaggcatcatcgtaggtgattttggtcttgatttccgtagatttttcatcaactgttcccgattcgattgcttcatggtttatgactatattgataagagcagtacctttcaatccagagataagttcaaaatcgacacctcgtctatcgctgttcacatagtcggatacaagtttgtaggatccatcttcgatgttgcttttgaacaatgcaccgtaaaacaaatacaaatactttgatggaactgaccttctaagatggaaaaacaaggggtgttctgtctcttccccttcaaacactttgcatgtcgcacctgcccatgatccgtcaaatcccagttcgggcggaaacatgagtttggcaaatttacttccatcacaagatattaaagcggccagcgtccgatgctcaacgatagttggtgccacaagacatgagcagtttcgatgggttggagagtattactgagcacttctcgtcgatcagatttaaaataatcagagctaacaagcagacgtggatttggaggtgtctctccattagcataagactgttcacagaagactatatttggatcagagtcaatggcctttgcagcaaaaaaacagaatcttgtattctctagcaaagaagtgaaactctcaccattatcttcgctgacaaaagataccgttcggcagtctgcaacattattccagaaatgacagcccttcattccagcgtaaataaatttcttgggatcatacttgtggaaggagagagggttcttcatgagagcaaaatcaacgcttcttttcgaaggagctttcactctcttgaaagaaactgcaccattggaagaaatatagatataaccatccacagtgatcagatagacataggcaggaaagtgcttattcacgataatgtcaataattctccccttatctcttaattcgatctggtggaaaacaattcctccatcataggagacatagacattgttcctttgtgttctcagtagaatagtctcagcacttaacgcatcgtcgtctcctgcctctaagtagacgttttgaaccacagagtcgtctaagcgttgactcgcactcaaaaccttgcactccatgggaactgctaagctaatattaattaatagtatgaacaggaaaagcacgccttcaaattcatagcccaacacaactgctgagaggctgacggtacaaacggcagtttctacaacacagcgttagtataaccttattctcttctttgttagaagcatgaatgtggggcagccctgacatacttacgtaagctggtcatatcattacgtaattttcttgatgatgaggttgggctctttaaacttatcaatctaaccttctcgtgcacatcgtaggtatcttcaaatatgtcagttatgaagaataaggcccccgcagatcttcaaatcacggcggagcagattcttctggaggcctacgaaagtaaagacccctccttgaagctgactgagcacaaaattaatgacctggaagaactccaacagatgcagctcaagaagagaacagagtttgagaatgccctcaggatgaacaggttgaacgtagggcaatggcttcggtacgccacgtttgaagtagaacaacgtgattatcgccgcgctcgttctgtttttgaacggtgtctagaggttgatccaaccaacgttaccgtgtggattcgatactctcaaactgaactcaaggggaaaaacatcaaccatgctagaaacgttttggaaagagctaccatattgttgccacgcgtggacaagctgtggtatttgtacgtgaacctagaagaaacattgggcaatgtggttggaacgagagagatctttttaagatggataaactggaggccctcagctagtgtatggaagcacttcatttattttgagtctcgttatggagagctggagaactgtcgaaaaatctttgagaagtttgttgtggcttctccgaagacggaaacctggctttattgggctagttttgagaaacaacatggcgacgctgtggatattaggaatgtgtacaccttggctatcgactcagcaatgagtcttggaaaagagtttctcgatgagtcaatattcgtcagttggtgtgattgggagacgcaacagaaagagtttgctagagtaagagcattgtacaagtttggtatggaccacttaacaggtgagaagagagatcggctgttcgaacaatatacagtttttgaaaaacagtacggggatagggaagggatagaagaaaccatcatgcaaaaacggaaaataaaatacgaacagatcctgtctgagaatccttatgattatgacaactggtggttatatatcgaactgttggagaactacaacgatactacagaattgctggagcaggcatataccaaagtcttgggagctgttcctcagagtgagtccaaaccagattgggaaaagtacatctgcttatggttgaaatttttgtttgttactgaacttgaaagtaaagatatctcaaaggctagagagggctacaagaagctgatatccctaattcctcataaaaagtttacatttgccaaggtttggacaaactatgcgtactttgaaatacgacaagatgatttatcacaagcaagaaagatattgggccaatctttgggtctgtgtccgaagagaaagctattcaaatcgtacattgccatggaattgaagttaaaggaatttgacagggttcgaaagctctatgaaaaatttatcgagacgtggcctcgggatgtttcaatttggattgaatatgctgaatttgagaaccaaatggatgatgatgaaaggtgtaaagcaatctatgaaattgctaccagtgaacccgaaatcctaccggatgaggaaagaaaggaagctttcaacaagttgattgattatctgctatcaacataccagtattcagaagctagaaacgcatattccaggttcttgatcctgttcaaacatgacacagtaatttggattaaaaaggctatatttgaactaaccattccatcagaagagcagctcaacgaatatttgctgcattccaaccagaatgaggatctggaattccagtttgaagtcacagaagagtccaaggaaagaagtagaaaagaatttgaaaaggcgttagcgtttgcaaaggcaactaataacaagagcatgagagtgatgcttttccaagccttcaaagaatttgagtctgtctatgggacgaaaggtagccaagaagagattaacaaaaggttcccatcagttgtcaggcgtcgggaaggtgatgaagaagtggtcgattacgttttccctgacgaccagctcgattccaagcaggtcgaagatgtggaagattcaaaaccaaagtcagctatgcagaaattcttggaaaatgccaaaaaatggaaggagaaacaaagttagttgttattctaatgtatactaatagtataatcttgcatcttatcatacgtggtattactgatcgctttacgtaaactattcattgtggcggaggtggaggtggctttgcagtaggaactgaaggcggtggaggaggagggggcttccttgtacttactggaggaggtggtggtggcggtagctttgttgtcacggctggagggggtggtggtggtatgcttgatccagccattgggggaggaggaggtggtagaaacgatgaattcccggcacctggaggaaacggtagagattgaatgggttgtggatcaacagaaacactcaaccccaacggagccttaatagcaggtcgcttggactcagatgcttcgtcatcaatatgaggtctcttactaggattctgaaacaaattattaatttgatcttgctggggaattggaactgaacctggttcggtggacgaattcagagttttcatgttgtaactcggagcatccccattgaggtcattcatcatctgatcaatttctctatcctctgctctttcattttcaaagccactaaacttacagtccctagcaaaatgtccagtttgtccacaatttcgacacactacagtttgagtaaagctttgcttcttagggcaatcgtgtctaaggtggcccagttctccacatagcgtacatgctctattttctgtggttctcaaagtaccattgagaactgctagctctcttagttgacctctcttcatatcgttttgcccttcagggctgacaatcgccttttcaattatctcattgcacagagcaacggccttcttgatcttttcttgagattctgaagttatcaaacagtgtaattcgtcatccatatggctttgatgtgagcctgcagcattattgttcctacctgttttgaccgatccttttcctctgattccgatatgggcaccactctcgtcctgtaatttcttcaatgtgtttcctcgggggcccaagagcagtcctatgaaattaatatccggataatctttggtaggtaaatagagtttttcactggtttttcctggtctcttgtagttgatgggggcggtgaatccaggcacagttttcatcgctctctccaccaagacatgtctctccttctctaatttttcagtgtatcttatgtcaatggtattgattctcttaccgttgctgttataaatgggagttggagaaggtgatctaagtttttcttcaggtacgacttgatgtgtttctagcttctgtgttatttcctctatcctaaagaccaactggaaggcgtctagttgttctggcgttaactggccaacgatgttcgtagggtatttaatccttgtgagaattcggttcttcacctctccccatttgttggctgaccgtcgttcagagggccttcctcttgttctttctacaagctggccttccataagagagtactagtcagaaatagatgatgtggtatcctgctataaacgaagaaaaatagatttaatggatgagggtcccttagttctgtttttggttttacaatttattttttcgcgtcgtcgtgtcgtgtcgtgaaagtttgtttatcaataattcaactaaccttgtcttagcaattcttcttcctccaactctattcacatagtttatattggaaacagcgcactactagcatgtcttccagcgaaggcttcagtgatgatgattttattgtgagttccgcaagcagctcacccaaggcaaagagacataagcccgcggctaaacccacgaggaagacaccaccagcctcaaatggcagtgcagttaacaactcagagaatggtaccactagaagctccaccgcaaacaatgttaatgtttccgaccaataccagaaactttctcagttagagcatattttgaaacgtcctgacacttatattggctccgtagagaaacacgaatccgaacaatggatttacaacaaggaaacggaatctatggaaaggaaagttgtgagcattgttccagggttattcaaaatatttgatgagatccttgttaacgcagccgacaacaagattcgtgatccttccatgaagaacatcgaagttactatcaagcctgaagagaatctgattgaggtgaaaaatgatggaaagggtattccagtccaaattcacgataaggaacacatttacattccagaactgatctttggaaacctgttaacttcgagtaattacaatgatgaccaaaagaaagtcactggtggcagaaatggatatggggccaagttatgtaacatcttctccacagagtttatcgtggaaacttacgataaatcttcgggaaaattatatacccagcgatggagtcaaaacatgggtaaaaccgataagcctgttatcaaatcaataaaaaaggcaactgagtataccaaggtttctttccgtccagacttagcaaagttcaacatgactgaactggatgaagatatcttgggagttctacgccgacgtgtctttgatctttgtggatctgttcgtgatattagcgttaaacttaacggtgaaaagcttaaaatcagaaatttcaagcagtacgttgagatgtacgtcaaggctctggagcacaagaatgatccgatcaaaacagaagacagctcgttacttccacctccaagttccagttctccttctcaaactatcgtctatcaaacattgaacgatcgatgggagattgcttttgctgtttcagactcaaccttcaatcaggtctcctttgtgaattctattgccaccacttcagggggaactcatgttaatttcattgcagatcagattgttaaaaagattgaaaaagaaatcaagacaaaaaacaaaaaagccatgataaaaccatttcagatcaaaaataatatgtttctatttatcaactgtttggtcgaaaatccggctttcacttctcagacaaaggaacagttgaccaccagagcatcacaatttggaggcaaaaagactgaagttccagatgactttataaagaaaattttgagaacaggaattgtggatgccattttggatatcgctgccatgaatgctgataaggcgttaaagaaaaatgacgggagcagaaagaatagaattactggataccccaagttagaagacgccaacaaagccggtaccaaagaaggttacaaatgtacgctgattctcacagagggagattcggcctcttcgttggctgttgcaggtttggctgttgttggtagagattattacggcgtctatccgttaagaggtaagatgcttaacgtgagagaagcaagtgccgatcaaatcatgaagaatgctgaaattcaggctatcaaacaaattatgggattccaacacaagaagaattatactcctgaaaacatcaactctcttcgctacggtcacataatgatcatgactgatcaggatcacgacggttcccatattaagggactgattataaacttcctggaaagctccttcccaggtttactgaaagttcctaactttcttttggagttcataactcccattgttaaggttaccattaccagtggtccagaaaaacgtaaggtaattcccttttatagtatgcctgagtatgaagcttggagagagcagaatacagaatcgtttaagcagaagtactacaaaggtctgggtacatctcttgccgaagaaatgagagagtatttctcacaattggacaaacatatgaaaacgtttcacgctttgcaagacgtagaccctggatttattgatttggcattttccaagaagaaagctgatgatcgtaaggaatggcttcgtggatttgaacccggtgtacatctggatcctgatttatccatcatcccaatttccgactttatcaataaagagttgattcttttcagtatggcagataatattcgatccattccgtcaatgttggatggtttcaagccttctcagagaaaaattctttacggttgttataaaaggaacctaagaagcgaaatcaaggtttcacagcttgctggttatattggtgaacatagtgcttaccatcatggtgatcaatcactgattcaaagtataattggtttggctcaggactttgtgggcagtaataatttaaaccttttacagccaattggaggatttggttccagagctcaaggaggtaaagatgcctccgcagcaagatatattttcactgacttatcgaagattacaagaaaaatttttcatgtcgatgataatcctttgctgaactatttgcaggatgacgaacaaacagttgaacctgagtggtacttgcctattgtacctatgttactaatcaatggttcagagggtatcggaactggttggagtactaacatccccccttttaacccagttgacattgttgccaacattaggagattgatggatggtcaggaaatggaggaaatgattccatggtatcgtggctggaatggttccattaccaaaataagcgctgataaatttcgaatggaaggtaacatagagcagattgatgacgaaacaatagagattactgaaatcccagccaagacctggacgatcaacatgaaagaatttttattgaatggtatagcagggagtgaaaaacagaaatcttggatcaaggatatggaagaacagcatggaatggatcttaagtttgtaatcactttaactaaagaagagatgaaaaaatctttgcaaatgggattgaaagaaagatttaagttgatcactacaatcaacgttggcaacatggttgcttttgatgctgctggaaaaattaagaagtatgacaacgtgaacgaaataattgaagactattatcatgtcagactggacttctaccaacgtcgtaaggatcatttagcagaagtacttggaaatcagttggagaaaataagctctcaggctcggtttgtcaagatgattattgaaaacgaactccgagtaaataacagaaagagaattgaattaattgaagagttacaaagattgaactttccaaagttctctaaagatggcaaaccaatttggcagcaggttgatcaggaagagatcacggaagcagagatcaaggtcgaggaagaagaagaagaagaaatagatgatgaaaatcttttaaacaaatcagtgaacatttttgcttcttatgattatctcttaggtatgccaatctggtctttaacccgagagaggtatcataaactgctactgcaaaaagctgagaaagaagatcagttaactgaactgttgaaacttagcgctaagcaaatatggaataaggatcttgaagtctttttagaagagtggcatgctttcttgaaagaggacgaggagaagcgggcatcttcctttaagaagtcagggcctgcagccaagaaaaagagagtgagacgtgtgaaaaaggaaaatgacgagaatgatccagactttggatcaaagaaaccaaagacggttgcaaagaaagtcctcaacccaaaaacaaaacccaagagtgcttctttgatgggtagtttgtcagacataaccagtgagcttgacaagaatcttgaaagttttgtagatcttacataataatggtgtatggttgtaatttttttatcaactcgaagagtctcgagaaagacgctttaaacttttcgtttcttggttaaagtacttgtgagatgccatacttcaaagtcacgcagctgagatcggcgattgcgatgcctcaaaaatacaaggacacattgtttaaattggggctgggtaaaagaggcaagatttctttcagaaaagtgaatcctcaacaggctggtatgttggctacggtgaaagagctagtcaaggttgagctaagtgaagaaaatgtctcacagaaacaactgagattgcaaagaaagagtaatcctggcttcactttggaaagaaaagattgaaggaactagtaacaaagcccaataaacaagggaccatgtagtcgatggtcattcagcatgtaaatacatttactcgccggagtcagagtctcagatttttccataataataagattttgtttccgaataaggggtattataattataattgtacttaagatcaaaatatggtgttgagttgtttaaaagaccaaacgttttgcttgcgccaagtcatcatcgttgatgaggacattgcaatgtttcgttggcgtgttacattcactcatactcatacttgtaaactctccatcagaaaccaaagagtaatcaaccatccgtagaacggttctaactgaaattgttcttgaattatccaacttttcattccttctcctcttggacttagtagggacatcagagaatagtttattctgaatcttaaagatagacatcggagtctttgctccattggaagagttggaatttgtagtgaacttgaattccaagttatcaacaatactacgcttggaggcagtaggtttgtcaaaagtaaagttctgactgcgattgaacccttggtcggccataataaagttttcctgatctctcttgaaggtaaccagacgttcaattggatcatttctagcattagaaaattcttcgagtcctaaagtttgtttgaaggttgatttcaaacagacattgagcctttttatggagctaacttcaattggtacaggtttggaagtggtactaatttccaaaccaattatctcataaggtgatactttgggaaagtagtcatcataatggtcacatcctagaagagaaggtttatccttgatatcagcaatagaattgacttcgtcgatgtggcccaaggcttgatttctgttcccattgtctgcgttatcaccaactttttttcccttgccagacctcttgggtcccttggtcttttgaggcatcatgttgttaaagattctttcgaccactgccatctgagattatttccagcctcattaccatgtcctatccgttatctttatataattttgacagtttcacccttgaaaggctactcttagtatatataccgttttgggacaaacaaaaacaaaacaaattatgtatcccgatttggtatatgaatgtgacacatcaaggatgcccaatgttcttgcaagatcgtctctttaatgagcattagtaccagcctcaccgagggagtttcatttcttgcaaattgtgatactcaaggttatggtactgaaaatagtatccctcaaaccttgaaagaaccatcatgggtcaaacacccaggtcgaatttttcacgtgaccagcatcagataattctgtttagtagattcagttattgtatctgatgccataacaatggagaattcagagatagcaattgccaaagttgctgatgaactattggaccaaattgatactctactggaacaggtactatctaaagaaagaagttcccaacaagaaaaggatctgatacagaaaatccaacagtttcaaccgtgtccgcagctgattgataaaagtttaaaaaagttcgtgtcatcccttcttagtgcttatcaaagtaacaatatgctagactatcttggttctacggaattctccaacactataggggttattttttacgaaatcacaaagttaagaggatataaaactgttcagcattgcctggatagtaacttttacctcattgacagtctcattattcgcctacaaaactctcgggaatatggaataggctggcaagaaaattgcttgctgttactttggttgggtgtgctaatcctgtctcctttcccattgacacctgaaaagaatcaaagtatattcaggttaggatcgacatttctaaacaaggttggaaaggagaacgaagctgccagttacttaatggccaatttcgtcacaaggttcaaaaacagcgaagtaatgtcacttttctacgagtctctacccttacgtggaaccgtgaacgataagatcagctttctgagatgtaacaatttggtgttgaaaaaggccaatcacgcggatatcctgccgtaccttgatatgcagtttgacacctttgtcacagaactagctgaaacggaagatgttgtgctcttgaaacttttgatcaagaatattggcaagattggtgttatatttgaaagcacctatcaggttgataaggtggaagatattattaatattttactgaactatattgacagcaaagaaactgtgataaggtacacagtttcacgacaatttgggaagctatcgcataagttgccggaagaatttcgaaaagatattgtcaactgcttgattgaagagttggacatcaacctgttatcaaccaaactgaaccttgacattcaagtcgacggggatgtgatcgacataaacaagtatcatggcgttttacttgtattttcggaactagctcttgaatctctcattccttgtgagtatttacaactattaacttcaattatatgccaaaccatttttgtggttcaacagagattaagctattcgattggaaataacgtgagggactcgtcgtgctttctgtcttggtctcttattaggaaacaaatgtttcactcacgggaagattgtgaatgtctggttgtcctcttcaaacagcttatgttttcaacttgttttgacactgatctaatgattcgacgagcttcagcagcagttatccaagagcttctaggtaggtatggtgattttgttcttgcaacaattgctcctcgatccgaaattaataaacttaaaatcaaactcattgaactgttggactatgtgaaactaggaaacttgcaaagatcatttcagctacctattgaaatcggagatgaacttgaaggttttatgaggaccgactttattgagtttttaaagcatctggttattggctggaactatacagtaagatgtgagagcagtgatatcttggtaaagctcctaataaaagaagggtcacctcctgacgatattattgattaccttgcatgtatgcccaccactgatggatcgttgatggctatctcaaagttaagctcacttttaactaatgacaagataactgaacttgcatcaagattaaagccagccttagacacgtttgagtttgactttcacatttcacccttccacaaaggtgaagaatatttactaatactaaactcactgcagtatgatttgacagacactaactgggaaacaactttcaacattatcagacaggatagtcgtgaagaagtctatgaagcattcaaaaccctcataattaacctcaggactgagataccaaaaaaatacacagaaaaatggaaatactatattgaaaacaagaacaagataacctccaaagctttgggatattgtccaagcattctcagctccaactttgaggagttcttgagtttagtattcaaccagaaaatagactatgaagttagagcggggttgatcggatccatttcttactttttgagtaatcatgaccatgacttgcatttagaaagaatgattgaccttttagaagattacacgatcacaaaccaaggagacgtaggctcctacattcgaatggctatgatgaatctaatagaaaacaaccttcacaagttcaaggattttgagaatagtattgacgttcaactttttcgattatccgttgaaacaatggaacgtctcagatggaaatcattggagcttttattactaatccatccagaatggcaaggctacctacaaaaagagcctcgtactaatgcgactcacttccgtaacatactggaaatatatcgtcatgaaattctgatccctctaattggagccaaaaatgaacaactttcagagatctcaagatctttttggaaaggttacgcattctcagttggttcttccagatctgttggacctgaagttaaagcagccctccgtcctctagttatgatgataatcgctcacgagttcaatgatgatgaattttctcaaattattgtcaatattatgagtaacttgaaactcgtagcaaatcctactgataaagacagagcaaataagttgtacaactgtactttatccttgattgtgaaacttattgactccaacattcttactaaaattgagagggattccttaaaaactttgtttgtgcgagtgtacaaccttcagctcaaggcacccatcatgagattgggcaactgtcttgccattctaaaatggatatatcaaaaagctgaggaatgttcagattcaaagtccatagaaatgcaacacggaattatgaaaaggcttattgatttatccttaaaacataaaagcagtaacgtcagacaaattagtattcaagtgctattcgaattatactattggaaacaccaaaaacaaggggcctatgacggtaccctggaattattggaaaaactggattggaatgacaacggcttggaaaagtatgtagggcgattacccttttgaaacaaataggaaaataatatttacaggacgtctttcaaagatatttgaccactacctcgttccaagggttttggttgcttgtcactctttttccagccaatcatgaatacaatgcggaaagttgcaggtaaggcacctgttttttcgtctccatgcaagcttctataaataggatccaatgctatcagcatgtcctttgtgattggacctggggggttagcaatagcattattttcacccattaattgtagatctctcattaggcaccaaacatctgggtaatttacgatgatttcttcgacatccaccgtaactaggttgaagtttgccttttgaagcaaattacccaaatcagagctgtctacaaaggggctaattctaggagatattcccccacgacgttccatttcagctaactgaagacttgttcttaattcaaataaggtgtctgtagcaaacatagaacccataaatagcccgtcctctttcaaactatcgtttatgttcctgaacgttcctggaaggttatttatccaatggagtgataagttggatatggcacaatcaaaaaaatcctttctctgcaatatttcatggctgtactcttcttcatccgcattgatctttgtaacaaacgagtcatcaaacgagtttctctccaaaagtggaagacagctatcaaccatatacacatgtttcagcttgggcctgacattatcgatattatctttcataagttcatcctccgtaggagtcaatagcgtctttacaaagttaccagagccacatccaaaatccaaaaggttcatcgcttccctttttatgaatgaaagcctatggacagttcttctagctatttcatctcgcagatattcaacttgtaaactttcttcatcattggcagccctggttctctgtagcaatttgacttttctgtcaaagacattgaactttgactcttgtttggcgctagctgaacgacaaaacgttctgatttgtcgtagcattagttgatcggaaggagataaaataggatgggggattaatattcaaagatttaaagaagcgtcgagggaaccccatcgcaggaggaaacatggagaaatgtcatgggttataaagaaactcctacaaggggttgatgacgaaatttactactactcttgaagtatacggctattcttgcaaagtttagtcctacactactagatgaacatctctagtttatcacgctcactcttcggaagcattactgaagggtccaactttgatattcgctccttcgattatctttccattctaccacttttgcacctctaatgctaatattcaaaaggtataagcatatcagacccatctttaagacacatgcaggagggaatagtataaatgtctcccgtaaacaggatctgatccatagagatatcacagagattcggaaaaactcgaaagacaataatcagcttaatcttaacatctgcctgaagatgaaagcctacaataggacgcctcaaacaataaacaacgtattcagattatgcaacgtactaaagcaagaaaaagattttatcccagataaccgagtatattacgagataataaagtcaatcaaccacaaatgcgacctgattggtaacactgacagattactgaaagacgaaaagattcaagaaatacaaatattggctaatacgagtctagacctagcccaagaactgatttctcacaacggcccaagatgcaagatatctgctcctctaagagaacagctggaaaaagtggtaactaagtgtcaatctgttttgcttcttagaagatatttaggcttattgaaaaccattggcacttcggacaaatatgaatatttgcggatattgacaaggttctacttcaactctaatcaatatgagctatgttttgactctttttggataatgatctcaaaatatgaggctggctttacaacaaaacctttgaacaatgttctgaacgagtttcacttggggtatctcatcagatggagctccgagaggaatgatgaagcaaatatcctgaaaatgattgaattattagagaaaaacaacaaagttcatgattttataactgacaaaacattgtacagattaaccacccattcggtacaatacaataaccacaaagtgttggctagattactacaattgaaggatgacaattccctcttctttaacgattacaactttaacgaaaacacccttaaagagtttttgaattgctttagtgaaaatggactggtagatgaaactttgactgtcattgaaagaattttattattgagaaatcaatctactctggacaatgaactagctagccacttaattcaatgctatgcgaacaataaggagacaaattatctgactgtatgggacatttgcaaggatatcaatgtggatatcaacaccaaagacttatatgttttgaggtatcctcagttagctaccaccgcggacatcagaaacaatttcaaagctctcttagatgacctaatcaatcatgattcacctctagaattaaaaaagaagctgctagagtccatttttgttcacattaaaacaagagtgcaaacactagcactgtcgtcagtccctgtggagttactaagtcccaaattattagaattatactcatattatttcaagtcaacatttccttctaagctgactgcataccaattcacgatcttgcacaaatcaataactaatgaaaagctatccccaaagtgtcactatcatttaatgctcagtcaatgtcatggaaactctcattccacactgaactattttctattcaactatcttaatgagtaccaatatttaacaccaaaaatactagagttgatccagatggtaattgaggaaactaatgatttccagctaaaagagttcttgaattactatgttcaacactctaataaccctgatgggggccgttggagagaattgcttcatcccgaagatgattacttttccattagaattttgactagaaaaaatcatcagataatagatggttttggtgagtatagttacggtattgaccacacaaatgccacaaggctagcttcgattggttaactctacctcatacgtttgatatgtacgcatctgcatctaggacgatatactgtatataacacccaaaaatcctaatgcaactaatgaaaggaaaacatcgcatttcaaactttcaatagccagtgtaggaaccaactctctatcaagctttcttttgcgttcagccttgacaaagtgaggtgtctgtggaatggtggcaccaggtgggacgtggggagctggattcaaagattctagaaactgttccaattcgccacatttgattcctatcttgatatagttggcatcggtaattggacatgagtgatgaatctgtcttaagtagtaactaaatatttcacaggctccttcaaatgtcctggctttcagaattaaataacaagttgttccctttctgatcttgacattagtctcaaaaactttttcatttctgaaaactgttgccaaggttgcaatggccataacttgtggaatgacacagaaattataagatgagaaatcgtaaacagatgacaaatagacgagtacgtccttgatatggtccattgtgttcagcacaagttccgatatacagtccaatcctttttcgtaattttcccgtttggagaagtcggacaagctgtctgcatatttggaccaaatttctttgggccaaaaacttcttccatcatcaagatcttctctataatctctgataatattagtcttttgcagaaataatcccatgctctcgctaagttgcatattgtcctcaagtttagggtctccgaaaccagcctccacgatcaagtgagtaagtccttcacccaccaatcctgcaacatagtgacagtataaatcatagtctttcactgtggctacgccattcaagttaaactcttcgtcagtaatatagtcagccataccattacccattttatgggtaatatcttttatgacatcctggtaaacaggtttcaatcggtgatattcctcgagaacgtctgtaaagtccacaagaacctgtctgtccttttcatcaggagaattaccatcgaaactccacgacttgaggtttagtttttcatcaaatgagcgaagtaaaggaattttaatatctggtttaattgtcatatcgtcttctacagtgtccaaggctcttaatacaaggtagaaaatcataattgcatttcgtaactcggggttaagttccaaaatcacggtacaaaaagatctggatgtcaatgctagtagctcgtagcagtgcttgagtgtttcacgttcatttgttggctgtctggggtgaagcgattgtttgaagaatttgctggatgaatagttagtactaaggtctttgaatccaaatctgccttgaaaagacgggtaaagatacgaacaattgaattgcagctcgaagctcaagcggatgtaggactagttgtgctagtttgcccatttgtaaaaaaggtacggttcgtttacgataaagtttaaacgaacaatatcaggtcgagtaaaaccgtcgttcaggctgtaaaatcacgtggtatttatttttttttaggggagttatgtaagccctcttatatttttcctctttgccagtacgtactataagcagaaaaggtttttccccctgcagggtagcaccatgctattagactgtctgtctatacctgctctatacacactagacaccttgtcaaacgttctctactttttcaaataatgatcttgcaatcttaatgtcctccaaaatcaaattttcatcctcaattgcagttgaatcgtcatcatttctttgattatccatcacgatcataatgaagatgttattggtcaactctgccaagtatatggacgtattcatgccgttaagaattatcgtctcaaagtttgttcttatcttgttcacactctgtttgtaagtttttattatgtttgagattttctcaaatcttttggggtctaattcatcgttattagtgatcagtttcctgtccgtagaagaaatcaccaaaaaagtggttttctcaaacagtataatctcccttgcatttagtatgtcgttaatcttggaaagattttgctggtagaaggaaatgtttggaatcaatgaacagatgattgatgaccacgccttgtacaaactttcatcccagatactagtcgcgaatccagtgagcttaaagtgaaatgggtttgctattttctgcaaattgtcaaacatgatcttgaacaattcatctctcttattaacttgaattaggtccatcttgtgtaatagtatgaataccttgacattgggagagaattggtgcaaattcttcaatactctttgaaaaatttcgatatccttgttaacctccttactttcaacgtcaaagacatgcaataatacttcgcacttcttgaagatgttgttatttgaattggggttctggctgctggtattcaaaaagttttcgataaacacatcctggccaccacaatcccataggttcaacgtcatattgttcaaaaatctcaaatttgaatgttcaacatcaattgttgctcctaatcgtctggtgtcaaatgctgaataattggagaagatgatcgaccgcattgatgattttcccgatccagaacggccctaataggtcagtagctacttttgcaccaattcactggttttgctcacttaccatcaacaggagcttcttcctggagtttgtcgacatggtataggtaacttatgtgggtaatgtcagataggtaatttgcaaacgagagatagtaaaatggagagcttggttgggggacgactttgtcttgagcacttgaacttatctggattgaggtgaatggtgagatttgaaagactagctatctcaaaccagttgaccagccgtttgaaatttaggtgaatccggcgaactttgaacagcttgattgctaagatgtcttgggaaccctggattgtctggtaaaaatatatgcctccaatcagattcgaactgatgatctcctcattactagtgaggtgccttaccaacttggccatagaggcatttgtactaaaaataacagcgagatttatattagctgtaagatttttccatttcattcatcatctcacttcaagcagggcaaaatcagcacacctatacatcgttgctggtcttgaaagacattttgaaatgaaattcgaaataaacaaatgaattactttatatacatctacttggcctccgactcattgagttcactttttttctcctgtgaagtaatctccgaactttctcgttcctctgaaatatcagagttagatggagaggaagataagttcgcagctatggtatttagctgtgcttcgccgtcctttccaggagctgatgtcaataccacttctccatcatcaccaacattgactgatgttcgctgtgtcggatcgaaccctttgatgaaaaatactaaaataagagctggaattaggaacccgagcgaaatgtatccctgtttctgcaaaacctctctgtacgccctatcgatagcctctctttctggagttccctccgcgtagccaattgcaaccctgatgtttccaaaaatctctctagctctgctcttagacgcttctggaagatactgcgtcagtcttttaattacaagttcattccaaactgatgccgaaatagaattaccaattacggcacccatttgattgaacatggtaaacattgcaatggatggagctatctgtgatggatccgagttagcttgcacggaaataattgtgggaatgttgtagaaaccccttccgaaaccttcaaacactttaattacagtccaatgaagctctgagccaaatccaccattattgttagcaagatagcagaagaacccttgagtgaggacaattaagcatactcctgagaccataaatacttttgcagtcttggtgtactttatcaagaggccaaccaggaccgcaccgaccatttgacaaacgttggcggctctagggattctggcagcttctccaactgtgaagtgacctgacacttgcagtacggaaggaaagtaggctcctgataaggaagtattaatagcatcaaaaagcggtaatgtgcatgccatcaaaaccgatgggcgtttcaaaatgcttacactgaggaacggtctcttgggaaactttgagaggacccacaacacaaataacaccaaaattagaaaaccaatgactaagaggacaattgtagtggcttcattccatcttaagattgatgctgatcctgtaagggtaaaggggaggaagaagagagaaagaccagtaagcatcaacaggcctccaactatatctagctcaacgtacaacaggtgagccacttttttgtaccagctgccttcgggaagatttaaggtggatttaatgttatgtgtgacgccatatctcttggcccttctatccaatttccacataataagaatcaacggtgccaaagaaacaggaatgatgatagcccacattccgtagccccatctccaggtggaatgctccagcatcttttctgctacaatagaggcgacgtaaagggtgggaatagaagcaacagctgttggcagagcagtccacaatcctctgttcaagatctgagtggtgtcagcaatgaacaccctctccatcatgacataagaaggaataccaatacccaggaaaatttgtgaagccaagtacattccaacgtttttggaggcagcaaacataacgtaagtagctatcaagaataccagggcaatgaagaacccagtcactctactgaagcagtctactatacgcgcaacccatggaagtgaaatgacacatacgatcttgtatacaactgttgcagttgttaacatagagtgttgcctgaatgaggatgtggcgtatggagtgtaagctctactggcgacaccgcagaactggattacaaacgccacaaaaaaaagagcagcataggcaataattagagtcttctttgaccaagcatgacgaagcagttcggcacgagcaacacctggaagcaatgtgacgtgagtttgagcttccgtatcggtattttggctttccggagaacctgaagcgctttcgttctggctcttacgaaaaacgttgaatttcatttgctatataaagcactgtactgaggatagctcaaaatgaaacgagggagctagaccttagcattttataattcgacttcaagggagaagtttctttcctatgggtaagatgttgcaagagttgcagcaagatcatgcagattggtgcatatccccggctccagcatcaatctgaaattggcaggaggccacttgagagaaaggcaatttaagcataatcagacagtcttggtcaattccaatctaacaaatcatacgtttaataaacgggccccttgaaggggagaaacttacacagtaattttcttggcagtagttccaagagggagtatcaccacataataggtaggtgaaaaacatgtggcaatgttggggcattttccatcggggtcctgactgtgaccagaaataaaaacttaatccaagagtcccaagagcgtaatatgtggttggtagacatgaaaaatgttgctgaaaaaccattcttcggcccagttcccgtgacttgggcttttacagtggaattaacggtttccaagaatgccgagaatttttatctgatctgatatttctgcattatatatataggcgaatggaggagcgccaattcattgcttacaacgcaaaaatcttacctggttggacagccaggcggagattacatcagatcgaattgaaagttgcagaaattccagacgcttcaatttcatttcgtcgatgtccgtgagttattcaatgcagggtcaactcaacttatgcataaatcatttgatgttgggaggtagtacaggagaccgaggatggagagatgacgaagagaacatccagcattcggacgatgaacattccgcgaattaactgaccattcctccataaggaacttctacttttgtactcagaactccgtatattataaacaactgcaatggcttttttgttcaagaggaaccccaaggctcaggagctggttcggaacttgaacgatagtctcacaaaactagagtcttaccccacggacaacagtaaccgaaaaaaggtggtcgcagatatcagcaagaaccttagtcagatcaagatcatactacaaggaaaaatagataattacgaggagttggacgacgaaaatgacgataggctcgatatggcggattctccaagtgactacacggacagagtcggaagtaacaccgctgatttatccatccctggcttggcaggttcaaatgtcggaagcccagagactgatagtaccatcgaccagatcagtcagctggcgaacgaatgctatatcacagatcttttgtaccgtctactactaaacatagaaactttggaattcaactcacgtaaggatgtctatatcctgtgtacatctttgttgaggagagaaattggaaatcggtctcccactattgattacctcttgactcacgactatgtcattcaattactcatgaaggcccccgaatatcatagcaatattaacatattattgagcaacatactgcgagaatgtatcaagtttgaaaaggtctgccggtactgcttgaacagtgagttgttttggcaatatttcaaatactcccaacaatcttcatttgaaaatagcactgatgctctcatcacgcttaacgatctgctcgccaaccatcatggattggtacaagagttttttagcaaacaaagtaatctcgacaggttcatagagaacatcaacaagctcatcacatgtaacaactatgtcacaaaacgacagtcaatcaaattactatccaagttgattttgcagcgatccaattataatttaatgacggactatgtaaataactcctccaatttgaagctgatcatgattaacctcagtgataaatccaagaaccttcagtatgaatcgtttcaggtattcaaagtttttgtggcaaacccgaaaaagaatagacaaattcttgatatcttgataaaaaatagagagaaattacttttcttcctgaaagagttcaactataatgacaaagatactgtatttaacgaagaaaaagagtttttgattcagcaaatagaagagctaccatcaaagaataatagtacatagtatagacgactaatgcttaaaaataatgatttatgtaatatacattgcctccgattgactgatccaatacaatcacaccttcactgcagagttcatcgacgacagatttgagaatggagaagttacagttgttcatagcgatttgaagttgtttcaaatctgacggattttcctccaacaacgtattgactttgttcgacaggttgtaattggtggaactagttttcgaaataatgtaaaagctgttattgttgtggtattcaatctgatacaacttcacgattgagtttacattttcaagttgttcacagatgagtttgaaagttgaaggagataaaagattgagccctctggatttgttgtacaacttgtacagctcacataatgagataaagtcgttttgcaccagatcgtaattcaaaataaattctaccaattgtcgggcaacctctttgtgataaagtgatttctttgtatcagattccactataattccattgttgattttatggggaggtttgttggactttaacagggaaatcaactgatgattttcatgtgaacactgatgcaggttcatcatcaatggtttcatggattcacttagccgaataagcttttcagcatgtctcattagtctccctaaaccactcagagaatcattaagaaaagaactatcaatgaaatttgaggaattattctctagatcatggatacccttttttggagtttcctttgaaggaccaacaggggaagctggttgctgaacgacgttcatgttcatcctattgaaccgcttgagaaaatcatgctggctcttctcaatataatgctgaagtttatcactaaaaggctgaacttttttatcatgaaaagacaatttgaacgtggttgagtctttggatccaagtagaatgtctgaatcatcaaagctatccttatctctcaaaggaaaattacacatttcacaattcagcattgaaggatgattgacaaacgtacactgaggacacctgtgctttctcttggacgctgttgttgcttctacgggtttgagctcaggttcgaaggaatctgccttagaggatccatcttttagtataagtctttctggttttataccacacatagagcatttaaaattgatttcgttgttagcctcattaaacttagccaatggtttatctaactgaacgtggttactgaaagagcaaattgtgcaaatccaggaaattctgtacatccttttcgtctcttctccttcggtcttaaccaaatcaagtattagtttgggggaggaattgatgaaaccttggtacaaggagacctcctgaatctcatgaagtaatatgtaatagttctcctccggaaaaagctcattaatgaatatcaaacgcttatttgttagatagaatctgaccgtttgaaacttgtccagcttagtgttatcttggtagagacctatgtcgtcctgaatataaactatgacttcatcaatgtcatcaaaaaacggtctaccgctttgagtagccttgatttttttccacgtcattgataaatcagtaaagtggtcccagaagcatggatgttaacgtaggtcggattgtactaaggcggaggaaggaagcaatttgaaggtgcgaagacagccttagatatcgaaactcatcacactaccatcactaggctgcttaaaagagctacgaacaaggcagttatagagtctttataggttctcatgacgctctcaaaatccaaagatcctccccacggtgaagatctggatcttcaagaaaaaaatgcgtctgaaagcgacccggaagacgaaatactaagtctatcccaaactgaaactcttcataaacacgttgacgaaatcgatgatctggatatcatagaagaactgcaatgtaaattgaaaaacgactacaaagaaatatcaggggctctagcaggaaattacctggagagaatagatgagatggtggatcaaatagattcgaccatgaaccgactgaacaaagatctttcgactttcgaaaaaaagcaaaaacaggctaagagaaacaacgaactggctgctgcaaacccgatcgatatacctatatttaagcatgcatttcaacaggcattggaaccctatgtgacggagatgaaaatcttggagaatcagacaagatatgattttgagctgtacgaccaagaattgcatagagatcgagatatcatatggaaacagtatttagcagatgtttcgaaggccagagaagaaataagggaaaggctatcgaaagaactagaggaagagataaagcccatgccaacaccatcattactgaataaggaggataccgtctgggatccctcgcgaatgttcccagcgcaacagcgttcgtcccagggtcccgagaactcaattgaggacgacgatgagctcgaccgagatatcctccttctacgcacgctcataaatcgaaaggcaaataaatagaccttcctccttcacttggcaatcgatttcacactctcacttgacaattttaattttagataaacaatgtcgtcagtggatacattcttagcaatcacaaacacagaagatgccgcggtggctcagcaatttatagaaatggcaggaggtgatattgataccgctgtatctctattctttgagcatggtacagatgcgacagctacagacaacaatcctgttcgaagcgacgaacagctggcccaagatttacaaaatgacgcctacaatgacgaagtacgagccccaatacagccggtcaccgaacaactagttgacacactctacccagtgtctggaaatggtattcccattgatccctccactgctattttcggctctagaccaacgggcatattcaaccaaacttttgggggtgatcaagaagaaattgatgacgatgtggataatcaattcgaaaccatcatggatgaagaaggtaatatagtccagcgtcatagaagcaattactcaagaggaatagatgtggacaatatgacagctacacaaaggaggttagctaatttgttcagacctccatttgatatcatggaaaaatacaacctggccacagcaaaaaccgaagcccgttctaagcagaaatggattttaatcaacattcaagatcctactgaattccaatgccaaatgttgaatagagatttctggtccaataccgacatcaaggatatagtgcacgaaaatttcgttttcctgcagtaccaaaaagattcagtaaacggtgatgattataccaatttttatcattttgaaagcttccctcacattgcaatcttagatccaatgacgggagaaaggttgaaggtctggagtactgttcctaatattagtgattggattgaacaagtggttgattttttgagctctcactctttaacgggagctactggatctgtaacaccactaccacaacaaagatcaaatcaagctgaattgatttccctagactctgcatgggaggatgctgaagaagacggcgacgaggaagaatctgctccaggatcttctgagtctgagggctcttctattcaaattataaataacaacacaactcttgctataaagccaattgaaaatgaagagcctccacaaggtcctgattcgacaagaattcaaatacgtacatcagatggtaaacgagttgttcgcagatttttatcatctgacactgttcgcagcctttttgaattcgtcaaatttatttcaaggatactatagaaaaccatgaattccaacttacgagccaaagagtcaatctctttgaatctttagggaacactatcgaggaagccaacctgaagaatgcatcagtgttgctagaagttataaaagattaaaatacgttttttgtcgccatcggtttaacttccctgtttgtattatttattatctttgattttctgtgctaatttgtccatgacctcttctttcaggattggaaccttttcatcctgaatgttcttagtggataacattttgtactttatgtatctttgcagtgcaaatgcccctccggccatttttgcaaagattagaactgatgcctggtgttttgtcaattttcggagatatctcttcaggaatggaacgaaatactccatttgaatgccactagatccttgtgcaacgttgatgaattctttgcaaaggtactcatactgcttattcgagatgggataagaacccagaaataaaggcttggatcccttttctttaagaaatctttcagcatctgtgagtatttcttccaagttctctgagtgaaagatcagcttttttcttttgataccatttttggggtaaggaactgcaatataccgtttcaattcaaatttgcctttggtcttgtctatcctcagatagcttctatccgccaaggataccccccaagaatcgattcccaattgtatccaagggagtgaatgctgcttgtagagtttgtactctatggatctctgattttcctttgaaaggtttttggggatagaattaatataactggttatatcattgaaagacgtataccgtaaataatctggaacttcttcaagcattttggagtaatccctgttgccatgaaccatctcttgatcgaattgtaacagggaattcatctgacgttttgttatcccttccaaagtggcatcaacgttaataccagaatgagtggtgcctacaaaatctgtgacgtaacatttggtctttcctgaatgaagtctcaaacctctgcctatcatctgacttagtaaaggtcgggattttgtggggcgcaaaaggaaaatagagtcaatattaggaatgtctgtgccctccgtgaaaacattacaattcatcaagacattgagttttccatcaatgaagtttttgattatctgttctctctctagcaggggagtgttgccagagacaaacccagctttgataccgtttgcacaaaataactcacaaagatcttgtacgtgctgtttgttcacacaaaagaacagggaagatttcaacccaagcactttctttctttcaaggtacgtttttaaaacaagttctgcaacagctgctgtattcacagatgattccaaactttgcagttgatagtcgcctgtcttatctagtttaacatcgtccaaagaaaaggcaccttcgactttggtgatggacaattctgatagatacccttctttaaccatagatattagatctttttcatatgcaatagtattgaatactttatccaaaggctgggcatcatgtctcttcaatgtagctgaaaatccaacaacaataatcccatcagagctgtccttcgatagggcattgaagtactgtaatattttgatataggagtcagaaattgcatgatgacattcatcaataatgatggctttgaactcattagggtcataatcaaacaagcgtgggttcttgctgttatttcttgccaaagtgggcactgaggctacaactacatcaacatcgtcatcatgtgttggccttaagcctgccatatctatttctatcttcatgtgtggaaaaaaacgtttgatagttctggcagcttggtcagccagctcctttctatgcacaagaatcagcgttttttgtccattgtacttgttgctgggtatttcgttcaataagttagagaaaatcactgttttacccccgcctgtagccaaactgacagctaatctcgtttcacctcctctaataactttcattatggattcaatacagtctttctgatatggacgcagacggactgtagacggtgtttccaattctcttgctactaaggtttcctctgatgctgtagcagatcgtactcttgtaccgcagacctgccgtatcagtgtagatctttgactaaggcttagtacatattgttgtcgaaagtgaagtcctgatattcggcttagtcggctaagtatcatggccacttgaagctataaacggtgaaagatcaacgtggggcagggtagaatgggaagatgttataggtgatatagataataataaggagtatttctataaagggaaacatcatggataaataatcaagggttgaacggattattattatgggcttttatgcggtcaaagtgtgtacaggggtaaaaagaaaagatctaagtgtgttgaaatattactttccatccctaaagccttatttactcgtgattgtgtgttctagatagaagagtagtctgtagggccattgcttcagattagaaatcgaatccactcgcggaagattagacggatacaagacctactgttcaatctttcccaggttgatgcttcgacaacaccttctcttccttcatgtctcaacgtgagaaggttcagaggtcgttattcacatattataaagtcaatggaaataagaacgttgcttatacaaataatttggtgaaggatttcatccgagaaacgagctcagtgattgagttgctcagtgatgaagagacaggtaatgaggctgtagactctgctggctgcagtaattataatgtcaaagatgaagaaatgccagccaagatagaaaagaacaagagtgaaggagaaactgtaatgactagttcaaccatgaccagcatatccttgaagcaagaaaatgcattgttcgttgcctcggatgaagagcaagaagtagccgttgatgaagatgaaggttttgatacaataaaacaagaagacaagattgagcctgacttcagccaaggtctcgattctttaggctgtccagaacaattgcttgaagatgtgaaatgcccagtctgtgagattcaacttgacaaattgtccattctagaaagaactacccacgttgatggatgcttatttctcacttctactaaacttgtttacaaatcattaaaggctgcctcaaaacagaaagttaagaaacccaaatcagctcccaaaataacatccgaggaacgaattgaaaagtcaaaagatgccataaggaacagagcaaagcagataccggatgtcaagattctaaactttacctcttgcaagtttgcagttgatgctttctgctatggtcaacatcccgagataacacattattttctgtctcacttccacgccgatcattacatgggcatcaccaaaaactggcacaatggaatcatatactgttcaaggataaccgctgaactgctagtcctcaagtacaatgtatcagaagaaatcttgagaattctcccattcaatgagacaatggagattgaagatacacaagtgaaagtaactatgatggatgctaaccattgtcctggtagtagcatttttctcttcagagactcgaaagagcattgcattcttcattgtggagattttcgaatcaacaaagaaatgatacaaaagttagcttcctataaaatcaatgagatttacttagataccacctacttggatcctacttacaattttcccaagcaggagaatgtcattgacgtggtaggcaccttttgtgagaatatattcagaggtgtttatcaacatcctctacagcaacgaattactgacttctttacatttcggaaacgctctaaaacattgaagcccttaatatgcgttggcacttatacaattggtaaggagaggatcgctattgacatagcaaagaggctcaaaacgaaattgtacgcgcagtcatccaaaagggagattcttaatactttccactgggaagaattagatacacttctcactagcacccccacagaggccaatgtgcatcttattcctatgcaatatatgaaccttgaacagttagaaaaatatttccactcatacagaaatgatttctcccaaatcatagcaatcagaccgacaggatggacgttcgtatcagccaagaataattccactaaatggatgaaagaactatcgaagtctcagatactggctcgaattgtcaaaacgaaaaatgatgcctccagatttgacttggaatccattgaaaagcagttcaatagtgataaagtcacacaaatataccaagtaccctacagtgagcattcaagttttagagagctcagttttttcagcattttgttggatcacaccagaataatcccgacagtgaatatgaacaacatgcaaagcattaaaaacatggacagctggatttttgaatggcaacaagcaagggctgttcaactagtaacaatagacgatttttaggtatcttcaaaaaagaaaatgaataattcatatctaacctcaggcgggactcgaacccgcaatcttcgcctccggagagcgacgcgctaaccattacgctacagaggcgattttaccaaaaaatagatagtatgtttgccctaaaagatgtatatgcgcatcacgtgatgacatttttctcttacacttgactgaccatccaatctcctctttctttccaagcactcaattcaacacctttccgttttaacagttagaaatgagtgttcgtacaatcagacccacttttaggatactcaattctgcaatcaggacacaatcgctcaagaaaaattttattgggcctaaatccggaatatttttgccagcttatagctttttaggtgaaagaaatttccatatcagtagcatcagaatccagcagcagcaaaatcaacaacaacaacaacaacagaaaaagaacagatcaacaggtcctaacctgtttttacgtataaaaaatgctgtcactttcactgcatccactgccttagtgattggagcccttgggttagcaggaatatcattatatctgctgttctcagaattgttccttccttctggagacaccactactttcaaccatgctgttacgatggttgaaaaggacccgggagctcaaaaactattacagatcgaccccggcacaagattgaaggcttatggtgaggcaacaggagataagtggacacgcaatagacctttgagaacatcaagaagaataggaaaagacggttatgagagaattttgatgagattccacgttgaaagtgataatcaagttggtgtggtatctttagaggctgttgataaaacagtgtttgatcaagagtttgcttacgtctacttggatgttccaggtaagaagagacattatattatttcgcctcagttgcctcagaagactcaaaataccggatttttaggagttaaatggggccctaagagtaattagcctctagaacgagataaggtgaatggtggatgagaattaatatcatgaaaggggaactatctactctaagtaaataatattactaagaacatagcaataagattggtcaaaaggctggatttggaaataatctttgcagtgatggctttgctttcggacgtgtccaagttagtatttttcaacctactatctaccagaattctccgaggggaatctctattctgcgaaccaaacggttccccagttatcaaacgactaatctccttgactggtcctaattcttccttgcatctagtccctttcaatgtcttaaacatagctaatgcctctaatgtgtttggataagcgttgatacgaccatacccttcaaaatagcatgcatcaggagtggagttatggtaattataatataattgggccacataggatagcttctggtggaaagaacaatcggaaaattctccgtaccagccagtggttccattagcaacaatattgtgacaactgatttctccacaaatgtaccccactatttctgccagctctgatctattcggaacctcttcaattgagcatttcagagctgccatcatgcaatcacattttggtgctctaggtgtagaaggtagctcttcggatactttccaatcttcactagccacaggacattgaacgtctttagatccatgagatgaataatcttgtttgttcacacccttaggagatgcattcctgtactgtgccttcaaaagattaaaatccggcagtttttctacggggtcggtgatgtaatcgcccttgactttgaccactccgtactcatttctttcttcaaaatacatgtacattattgcacctgaccaaacatttgtcatgggtttgttgaatatagcttccacttctgtgaacggccttggacgtttcagattacaaccaaattcacttaaaaatacgggaacaggatagccagccatctctaaagttctctccttatatcctgatgtggcataagatgagtaaccacaccattcgtacatattgataccgaaaaagtcaatcttggccaaatcattttccccacacactagatagtccgccaaattatttctagtaagggaatcatcattggaggagtagccaactggaattttcctaatattctttcgtttaatgtaactctttatatctctaatagaactttttacaaacggcattgtgtaagtgtttgcaacatccgtgttgacctcattgccagcaaaaaaacctaatacattgtcataaggagccatcgtatcgatcacagaagtgtagcagtccataatttcaagatcccatgagggatcgtccctattaatagagcaatcaacgttagacaggtccaatataacataaatcccagcctcagctaatctttccatacagacgtcatgattagcccttggatctatagagtagaccctgagagtgttgactcctagctcttgaagatatggcagatctctggtacagatatcaggccaagctagagggtcaacaaaatgtcggccgttcctaaagttcaattcacatagagtttgggttttgggagcgtcaacgtcgacaagggattcaggacgacgcaagtattcagtgaaatcttgctgataggctattcctttgatgaagaattgagatccgttgtttgaataaaaaaacttagatccgtacgcttcaattgtgggagtcaactttcggattctttcaactgttgtgggtgaagctatatgtttgacggaagacgaaaactcataggagtcggaggcaaatgcagtaacaaagagaattaataggcgaaagaagtccttgaaacccagcattttgtctgttaacagggaaaggaaatggctatggtgattgtccttttgtaccccagattttaatgatagcgtttcacaacatagaacttgttgtagagatcttaaaaaatagtacctgatgaatgaggtactatgctgtcaaaaggctgagaacttataaggatgtaatgggtttatatggggcccaatgttttgattgcttaggcgaagatggcctacaaagatgagagatgtaaatgcaccggtaataaatagatgcaaaggttaaaaggcgaaagtggttcaagataaatcatgtagtttaatctgttcctaaatccaatcccttctcatagaagtttgaactttttcatcgccaatgctaggtatttcaagttgtaatcccgtccaagaagaaactgaaccgtggaaaacaaccctgccttgaaatagcatccaacggaatatctccatgtcggaccgctcgctactggtactccagataaagcttttttagccataccaatgtcatctgtgatgagattaaccccacactcctttactaagtaaggatcattgatagtccaaaggtatagtactaagctattggagttcgcaaactttaccagttcagtcctatatttttgatgataccatatcaaatgcagaaaagagattccgtgaagtttcccaccttctgcggccacagtgttggcaaactgaaatgatttcttcagatcaacagcaatattgaccacatcaaatccctccaagagttcttgattcaacagataatagtcgacagaccaaagaccaaatataattctctttctccaaaaattgacatccgtattctttttggtgagttcttctaagatcaggcggatgacatctttggcggggttgtctctcttgatgtccagcatcagtttgacatctggataatcggaaagccattccagtacatcagaaaacgtaggcatcggttgtggaggatgccggatagttcttaatttgcttaagacgtccttgtatgatgttttacacacattatagtcagttccgaaaactgccttggtactttgatcgtggatcacgactagcacttgatccgaagagaggtgaaggtctaactcaatcatgtcagcgccatgattaaccgcttgatcaaaagaaagaatggtattttcagggaacaatttcctatagcctctatgagctccaacagtgatagccattcttcggtgcagtaggaagcgatgagatgagatgaggttttttgacggcattgcgcgaaaaaaagaaagccgggaggagagcgaatccatggagggactaggcccaggagactttcttctgctgacgaacagcttgaagaatatgtgagagatagggcccttcttgcacccaaggcggattaggcggacattggtcacatcctcagctgaaatcaacaagaataaagtcaaagctctatgttctgcgttacaatggtcaatcaagtgattgtagattccttctagctcttgttattctctgttcccgcaggtagctatgactctggccagaaaactgatagacaaacttaacctgactcatatagtctagggtaaaacctcgaagatgacttcattcaacctctatgattgtctagatgttatcagtccggagtatccaagcattcgtgaatttatcattgatcgcccagtcaaaatcattataactacagctgaaacgctgcgtgtttaaatgatcgtcgatcgttggtgtgtgacgcgtgcaagctcgaagtgcttgcgcttgacaacttcaataagggctgggacctttgaagcttgaccacggtgatcaatccacaactcaaaagcagatctgaatcctgtaccaagatataaactcatatactctccgtaaaactatgcgtttattccattttgagtcgtgtgatattgggccttccgaatttgctggctcaatttcttcgtatacgggacaagtaacctaaaaaagtgacaacgctttgaaatctcaaataagtcaaagcacctttttcggggcgaatgcacactttcggtccgatgagaagagaactagtgggctgcaaggacgtctgcattgcctctgatcgggctaaacaggtggttaggctttcctatgcagttcgccggcaaataaccgctaatcgtgcaaagggcttcaaggacactgttgtttcatttaacccaaaagtgcattatgtctaactctgaacaataaatcctgctcactcaatagatgtatttggattcagtgcgggaatggacgtttctctaacttcaacaataagctcactcactcttttatccttcaggcaacatattgcagcattgtggcaattttccgtctgttgaggtcttggttacccaaatttttccttcgaattgaacccttaaggcctatttgctcaagaaaaattcactctcacttcgtttcagtgaagaaaaaaaaagctgagaaagcttgcctcaattggtcttggatgcacaacagatgtgcatatagaagcttaagcaataaacgcatgaccccacccaaattaactccagcaattgggctaggtctgcaaattgtaaataaagccggcctcctcttcttctatctgttgacagggtcgtcaagatgttgcccatccgcttatccaaacttctgcttttgctctccttaaagttgaaattgggtacagctgaagaaaaataccaaaagttggatttaaaaagaattgacaaagactattatgccgtcgatgtcaaagtcggctccgatgagcaggagatcaaagaggtactaatagatacgggttcatctgatttctggatcttggacaaatcgttctgtaattctccaacatcagaggaagaagagaacagtaacgggcgtagcaacaaggaaagctgtggagtctatggctcgttcgactccaacaagtcagagacatttcaggcaactggccaagtatttgacgctgcttacggtgacaccacagccgagtcgacaggatcttcaggagttcgaggaattgatcagctacgggtaggagatattcatatagaagaactctattttggactagtgacaaacactacaagtttaccacccgttttaggaattgcccagctttccgaagagttcagcaacaactcttatcctaactttccataccagatgaaagaggaaggtctgattgatgttgttgcatactctctctccttgggccaaagtaaaggtgaactactgttcggggctatggaccactcaaaatataatggaacactattgaaagcccctatattgcaggcgggcacaccaggaatgcaagttcttttaactggagtggcccttacaaatggttcatcaagcgtcttcaatgagacagacaataaaggttttatctactttgacagtgggactactgcttccactctgccatcagagcactttgatgatcttttcaaccatcacggatgggcgtacgatggtgatacattgacatattcgattcaatgcgatagtgagggagaaaaatctttacttgacttcactttagaatataccattgctggtaatattgtcatcaaagtaccatttgaagacattattatgaagaatgaaaatgatggagaatgcctctcaaccgtaatggtgtcgaaccagacttctttttcatattccgatgacacaccctttttcgttgctggagacgaagttctgttgaacgcttatgttgtttacaacctagaaacacaagagctggccattgctccagcagtggataatccagaagatactgaagaagatattgagattatctccgcagactttgatatttcagaagccagagattatagcgttggattagagttcagaaataccacaattccagctacaactgattacttgccttcctcgatgtcgtcaggttcagtcagcgaagagactggttccaagtctgagagctctacttctgaggactttgctgcagccacgttgaaaccatttacattttggggtttcgtccttttttctttcactttttgatttgagaacatagcagaagctaaggtacttttaaatctacatacctactaatgtaattgagatatattgtagtgtaagcattattctagagaagttttcaaatctattatcatgagcacatactaatacggaattaaatagaagctatcggttgcggccacatctagcagaaagcaccgtttcccgtccgatcaaccgtagttaagctgctaagagcctgaccgagtagtgtagtgggagaccatacgcgaaactcaggtgctgcaatctttttttgtctctcctagctgtaaagtaactcttgcccatacgcttttgactggtgcagtgtagtaatcgaataggggcctgacattcaatggttcacctttcattcgttttgagttttctggtttccagatcatgtcaattgtagttaaacatatattttactgtgaaggctttggaaagcctcaatcaagaagtccccaccacttagttggtcctgcggtttcttctaggtatttcattccacactacgacaatagagagtggcccaatactaattagcaacataccgagagagctcggagtgacttgccagttttagaaagattcatccacgatgttatcttcatccacgttctgaacccttatatgggtcatgtctagagtttatcactcctttatcgtgttgagccaagcgcaccgctataagcttccgtcagttaccgaactgataaccatcaaggaccaatatggtggatcatcacacaacagttattaagcgacacccgcgatgttaatgtgaagcgaggctttcagggtctatgacgtagtacaggggttaaactatgtggtccttagctgacctgcatgcactttgactatcatcgaccttataatgcctttattatccgaaggattgaggacggttagaacagctattacgtcactcaaaagacaagtgataattttcagttaaagaactaattctgataagcctttttgctgcagtatgatgtagtaagtaagtacgttccgctgttatccgctcacacatcctgttagactgaaagagtcacacatttctccttggatctacctgactgtcagtgtctgctcagccttgttgaggacaatatattaatcttatttgaaaccggttgaactttactcatcaatctatctacaatggctcattttaggataaacatgcttcaaaaacgatccgtccgtcgtcaaattgttatcgttggtgctggcagttatgggatcgctctagctaaagaattggcaccgctggtagaatctatggccgatgttgtgctggtttcagactctgaacaagttatctttctaccatcattggttcgattggatgctcttaaaaacgttgctaatctattcgttggtctcgagggtctttttgctaaaaccaaggtaaagctggtcgtggaccatgttgtcaacatcacgaaaaggggagtgcaattggagcatacaggattactccaatatgattatctggttattgccacaggtgccgtttgggacaactctattttacctgcaccaacttacaatggagatacaaatagctttcccggagaagctattcaggaggctagagatattgtaattgcaggtggcggtcctttgggagtggaactcgctggcgagtatgcatcctactttcaggaaaaatctgtaactctagtgcactccagagaaaagttactaaacgatagttaccttgataaagtccgtgacagagctttcctacaacttcataagctgggagtaaaaataatcttgaatagaagggcaacgataaaagatcaatctgtgtttttagatgacttccaactgaagtgtgattacttgatcaattgcacagggccaaaggctaatccaccgccaaattctttcaagaattttgttaatgataagaatgaaattattattggaaccaaatttagaagcttgacaaatccacaagtttttgcaataggagatgttaccaacttccctcggaaaggattagaacatcgtgcagcttgtataaaagttgttgttcacaacttaagacaagttcttaaaggtacatcgagttatcttatcgttaagtggaggcctgattttatgccgtcatctgccatcagcattggaccgtctggaggtgtgggtcaacggcactctctattaagaggcgtcgtcagtatggggaaaagacaatcagcaaaagccaaaaagcatgagcgatatcctcaacaattagaagatatgatttgtggagactattatcgctttgcatttgctggagggtgtgattcagggcgtggaggcactgccaaagatattcgcaatagttggagcgaagtaaaaggtagcgttcggcgcagaagaggagacggaggaggaggagcaggaggaggggggtatgtagggtatggaggagacggagggtgtggaggagacggaggtggtggtggtggagggtgcgggggagatggaggtggataaagcacttgtgagattattcgtcactggaagcttagatcacctcaacagaacttttcacttgatacagttattgaagaacatggaacgtaaagttacgtcgaaggtcgtaacaacctcagaaatataatatgcaccttcgaatgaatattctaatggaacttcttccaagttcaggattgaagttgtattcccctgtgtctgaagtcactttatgaacttttcaattattgattcacaactttgtttgcctacggccctttgcggtcaaccttttgtttttatatctactgtcttgttaggtcccaatttaactagttattttttggctgtcaaaagtttcaggggacgcagtccaatccaaacacgtttgttgcttccggagatattggtttttgattcaatgtgagtatttgctccctggaagttctgacactgcgtatgcggaaagacgcaagcctttaatggcttatcataccatagatcttcatgttgaaatgttgtacaccgatggttttatggcctagttgaagctagaagaacatagttgcataaagaacattcttttttaattggagagcgtcgtcaaccagatcggatggactcgtgtcagtctgaacatggctagagtttcccaagtaactataaaataaaacgatttattgaaaaggcacggctttatctttaaacggtcctccttactgcaaacgcttagactcaggtgctgcaatctcttttcttttaagaatattgttatacatcaaattgagtgatctttagtgaatagtttatgactagatcgagtgtctagaatattgcggatttagctcagttgggagagcgtcagactgaagaaaacttcggtctcaataatctgaaggtcctgtgttcgatccacagaattcgcatttttttgcactcgacggtttctcactattcaaccatccgcaaacattttgtccagtacttgcttcatctacaagttcattcattaatttgcatgatagtctatttaatacgttaataattaatgcagctcaatttttctttccgaacagtttgctaaagttcttgaagttctcattaatgttcagtttatggtcaccgctaaaagttctggcaaggttcttttcaagattctctttagtatttataattgcctgtttatcaatcttcttggctaacgagttgatacccgaatcaataaattgatcgtcaatagaatcggtgttggaatgtccgatgttgttgaaaaaattagagattgttttggctgttggtgaagtggtggaattgggcgagaaagtaacgttgccttccacttgaggcacggtatctaccgtaggtttataaagattctttctgtaacgatcaatatcgaagttatccaaaaatgcaaatgactcttcaagttgttcctgctcagtgtctccatcttcgtaagctaaaagctgctggttgaaaatatcctgatacttcaacctttcgttttgtaacgaggcatggtgactggcagcgtttgaaaatcccctgggtagggaaatggtgccgtttagaattaagatcttaaaaaaattatcaaacttcttgtcccctataaccataaaataactttgaacaaaattatcaaaaggctttgttcttgtcataaccatcttcaaaattcgttccaagttattgacattagtgtccacaaatttcttgaacatcctagagctcactattggttttgtattagtcagttctgtttgtttgggtgacagattgggaatatctaagaaaagggatcgtaatgattgcaaatcgagaagtaactgttcggcaactatttcatgtatgggaataatcttcactatttgagcagtaaagtctgtaatgatcaattcaatcactctgtccgtgaaattacgaatatatctttccttatcaaagtttctaaacaaaactgtgcaattttccatgactgttctttttactgatgtcaggaatcgagattctccagtaacttcggtcaagttcttccaattttcattagtgaactctctccaactcatatcaagatcacggtctagttttagcaacagtagatttagacagctgttgattagaacaagataagattccttaacaggatcaaaccccattctttcagaaattttgggatcttcaatcaacttcgaaagtcgctcttctaattgagaaattgtggaacaacaataatctgccgtgtttaagatgaggcaaatgtgaggcaatacctgcgacgcctcttctgtggtcaaagaacttatcttctttgcaggagggatcaacggctgtaaaacttgatttttatactggtaaagatacttgacaaacatattcgagagattcagtaatggttcaccgtgagaaagctttgaaagttgtactaaaagctgacgatagacacggaaaagctctgttgatgagtccaggacatttattgaactatcatccaacgctgatttgtcatctgacaaaggcccagtttttttgagaagattgtcaggtgtcaagaactgcgaaaatctctcattcaatttgctgtcctggtagtccatccaaaattgcaactgaggttcgaaaacttctgagatcattcgatcaaaaacgggaaccgcttttgtagattcaatgttggaatcgtcataatacttgaacttttgattcaaatgagcttcaaaatctaaagtttcctctaaagaattcatcaataaggtagtatcaagtgaacctgaagtattacttgccctctcgcgagctatcactcgattcagatctgattttgtagcttcacaaaatttttgagccagaactagttctattttccagtccttaggaaacactttgcttgtttgattttcaagttgcattaatagcctcttaaagaaaatgaatcttctccccaaattggaaagagatcccgcttcttctgtggggccaaaaatggaattaacttctttaagctgtagattgacgtaccagttaatcaactttgatcgatacgcgggtcccagcgaatctaatgttttacaagcatagagtaattctgggttagggttgctggataaatcttcgaaatctgaaaatattccatcaacaatctgatttttaattctagaaatggttctgttcaaatcatttatctcatctatacttttgtaactttgaaaatgttgcatcaactccaacacaacgctgagcagctggtaaatcattgaatagtttttggcattattctttaaaagatcggtaaggttgtaaaatgcaccaatcaacatttgcaatcgtttgagaactgtcatagataatgttaggtttctcttgcagttgtccaattttcttatatttccagtcattgattgaattgctttctccgtatcatcggcgagctcccaagttttagtaaatgaagatatgaggtcgactatatccgtttccaaattctctaattttgtttcatcccccatcatttcctgaaaacccttgtactctgtaatgttgagggaaatactgttatctaagaccctcttgtaccctgaagtgtaattgagcaaatcatccaattgacgcagcgaattgggtgtgtccaagagtttccaaagatcgatcttgggatcataatcctcagtctccatccttttagagtgctgaagcttaactggttagggtggggtgttgttggcgaggatagttagaagctggctcagtgaacttcagaacattgcgcgaatctccctttacgagaaaggaattaaagattccttccagcagtccctttgaaaaacgcgcccaacttaacgctcgaacttccatcaaaagttaaaatggcaagaggaaaaaaatactccagacaacagcaccgaacgcacctttcagatacccttccagtaaagcacaagaatgtcgtctctaaaacttccaagtgctccaaactctggactattcaagcaaggctaccaaacgcaatcgaatgcagatggtgctatcaacagaaatatccaggcatgcagagagatcagctctatggtggcaacttcaattggtccatgtggaaagaataaaattattgtcaaccatctacagaagatcattattaccaatgatgccgctacaatgctgagagaacttgacgtggttcatcctgctgttaaagttctcgtcatggcttcagatcagcaagaaagggagatgggtgataactcaaactatgtcctggtgtttgccggtgaattgctgtccttggctgagaaactggttatcttgggattgactcccacagagattatccaaggatacacgttggccaacaaatttgctttgaaagaattggaatctctagtagtagaccaggttgacgatgttacagtcaaatccgaattattgaaaattgtcaaacctatcatctcttctaaacaatttggatccgcagaaatcattagtgagcttgtgactgaggctgttttgaatgtgcttccacgtggcaatcctcaggcgtttaacgttgattccgtaagagtggtcaagataatgggatcatctttggagagctcatttgttttgagaggaatggttttccctcgtcctccagacagtcatgttaaatccgtaaaacagaaatctaaagtggcagtcttcacatgtcctattgatataaccactaccgagacgaagggcaccgtgttgcttcataatgctcaagaaatgctagactttagtaaaggtgaagaacaacaactcgacactcttgtcaaagaaattcatgattccggagtgcgtgtaatcatagctggtgctggtgtcggagagttggccctgcattacttggatagatatgggttattggtgatcaaggttccttctaaatttgatctaagacgcgtgtgcagagtatgtggtgccacgccttctcctcgtttaggagctctcagtccagaagagcttggagaaattgatgttgttgaaactactgaaatcggtagcgatcaagttacagtattcaaacaggacaagaatacctcgtcgtcgttgacttctactatagtcattagaggggccacccagaataatttggatgacatcgaacgtgccatagatgatggcgttagcgctataaagggtgtcttgaaagattctcgtttgttgcccggagctggtgctgttgaggccgaacttgtgcgccgtgtgactgcttatggggagaaaactcctggtttgttgcaattggctatcaagaaatttgctgaagcttttgagtttctgccaagaactattgctgacactgccgggttggacaccaatgaagttattccaaagttatacgctgcccacacgccagctgaagagcagtcttcttctgaaggactttctattggtataaacatagaggctgaaagtctggaagattcgttggtggatatctctaatgagggcatttacgatctattcatttcaaagaagaatgctattgatttggctaccgaagctgtcaatacagtattgagtgtggatcaaattattgttgcaaaacgtgcagggggaccagttatgccccaacagccacgtccaggaaactgggatcaggctgactaacaaattgtcaaacagtaattaggtatattgtatttacaaatatagatacacattgtcaagcccttaaactgactaaaatctttaactgaaaaggtggtgatctgcgaagtttagagagtcccagatttcagtctatcatttgagactctacaactactcgtttctctcccatcgtaactgctactaaaacatacatttcttcattagggtgtggtacagcaaatttcgaatagtagagttgattctgaacaaacctaaaggaaaagtagtacaaacgcaaataagtaggaactagtgttaatgtgagacaccgacggggcagctccatctgaactagtttttgtactcgtttcgaaagttgacgtacccaagggagctgaaccagtttcataggagaacgttgaccaggttgacgagtaccctgaatcttgatccaaagaaaattcaccaactggaacgatgtcctccttatcggtaacctttagttggccaataccgacttcactgttatcattgtcaaaaaacaaatacgcagacttgaaaaatgcattaccaaggataaagaaatcctctctgctatcctgaatctccaaataggtgtagtttgtgcttggaacccatgtatcagacagataatttgataagggagaatgtatcacaatctcgtcaccaaattgaaactctatgatttttttgttaatatccctaatgtttgttctccttatcctatataacccctcaacaggatcatattctagattgtcaatagagtttaccagccgggtcaatacttcgtttggaaaataggtgtatataaactttggattcaacattgccaattgggggttggtctcaacgatcagggctgtatcattgtcagccacggcaatattattcaaggtgatgtaagtgaaattagcatcaatctgagagtgtccacctgaagtcacgtatggtaacagcttcaatgacccgtcaatcttcgcattatcaattgctccgaacaaaatcgctccttcattagaatagttatcttcatctctgaaattctctggattgagatagattgagaaagaagccgagttgataagcccttgatcacgcatggaatctaagactccgctgtaaatgaattcctcaccgttggggttagcattggttgtttgtaggttggaagggccaagacctaagactcctccataacttattgttaagtttgccagcccaaaaaattgctcgctgacctcaaggtcaccaaagtaaattgtatcagtagcccaaaaaccactagcactggttccatcaaagtagctgatattgaaagcagtatcattactctggaaagaagacgagttttctggattgaaggtaatcgaatttggacaagcaccatagttagcttcattaacctcagtttgattggtgtcccttttgcgcaagaattttctagcgctgcgtacaccgactgaggagccaagatctccagcagaataatcttcctcagaagtatccagactacgtttaagataggtttcgtcaaaggatctatcacataaaccggtgttgtaatcgacgacccataaatcagaggttcctaaatcaactgttacttcaactttttcttcttctgatccaaccaatatagacgtagtgtagtaaaagtaagcgtcggcttctagcggatgatagggtccatctcgtttaagaaatcgttcatgcggggaagaagaatcacgatgttttttgagaggtaacttgctgggtttgaaagagaaatttgactcagcaatggagtagccaatgctgagtgcaagtagaattaagctgctagggttcattgagttcggtgactaggaattttggatctgatctctggtatttatgcagggaaagcgcctcgcgcaaaaatcgaaatgtcacttactgcagggttgactcttggtctagttgttgccgtgccagcattccggaattaaactcacaatagtttcagtccaattaggccagacatgaccatttttttctaccaaaaagaacaaaatggctgcattgatcgatgcagggtcattatagtgctgcgaagtctaagccaacaacaacaacaattcctctgaaagtaatggctgtgcaatgcatgttgcgtggctagaggcttatactcaaactaaaaagcgtacgctataggttagtttcgactaattccttcaattggtaacgtcatcgaatgactttagctttcgcagaagtagaactaatttcagccttaatgttgcaagattcaccaaactaatcaagagttgggacgtgcatatggtcaagaaaaatgacctctaggcgcggaaagactataggaattgagtgagcctcatggaactggtgctacgcttgagagaagaggcattgacattaggctggtaaatcatatagtcacaagcactgcacttgttcaaggagactcatacggtgggtttattagaaagttttcttctatttctgctagtaaccgaaaaaacagtagaggttaccccattgttccatccagtttttgcaggaatttaattagattgcactagaaattctcttcttatcaacttaccaccccattcgatcccttgaaaagagaacactatccgttgtaaactgtacatcttctgctgacctttaccacctgtgaattcgatcgaaaccggaaatcttaaaaatgtagtgtcgcgatcaaggaatcgaatcaccatgcacgcttattttcgaaacaactaactatcataatattacgctcaacctaactcccttttagactccaaatggctcctttcttcagaaagcacaaaaagtcaggaagtacttcaaactctcaaaaggagactcctgagaacagcaatcatgctttcaatcaggatgttcagaccccacagcgtcgtgtcacgggcgagagcgagtccagcctcaagactgacctgtcatcaccagctacgccaatcaacccctttctgaaaaaaaatcaaaatcaaaatcagaaccaaaatcatcagaggcccccacaggctccgagttatcaacacggtatcagtaccccccctacacagtattcgaattttgcttctcccaacagttatccttcagtagccactccttcagttaacactccacctactagcgcacaacatggtaatttaccacgatctgcaggaaactacaataatgggtcttatagcgacctttccccgagatactctcaaggccagcagatccacaatccacaaattcagcagcatcagcaacatcagccgatgccccaggacgcccctcagaagattggcaattatcgttatcctcccccagtttctccctctaccagttctccaagtaatgccgctagccgtggcttgcatcatccttctggaaagccacttcctacagtaagctacaatactatgattgcgaagaccctagagcctccaacgccaactccatggacaaaaaaattcctctataactctccgtttccaagatttatgcatacagcatcgtctttcttaactgagaatggcagtttttttgtgatgggtggtttaagagatgccaatgtttacggcgatatctggattttgcaaccaacgaatgcgaaaagctcgtcgaatgaagattctggtccgtcaaattactgctatcttgctaagccgatcgaaaacttcgaaggaatccctgctccaagagttggccacagttctgttctcattggcaatgcttatattgtttttggaggtgatacccttcaaaccaacgagattggcgaactagacaataatctttattttttccatgtaggtgcatacaaatggaccatccccaatccgaccggagagaaaccaaccggaagatatgggcataccatctccatcattacactttcttctgatccagaaaacatccaggaaactaccccgtacttgtacttatttggcggaatgttggataacgatattcacaatgatatgtggtcatttgatctttcaaacttccgtcgtactcaatggagtaaagttataccttccaaagaaagtcccgtgcccccaagactcacgaatcacacgatgtctatcttcgatgagaaaatttacatttacggaggatttgatggggttaagctatctaataagttatggagctttgatccaacagaaaagatttgggagaatatacaattaaagggataccagcctcctgctcttagggaacatgcagctgccactttcaacaatctattattcatctacgggggtaaagataaaaatgataacccatcagatgagttcttctgtataaacttggaaaagtttatctgtttcagaataaagaacgacgtattttctagtccagggaagcgtatggggcattccttaactgttgatctggcacaagaaaagctcataattgttggtggtgaccctgatgatagcgatctaactgatccctatgttcaaaaggactacgtgttagaaggtgcgaacctggcttatgacaaaactgttcttcatgaatttgatctgaacaagttacctaactttattatacaagaggatttggaactagccgcaaaacccagagagcaggagatatccaaggaggacagtccaacacaggagaaggaaattgccgaattttcttcactgaatgaaaatgagtttacatcttccaccccgcttactaccccaaataaacaagacatttcttccccaactcataaggaagaatctccgagtaactcgcctgaaatgttgacctttcctaatcacgaagaaatggagttatctcctaccaagccgttggtcaatcctgcagagcataaattgtcaagtgaaacagaggaatcagtggcaaagagtactactactttgaatgcgtcttccccccgaacagcgaatggagttcagtcagagtcaagttttttgaaacattatgctaacgttaccgataatggtgaaattgacaatgaaaacgaagcagatcccactgaaactgaggtcaagtcagttcctaaatcagaatatgacgaacttgtccagctcgttgatcaactaaggttcactctggactccaaagtgaaagaggcaaacgaccaagttattagtatcgaggccaaaaagaataaagaaattgaagggttaaagatccagcttgctgatgtaaaaagccagatccaaactccaacgataccagtttcttctccatccaatgctattattgcaggatctctattcagtaaatctacaagcacacgtgcgattcaggaggggactgaagctcccgaggatcaaaatgttaccgatgaaaatagtgaagcaaaggagggtgcaattgaggataaaactattgataccgcagagacgactactgttggactcaaaagacaggtgcttacactccaaaataagcttgtacatctagaaaaagaaaaagttgaacgagattctcaacttaccaaatttaagccccttttagataatcaaattgtcgagcttaccagcttgaatagccttattaagacacaggagagtaagatattagagttggaagactatgtgaaggaccaaaccagccttcagaaagagattctagagtggaagaataagtacgaagaaatccaactagaactagaagaatccaagaaactagcctttgctgatatatcgattaatggtgaaaaaagtatcaatggtgaggagggtgacgaaaacaaggaacctgttggaattcacaaatctgtgcatagaatcactcaaggtattgacaacttgattaatgtgtggtctggcctatctacggagacaggacctcttgatgaatccgtagacactgacgaggaggacctcccaacgagacttcaaaaacagattgaccagttattagaacttaatgctactcaagaggaagagaaacatgcatttaaggaagaattggataccttgaaaaatgaattaagtgatgtttctaaagaaaaggaagttctggaaactaaatcggtcacgaatagagacctcgaaacaaattacaagcaatcagtacagagtctgaaaaacacacataaagctctcaatctgtctcagattgagctggagaagcagaaggatttgaataagaagctctcttctgagattgaagaacttcgattgttcaagttaaacaagaggaatacctccagaaatgtaacaccggttattgtgaatgattctgatagtttccaaaatgataccaatgaaagcaaagaacaacgaaatgaggacgcagatgatgacgatgataataacgagttgaacgatcattacgacttaaagataaaagatctcgaagcagatttattcattttgaagcaagaaagagatcaactcaaagacgaagtacaccagttaaaaaagactttgtacacaaagtgatgtggatttttgatatgtacgtgtaatttctacgtaaaaaatatcacagatattttcattcaaatgtttttgttctttcaacccaagagttgaataatcttcaccagatgagaaatagtcattttttcaagaatcttgtggttttcctagagaattaagcgttgtgaaacttgactctttttccatcgggtgaagctctacgtctttataatcagtctgctgtgtttcttgagaatttccccatgattctggaatatttgattgggtatccgtagaatcttcttccacattaagcatcaaatttgacttcacttcattcatgaaagtccataattgtgagctcatagaattctgtgttttattcgattcgttagttgcgtgagagttgggtgcggataactcgtccatgagatttagtttctcaaattcatgttgtatcaatgtatcaaactgttggagatagctcaacggtttggataaccaggaatttggggtatccttttgcttgccatctaccgattttaaaccttcattaggattcgttgtccttaagggatctttgtgcacacctacttccacatctagtttgtggggtctttggctagatgaaggcgatctcgttacgactggaggtggatttgaggatattttttccacactttggacctggtcatgtacttgcttgtataaggatctttcaatttcagttttaagcttgttaacgcggtgttctttttgtctctttttctctagtaatgccttaatttgttccttgatctccaggatctccatttccgttgtggccaaaactctcaatttatccgacaaatgattatcattattcgaactcaaagaaggagaatcaactgaggaattgccactactttctttccttggtgtggatgatgcctttgtaactttggaggagtttggagcagggcttcgacggcgggtctcaaggactgatattcccagattcaagccggatttgcgcggcgaatttgtagatgatgtctgaaattcatccattactgattctgctatcaaataaaagacgcaatcttttggtaagaatagagaaggatgacctactctctacagggttgctggaactagtagtttcgtttctgtaaatcctatgaaattgatgtctatcgcgcgacttacgatgcgcgcgtgtcaaactgtactagtcatctctgcgatcagtatcaattcaagcccatctttgtttccaccctgtaaatattccggtaatagagactgatacccttgcttttcaatggtcagtcagaaaattaccccaaaacctcacttggtccttaaaacaaaacttttggctccaataagaggccttccagtgggaaccaaactctttatcaacgtttgcactaatgatctagttccgttgccaccgcctttaacacctttcaccccagctgaggatgatgtgtttgatttgtcggtgattttaccaaaggttatggatgataagtgggaaatccccatacttacatctccagacctaagaatggataaagacaagtcaggaaacctttcattggtaacagattgcgtaatcaatgacaaacctatgaattggtgtctaataagtaaggacttgatggacattcttattgaatggtgttttgagtccttggaatttcaatatgattcagaggtgttggtggttgatcatatcaagtactcaattcctaaaatgtcttataaaggcaaagaagtacaggaaatggaaattgatcttgaatcaaacgaactacaacgtaaggagtttgagcgaataaagacaaccctaaccaagaacgaaccacttggtattttagaatcgaagagggctcaagatgaagacgatcttgatacggataaacaggaattaacctcattagatagtctattggcccgtccagtagcaaaaccagttggaaatggacctttgattcaagagatcaatgacatgacaatttcacaatctcgccccaaaccaaaacttgaaacttcacagaacgctacaaaatcccctctccagaaatctaaaccaaaactgtcgctcgacataaaagttgtgaagctatctcccgaggatactgaaaccaaatacaagcttctgctacaaatctcatccaatctcactgacaaatcagcttacaaacttgatctaaataaggagaactctaccctgttaatatctacgaccgattcaaagtatgacttttccaagtctcaggttcattttcctctacctatcgatacagagcaaataagggtgattaatgtaaactcggaggcttttctacgtgtctacatcaagtagactctgatctaagaccatatccataagatagtgtagcctattacccctttcggacttaaacgagactaaaatttttgaaaagaaaaaaagaatcttttcttacatatatacagccagacaaataaaatccaaaggattgatgtattatcttgatatagatttgactctttgaaatcttttcacacatagcaattttttattcatacattggcgatgtcggatacggatggtttatctttgactccgacctcaagcagaaaatacggcagcacgaatgatactgaggcaagtatagataatgagattctggtccaacttccagtgactacgttcaaatctgaggctaaaatctactacgaatcggcttttcctttagtaatatcatttttcttacagtatctattggctgccactcctatatttattgtagggcatattggagctgttgagttgggatctgtaagtttagctatcatgactttcaatattacgggtgcaggtttggttcaaggatgcgtcactgctttagacacctttgccgcccaagcttatggagcacaaaaatatcatttagtgggagagttttgtcaaaaagcttggatgttgataaatattctttccattccagtgctcatgacttggtggttcatggaacctatcctcggatttttacaaccagatagacagatagccatgctagccacacagtatttgcgaattttaattttgggattaccagcagttattatatttgaagttgcaaaacgattttcgcaatgccagaaaatattcgacgcttccaccaaagtcttattttttggggcgccattcggtttttttatttcatatctactggttttcaagtttgagcttggatatattggagctcctattgcagtcgttatttcgtattggacaattgccattttactcatattctacgtgatcctcatcgatggaaaacaatgctggggaggattttgtaagaatgctcttttccaagatttctcatccatattaaaattagccattccaggtgtcattatgactgaagctgaatatcttgcattcgaagctatgactctcgcatctgcttattttggaacagtgcagttagccaatcaatctatcttggcagccataggttcattggtgtttcagatccctttcgcagtttccgttgccattggaacgagagtttcgcaactgattggtgctggtgatatcgtaaactcaaagaaatcagcaggacatgcacttagatttgctctcattgttggatctatagactgcttggcagtaattctattttcagatccgctactgaaagtgttcactaatgataaggatgtaatcaacgcttgcaagatgataatacctatacttgcgattgagcagatatatgataccgtcaatattacttttggaagtatattaagagccatgggaaaacaaaaggttggttctatcttctatctttcagggtactacttggtggcattgccgttggttctcgtattagcattcgtccttcatcttgaagttttcggactctggctcggattgtccaccacagttttattcctggcaatttccgaaaccatatacgttttcagaacgaattggactcagataattgaagaagcgaaggagagaacgtctgtggattactaatttttttctccttcctatcagaatacatagcagtagagtaattatcatattttttacgtataaatataatattcacatttatcctatccaactttttatcccttgaaagcctgtgtaaagcatcagagtagcgcccaatgcacagattgccatatcagtgatcatgtttgtcttcgaaagagtacctagttccagatttcccttgatatgcaataaaggaggatatacgtaaatcaaaggaatgcaagtaaaacttccaattagagccacaaatttatccaagtcagaagatccagcataactaattatacttgccccaacaacaatgagtagtcgcagcaaattttttgaccatttgatcctggtgttattctttcccgaaaacacgttctcagagtccgtctgcaccgtgtttctgttagttttgctctcaatagagtcggaatgttttctttttttgaaaacgaaattctcaataatcttaatagccgggaacaattgtaaaggcgttgaaagcataatagcaattgcatataggagctgaacagaaaacactttgttgttctgaggaaagttgagtaaaatcactgtgttgacatcacttccaaaactcatataagcaatagagccaattgagatgaaaaccacggttatgacggccataacacctaccaaagacttgttgaacttctcaggctttgccatagattcattaataggaatcaacaacccaataccctcatatgtaaacaccgcaacaccaataaaaagtggccattcagattcgttgtaaagtcttacatttttgctgattccatttactaccagatgatatgtgctgtaatagtaaaccaggattagtcccgcaagtataaacaaatcggcaatgagagccgtgaaacttagtttgtttatgtcacgagttaatgacaggggaataaagacaatcagttgaaggaatataaatacttcgattgaatagtctcctaaattcaaccatgaatcgcaaagaactctcgcattttcagcaacgaaaacgatgtaagcactggcaaaaccaatctgcgaaagaatgattgatgttaaaatggacgccttcatggttctaccataaaggaaacctccaatatcaccataacttgcaatttgtgttaacttacccacttgaatgagctctatgaaacaaactatggaaatgcaggagaatatgagtaacattccagatgaaaataagagacctccattactgaaacttttgggaagaaacagcacacctgtgcctatgaacgcttttaatagcagcaacactgcttttacggtggtagtttgcttcttcgagcgtatttttgattgtgttttatgcttgtgctgtccacgtttcttcagcttcgggatttgacttttcattaactgctgatgaatagacgaagaaccaacatttgaactgaaagatccataagtaggagtacgaatacttcctattcttgatctcgcatagttggaggtactaggtgctaataggagagactcttcatcatacaacaaattgttgtcagcctcactgaattctccctcactatcactgactgcgactgattcggaaccactgtctaaatcttcatcttcgtcttcctccaaatcttcacctgcaaaatgcccatacaatgccaaaaactctataaagttgttcgtgaagaaattaggtttagtaagttgttttggttggtgagccgttttattcagtccagaaagttgttggtctctatgcttttgtaataaaaaacttcgacgcatccctcccggaactttgatatcatcaatggagatatcatcctcgtcgaatacgctttcacgatcgtggtcagcatctgccttgcctacctcgtcaccatgcacagaagaaaaatcattaaaactatttgctcgtttcaaaggcgggttatctttttgactactttctccagttacccattgataaatgcctctagtgacatctccaccttgaagttgtaaagatgagtcgatctcgctgtcattggcaagatgtttctcgacagttttcagtacatctgggtgccggatatctcttgcgggggaagaaacagaaaaagaagatcgactaccatcttcttctttttgttctgattgttgtccagtttgtaactgctgctctgagtgatcatttctagctgcatgagaagtggaaatcatgtcagaaagaacactttgtctccttgactgtttcgactttggaacgtctattttattcttggttggatcaagcccgtggaaccctccagaaagagttaatggcgaagatcccaacacacttcccacagcaacgcttccagatccagaggatggtaacctttgcaatgatgacgaactgatgacgttcgaagccacagaagagccttcggtgttagggcgacgatttagtatatgcttagcgctgaagtccccttgggagaaaccctcctcactaaagcctttacccccaccgagactattctttggaggctgactcttcttaggagtcaaatcaggctctttcttgggggtagaactcatactagcaaagtttataataaggcgaatagtactataggaaaaaaaaaaagtatacttttaatgcgatgcgcgattgacagaagaggaaatcgatgccatcgaacgcaaggtataattacataatcaagcagcatatgtgaaattctatttatttggtttggattctctctcctgttcagacagggtactctcaacaacatccaacagttctggatcggcaaatactgggaaagccaagttgtccctgtgaacaacatactcaccgtcagcgtaacctagaacctgctcgatctgcgagctttgtagacccttaattttgttgatttgattgctggggtaattacaacgggcacggccaacgacgtaaagttcttcattggggtctagtgaatgtgggtcatctggatctcttagtcctaccttaacatcaacacactcgtattcatggaaattaccctctacggaaataattccagctggaagaataccagctttgttttttctagtgatagccttataacaacctggatcaatgataatggctccgttggcctttagtccatggagtaaccaaaactctttgttattaacagcattaaaactgtggccaacgaaacgtgtatgcaaaggaatgtccagcttgttcaactccctcagttctgaccgattgatctcttgaaattgttccacagtttcctcttcgttgatgaccagatatttagcctcattttcgactctatcagcacggatactgtactctacaatgtccaaaatctgctcgggatgttcacttttgcaaataatcgttgtaacacctgcagatacacccaaatcagctgcgatcaatttagttgtcattcctcctgttcctacggcggaacctccactttcggtattgacgtttagattcctcatatttctaactaacacgattggctcagcgtccggattcgtacgagggttatccgtgtaaagacagtccacatcagtcaccaaaaacaggtagtctgcatgacacataccagctgttatggcggataaggtgtcattgtcaccaaatttgatttcttgaatggatagggtgtcattctcattgacaataggaataatacccattttaataagctgttccaatgtattttcagcgttcttaaactgggtgtaatcgaccaaatccgttctagtcagtaaaatctgcgcaataggctgattcaactgacggaaaaggtcgtcccaaagtcctatcaaacggccttgtcctatagcagccaatgcctgcacttgctgtaacttttttggtttccgcttcatgttgactctcttcatgcccacagcgatggcacctgaggagacgatgacaattcgatggcccttccttcgcagcttaacaagggtctcgacaatacgagacatagttgcgattcttggttccctggtttcttcatctaccacggaactggttcccaatttaacgacgatagtgtaacaattttcacccatgttttgcaataaactttaagggtaaaaagtcttttcatttcagcaaaattttggaacctctagacctatgatgtcatagtcgtaagttgatcggaagtctgctacaatgctaacaatatccacgtgcacaaattgaggttacgtaattttctagacgggcgttccctcctgttcgagaatgccttcctccaaaggggacggcctcccactaagtgcttcgaagacttccttgttattggagttctccaaggtgaatatctgtctacacattggacacaacccctttgaagtgtctgtatccaaccattttaaaatgcaatgcatgtgaaacgagtgatggcaggagccaattgctgggcaaaaagtcagtacatggcccacatgtgagcgcaaaattacaaaacaaaaaagacaatcaaaaaacttaccaattggacattgatctccggggaacttgcatacagggcaggttccatcaaaggcgactcggcatattccgcaaacttcgtcaccaggtacatcccagtgccaggcaaaaatggaatgccagttctgaatggttaccttcattggaggtgggttgttcttctggaggacaagtgtgggtggatcgtagaatgatcgtatcgcggcagaccttacctagaaaaaaaaaaaaaaaaaaataagaatacaggcaagcactgcaagaataatcagatagaaatgggaaggaaaaagttcgacaaaaagtcggcccagactttcaaacttgtttatcgatcccgggaggaccctttatattatgacgaagatgctccagatttggttctgaaaccgttgcctaagggcgatgaagctaaaagaccgaacttaagactgaagaccaagaaggagttagacgaagaattaaaagaccaagtcaggaaaaacgaaggagaggcagctctctacggtattatctatgacgactccagctacgattacatgcaacatttgaagccaatcggggaacaacagggtgtatttatccctaaaaaggaagagccagtgaaaaagaaggctagtgatatcgttatcaaagaaccacaggaatttttggaccctaagctatttcaatctgacagcattaaagaatatgaccacagaactcaacaggatgttcctgatgagattaaaggatttaagccagatatggatcctaggctgcgagaggtattaattgctttggaggacgaagcctatatagatgcagagcaggatgcggaagagggagatatatttgatgacttgttgaaatctggtgcagcagaagaccaagaattcgaaaatcaagatttcgacgagtgggacattgacaattatgctgatgagctggcagaatacgactccgataacaataatgctgaatttgactggcaaaaagatttccagaaattcaaaattgcacaaaagcaaggaaaaattgctaacacctgggattcggatgatgatttcgattccgatgaggaggaaggagacattgtaggtgaacttcctgatttatccaaggaacccaagattgctgccacagcagagagtagtaacaagaagaaacaaaagcaaaggagaaagaagggggccatgaccgacacctccagtttttccatgtcctcctctgcttcatataggtccgagggattggagctgttagatgataaattcgagcttatcaagcgccaatacgaagaagaagacgaagacgaagatgaagagtatcagccgtttgacatgaaggaagaaagacaggatcttgaaggaatgatcgacgatttacttggaaattacgagctgcaaagggggggcagaaggcttgccaaaaagagtgaagaccttgccgctttcaaacgaggtgccgactcggtttctaagggaagagcaggccgttcattcaagaaggagcaatcacaggtagattccctaagcaatggggttagttctttgaagttgagtaaatagtagaatagatcacatccagcatcccgcttgtcatatcttagataagcgagggaagaaaaaaaaactctgaaaaattttatttagtagagaactacatagcatggctagaaagacattggctgaaacattggcagaattgtctcaaccagcgtctggagattttgatatagaagaccaagaaggaggagcagtacttgactatggagataatagttcttttggctccgagagtgaagaggataaaagtaaccactatgttaaagttggcaagtcaaggataagagagaacgcagttaaattgggaggacaatacgagggaaaaaagagtagtagagccgatgtttttggagacgaggacgatgaggaggaggacgatgaggatgttgaacattcggaaactgaagatgcactttcggtttcaggatcagagtccgaatcggatgaaaaaaatagtgatcaaagccaaggtgattctgagagtgaagaagaatctaactcaggtgaagatctagactacaagagatcaaaactacagcaacttataagctccgaaaggaaaaccattgtaaaccaattatcaacttccaataaacaagatgcactgaaagggtttgcagtgttgaatcagcagaaacagtatgatcaattggttgacctcagaataaaattacagaaaggattagtagcatcgaatggtctacccattaacaaagaatattacgaacagaataaagcaccaaagtcttccaaacacctggataagctacaagataaactatacaatttattggatgtcactttagaactgagaggcaagctattaaacaaaagcaagattgtgagccaagagtttccccctattccaagtaagaaacgtagtttacagcattatttggaggaatcttccaagttggataacatagttaatgaatatagaaggaacgtcctcgttaaatggtctcaaaaagtccaaaatgcttccggagcaactgctttgagctcatccaaattcaaggctattaaccaagatagttcgactcaagtggacaactatttggcagacatggatagattaatcaaaagaaccagactcaacagaagaagcgtagtgccattaggatacaccgagacagaagaagtagtagatgatgatgaattgatcgacaacgataaagataacaatgagaccaaatacttcagcaacattgaccgatctttgaaggaaaacaaatatatctatgatgatgacgatttctatagagttcttctgaacgatctagtcgataagaaagtttctgatacacagaagctgacatctacatcaactgttattacattttcgaaatccaaattgcataaaagttatgaaagaaaagcgactaagggtcgtaagctgaggtatacagttcaagatccattattgaattttgaagcctccaacccacatgcctacaagtggaacgactaccaaattgacgagttttttgcgtcattatttgggcaaaaggtcaacatgaacgaggatgagcataacgaagaggtacaaggtgaatcagaaggagaggacattttgaaggatgatatcaaactgtttggataaatgcagtctcaacctttataaaatttaatttatataatactaatcgaaaataatatattgatataggtattatttgagcgaaagatatcggatctttcgttctacagttagttcaacctgtccatcgagtagatccgtagaagatcagtgccatccaatcatggccagaaagcagagacaaggaaggaactctggtcggaataaatcaaagccttccgtatcagcggccacaagcgtggcagcttcggcgtctcctagtgaagaaggggaaggtgaatctccacattgtgcttcaagagacacatcaaagagtaatactccaacgttggaggaagacaacgtcattgatggtggagacaagtcagaagttagcgcaattttgaatcagcctcaacaattggttgagaatgtgtcgctttcttcgaatggacttgagaaagtcgatgattcgagtaagaagacaactgagacgtatgaggcgagcggtgaagcacaccaggagaatcagaaggaggagcaagatatgatagaaggaattcgacaccaagagggattggtaggccctgaacagccccctgaacaatcccctgaacaatcccctggagggcctgatgtgagtgaagtcgtgaaggtctcaccctctcctctcgatattagttcgcagaatcgagtcaatcccttagagaattctgccaatgaagaaggaaagaagagtcagcaagatctagaagaagactctgttgacaaaaaaattgaaacacgggaagaatttctagaagatgacaacaataggcaaatagagcagcctgcaatacctaaaataactgatgagtttacaacggccagggacgttcaagaaatcccattaggaactcctgaatttcaagaagatcagatagatgaaagatatcccgaaaatcatgagcccaacgattcagaacaacaagaactgaaggaacttcaccagaataactcccaagaatatttgaaaccagacgattaccttgccccacagcaatcacaagaatcaagacatgtcaggtcgtcttctggatcgcctcaacttggtaatcaggaaccaagagtgtctcctggccctttcatcctcagctccgtagttaaggatattcccatacagaattctggtattttaggttcaaacgacgccaccatcacttgcatagaagcttgggatcaaaacctgtacataggcacatctgttggggagattcttcacatgttcaagctagatgacgaaacgggctacatactaatatcaagacagagctttcatacatccaaggtaaaacccatcaaaaagatacttcttctcccttcaatcgatagggcgttggtgcattgtggatcgttggtctctatattcatgcttccagaattctcgcctgctagtgttggaaaaatcaaagatgtaacggacgtgtctcttgattacgattcgttgtctatcgatcgagttagagggaacttagtgcattcaagccaaacaaagtccccagattttgtacaagtttcagtgttcacttccaagtttttgagattggtaaacgtttttaaagaaagtatcaagcttcacaaagatataagttatgccaatgccatcactggattaatacgttcgcactttgcactcatttccaatggtattgagtacgatctgttagatgttaataaccttttcaaagtgaaattatttccagtctcatcaggcccaagtccttccaagataaaaccgttgatagcaccggtttcccagaatgagttcctgctatcatgcggaacgaagcaagatgaacctgccatgggaatggtagttgatacagacggaaatattagtcgtggaaccataccttggaacacgtacccatcgtctttgaatgtagattaccccttttctatcggagggttctcaaattacatttatgttcattccttgcataaccaacaagaagttcaatcgatgaagtttagccatagggtgaagattagtcaagtcagtcaccttttctacacaaattttaaagacctaaaggatctggtcacgaagattcccgtaaatccacaatcgacaccagcggaattagaaagaatcactgttgaaaatgatttagcaacaaaatactcgcaagtaccttcgtctaccgttgtttatagcacttatgaaggtgtaaaactattacaacagatacctaggctgatgcagtttatggaaaattttacacttactcaagaatatactgccaatgaattgtcaacgtttattgatgatatccaagatgaaatgaacgtgttgaacaaatcctcaggatctaatacccactttgaaagtattgaatggcaatttttaaatgatctgtgccaattactattcattgaatccggccagtatcaacaactcttagattattcaatatcagcatttgagggagatccaagagttcttgtaaatatatttcaaggaagtgacgatattataggtgaatctatatggatgtttcaagggttaattccaaaaatgaatcaggtatcggataagcatatcaaccaactatcggaaggaacagaggcatactcgttttttgaatcttatcttttgaaatggttttcaaagaagtcttttcgtcacgactatgataaagcttcaatgattgaaactttggagatagccttgatgaaactataccttttgaataacagagtgactagtgagaacttttccaaggtccagaagagtctcattaagaacgtccaaagagtgagtgccaaattggaacaattgctcattgatgggaaccattggacccttttgatcaagtattatcaaagatcaaatgaaaatctggcagcattatccgtttggagaaatctcatcaaaggcgactacaaggatgagatttacaacgaactaaagatgcagttcagcattgaccagtttatcaagtatttcattagtcaaattacggatgagactgttttgtgggattatgggaactggttacttggatactctccttcggccgcactacgattgtttagttctaaagatttgcgtatcagtgttccagagatcaaggtgttgcatttgatcgaccaaatgagctcgaataaagttcagacgaagtttgagtacttggatatacttgtcaatgaaagacatgaacttcaatttcttggagattacttgttagagctgttacctccttttcttctcaagcttcaggatcaaaatggaaggttagatgaactggtaaagatgtaccaggatttgaagacaccaaaattggtgtttaccacatttttgcgtcttcaagcagctaaacctgagtacaaagaaatacttgctacctatcacacattttctaaatatttgtcccaaataactcggaacacagcttcattgtcgaatagaaagactctgaatgtcgtgaatgaatgtttcaagttgttggagccatatgaaaatcaaattccctatttaatcgctatgatagaaagcaagagagatgaccatgaaaaggtgattgatattttactgaatcttacagatttccatacggcggaagagtacgctgtgtcgtttaggttagctggaacgtttccagacactgaagagggacacacgtcacagcttgaagctgtacagaatttggttgttgaatccgataacctctttgaacaagatacggatatatcagcagacgaaaatacgaacgtccacgatctgttattaatgtccatttttgatcgatacctgattctaaatgattctcaattaattgaacatttcttgaacaagtacaacattttcaagaccgaacaattggatggcaattctgatatgctaccagctctcgttcaattggacaatttcaacgggttgttgaataaaattccggacaatcttcgaatccaacagatcaactcattcctcttggggaacttactctcgattgaagactcctacaacgatgttttgatgagaaaaaaccttactaaaggcaaactgagcgccatagaaaacttataccgtgatatacttaactctggagaggaaccagataattctgaagagtctaaaggacgaaacggacatataccagaactttagatagatttacataaactgcatccacacaccattttgagtttaaagtagaacggcccgatctgagatccctggtcaatacacctgaaaaatgaacaatcattccaggtacttactacttggaaggcatagattaggtttgaaatggcttgctcaaaaaagcgtcaatcagaagtttcgattgatatcaagttcgactaaaaagcttaacacagtcgttcaagaaactcccatatttgatgctgataaactagcagctgccagacaggccagattagacggcctgggagtaataggcaaattgcctgaaaaatggataccttatgcggagctgatgaggctggaaaaacccattgggtcttggttgttgtattcaccgtgtacatggtcgattactatggccgcgtattccaccactgctccattatcttccactttgtggatgctgggagtatttggagtgggtgcattgataatgagaggagcaggttgcacaattaatgacttattagatcgagatctagacaacaaagtggaaagaactatagagagaccactggctagcagaagagttacacccaagcaagcgattacattcttgggtgctcaactggctgttggtctgggtgtgttattgcaattaccagcggactgtttcctattgggagctgtttcattggttccagtggcagtttatccacttttcaaaagaattacgtactacccacaagttgtattaagttcgtgtttcacttggggagccttactaggattcccggctatgggtgtttggaactggtcctctatgattccgctgtatctatccagcttcgcctggtgtatgacttacgataccatatatgcccaccaagataagaaattcgacgtcaaggctggaattaagtctacggctttggcttggggtgacaaatccaaaccaatcatgtacggactcactacaattcaaatggcgacatttgcattgagtggatacatgaacagcatggggcccggatttgcacttggagccataattggaggctacagagtatttcaaatggtcagaaaagtagacttggataaccccaaagattgctggtaccatttccgaaacaatatcaataatggccatattttctttgcaggcatttttcttgactacatcttgagacttttgggatacatttagagtagaaaaaaataataacaggaaactttgatattagattgtagttttacacaaccctctactgagaagaaggacctgggttcattcttctcttaccgttagtcagagtgacgttaacgaatcttctggtgtataagagtctcttgtaagctcttccctttggtttctttggcttttcggttttctcaacctttggagtctgcgacttaactttaccagcacgagacaaggatccgtgaactttaccctaaaaatatgttagttcggtgttcactgaaaactacgggtggcgttgcatgtaagttagagacaaccttgattggattgaggtaaggccccgttcgacaggatctaaaggtctgactggtggcaaaccggtcaactgttcaacgagactaccggtaatcttcggttccttcagcttacactactacccatcatttgataaatcacataccattgttaattgttgtactttgtaataaaacttttgctgtgaaaaggatttttctcacttaacagtgggcaagcaagatttgaggtcgtgtgatggataaattttgctctcccctccaaggatagtacgagaaaatgtgttcacgtgatgcaacttgattctacgcggacgtaggtaagtgtcagcactactgtttgtgacggtgaaattgtaactgaagcttttgtcatacatctgcttacgtcatttcatgtcttatctctatatagcttaataaacctacccatactaaatgggcacaactacgagacctatttttgtagcagatacgcaaaagtcacgataaacaatgctgtggtaccaaaaaccaccgtgcccatagagaacctgctcacagggaaactagactccaggagcaactcctgaacaaggaagaaccttgcgaacccaatcaataatgtgacaaacgccaaagctacgaaagaaaggccaatgattttttcaacctccatgggaccggaatccgtcccagagaaatcgctactgttgtcaccatctgtaagtgaaagtagctgagtaatcgctattccaaatgatgccaaacccagagaagttcttagccaagaaaggaacgtcctttcactggccaggtggtccctcgccacagaacctttattttctaacagcagaacgcctttatttgaccacccacgtaacaaacggaccttcatcggagccgtggtaaccagtggtgtgagagaacgaatgctattgtttgacgtttgagcggtcaggggaacagtgtcttgaattgatagagttctgcttgcattcggcctggaagatcccgtcagtcggttgctaacttcagagtcatcatccgtaatcgacctatagccaagacgactttctggtaaactcgaaacggacgcttgcattgaccagaccaggtgttgttggtgggtttcaatctcataaatgtgagcgagaatgatatcagccatagttttcacgtgatttgatgggactctgtcaaacagtcaacatgtcagcacatctggatcttttaacagcattttgatgataagaacaacatagcaagctgaacgtatcgggactgaacagagttgtagaacgacttcaacctatcagagaaaacaaggtcattaacgagttgcgtaggaagacctctgacacccacgtgatcagtcttgctttaaaatttggcctctaccgttttcgttgaaagctaatggcttcatcatccagatcgattatccgtccaagtgatgttcccgataggataatctcaagaagaaataccgtcacgagggatagggtaccacgggctgtttctagacgcaattcggcaccagtttcaagggatggtaaagaaccttcatcgttcctatattatctgcttcgcaagatttcaaggaagaagatagagaataaaggagccgtgtgcagagataatctagccaatgaaaggactgtgttggcatatcttagaacggcgttaactatgatgactgtcggtattacgttttctgtacttttccagaccaaattactattattatacacggagagtgaagatgaggtcaatgatcatgcgaatgccacgatgtcaactttgcaaactaacagagcgtatgcagcactaaataggtttcatacaccacttagctgtacctttataggatggggggtcctcattatgacgtttggaagtttcaggtactattccaatgagttcttgatcaatgcaaaaaatgagtttatggtggacaggttgttgattggagttattgtaggagggatgatttgtttgagcatagccggtctgtgtttagttatttatagctctttgtaataaaattcttagctggcaagggtaattgtctcatatgttctgacaattccaacagtcccctggatagtacccaggcctatgctaccacttgatggagatgctatggatgagtataactgtgaaaactgttgagtgtaagcagactgtgtagttgccaatctcccacttgcatcagtgccagtcacccaaaccagagtagggctttcggagagactggcagtggtagatgacgtagtcgtctcgcctatgacagcagtgatgactatgagtattgcaatgaacagcttgtttaacatcaagtggtgggctgtggcttgtgttgatcaaagttctagaaaacaggctgggtaaaatttgctgttatattcgcagactataattcgtagcatactgctattgtcagcaaccttgttccataaatagtaactcgtcgccgtggctgagtgagtagtccctagaaacaacgaaccgcttctgtagatctatgcacaattactaagatcgcgagattcctctatagtaacggctatgcattaaagataaaaagtgtctgcatggaactatttgaagactgtaatcatgcggaaaatgtacaagccggttggcgctgagtactaagtggctcggcacttggtaaggttggctgatagtaaatgataggtggctgtgtgttagagataaccaaaggtgagcagaaagcctcttaggctgaagaataacaagtggctagaagaaggttgttgcgaaatcacctcggtcgatcgtgtgacaaccagctttcggagtagttcagagcgaaaaattccaactactatctcggtacctttcttccatctggcaaccgaaacgtcgtgtaccgaaaaaaggtccctgccgatgggtcgtgtaatgtgcaaacaaaaatcgctcgaaggtcatctcatcacctgatccgccaacaaaagtttcacaaatgcctacaacatggagaatgttgttattgctgttccatgacaggctaagtaaccacatcttctatatataaatagaaatagtgattacctgacttcacctactagatattacaattgtaaacgaacaaacgaaaatgggacagctttttcgcaaaattattcagtggattcccctcttgttttttgcgggatccgtgctactgcaattcttcgtgatcctaagtggagcacgaacaactggagttctaaaggacttctattggctagaggtggagggtaccggtgccattgacccccagtttggaaccacccgctggacgaactacagaatgtgcaactgggagaatgacgagttgagtaactgtgaaggtcctcagccagcttatcctttctccccagataacaattttagcgatggtgaaaacagagcgctcattccgagcgactttatcaatcaccgagacacctattactaccttagtagggtcggttggtcaatgcttcttgtgggtctggtctttaccgtgttttccttcttcagtactctactcagaatttttctcaagtggaaactggtttcgggacttaattggctcaattcggtgtttgccgtgtttttcgtcgctttgggcgcaagtttaatgacagctgcatacgtcaaaggtcgcaattcgtttaatgacgcttcagagttcgatgccagtttgggagtgaaaatgtttgcgttcctatggacttcattagctttgctgctcctgagcttgccgatattctgtttcaagaagcctctttcgtccttccacggtggtaccggaaccgccagccacgacgatagtatcgaatacaaggaggattacatccctccagctacaggtgacgcctacaacccggaaccagccggcgactacccccctactcagaagcgtaagttgaatttcttcaagatcaaccgaaaaacgaccattgaggattaggaggggaatcgaggcaagcgggggaggccggcaggttggtttttattctcctttgaagggcaggggggaaacgcgacacgaacccctccttccaccaaggaaaaaaaatcttgatatgataccagccatcaatggcgtactcataagtttcatctattcaactccacaattcgttcttttgtcttctccatgtttccccaaacttttttatgtggagaaacaggcagccattaacggctggtaaatgggtccgtaatcaaagccctctctaattaataggtttaatctttttttcttttcactgataaccgtagataggtcgtgctcgcctaatttgctatcatgcagcacgggctattgtctatctgacataatcgactgatctgaagtccggagtgaagaagaggattcttgacttttacatttcgggggtaggccaggctgaaagggatcacggaacccctttggcctgctaacccgaaccaaccgacgacccaaagcaagcgaaaaggacgaattggggaacgacttatgcacatagtgttaattttgagcccaagccttgtactccccatcgcctatggctcattctccacattcctccatgctctccaagcttaattgatcaaatatgcccctgttttattgcgtctacataattagctaattatgcccctggtgggactgcctctttgggttccccaaaaaaaaaacttacatatctttttcagcataggtttgagtagcaaaaataaacgcgatcgctccggataccacaggtttgcaacatgtccaatttcagtacttttttttgtcgcaaatgtcgcttcactttacgaataactccataccataagatgttttttttcggcatctccggaatggtcttattgttcgcaccaagataaggggcttataccagtttataaccgtggctcggtactagagaaaacttttgcactcatacagtcgccgatcttacacccccagtaaaacccaccatctcaaaccggatgaaaagttcacaccccgattattgcaactttttgaaacgcaagtcgctctcacccctcatattttctccagtatctcctcttatttataatttggggagatttcctggcgtgtgtcaaacagatttttgacaaagaacacccacgcattcaggaatttactccggtgtccctccgccataccagatggattgtttcccttatatgcactatatgcaacatcgtaccacaacccgccctacaacctcttgattcaggattttgctaatgaaaggtttttcttttgttgagctttttatataagaccgcacgcacaccttttctgtggatttgtagtctctctgttttctctcccattttttaacgtcagtgtggtccgaggtctggtgcctacaagttatatttaaaagtcccccctctccgtcccattttcccggtttgttggtgcgataagatataagaactaatccacattaaatcccttttttttgtggttgccttttcccgttcagttttaaattggaatcactctctccttcattctctggttgctttcatcgataggactttttaacctctgtttctgttttagtatcacatttgttttcacaaattattttcatcagagtgtcgttatggcttatttgggtccaaaagtgtacaaaacaactcccctaacttcaaataacctggcatttttaaacagctcgtcttcgtccaatagttccaactcttcgaacgacgatacgcttagttcaactcctgacagtgttttatcattaaattctgactcggtctcaacatactcaagcacgagttcagaaattaatcaaaggtctcattatggctgggaacaaatggatatcaaagtatcttcaacttcgactttaagccggaatgactcaacgtcttcgctttccacgattgtggatgcacaaaatgaaattacttcaaataacaacgatctcatagtatcccccgttgccagccccagacccaaagctggtgggctcttaaaaccatctttaaagttacccattttgaaaaggtgttcctctgtaccaaattacaacgaggagaccacaaaggttggtgcaaagtcggtccgtttttctgaggatttagaaaggataaagatcttcaacaaatcatccacaccaatggctctttctacagataactcccctatctcatcgcctctcagaagggagaagatggtgtgggatgaattctcgcttgaatacgatgatgatgatgatcaatctggcgtcagcgatgccgagagcgaatcagattccgtatccagcgtgtacgattataacatatggagactcatatcttcagctctccctctatctggtccaagtataaactttcagagatttgtcaacttgccgccagttgtcattgaatcgatcaagctgtcttctaacaaaacttccataatagggtttatttacgttaaaaacgtctctttcgaaaagagaatttccatcatagctactacggacaattggaaaaatactttcaactttaatagttgttgtaactatatttcttccaaccacattttcaactacgaaaaatcccatagcccaagtgacatgtatgacaagttctcgttcatcattaagatcgatgatcttgtccctcacgaatctttaggaaacaatttaaccatccaactctgtgccaaatacgagactgctggccaagtcttttgggacagtgatttcggtagaaattacagaatctcacttaccaagatcaccaaacaccaggttaattcagctccatatgacacttcatttttagatgtgctggactacaagctaggttctaatgcctcaaacagtcagtttaagaatcgttatcaatttagcttggactccaactattcagtcgatgaaagttacttttcagcacgtcctcttttccgcccatcgtcttcttcatcttcatcatctgcttcttccaagaagtcgatccagagaactccattgggtgtcccaaagaggtcgttcaacacccctcaaggaagtgatcctaaattttttgacaaatccaatgactccaaatacaacgatttggttaggaagtactgtttttaccaaactgcttctccaagttctcccagcacctcagaacctcttgctggttaaaaaaatctgattttcatttcatgtatattattatctttcatttggcacaaccttatcatcatattttagtttctgtatgcactattcctttcatacgaaaaccaattaagttgggggctaatacgctgttgaagaaagaatagtcattcttaacattcatagctactctctatgggctgctatatatatattattgatcgtcaaaaatacatgatcctaattagctttaatctttggaagaatcttccttcaatgtaacaatacggttcagaattatctcctggtctccgttagtgtctttatcgacacagaagtaacccacccgtagagcctgatatctaatagactctggggtgttgggttgttccttgatgttgaattcttcgtttacagtagggagattaaggggggatctgctcttaatgtcaaagaatgctggttcgatgatagcagttgtgataacttcctcagaatccttattaatatcactagtaaacccatctggatgagatgaagggttctctgagttgaacagaacgttgtgaatacgcgtttctttgatgtgaacgggggagttctgtttcgtagactttggaatccattgtatatacgtctttggtttctttggtttaccttccactttgtcgtagtttacgtgaattgttgttacctttccatggtcgtctctctcaacagagctgacacttacagtgaatggaaccttcatcaaaccaactggttggccaggagccaatctaaagtagtctttggaggtttcatccctgtagtcagatctatcaatgtagaactctttggtgaaggttaaagatctgtcacccagcttggcgtcaccaggcttgtaaggtatggtaattttttcttcgaatgtgtcatcaacgttgtcgataacgcaaagaacaggatccaaaatcatcattagtctgggagtagttacgtccaagtaggatctcacagcgctttcaaaacgtgtagcttgaatgtttgttgtcgaggttgtaacacccaaagtgttaatgaatgacaaaattgctcccggtggaacacctcttcttttgattccttccaaagtaaacaatctcggatcatcccagcctctaacaataccttcattaacaagcttggcaatctttcttttggaaagaatcgtaccagtaatgttcagtcttccatactctctctgggcaggtctataaacatgaagaacatcgcatagccattcataactttcacgagaaagttggaactcagttgtgcacaaggagtgtgaaatgttttcaaaactatctaccaagcagtgcgtgaagtcataagtgggataaatcttccacttgtcaccagttctatgatgaggagcgttgagcactctgtaagcaacaagatcccacatttgaggagaaggagattccaaatcttgcttcattctaagagttgcctcaccgctttggtatttaccatctcgcatgtttctaaactcctgcagactttcttcaaccggtctttcacgatgaggacaggcaaatcttttaccaccaggggtaccatcctccttcattcctctttgtaacttgacttcttgggcagtacagtgacaaacatagccctttccaacttggatcagtttctcaccaagttcgtacaactgatcaaaataatcagaggagtaggttatcttccatggtttaaaaccgagccactctaccatagtcttgatggaaacaaaatacttttcctcttctgcctctgggttggtgtcatcataacgaagataacagactccgtcgtggtacttggcatatccaaagttgaccatgatagccttagaatgtccaatatgcaaatatccgtttggttctggcgggaatctggtgaaaactctacctccagtaactttcaaatgctctttcatcaattccggccacatttgtgggttctcaccaggcttatgcaaatcacctagaaagccttcagaaaacatggatctttgtttaacgtcaccagtaacagctgattgcttagttgcagtttcaggttgcttagccttcttctttttctcctttttcaccacatctctttcatccttgggacccagtaacttcaggacttgttcatctataattggtttgaacaaggcaggagaagcccatttcaattgaggtaaagccttgatgttccctaacaatgcagggacacaggagtatctcttggtttcaatttcttgcttgtggtcattgatgtactttgcaacctcctcatccacttgctccctggttatcacaataccaacaccagaacgaacgttcataccttcttcggtacttgactctttggcctctttgacatacttgtaagcctctgacacctgcaaatttgtagtcaatctctcatcagcaatggccctggtaataagttctcgtttgggcaaattctcgcctttgaccagggtggccaaattgtgcaacaaggccgtcttactcttgcttagtggctcatcagcttcaacctcttcgatgatctgagccaaagagagcgaaacctttttgttcttcaagatttccttggattttgcttcatcaaacccaactttgccaaacaacgtggctaattcttcatcagtggtagacattcttgctcagtcaatgcagttggtgggattagttaaggtagtacggtttatacttggctgtcttatcaaatatctaactggactcgcgaatgctaaaaaaaaaaaagttgggtcgtgcactgatagagcagagaatgcaagatacagtgatggtatactactatcagtatgagggggattcaaacacttcaactcactaacttcttagttaataggaggtgagaaaaacgagctacagtacttccaaatagttgtctggcagagtaggtcgcaaaataaagttcttgctacgaaaggttctgtcttcccttaatggagcacttattggattgattaagatagcagcactaaatgttcataataagcatatagtataatattagctactctcaactaatcaatggtcccttggcccagttggtcaaggcatcgtgctaataacgcggggatcagcagttcgatcctgctagggaccactttttttatttccactacatctctaagtactggaaagccaattaattgtatcttgccagaacgactcaaagtcctcttcattaatgggagtatccagttgaatgcaattactagagtcaaccgattctccatgcaattttttcatacgattgatcattatatcatcgcttagccctgcagggggaactggtatcttgtaaggctcagcttggttctgtctggaaagaagaacggtctgtaatgacttgatagcatcatttgcgatgagtcggctgctttcaatatacggacccgaaacaccttccaaaaaagcgcatgttttgtgaagagtatcccaaactttagaaacctgctccggtgagatgtagttgtagttgctcacaatgtagaacaatagaacagtacaagcactttcaacatacgtagcaatgaaaaatataggaagacgcatgtgttttttgtacctattcgattcaatcaagaactcggcgaattgcaaagctattgcaaagcatttctcagaaccttcatcgagttgaatacgaagatctttaggaatacagttcgttcgaagcttcagatatgctgaaaatactaagattggccggtaactcaacattttcaaatacaggtagtatgcacgtatccaaaaccactctctccattcttggtctgataaattctgagcaagactgttgtcagaaaagcacaatctgttctcgttggattcaggatatatttcatccagcttttgagatatgctttcgactagtttgaacactgttggaaactcatcactggtgttgtagagactggcctgtatcttagtacagaagtgagtaaaatacactcttagcttcatgtgagggagattaatgggaaacaatttgctgcttgtgtatccagcactcgtgtacacttccggtatcgggtggggaatgggaatgtcatctttaatacaacttggtcttcccatacagaaactccagtatttctcccaaacccaggtagcgacccaaattctatgcctttcatacatttcctgcttcttccccttcccctggaactgattgtctagacttagagcattcttgtgaagtcctaatataaatgccgatcttacagcagatccagagtaaagatacgaaatgcttgtatctccaaaattggcagagctaagactgaacaaatatagcactttaacggcctcgtaggagatatctaactggatattgggaacctctcttcttgccatttcaaatagaattctggcaagaggaatatgaggggcaagcgaattgctatcaaagcaggaaactactcctccaattgacatgagcagatagataacggctttgtcatacttgttcacgatacttgatttcttatcgcctttcaaataaagccagacatctttgaactttccaaacattaactctggatcaaaaattggataaggtatatgccatgtttcaaagtaaaattccaacagagaataggcttggtgatagctgagttttgccagttcactttcaatgtctacgtgttcaaagtttctcagcgtaacgagctgcataccaaaccggtcgattccattattaccatcctgtagtcctgctgcttgcaggtattgattcaaatgggtgacaaaggagaagttactggcaggaccaaagtatttattctggaagaactcagctgagttggcgcttaacaggccgggtaattgaagattcagcacaccattctcttcctcaggcttcttcaacttcacttctgggtctatttttctcctcttttttctctccttggatggacgactgaactctctataccgacatatatcgttccatcttttacatgagtcacatacatttccaccggtgcacttaaccttgcgccgccgacagccttcacacgcctttgagattctgatggcctctttggacattcaatagaaacgacgagcaatgggcctgtttgtgtaaaccgtggattaatggttactatatagatttttcatgaagagaatacttttccaaattacattgttatcgctatctaatctaatcacgaaatgggcgttgataaggacttacttaatcaaggatttgaagacaaactttcgctcagaacttccgccataaaaagtgccttttcatcttcccatcgcctgcctacaacttgaacggatacaggcatgttatcaaatttttcagcatcgtagtattcctggactgtattgtcaatctcatccactggaacatatgattcatcctttaagtctatagacttatcgctcctcaacacaggaaccactacggatggaaagtccagaacgttaaagggcacggtgtaattaaatggtgttttgtaggagttatcgttctcataagaggctgaacaccaaactggagcgattataccgtcgactggtcttcctgttccagtgctattgaccgtattattccagtattcgctgtaggtctgttggagggcatatttgcgctcagatatatcccaccaagcattgacctctattggttgtttgcttccgctatcaacacagagatttctgagcgcttcgaataagggctctcccgtttttgcacaattctcttcaatctctttgtagcgatctgcagaaagaacttcaagtccgatatcgactaagctcttccgacatggtggatcccactcaactacttggtgtccagcttttttcagggcagctacgcattcatcgacagctctgagaacaggaggatggggcatgaccaacttatcccatttccaaactccaaagcatagctttttgttggaatattggtcagtgatttgatcatatctccagggaattggcatactttttggatcccacaaccaaggtttagaatctaacactacctgtgtgaaaagtttgagccccttcaagctgacagacatggggccaataactgacggcatcacttcctgtcccagatatgaattgaacaccttcatatatggaattcttccatgagaaggtctcagaccataaattccgtttaaggctgagggaattctaatacttccaccaatatctgttccaatacctaatacagaaccttgacagccgatcagtgatccttcaccaccggaagaccctccagaagataagtttctattgtttgaattggtggtgtatccattaatgttggagtaggtttcaacacacatcattgcagtggggacagcagttttgacgtagaaaactgcaccttcattgtataaaattttagccaacaaggagacgtcgtcggcacgtttaggtttccctaccaaagcagcgtaaccaattgaagagtcaaaaccctcaagattcacttgatcttttaaagagatgggaactccatggagacgaccaacaggcttaccagtagccttcaaaatttcgtctagttcctttgccctctcgagagctttatcaaagaagatttcaatacaacaattgaccaattgatgggccaaggcggccctatgacaaaatgcaaaacaaacttcatatgatgacagctcaccattggcaattttgtccctcaattcgatggtatctaagctagtaatagattgttcggcttcaggtaaaactttatccagatagagcttagcgttgggttccttctcggaagaagggatatttttcaaaatccaatcttctggtatagcagagatgatatcgttcctcttttgctcactaattgattcccagttggcagtagttgtctcaatacatgttggcattgtcttttttttagtttttctttgagatctctaccgaatggaagcctgtccatgttttataatgatattgcttacatcaatcgaagagactccattggtaatctgtttgtctttactatcttatcttatccactcatctatccgctacatatccggtacttttccgatagccggtgcatatccgatattattccaatatcaataagggatgatctgaatcatctaaaagattatctggtgattggaaccattaggtggttgtcagagacgttattttgataattcgatcagcaaaacctgttcttccaaggctttattcacattcatttagtacctcgtcgaccaagtttcacataaattgaatcaccttccctttcgagaaaagccctctccacgcaatgttgaaaacgtaaaaaagttgtcataattggtaattgccggcgaccataacgataaatctcgactcaacagataagcatttttcatccgatcggataaaaaccgtcatgcacaatcaacgatatcgcagtgccttggggtctgataaatggattggcaagtttgggttcaccttatttttccacctgacatcggcaaacgtcgaaaagcagtttatcagttagttatcagttaaagattaccggaagaagatcaccaccacctttgaagatataaaagacgcccaaattcttgttctgaaaatctaaatcgaagaactacatcacatacataatgactgaattcatactgactcaaggttttggttacgggatagccctaggtttgggtgctgcttttgccctgttaatgatggcaactacttacactgctaagaaatttctgggacagaaacaagactcagaaaggtttaccactgcttcgagatctgtaaagcagggtttgattagtagttgtgttgtcagtagttggacttggcctggtactctgctgacttcctctcagtgggcataccagtatggtgtggtcggctcatactggtatgcagctatgggatcttttcaagtcttactgttcactttggtggctattgagataaagaagaggtgccctggtattcatacaattgctgaagttgccagagttagatttggtagaggtggccacttggtctatctatcctactgtctgggtactaatgtgatcgtgagctgcatgctcttgctgggaggctctcaaggattctccttttccaccggcatgcatatcgttgcggcatgcttcctattacctatgggagtgtgtgtctatacgttgtttggtggtttgcaagcaacattcctgtctgattggactcacaccgtgatcatttatgtcattatcctagtctgtttgactacagtctacggtacttctgatttgattggatcaccaggaaagatgtacgatcttttgaccgaaattgctaaagagagcccatcatctgctgcaaatggatcatacctgacatttgataatagggctatgattttcactgcttggaacttgttgatgggaggtgccagtacagtttttggagatccttcatactcccaaaaagctattgcggcttctgcgaaagatgtcatgtttggctacattaccgggggactctgctggcaaataattccttggggattgggaacttgtactggtttggctgccctggctctcactaacaacccagcttcatacacttatcctaatgcgttaactgtagaggaggccgaaaagggactgccgttggtctatggaatggctgctatctttgggaaaagcggagctgcagctgctgtcgttatgatttttatgtctgtcacatcagccatgtctgcagaacttatttcttgttcttccattttaacctatgacttttaccgatcctatgtcaatccaaaagcttccggaaagcaattggtgactgcatcccacatatttgttattgctttctctatttttatgggaggtttagctgtggtattcaactacataggagttacgatcggatggattttgaactttattggtattgctttaggtcctgtccttggagctttacttggaatgcttttctacccaaagatgacaaaacatgccatgtggttcggtccaaccatggcgacgctcacaggtgttgcttgttggttgggatcttgccatcatttctacggcgagctaaacaaagataatttggctggaaactatccttccgccattggtaactttgtgtctgtctttacctcaccattgtatattttcctgatttctttgataaagccgcaatctttcgatttatctacgttgaatgatcagtttgaggcaggtgacgatgctgaggagactgagctagagaggatgaaagtgcaagagactgacctcgatcaattgaacaaatcattgatccagaccagaatctttttgattattcatgcttcgatttttgtctttatcttacctctgtcgctgtacggttcaggctacattttctctaaacgatttttcaccgcttgggttgttatcaccatcatttgggaatatttagctgccatgtggatcattatctggccattatatgagagtcgtgttacgctacggtacgttattatgaaactcctaggaaaagaaggccatctttactacggggcaggagaagttaaagaaatcagtacaagcgaccaatcgtttgcaacgccctcagtggctgaagcaaagaacgagcaccacgtaaacgtgatcactgacagtgaccatgatatgtagtttttagtagtgatatattgtttaggtaatcaggtttttttcagtgtattattccgttaggactacatgctactattctccagatcgtgctcgaaatctcgtcagaccgttcctccaaaaatccaaatcgtgcctcttgaaatttcaacctctacaaatactacaaaaatggacaccaaaactccagtaacattagccaaggttatcaaggtacttggaagaacaggatctcgtggtggtgtcacccaggtcagagttgaattcttggacgactcttccagaactattgtcagaaacgttaagggtccagtcagagaaaacgatattttgtgtctcatggagtctgagagagaagctagaagattgcgttaataatgattatgcagaagggtctgctgattggctagtattgcttgtttagctccaatataccaaatgtcttcatagaaatgaaagctgagcggtcacaaaagatttccgtttccgggtgtagatcgcgcgtcaaccagattgtgtgtcacgtgaatatcttaagtctagcgtctgtagaaacagaggatatgggttaactttataactaattaagagagatgaagacggacactgttgcagtagctagtgatgggtgatcttgcaccaaaagtagtccagtatttccttcttgtggtcttgattttggatgaattatcctgtttctagtcaactgaaactccctcttacacaaaacttcctttttctgagcctcaaatcacctggctatccgaatattcaaaccatctccccagatactcaaagatgcgtttgaagatccgtcgaactatccatgacactatctctcctctgagtccagagccttatctaggcatctctttcgcgcgtagacttgtcgcaacctccactgttatacattggtacgtcatatggctgcagaatttgtccccttagcagtagctagagagggaagggaatcccaactgtactcaaagacaagtggagctagattgatagcaggatgtgtaccattaaatgaagccaaagacaaagttatcatgatctcttcctccaagcataaagataggtggatcttgccgaagggaggcattgaaaaagatgaagaagacgactacagaaatacagctctcagagaaacttgggaagaagctggaattttcggagaaatcaccaagaagttgaaggttgtcttcgatcatcgtttccaaaaaggaagcggtgacttgaaggaaaaggatctcgatattgatggtgaacgtattccaagatcagagtttcacctgtatgaaatgattgtaagagaactctcccaagaatggccagagtctgccaaacgtgaaaggaaatggtgcacatactctgaggcaaaacatgaattgaccaaatccaagagatgggagttgctagatgctttgaatgactctagtattgaaaaagatgtacaaagtgtgttcatcgatcaaaagggaaaccataaggatgctgcaattcattcagatcactattgaaacgttgttattttgtttatttaggtcctcctcccaacagcccagacatcatatcttgaaggaagtttccgttgttggcaacaactgcgacattgaacactgcttggcccagttcattgatcttggcagttatgtctgcttggcttatgtcttctttgtatctgccgaacaacagtttgaagttttgagcatttgaaggatgatttctttggattagtgcaatcagtagttgtaagtagttaatgatcctcttgctggcggtcaaatttgaatcgtcggatgatgaaacgtcgtagagaaaaaaagtatctccttcaaaggtaacagtttggaaattcttgtaatcgtctttcaaggaagaaactctcttcgtgaagaattcttcgacggtatgtttgactagtttaatgttgtttattttcaagtaaggaataataagtctttccaaatattcgtgcaagttatgcgagttgttttcttgatccagatattcttgcaaacacaaatcaacaaggagttcgtttgccttgtcagagtcggttaagagtagatatttctctgaatttgaaaccgaatcaggattgccactatagtatagtttttcaccgataatcaagttaagcttggagtctcccagagtacttccagttttcttgtttgcaaatgaggtcaacttttcacccagcgttggtatgtttgaatcattatcaggataggacgctaagatttgaataattcttgggagttggatttctttatagcttgaaatatcgtcttcttgtaataggtagacgtctaacaggtagttcaaaaggtcggttccttcatcaaaccgtccgttctcagaaaagatcaaagagctatggtacaacaactcggaggcggcatcgtgatctttggccctgatgtatcgattcacaatggtacgaattgtctgctgggcctcataataggagccagcatcgattcttgccttgaatctgttaattgtcttttccaatttagcggaaggagatgacattggtttgctgttacgatgaggtgtctaggggtagagaggagttagagcgtgggaacctcgatattagataagcaattcacaggtccaagtagctttttaattgaaggtgcttttttgataaggatagctccaggtgagcactcgttggctttaaactcactttctttgtattttgataataacgactttggcctccttccattccctccatttgggcaattcacagtgttacataaactatttcttctgtgatgacctaatcacacccctttcgagaatcatcgatggagatcatttatcacctgtcatcatctctgatctagggagcttcgttatcttcaaaaaagcagtctcacaaagaggattagccattgaatatcaaacttcatccaactccaaaacacaatccaatattgattaaccgccaactcaaaaatcatcccgcatagtattcagcaaacccaagcgacccccacagaatgaccgacctagaagtatcagctatccaagtgattgacgagaacaaggtgttcaattctcttttagtagattacatgaaacaattctactcacagaataattcatccgacgacaaaggactaaattatcatattgtctccgtttttggatcccaatctactggtaaatcaactcttctaaaccatttatttcacacaaagtttgacgttatggatgagtcccaaagacaacaaacaaccaaaggtatatggcttgcccacgcaaaccacatctccagctctaacgagagcggcgactttgctaacaataccaagaacgtatttgtcatggacgtggaaggaactgatggtagagaacgaggagaagaccaagatttcgaaagaaaagctgctctatttgctttgtcaacttcagaaattctaattattaatatctgggagcaccaagtcggattgtatcaaggcgccaacttggggttgctcagaactgtctttgaagttaatttgtcattgtttgccaaaaataagcaacgttgccttcttttgtttgtcattcgtgaccatgttgggaacacatcattggaaagcctttccgacgtgttgactctggatctgcaaaatatttggagccaattgaacaaacctcaagggactgaggggtttgaactggatgatttctttgacttgaagtttgttgcccttgctcataagttattgcaacccgataaatttatcgaggacatctcagttcttggtgacaaattcataagtgaagaccaattattcaatgagggatatcatcgtgctatccctattgatggctggtcaatgtatgctgaacaagtttgggaacaaattgaaaccaatcaagacttggatttgcctactcagcagattttggtggcgagattcagatgtgatgagatttcttctcaagtttacgagtcctttcacgaacaatttgtgaaatcaaactgggacgacttgtcatttactgaaattggcaattcattgaaagaattacgtcagaatgctgtccaacaatacgacatattggctggtagatattcagagtcagtatatttacaaagaaaaaaacttttagttcaaaaagttgacctttcaatcttggaagtctacacatctgttcttcaaaagctcatcaggcagagtagagatctatacttaaaacaaattgagtcatctttaaccaaaaaggaagccggcattattttttaccaggtgttggacaatgctgaacgagaaagtttaaagtattttaacgagaacacatcactgatttcatttgtcgatgtcgatgactcagaagctagaagttatgatccttcccctaagctaagagaattagaggaagagctctccaacttgagaacagaattggttaataaagaacaggagaatattaaaaccaaaattcctaggaagttcaaatctcatttcaaattaattgttcaagatgaactttcaaatatcaagccatcatcatgggaggaacttttggatcaattcagacaggtttctgagaaactattggccaagtacaaaagccctgactctaattatgatttccatttgggtttgagtaaggagaagaataaagaactgcacgagcaagtccttatcaagttttggatcaagtttaaagaaatattgaacgattttgtcactgaaacaaatgttctaagacttttagtttccaagtttgaagacgaatttcgatacgatgaggaaggattgcctgtagtctggaagaattccgctgagattgatgtcaagtttgctaaagcaagaaactctgctttagacttattgcctttattttctttagctcacacagccgaaggggaaattctgccagattatgatattgcccatgatgaggccgaagccgagtctgacaacgaagaagacgatgggttcaaagagtcacataagtttgctcacctgttaagtgctagggatcaagatgcaattcgaaacaagttcaagaaacaaacggatgcactttatgtcgaaaccaagagatcggtgatcaacagtaaaactgaagttccgctttatatctatgccttgttactagtcttgggatggaatgagttcatgattattttacgaaacccattgctgatcacgttgttattaattggacttacaggtctctaccttggctacaaaacgaaacttttgggacccattgtccaggtggtacaggccatgatacaagagttgcaagatcaggctaaaaacaagctaagggatgttttagtgtctgagcctgaagcgccatctcaagtaaggattggaaaggaagtagacgctacaaaggatgaggattaagtcgaaaagatttttaagcgttaaccaatctgaaaccataattatcaatacttcaatgcttattcattcaaactcatatatattatatatatgttcataaatcttcctgagattcatgaagtcggagggctctgagtctcaacaaaacttttctgtggcatgaaaaagtgagtggtaatataactggtgctgaaatagtaaatgattaataactcaatggtagaataaaattcaccgcaaaattaaatttatgttagtcaaagagcacaaagtgcttccccagtgcttctggattgtcacaacaacgaattagcaagaaaaagtaaagatcaagccctccataaatggcctgccagaatagaagtaagtatgcgaatgtgaaatggtgaccttgaaaatgaaagatctttagctaaagctgatccttctgtcctgtctccgacccagaaagtcactccctaccagctagtgaaaaccttcattgcctagagtgcctatatttctaggtctttattgggtataaagtccgtagaatatatgctttgatcccatctttcagtaaaacatcgtacttttgttttcttttgatcatgatttcgtaaggtacgtaatcctctgtaagttctgtgcattccaagttcgatttagaattaatctcttgtaattgagactcgttatgtgattgtctttgaactagtagacggtaaattttccactgacgtaaagccagtagtaagattacgccaataaagaacgcaaatcccgaaaagatttgagtgttcaggaaaggattcgacatggaaaaatctcttatgccaagagccatgacttctgcaatcaaactcagacatccaccaactatgttgacgaaactccacgcggcagggaattgagttgtagaaacggagtctgcagttagtactgcattcattacactgccaattccaatgacagctccaagtatgaatgagaaaggtagaagggctgcaaatgaacgtacaggaatccaccaaccccaaatgagaatagctacaaaaaggttgatcgttatggtaaaattcaaacggccgaagcgatctgccataagccccatgcagggccttcctacaatttggccggtgttcattacagcagtgagaattgatccctgtttggctgaaagcccacagatcattgttgcaaaaggagaaattgaaaacaaaaggacaacataaccaaggtttactattgcaaaccaggaagcaacaagacagacttgctgtttcaaagctattcggaaattgaagataatcttgcattgggctttaaggtccagagagttggtaattctaggacgatgaactctaggcctagaaatgatcaagccaatgacagatatgaaggttaccacaaaacataccatcctcaaagcccacctttggtcacctgctcggtcaattacagcattgacggaaagggaaaataacacacctccaaaaccgcttcccgctacagcgatagacattgcatatgccctgtttttcataaaatattccggaatgagagtcgacacagggacaaacaaaaatgaggccgacagaccgacacagactccctgacttaggtacaaatgccatatagtcttagcatagcttgcggtaaaccatccagtaaattggacaacgattccaaagatgactgccgggtaataaccgaatgtccgttgcaagatcatagcaaccggagctaaaacctgagctaaaaaaataaccattccaccgatcaaagcaaaatcatatggagttgcacccgagaagatatgattagtcaaatagtagtttagaaaaactccatatgcagcattggcaccccaagttgacatgacaaacagacaagcaccggtgacagtcaaccacgcagtgattcccccatctggtggttggtcaattacatttttttctggcgtttcggagattagtgaaatcttctcggctgagtcatcatcacattcatgtgccccagttttaaccttatgcacggctaaatcgacggcctccattatggtagaatcatcaattggaatgaccctatcgttgctatacagactcgtagccccatttcttgtttgttggttttcgtcgtcaattgcctccaaaattgaagagatggcacttcgtcgcgtgggttcctgggaaatattttgaagtggaacatcgttgaaataaggcagtatatcatgctgattctcagcattggagtcagtagcttcaagtgaatctatactgtatgagtcggaagaggatttccggctcgtttttgtcttcattttgttattagaaggaatgataacgttgggaaaccggaggttggagattttgtatatataaaactttcttggagcttattaataaatgcgggatgcagtaaacttgcatatatctattgtaacacttttgcaatagctgcatgccttgactcatcattcagtatcgtgtgaaaaccaatgatacatccgtacattcaaactacaaccttcctcattagtaattctttttgaatttttcggaacccgaagctccgcctatccccccaactaacacatcttccaatttgggtgggagaacacctagcaacatcacgatcattgcgcgaacgttcgcactgtatttttttctcccaaacacccaacttctaggccaaatatccacttctcggggttctattcacccatttaattgttggccttaaaagtcaattgagttccaatcatagtccctagttgattgcttgtagcaaatgccacaacagtaggcatttacgtcctcacagtctcttcccttgtccctcattgatacctctttattctcccccaccaccatacactaccttcctcgcacccctgtcatcacaaccgcaatataatcgatgcgcggtttcttgcctaatccatcgtccaacagagaggtcgctctccttatatatatagttgatccccctttttttctacccttgcaattttttttttgggaccaaagaaaagaaacaagactgatacaaatatggttgaagcaacaggagatattggccttattggattggccgtcatgggtcaaaacctgattttgaacgccgctgatcacggtttcaccgtcgtcgcttacaacagaaccgtgcagaaagtcgaccattttttggccaacgaagccaagggaaaatcaatcatcggtgctcactccattgaggaattggttgccaatttgaagagacctagaagaatcataatattggtcaaggctggtaatcccgttgatgccttcatccaacaattgctacctcacttggaccaaggagatatcatcattgatggtggtaactcccatttccctgacaccaaccgtcgttacgaggaattaaagcagaaaggtatccattttgttggatccggtgtctctggaggtgaggaaggtgccagatatggtccttctttgatgccaggtggtgctaaagaggcatggccacacatcaaggaaatctttcaatctattgcagccaaaactgatggtgagccatgctgtgactgggttggtgatgccggtgcaggccattatgtcaagatggtccacaatggtatcgaatacggtgacatgcaattgatttgtgaagcctacgacttgttgaagcgtgttgcccgtctgccagacagtgagatctctaaggtatttgccaagtggaataagggagtcttggactctttcttggtcgagattaccagagatattttggcttacaacgacgatgatggaaagccacttgttgagaagattctggactctgctggtcaaaagggtaccggtaagtggaccgctatcaacgctttggaccttggtatgccagttaccttgatcggtgaggccgtctttgccagatgcttgtcagcaatcaaggacgagagagtcagagcttctaagatcctctctggtccttctgttcctgagaacgctattactgataaagccaagttcattgacgacttagaacaggctttgtacgcttccaagattatttcctacgcccaaggtttccaattgatcagagaggctgccaaggagtacaaatgggacttaaacttcccatccattgctcttatgtggagaggtggatgtatcatcagatccgttttcttgggtgagatcactgctgcttaccgtgagaacccagacttggagaatttgctgttccacccattcttcaacaatgccatttctaaggctcaaagcggatggagagcaactttgggtaaggctattgagtttggtattccaacccctgccttctccactgctctgtctttctatgacggttacagatcggagaagcttccagccaacttgttgcaagctcaaagagattacttcggtgcccacactttcaaggttcttccagaagaggcaaatgagagactcaaagttggtgactggatccacatcaactggactggaaagggaggtaatgtttctgccagtacctacgatgcttaatttgcctgatagctaaggtaattatgtatttagaaattatcactaagtgtcaatgattgtaggttggtctaattgagcatagttcaatggatttatgtaaaagagagctttgagaaaacaaaacgtgaatattgaaacgcatgaatgttgaaggggtttgggttgacaccgtaaattaagtgaagacagaaggtttgagaatgataatggttcaaaattattaagcacagccatatattttgctgtgttgattcaaggtcaagcttcgttcctcatggcccaatggtcaaggcgtctggctacgattagccaacttcgagtaaacttgaggtaataggaaaccagaagattccaggttcgactcctggtggggaagcttttttttccccctttttttttatctcagttactgataatctatataaactgattgaccctggatagtttattttatttaagaaacgctaccacaattgttcactaaagacgttgtcagatcacacacaacggcggttaatgattcctgacacttggtccaaatggtatgatagggacactggtattgattatctgtacgggctaaaatccaagaagcccgatactgcgaagcaagacaacaaggatccacttctgacgtttatcttgaccaacatcagacagacatggatgcttgagatcaacaatttgaaggatttcatagaactttcagggaataatggagtggaagtttctagtgtcgatgacctttacaaaacaatgttgtttttagatcaaaatatatcccaattagactccaagattgctcaagtggggttcttatacccaaaaaatggacgatcaatgtttcaattaaccaatatatcagagtcaatgccaaagaaggaaaccttcaagtgggttttcccactaaatctcgtaagcgatgcaacttcattggctatttcccaaggtattaactttcaagtgtttaaagcgttatcaattgaaagatttcaaagaaattatatcctacatgaaatagaaaaaaaggacaagctgatttcaaagttattggattccgttctggagacttatagtttttcctctggcaatggagaaagctcggcagagaactctcttcaggagaagaataagatactgaataacaagacactgacaaaaataataccagagggtcatagtttaagacagtcattattgaaatttgatccagcaacactacagggtcaggatccatataagaatacctgtatctgggatcttataggagaattgctaaaagagagagataattggaggcatagcaatgaatacagtgtctcaaggacagtaaccgaatcaatagaaaagagagacaagaatgataacaacaacaataacagtttctaccatgaatatatggaagtggacgaatctccgaagaataagaagcatattgaatcacagtttgaaaagaacccaaagaaacggaaattcggtaaagtgtctgcttctgttccagtgctacatgaagcaaatcatgataaggtcaatatgtttggtaaggacagtaatgtaaatgttgaagatgtaaatgctgaaatctataaaccaaagaggagaaaatttggtgtcattaaatccctcaaaagaaagttggactcatcttctgaagttgccatcaaatctcaaaaataatgcgctttaaaaccgactggatatggccagccatctcgcagttagttgagacaaagctttcttttgagagggttctcgtgcctggtacagacaggtgagtaattcgcaccagaactctacaaattcccgaaactcgggagcatcagatggaggagttttgaaaaacttctgttttgttgctgagtttctttgaaacattttggaatcaatcagtcgactcctcttaaagaggtgaaaaaatgtggataccccgtacctggaaatcagatcgaaacaatcactcaattccacaatatttttcttttcgtatccagtaaattctaaatcatccccgtactcctgtatcattaaggcgtccaaggaatcaagtgctaccattttaatttcggagtagacagttgcaatggcgtcttctatagaagtcttgtcagctggttgtactgtgggttcatagtcaatgatttcgtgatcatcattattgacgtctaatagtcctctattctgtagctcttgaaatgtcgtagacagtatcagttctgcagtcataccggtgcgataagaaactgtcagtacttgatttgtgagagccatattacacaagttcttatcatttgacaagagaacaaccaaactagatcggtactcgctctggagatacaaggcacaatctaaaatggaagcgtctggagtcaaatctcgttctattctttggtacagtttttggcccttgacgataggatcattgctggccaaatgggtataaatccagtctactgccgacctagcaagcatgcccacattgaatccatcttcctttctactactagactttaaaccgtctagttctgttatagttgttatggggatcacaacctttaagtgtgtcatcatttgctcattggtgagggcgatattgtgaatttgtgataacagtttgagatgagatagaacaaagttggtgtcagctacgaacaaaatggagtgctcgtatgtatcatctttactttgcttgtatctagagtccaaatcattttcaatgctgagtacaaaatcattggttaatttctggttgttaacgtaattggtgataatctgaagttccgatccatcttcaatgtccataaaatctgactggtcttgctgattcatagtagcaatcacagaaccatcgctttgtgacaatggagttaagctttgtaggataataatagtgaagctactagggaaaaaataatgctcgcgctgggaggcatcgatggtgtcttcgtctgaggtgggccctacgctcgcttattcaatctgtcaacctgtgtacacctcatctccaaacagtaatggtaaagtccaccttgatctttagaaacgatggtaagttgcagtccatggagtttttagcacgttaaatgaaatcactaacttattaaggccttcctttgtcagccacggtggatgatgaccagacccaaaatctgacagaacaaaagaaccaagccaaagccatagtaaacaaggttaactcaaattctgctacggaggccagcatcagaagtggaaattacaccattcattatctccttagagaatctattgtattcttggtgatcgtggacaagtctttttcaagaaaccttgcatttgcatatttgcaagagattgccaatgaatttatcaactcccacgggaacgcagcattaagatccgacacaagaccataccagtttgtgtcgtttgactcgtttatgagcaagaccaagaaattgtaccaagattcccgaacccaatcgaacttggatcatttgaataatgagcttagtgacgtgaagcgcattatgactaagaatattgaagatcttttataccgtggagagtctttggatgatatgtctgatctctcatacaatttgagagctgaatcaaaaaagtatagaaaagcagctcgaagaatcaatttggaggctctgataaaacagtacgttccggttgcaatggtggggattttcttcgtatttataatatggtggatattcttgcgctgaagcaagatcattgttgattactaggtggaaaaaaatgagagaacgtttcaccaagagagcatcgggccattcttgatcaatagccaaaagcacgttgcctgctgcacacacaaacgatagcggatatatttaatagtcttttcaccttacatccatgaatttatgtacttttagtcttcactagactcctctcctctctttatcgtgttccgtacgatgcttaaatactcgtttacgtaatggtgatcctgcttaagcgagaacttacctcaaaatttattcttatcctcaatcaccaccgcacaaatgccccccataagggatcttttgccaggtttcgagtttgaaaagatcctcaattcggatccacagacaaagtctattgtattgcttggaaaaattgatgaacaaaacgcaatcgtatcattagagaagtcacatttccaattcaacgatctccaactaaattcactctttgaatccgataatggtgtcattggccagcggatcagagacataaacataaatgacgtctatcattggggaatgtgtcttgtggaccaagacttagaaacggctccttctgcaaagatcaacgtaatttaccctgcaactgaaacgcacttgaaaaagtacgctgcccagcagtaccacttgataaaagaaactccagaagcatatcaacgaattgtggagccttacattaaaacaatgaagggagatcgtatccagtgggttcgtaacatcctcttcaacaactacgaagctgataaaatcctacttagagatcctgatccaaaaactggattcgttgtattaccggacatgaaatgggatggggatacgttagactctctatactgtgtttgcatagttaacaggggagatatttcttctgtcagagatctaaatcattcccatgttccttggctcaaagaactgaacacatccctccgacaaacaatctctaaacgatacaacattccaagaacccagttgagactttttgtccactaccagccatcatattatcacttccatattcacattgtgaacattagacatccagggttgggagacagtattgctgcagggaaggcaattttactagaagatatcattgaaaatttggactcaggcgaatctaaaagctacgtttccaagactcttcactatgtactcggagaaaaccataatttgtggaatttgggtctgaaggaccatactgtttgaatagttcttatataagcaccaacatttcccgcgattcacatccttcctaccccatcccattcttcaaatagtattctagtgtatcacttggaaaatgaacaccggcactccatcccagtcgtcagctggctcatggtctgcgcacgcaacaggatcactgacgaattctaaagtcaatgaaaatcgaagtgaaaaaatatttcaacaacttgataacctagaacaggatctatccaaattggtcacttcaatcaatagattccaaccgtccaaggaagctgcacatagactcgtctcagacgtggatgaacttaattacacaatagatgatcttttatacattcatgacaagcgccggagtcaagttttgaaccaagaagtcgaaaacagacatttaaataagagcatgataaacattatgatagggctgactgaatgccgtaaagaactcaagaaattgccaaatctaacagaagaacaactagagaaagtgtacacagagaagttgaaaagagagatgaatgatggtgatgtcgatatggacgctcctattaagccactaccctcagccgaagagaatctaaaagatgtggaaacgttactagaatatgctatgaaattatccaaattttccaagattcctgctagtgtagacccaaacactctaaaccccagaaatttcatttggcctggcgaagactctatgcgtagaggaatgttagcattggcatcgatacaccatgaacgtttaattgaaaccctaaatgaatccacaattaacccaggaggagaatcaactataaacaacgaacaagaagttgcagaaactcctagtccttctaaaagcactaaggaacataataacaccactacaaaggggcccaaccaagagactgatgctcaagctgccatcgatggtttagatttgttcgactcagacgaggatttatagtctgcgaaagatcataattcgaaaacattagtcatttttgaaagatcgaatgttccccatgactttaccgatatccttgctcaaggagtccagagcttcatagagagcttgcttttcttcattctcaatcaacgagaagtcttttgaggaacggagcttctgtagctcgtcaatcttgttcattaattcatcataatcttccttagaaaagtcaatttcaggaagaataattggttggttaagctcttcttgattgtcatattcaggaataagagaagcatctgatgcattgggatgcacggtgatggtgtctttctttggtgcagatatagtttcagattctcctttactcttgagatggtactttctcaaaaatcctgtgacacttctggaaaatgggcccttgaatgcaaataatattattccgatggcgatgtgaggaaagaaatatactgagctccaaactttgatggatttcttgaactcaaggatgacgaatggttgaaccaagtatccaaaagctagatgagtaacagtccaactaacgatatcatacaaggttttatatctagtgacaggttcagcatctttagtggtaaatattggtcggatatttcttctaaagatttttcctatcgtttgataaaaagctcccgatacaaagctcaggtagtatcctggttttgtgccatgccagaaagcggaagtagcaaaggttaacagagtagatagaaaccctggtttgttgttcttggcacttctcaaatagatgaaattctttagccacttattagtattcatgttccaagcttccagacatgtgcggacgttttgaccagtttcgaattcccagggagctatattctgcactcggttccaatagaacttgcctgtcgaggcatcgtaaccattataaccaattccaacaagaatacagcacccttcagatatcaaccaaactgcatagtacttcaaccgataggtgaatcctagtatcgtgagcacgatacctttgactatcagaggcttttgttggtattctaccgtgaataaataatcagttgtgatgtagttgagggatgtaatccaaattgcggcccaagcagcaccttggactactttagcaaaagcaattcggccactttttgggatcattctctttcttctttttcctgggcgttttgtatcaggaacatcactaaacaattcggtgttgataaaattttggtaatcagagtagtcaaaactgggacccgttagcaaacttggaaaaaaaaagcataacccagaaagcttaatattgagggatgttcgacaacgactcttgatctctggtatgtattcaatttctcttggaaagctttgggatcacgtttcaagagtttcccatcacggtatgaccaagcgaatgaagagagcttcattacaagtaccatttgagcacctgtgatgtcaatctttgttggatcatactctgcttgccaaaattgcgcctttaaatgattgatacacaaatgacccatgagaaatgctaggttgaaccatggcatcaaatccgatttcagatatttggtaatgaggtatgtaaaagtggtgctaatcaggagggtaacaaatcctcctttgagttccaaaatgataaaaatgtaaaagaaggacaccccaatgaccactagattcttcagggtatatttgttgtcaggaagtcgtttgaagagggcactcagtgggaaacttaagagcaaacacatgacaatctttgtggattcttcatccagaccagtcgaataggccatgtatcgaatctggtcctgcacccactgaaccatgatagtttagttgcaatgatatacttgggttgcactgaaagggaagggagagatgcttggatttaggatctctaatttcgagagtaatgattatgtaaaactaataatggggatgcaattgtgtcagacgtaaatgaaagcgctcaattgctgaaacggaaaggttctcaattgcaatagggaacttttggcacttggctgtatcctgcctatcaagatcatgagcaaggcaaccctttgccaaggttgcttctggaatcatccacctctcccccacctttgcctcgaaatttatcaatcatcgcctaggtactcagtatacaatctttggaattattttactgaagaagctcttagcacactgtaggtaatattcaagtcttaacggttcagaaaatgatggcgaagaggtctagaatccagcatttcaaaagtatttcatgggtgagttctagaacgtttttgaacttgggccgtttagcacaaaactctgaactgaaaggaaatggacagcaatacgtggttaaaaaaacgtttcatcagcctaaaagcgttgtttacaatgttatttccaacgtcgacaagtatcacgagtttataccctattgtgaagcaagctttatcaactcaagagacaccaaaggtgagcctacagaagcgggactaaccgttggcttcaagtcatttgacgagacatttctctgtacattagaatgtcaaaaggacaaacaagtcattgccaagtcaatcacccattccttatttcataaccttctcactgagtggaatgtcaccgaagctagttcctccaagacaaacgttgaattgatcctcagctatgaattcaaaagcgatctctacaaccaagtcagcgcattatttgcatcaaaagtcacttcaatcatgataaaggcatttgaaaagagagcctatactgagcacaaacaattttgtaaatagagacattagaaacagctccggagcttacgtaatacacgaatcatatatatccacaacctccaaacatctaaaagtatcctccgtatagacaaaaaccagcacatactaagtatccatgtcagatagcttgtttggttcgaacattttggagtcagaggatccttgggcagagccaggggcattctctagtaacaaactaaattcaagtgaatttaagccagattggcatccaagtggtaccgccgacttgcaaacagctgaggatcccttagttgatccgtttaagcaggaggatgtctttattaaatcaacttttgaagaacctactagtagtagatccatagaagctgttaaatcagctgaaattgactcggaactgggcgaagcagatgttgaaattcccaatctttggagtgataccgtccaggagtttaatccactatcaccacataacaactccagcaatcatatggtcacagtgaaagaaatcccagaaaaacaagggttgctctttaaacacatcaattacttggtaactcataatatcaaattttctggtgaatatttaaagcatgctgagcaaagtacccaaaacaaaaaaggtgaattcaaggtgattcgacgatatagtgatttcagttggctattggaaatcctcttgaaaaaatacccatttagaatgatcccagatcttcctcccaaaaaatttagcagtgagtattttcttttcttttgattcatttgttttataaacctggtccaaatactaattatctatagtaggcgctacgtcatcttcgaacgattctctgtttttacaaaaaagaagaaggggtttgcaaagattcctaaaccagattattcatcatcctgttttgattaaggagccgctagtgataatgttcttgactgtgcctaatgattttacaaactggaagaaaattgcaaacattgacactagtgacgagtttgaaggagttaaagtaagaattcctacgcgtttcagattgactcttgacaaactgtatctgaatgacgaggctcaagaaagtcaagaagagtatgaggaggatcgtgccggggccgcagccaatgagcatgctatcaatttacagacaactttcaagaatattgagcacgtttgggaagagaatccaactaattatcacaataaagacttcatggataatatcaacctaatcacagtaaacttgggcaaaatacatgaaatctggactaaactttgtattctcgttgaaaggtctgaaagaagagagcatgctctagctttggataaagctaagtttggtgattttctgggaattttcatcaaacacaaccatacagtttatgatttgaataatcttgccaatccaaaaatcatcaaacatcaacgtccgaacgaagaacaacagaatctgggaatcataaacaacatcctactttcagtgaccaacttaaccaaaaaatcaaaagaactaaaagatgaggaggtaaagattattggctctgatattttggagtcgtttaaaaactatcaagattatattacttctttacatttcctttttgacaggttgaaggagtaccatcaaatatcttccagagatgtgtcattcctactctcaagaatagaaaaatctaatacaaggttactacagattaaatcaaaatcagatgtgaagggctcagatgttgacaggctaatcactaacatacaagtgtctcatgatgaaattcttaagataataactcgtattatcctcatcaaaaagtgtgtcatgaatgagtacaaaatgttccagactactaaatatcttgtctccgagattttgcaagatttcttcatgaaaagagtgaaatacagtgacttgcagcatgaagcgttggtgaagtgttttcacgatctacaggatcttcctttgaaatagatactattagattatttatgctacttttttggaagtgttagtaaagccaacaccttttaccgtggccaccaaataatcttcttcagcttcttcagggctgggcttgaaaaggaattgagtgttaaaaacacttttgatatctcttaacatggtaaccaatttagcatcgatttgacttttgtggactttcaatctaccaatatcttcctttccaatcgtcatatacgtcaaagccaatggtaattgattccttcctatcactccactgttttccaaaagttccaagaatttataactggtggcttcaccgatatcttctggcgtttctctggccaaacctatatcttcgatgcaatatctccagttctttccctttttagattcagaaaataatgtcaacccaaaaccaggagattttccggaagtttcacccctccatacatccgttgtgatattgacttcacatccaatggtgtttcgtaacacatctcttacagagctcacaattctattgacgatactgggactgactctcgtacagtaggcgatacctctgatagacgagattttgttgatttctaaagcatgaatcgttattggctgggctattaaagagttgcagaggagatgtacttcaccacctcctagtggtggagatcctcttttcaatgtgtgtatactgcactctctgactccaaagttctccatcacgggcaagaaaccccatttcaatagatcgactccaacatcttcttttgacgaagttatacctttaaatacaatagagaatttttccttagaaaatggggccagaaatagcatgtactcaatgaaatatcccactggcttgctaaccggacaatcatgggttaataccccccctataattattccgggtctgtatataactgtggtacctgtgtaggaaatctctataactgaaccgtttgtgactttttctaagagccttaggaatgaaacttcataatctttgagaccaggattcaattcatgtgaccgtatcttttcaattttgattggttttccagctagagtggaaagtatgagccgtaacctaaaattttcatggtcctgaaaagtgattatttgtcccttagccatggtgtatgctggaagtggggattaggagctaggttttatgtgatattttttttttctgataaacttttattctgaaatatatgattacataatgcttacataatatcaaatttgagaagggaacggatgtgtcaaatgaacatttacagtggattgaaaacagatcagttattctatcaagtatagaagtttggatcacaatgaaaacccttatgggtgttatctctttgcccgtcttttgtgtatattgctgattctgccttaaggtgaaaaaattacccggcccaaatggatcgctctcgaaagctacaaagaatcaaaatctttcgtttatactttgttacgtaaacagccatcaagagttgatttgaacaacaaaaacaatgtcatcgactccagatgggtcaactccagtggatagtggaaagagaacatcggatcaaattgacgttggggaatataaacgtgttaaagtagagcgaggcaatcgttctgaaaccgttgattcggggctgattgacatgagcaattctgttggagcgtcgttagatattcccactcctgatcaattgaatccaacaaacactggagttcagaccccctcattgcaccagccaggcgaatcaatctcagcacattctctctcgcttccaggagagacaagtgtgggcggctcgacaggtattagcagggaaaatacccctcaagttagaccggacgtttctgtctcacaaagttcatcacagttacatcaaaggaatgagtcgttccctgggttaagtgtcagcaagagtactacatctttgaataaagataccatgtttgacaatcgcaaacgacttttgggaaataatggagctaaccccaatggacagaaatcctcagatccagaaaaattatctgacgcattgactgcagcaggtgtagacctgaaagaggaggagagtctgttatctcaatctactgtgatacaacaaagtaggagacaattgagtacactgagttcattccttcacccagtgcatctagcaacttttatgagaagagtcatggagaacaacggactaagaaactatgtggaccatgacacggagcttttatcctacatgtcctctgcgtgcgaaggattcatggccggcatcttgacagattctgttatccttgcgaatcatcgcaagcgacctatcaaatctaaattaaaacactccactactcctagatctgacgtgtcaaaagttttgagagacatagcaacaaagcaaaaagagagagaagaacagcgggtgcagaagagagttacgttggacattgagggacaagaagatgatgggaaatctaagcaggataatgaggaagtcttacaccgagctgccaatgccacagccatgatgatgacttccaaatcaaaaaagaaaaagtatagctggatgaatgctgactcaggcgcacagggtggtaaaacgaactccgttcttgccagaggagactccggtattcgctatagagatgccagggaagagcccgggcttgttctcagagacttattaggagcattagaaggtagacggatgtgtgttgccaacactgtagtcaaaggatatgccagaatgaacgattaaatcatagtagctgtatattagtaaaaatgatattagtggggatatcccgcactattattttcttgcctgtctcatcgcgcgaacacaagacagaagttagctagctcttctcctaggagtcaacacatctggtaccgactgaatcatgtctgaaaggaaggcaatcaacaagtatattcctgcggactttgatccttcccagattcgtcggacgaaaaagaaaaagagcacagctctaccgacggtgagactgatggctcccttttcaatgaaatgctcaaattgtggagactatatatccaaatcgaaaaaattcaacgcccgcaaggagaccacaaaagaggattacttaggcgtcaagatcataaaattccactttagatgccctctttgcagtggggagattgtgtttagaacggatcctgtcaatgcagattatgtggtggagaaaggagcggtacgaaactttttgcgatctaacgtcaaggaaccagaaaagttagagacgctggaagaaacactggacagattggagaaacaagcagaacaagacaaaaaggaagaattagccaagcaaaaggggattcacaagaaattgaacgacccagatgaggatataatagtgcaggtagaaaagaaaatgatagaacagcgtgaagagcaaaggcggatggatgagctcgatgacctgagatcaaaaaatgccaggatagagagaataaaacgctcggaaatatctctggaggacagaattttgaacgatgactctgagtctctggaaaaagaaattgcatccagaactcgggaagcctttgagaataaaagaccactagaaattcgcccagatgatgaattctcatctaaggaggcgaagagcgttaaattgaccgtcactgctcccaagcgggcttcgagagctttaattaattcacttagtggcaacagagaacattacaacggtatgccaagattgtctcttggatattcttctgattctgagtgataggcgaatattattacgatttctatgctcattatctcggagagccgcctcagttcctcacaagaaccacacatttagtaaagtcacgtgctatagtatacggaaatgttccatatattttcctatcgtagatagtgaccaaggaaaaatcagctgtacgttgctgcgaacccttgatgcaagtctttcaccattactgcctgaagctatgaatgcggagaatgcaaaatccacatcgcatttttctttttatgaattggttttgacaacgtatataacagggatacaagccccctaccagactatcagcaaaccactatgactagtcagggttcttctgagatcaagcaagaacacgcagcagtagctgattcggtgaactcttcagatgatggatttcaagttctgaccatcattaatagagaaacccgtgaaactatcgttatcaagaaggactggaccgatgcagaagagcaaagactcgttcgtaaattggatttcattataactccactaatcttctttggatttttccttctacaacttgacagaggtaacattgcaaatgcctatactgacgttaacttgattaacatgttggaactgaacaactaccgaattaatattgcaagtgctttattctcgttaggtattgtcatttttgaaatcccattcaacgttgctcttcaaagagtcagcccttcagtgtttttgagttttcagatttttgcttggagtttggttgcgactcttcaaagtcagttcaccaatttggctggattctatgttaccagatttttggtgggtgccttagaagccggctatatccctggttgtctttattttctcagtacatggtacaagagatctgaactaggtttaagacatactttgtttttctatggtaatcttaccgcctcagctaccagtggattaattgcagccggtatcttgagagacctctctggtgttggtggtatgagtggatggcaatggatcttctttgtcgaaggaatagtcggtgtaggattttcctttatattttttgcatttttgcctgatagcgctgcccaccctgccgcattttggaacaaaaggtggttttacttcaccaaagaggaagctagaatcttacgtgacagaatctacgtagacgatcctgccaagtccgtgtctactaggacaactaaccacaaagatgtttgggaaacttttaagaaacccattccttggttgcatgtgttaatcacaatttcctctatgcagaccactgctgccctgtcgagttatattccacttattatcagatctatgggctttggtgtatttgaatccaatgccagatcttccattccacaatggtgttcgatggtactgattttgcttttgagtatctcaagtaaacacatcaagcccagaggtggttcgattgcatttgtgttgatttggcaactggctgcacaaattgctcttagagagcttccggcttcagcctctcccaccgcaaggttcaccgccctgtgtttcctggtgaccgctgttgccaatggtcacattttgaatacctcctggttgagtgtcaatataaaaagtcctagggagagaagtattgcacttgctatgcttatcatggccgccaatattggtggtatctgtggtggtcaaatcttgcgagacaatgatagacccttgtatagaaagggattcctggctcttatcatcttagacgtattttctgttttgctagtgtttttcaccatttggtactaccacaatctgaacagaaaacttgaaaagctacacggaaaggaagagctagttgacgaagaggaagagaaggaggcagaaactgtcgaatcattgcatgaaacggtgtacgttggattcaacacgtctgaggtcatggataaggaggaagaagaaaacacttttgtcagaaagcctaagtacagatatattccataggctagttgttatgttcttgttttatgtttaatatcattaatcgtattgtaactgaacccttataacgttgaccatgtagtaggcgataccgcgtgcgttcgatacaaatcgcacgataggtcagatgacttttttaaagattagcaccgtgttcctgccttgcaaaaagtggcttttcggggttttctctgcagctatggctttgaggtaggtttaatgtgcgtcgggttttgcctaactgggctattcctagtatttggtagaggataaaatttcaaactctggaagaacaccacagttggcgccacacatttctgagccagaagcagcgactgttcacgcgcatgaaaactgatgccatcttggaggagcgccaaaaaattattggagatcacgcaggaattacagaattaataccggcgacgcttatctaatccactaggcaggtttcaaaccgcttatataattcgcttctgatattcgcttacctaatcactattgagacatctcgcggctatgtaaacaaacataaacatattacagaaagacctaggagactactttaatcgttgaatggatttcactttcgttgtctctgaagctctcaccgagtttcaggccacagaaaagggtcagcttactttggaagattcacattcaaaattggaagaagtcaccgatgccctagccctttccccagaagcaataggtagatccgagatctttgatctcttgaaagatttggtgctggcatctccaacgttgaaccaaaagcaaagagaccaaatcgggtatttgatctgctctactatcagcagtatcgccaagaacacatctaccttgatcgagagcggagaagttgactcgtttcctgtctataagaaatatctggaactctatggatttctaatgcattgtcatttaacctttctagcgttggaggaccactcagccgcagtgactacacagaaaattcgaagggctacgaaaaaggatgttgatctcttcaagaaccactgcttgcagttggaaaatgcactggaagctacatgtaccgtatttggcgtgaatcttgagagattgtttgaaacaactccagaaagagacttatttgtcaacttatttactagaccggtttatctcctgatggaaagtgaacagcggattaaagtcacgtctgtaaaacttcatatcttcaaagtaatctgtattggaattagaaaccatggccatgctccagctgctgaaagctcaatactacagaatttgacctattttctgcatttggccgttattatggctgagttgctagacaacttgagtgaacaatataattacagccaattaactgatgagatacttaggaatgtatccttgaaagagtttaacccaaatgatgccaatggcccacgttccatctctttgttcatagccaaattatctgagttgaatccaaggttagtattacgacaaatgacattcatagcccagctgttggataatagttctcacatgttaagatgtgctgttgtggaagcttgtggtaatattgttataactttagccaaggacgatattagtttagaaaaccaccaatctcaaattgagactttgctaaagttgttggaacaaagatttttggaccagaacccttatgtgcgtactaaagcaattcaagcattgttgaaactctgcgaactgaaagaaaggttttccagaaggcgttacaggtttttgaaactagctgtcaggtctctgaacgatcgtaatcccttagtccgtcggaatgcaatcaaactaatatgcaaagtgatactgactcattctttctctgcgatgcatggcccccaacttggcctctctgtatggcaaaagagacttgtggatatccaagaacaaataaatagcttggacggatctttttcgtctgaactaataccgacaggtgatgctaataatactagtaataccatcaatttagagcaggaccaagattttgaaggggatatcacaatgcgtacaatagaggaagactctacgatgccgactccgggatcttcggagcaagatgcagataaagatgaacacaatgaaaaggaagttgttgactacgaggcgctaaacaaactcaaattgacacatcaatattataaagatgctattaagtttattaagacaatccatagaggtaccaaattggcagctgtaattctttattcgaaaaacagaacagaggttcttgaaacaatggatttctttgttttagctgatgcctacgggatagagatagctgagcttggagtcaagaaaatgttacacctcgtttggattaagaataacaacgacgaaggaacaagtgtatcttcccatttaatggaatgttacaaacagttattttttactacgcctgccacggccactccactagaaaaggccacttacattgccagcaacttagttgcgttgacaaagtcagcatctgcctcagatttagcatctttagaaaagcttttgtgcatgatgtacactagtactgagaatgatctgattgatgataacacaataaaggttttatggaaaatatatcaggctaaggacaatagtgtctcgatagagcagaagcatggctcaataatcatcctcagtatgctttcattagctgataatcaaattgcactaagaggtctagaccaattgctaaatattggtcttgggggtgaaaaagtcgaagacatgattttggccaggttctcatgtgtggctattcaaaggatggtgcctcagggtaaaaaaattggacacgagaaattcacactagaaagaaaagatgagataatcaataagcttgtcgatatggcagtgatgtactctgaagatggtgaatggtatggtgcagctgagcatgctctcaatgcaatttttatcatttcttctcatccaatcgaagtcggttctagtttattgaagaaaaagattgaaacgacttttggagaggtacttcaagagaagacaagaatacgaaacctgacgcagctactatttttggttggtcatatctctattaaaacgatcgtatatcttgaaaagtgtgaggcagaatttaagcgtcgaaaattggaagctagttcctcacaaggtaaacaaaagccggatgagagtaaagaagtagagaatgaactggaaatgatagggggaacctctgaagatgatttttctgatgctattgcttttatcaaagagaaggagttattgttcgatgaaaattctctactcgcaaagtttggtcctcttgtcaaagaaatttgtgccaacaaccttgagtatcaaaataccgaacttcaaaggtctgcagtattgtgcttggagaagttcatgtgcgtttcttccaaattttgtgaagagaatctcccacttttaatcactatcatggaaaaatcccccgatcctattattcgaagtaatgcggtactgggtcttggagacatggcagtatgtttcaataatttggtggatgaaaatactgacttcctatatcgtcgacttcacgatgataatatcatggtccaacgtacatgtttaatgaccataactttcttaattttagcaggccaattgaaggtcaaaggacaactagcaactatggccaaatgtttggaaaatgaagatcaaggaatatctgacatgtgtaaactgtttttcaccgaacttgctgctaaagacaacgctatctacaacggatttatagatatgttcagtggactgacaaacgataaaactcttgaaaaggacgcaatgaagagaatcatcaagttcctagttccatttattggcaaagagagacaccaaaaacaattagcccaaaagttgttgcatcgtcttgaaaaagtggagaccgaagatcaatggaacgatgtggcgtttgtcttacagtcactccccctgaagaacaatgaacaggttcaagaggcacttgcggaagggttcaaagtagtacaggctaggtcttgattatggaggctttagaagcataaatttaattaataaataaagatgtctatgctcaatgggctctgaaaaactcttttggatctgtgagggaattatctgacactactcccagcatggaatccaatggcaactggttggaaaatacaaccttcgaatcaatgtgactcttcactagttctgccaaggagtcaatgaaagtttggtctccgttcaacgattcaactcgctttacttttgaaggattaggtagttcttgaatcagttcaatatccagttcatggagagtttcaatatgatcagaggtaaaggcaataggaaccaaaacgactccaggaacatcactggatgctagctgcttggtaattttttcagtttgagcacccagccaaggctttgggccaacctgtgattgccaggttaatttataaggatttgagaagttaagttctttcataatggcaaagacactcgctgcgacttctgcaggatacgaatctcctttattgacaatatccattggtaaagaatgagcactgaattggaggacgacgtcttttgtgtcagtcagtccattttcagttttgaatctgtttagagtatctttgatatgagctgcgaaagttttaactaaggctgggtggtcaggccagcgatctataactgtccatttaatagattgatcagggtccaaaattttcgattgcctgtaaagttcgttaatcgatgatccggtggttgaataactaaattgcggatattgagaaaaggcaatggccttagtaattccatcatttttcatcttttgtaaagtatcttcagtgagaggattagcgtatctgaaggcaacataaggcttatgaggagccgattgtggactgataatgtctaatttttcacatagtttagaactctggtattcagaccactttcggataggagacccacctccgatagctttgtagtaggattcaattttgggtgttcttctacttgcaatgaagcgggccaggatgttctgaaatctgccaaacgggattaaatctccgtccgagaaaagacgaaataaaaagtcataggtttccttgacagtggagggaccacccatattcatgaacactattccagtgcccttgttcagactcgaggacacggtagattggaaacgacggttaagcatcttgtaagttgtctagaaggaaggaaataattttgcgggcggggcctgaaagcaatgatctcggatgcttagaagcaatcgagggcgggccacatgcttggaagtgaaatctattgttcctgcaaaaagttcctcgtacttctcgtttccatgtctttagaggttaattgggagcaaattgcctcgagtgaagcaatcagagaacaattagtggattggttgaacgatcaattgaaggcagtggaagttcccaaatacttagctgatattcatgtgacatcactgtccttggggtccaaggcaccagagataacaataagagacattggtaaaccttttgatgatttttatgacattgaagaggaacgtgctggcacgggtgagggtgatgaagatgatggtcgagttgcaccaacaagcacaccaatgaaacatcaaacttcgggttcatcagatcagactgatgcttccaatcccatatccccctcaacctcacatgaccatgaaaatgacatgcagttcgtcaccgaaatcaaatacgacagcgacatttgtgttgaagttgcagctcaattattgatgaattatccggcggaaaagtttatatctcttccggttcgcttgaaactatcagacttactaattcatactctagccgtagtagcttatgtcaaccaccgggttttcataagtttactatgtgatatcagtgagaatgaagacacagacaacacggaaagtcattcagggaacttaagagctctttcgtcgaagactgctagccgcatagatgtggttaaaaggctgaaagttgaaagtgaactaggatcttatgaaccagacaatgggtcaatattaaggtcagttgggaagatagagacatttctagtggacacaataaggaatttactagttcaagaggtcggatggcctaattggattgagtttcaaggagtgtaataataccccaaaaagttcaaatcttaaatgcttatataataacgtcatcgcgcgacaggctcatcattgactcgttcgtctattcacttgatcttatcatccttgctcccttatagcctctaagctgccccgtgtccatgtatatacgaaagtttcactctttggcagcgctgtcgaagcagcagataaatcactatgatatcctaggggttcctcctcacgcatctaaggatgaaatcaagaagcgatttaggcaattgagcaaaaagtatcacccagatttgaacacccacttggaagagcctgataagaaggccaatcatgacaagttcatacagattgttaatagttatgaggtgttaagtgatgacagtacaaaaacgcagtttgatcgtaatcgtggggtaaacgaagaacaattgcgaaaagcaaagaggcaagagtttcatgatagatactatggagatgcaaagacgtattcacaccgacccagtggatattacaacaccaagaagaatcgtgtgcattatggagaaggcgtcagattcagaggaaaatcgcaatttcatggtgagtttaatgagccatccaactacgatgttccccatttcgattacgacaaacacctcgcaaagaacattgcttatgagaaacggttcacgggtgctaggggctatagaggtggagatttgaggtctcatcaaatgactcatcgatcaataaatcatggagtacgaaaagacattttcatagataaagagagcggatggggaggtgttatggcaggtttggtgatctcattttttggtctttcatttacagcttgggcgttgagtactaaagaggctaggccaggtcagtatcaccgtgaaccaacgcaaaagaccacttcaaaagttcaaagctcatcatctcagacagacagtgctccttcccacgaattcgcgaaatcaccggaatctccttcgaaatctccgtctgagaaatcccctcctgagagtaattcctccaacatcacgtcaactttgatatcgcgtgcgtcccgatagttcgatagatttgtctgccgacatgagggcacctttgattgttatagagggcttagatcgaacgggcaagtctacacagacagctaaattatgccatcgtctcaatggcttcttggtaaagtttccgaacagggaaactccaattggaaaactgttgaatcagtacctgacagacgcgagtaatcctatgccgttggaagtagctcatttactcttcagtgccaaccgttgggaaatggtcaaaaatattgaggatctactaagtaaaggaactcctgttgtgatggaccggtacgtttatagcggagtggcgtattccatggctaaaggcctcgacatcgaatggtgtcttgctcctgataaaggactacccaaaccagacgttactatttttctaaaggccaacgatcttgatagcataagtcaaagagaaggctttggagaggaacgatacgaagttgcaagtctgcaaacgtcggtaaggaacaattttgaaattctacggtctcgttacgatgagtggaaggtaattataatcgatggcaaggatattgatcaagtgcatgagcacatatgggaactggtttgtcctttaacccgaggagtaactactggattgaacagattttagatcttgaaacggaacgtatattgacatacatataatacatagaaaaacaaccaaagaaagagtataaaaattcaaacaggcactaagtaggcattatacatactgcaaaacagagtaaaatgctacaaacgtggtgatcaacgtagagactatacttacattaccgaatatcaacctcagttccacggaaccgtggaggaaaaatgactttgcggcaaagtaagtatgagttagaacggtacttggcaagttgaattcattaaacagctcatctttgacgtcagacagagtgatcgaagatttaacaacagttaaagtcagtatcagtttagcgattccaaaaatgacagggtcatatttgtaaccttgcaagtactcactaaagttgaagtagtaactagcaataaggggaaccaataccgaagataaaaaccaggttacaaataattggaaaaaactgatagtcaggagaggctgaaggttgaaaactttcagatttttaacacgaattggaagggctttcttgagtgcttttggaagaaaagaaactttgtagagggggatggtttccccataatgaagttcaatgagggccaattcaaacaagagttcaatgagaaacacagtttcaggagtgcttaaaacatctctaaccaattcgttagagtctaataggtactctttgaagtattccaatctaccaaaaagtgttcttttgaggctcttaactttatattgtagcgagtccacactttcgttatcctcgccgccctcttcatcttcatcgtcgtcttcaacctcttcgtcaacaatctcactatcttcatcgtcttcctccccttcatctccatcaatctgaagtcctttcttgctttcttcaagttcctcttcggaaccaattcgctcgtaaacaacaggtttcttagcaggggatcccttacgaatagataggtaaaacttggagtattttggattgctttcaagctcatcttgctccaaaaagtgtctggcaatgttttcaacgagttcttctttcaagtcacggcttgagtaactaaataatccaatgttagtaattgctggggaagacgatgaggaggagccaagacccaccacgccaaaaaaataactgggttcagaaatgcgcacttacctcaatcccaactcctgagcaagctgaattaaatcagatttcttcaacgatttcaaagacatggttttagttggaagtgtttagtgtgagcgtgtatgaaataaacaggaaacacagagagagagagcacttcactaaggaactgtttgtgttttggtttttttcgtggccaccccagcttattacccaattgggcaacaccaaaaacagtaataatttggtctgtttacgtaagacagcagatcacgtgaacctcgaaaccgccggtagcagagctcggcttgtgaccggctcgtgctgctcggaacgtagtccggctgatttgctttctctttaaatcagtctttttctttacgatcaacgaccgattctaacccacaaatgtcgttaccccctctgatcaatggatttgacagacaaacctcggaaagcgtagagtcaactttggcccaagctctgaaccagtatgagccgtcggtgcaattgcacaacacagggaatgctggctccaagaacagacaacaacagcaacaacagccccaatttgttgtagacaagtcaaaacaaccggtgatgccgggggcttctgtcgggggcactccatcatcattaagtcatcataaccaactggtccacgttaacgttggtgatagcggtcctggcagaagtggatccaatgtagatgataccgtttcctcttctcctggtcatgggtcgtctaccaatgccggcggggtagtcatgagtcgggcctcgatgcacgatgaatctcagcatccaagaccggcaacgacatccaacattaccagagtaaggcacaaccgtcctgggatgaaatttggagcaaagaagaaatcatgggtctgggattggtttgtccaggatagtaccgacccaaatgtggccatttgcgaccaatgtggaagaataatacgaaggttaccgagtgataaaggatcgcccaagaaacttagtgagcatctaaggacacacaagattgataaagatactgttatacccaacagagatgctttgatgaataactacgctgctaacggcattactacacagctcaacggaagtaatagtttgacacaattaacatcgtcttccaataacggctcgggttatccgaatgtttcaaattcaatggtcagcaataatcaagttaacaataacaacaacggtcctaggcccaatgtggttccagttggcggtttggctcacgttccccaacatctattgagtgagttcgatatttccccttactctcaaatgaagttccataaagatatcatgagatttctgactgagcagaaactaagtatagatgttgtcaagactcatgcatttcgtcaaatcatattcactctacgacctgatgcaattgtcgacttgaacgatttggatcatatctattcttcctttatggaagttttgaagaataatgctgccgctgagaataagaaagatagccgagttgacggaccggaacattcgtggctttgattcatttgagcatagaagaacaataattaaacacttatgatagtcccaataaatctaattaaacccccataaaaggccatcctgtttaccgttatttgcattcccaccattaaccatatagtcagcgtccttagatcctgggattggtgactgtaagataggcggaaggcggattctcttattgggtaaatcttgtgccgaagattcatgttcaaccacaggcttttgaacattagtctgataagtcgctaaatcaagagcgttgttgttgttgtgattgttattgaagttggttggtgatttattggccgcaccgttaaacttctccattgcagcactggcataaatcgacttcatcactacattcagtgccaatattaagtttgttgtagacatttgaatggataccagaatgctgatccaattgataagagatttctcaatgttttgaagtataaatttgtacaagtcatcattagtaagaatttgttgcaaagtcattccagacacatcaaggtcgttttctgaaccaacatattttttggatccagagctctttttgcttttgctttgttgaacttgactttgaaggattccaatggtgatggaataactcctattcttatgcccctctgaattatgaatagcagaaaaaccagatcccagttcactaattagatagataataacattcaggataggtgtgtcttcctctgtatcttccacaacttgcgaactgtaagaaattcgtctttgtactagtatcctaataagaagcaggaaatttccgatgataaactccagcagtaaaagtttgttactaggaagacttaaaaacgacttgatactcgcaaagctttgtttgttattgtaaattagtgagataaatagcaaaggcagggttgtcaagccaaggttgttattcacaactagcatcttgttaaatggatgaaaaatgaacttttccaagtttgatttgatgtctggaacagtcaacgaagaatgacaaaacttggcaatatcaaattccgcattttctgatgggacatgttgactggtggacgttaaagtgttgtataaagattccacttcatacatgaagtctttcaatgttaaagacagcagaacccagttgtaatcctgcaaaggcaaaaaaaggtaattgaatagcaggtcatggaacttcagtggacaattgataagcagtttcttcttgttgagaatcaatgaattgacaaactctacaaatttgttgttattcatcaggtctgctacttttggtgggtaattagcctccagcttgcctttgttattctcctgtatgatattcactgcggttgcaccgactgagtcattgaatgacgtttctttccctgaaggaagagctgaacttcctggatcatcactcactgcgttgtaaatattgttgaacgatttgttagctagaataattgcgttgtgaagaaagtttttgctgtcattgaaaataccatgttgaattttggaggtggattttctaatttggttatcattgaatttgatcatctgtagttcattcaaaagcgcacatatgagcgtttgctcaatgttgctaattctgtgattgacaactagattcatattattcaagaacacatttttggaaatgtcatcctgtgaatattccaattgtgaaacaattgtttcaggctggtcagttaacgaagtaactgataaattccttagtaattgagccatagtgacctgagtattcggaagaaacttgtcagctaggaacatatgcaatgatgaaggtgatttgttatagatgaacgagtatttcgacagcagcacatacgcataccaatagaaaggttcaaccgtttccaatggattggaggaattgttattaatatgcgtgctaataatattgttaaggtattcgaacaagacatccaacgttataactggacatggtagaacaatgtttatattgtcgtggtcaatgttgtgattatcaatatcctcaaagtcatgatttgcaaaataattgagatagatgaaacataagaggatcaagttctcgatgaattctgaaaagttgtcactgttgtaattaattaattgatttgatattttattgattattattgcccaactcttgttaaatagcttgattgcatccaaagattgtgattgttcacaagcccctagacagataattaaataaaggaattcactatttccatctaggcttaaaaacctggatgacgttgaactggaattagtcagaaaatggcttgaaaacggctccggagaagggttcacagtcgacgaagtatcaaacactttgaagaatgaagggtactcagggcgaaactgaaaattattgcaataagttaacagatacccagaaatgttattgtctaactgtagatcaattgatacctggctaaatttcttgcataacgttaataaagagatgatatttttttccagaaacgaatcaccaacaggaaccgagctgggagtgtttagggttggattctgactgggacttggttcaaccagatcgtttgctgaactctcagccaatcctgttgcgtattgctttatattcaccgcggcatcgatgttttccttcaaaagcattccatgaacagttcgacaatgccgttgcagcaaatctcttcgaacaaaggaattatcgcagacattgcagacaaaaggcttctccttcgtatgagaacgttcatgacggagcttatgctcagaccgtgaaaaagccttagcacagaaggaacaaatgtatcttttctgaggacccattgaaagttacggatgaggcgcaaagtatcagtgggatcggacaatgaacttgtagaatttggtaaaagaatattagaaaattcttacttaatacatgtggttatcaaaaggaggaggcggttgacggtagatttctgttctccactcttaaaaaagcggagagcgctagccaaaatgggggacatcgtagccgcgattagcgaatcgtcccatatgctggacagggttaattagggtgacacatttcacactaagaggactgattggaagaaaaaataaagtttggaattttcctacctgtagcaatgctacgcaagatcaaataaggcgagaagtcttcgcatcaattgagatttttgaggtgatgggtgctttgattttgtggaagagtgccttttagtttcactgctacttcccattttgaaaaattttctttgtgcgctagcaggggagggagtagtggaagcaggaggcgttgttgggccagttgaggcatcactgtgtgaattgtcgaattttccgtcagattttccgttgcttgctggctctcccttcttttcctgcacacggctagcttgcgcatcagcctcgattttaatttgttcttttgatgcatgttttccgtcaattgactgttctgtaagggacggagtcgcagtgacagcggggttcgtagcatcaccccttttattcatactatttagcctgtcaccataaacctttgccatcgcaacctccatggccttggagtacatctcctcatctgttaattgaacactctttttgggcttcatctcttttttaggctgctggggaggtgcatggaacttgacatttttccgtaaattgctactagtaatagagtcactgtgttctattggttgtcttggtgagggtacattggaacgagggataactctggttggggcctcttctgcatcagagtacacagagtaatagcctgatgaggtatcatttgagtttccttgattctcctccacagcttcatcctcttcaggtatgtaatcaatttcattatggaaatcttgatcaaaatctccaatcaaagcctcaagatcattatctgatgctgttacaacatgtttgggtataatgcgggtggtttgaacaatttcataatcaccaaggtcctgaatagtttgtctggtgatacttctggtagatccgtcttgaagagtttccttagtggtcttgaccagaacactcgtagtcgttgaagttatactattcattcgcatgcgtggagtctgtgagtttctcaatgacccagaattcaaactcatggttcttctttcataagcgggaataatacttgggggtctataacttgtaagactattttgacgttgattgtgcgcatataaggcagttgaagcagcctgtccactaagtgaatacgctctggaaggttgcgtttgcccaatgttaaaattatcacttgccttctgctgggcctggttaaggtaatactggtccgtggcactgataggtttgtgaaaccccagagtctcctaaaggtgttagttaataggcaatctgcaaagagctcaaaaaactaccaacccttgacttccttttggatcgtccaaatagacccatagttttcaatgtatgtcagtagggattgacaatttgtattctgtttgtttttggtggaatagaccaatacaccacttttcttccccatcactcttcaaagtgaggcctgctttttccctccctcacattcatggcgcgacgctggatgtaatattacgggcccctgtctcttctgcctccaaaccaaaacccaaaccaatcccgcgcacccgttccctcgcgccgatctacagttattcgttgaagaatgacagttcagttttctgatttttcacttcttccattcgaactcattacccaagatgtcccccgttgaagaattaaaggagtatattcacaagttgcaggatcgtgtcaccgagctggaaatcaaggccggtgtcctgccagagccaaagctgccagctgctattcgcatggtcttgatcggccctccaggtgctggtaagggaacccaagctccaaaccttaaggagaagttctgtgcctgtcatttagcaaccggtgatatgttgcgttctcaggttcaacaaaagaccgagttaggagttgccgccaagaagatcatggatcaaggtggccttgtctccgacgaaatcatggttaacatgatcaaggccgaattggactcaaatccagagtgccaaaagggcttcattttggacggtttccctcgtactattcctcaggctgagaagctagactcaatgctggttgagagcaacaagcctttgcagaaggctgttgaattgaagattgacgatgaattgttggtctccagaatcaccggccgtctggtccaccccgcctctggtcgttcataccaccgtgaatttaacccaccaaagaaggatatgactgacgatatcactggtgagcctttggttcaacgttccgacgacaacgctgatgctttgaagaaacgtttggtgacctaccaccagcaaaccgagcccattgttgagtactaccgtaagcgtggtatctgggctggcattgatgcttctcaatcccctaagcaagtttggggtgatattctcaaatgtctacgcaactaagtgcttttcaacgaaacatattctgtataggggcctcggccgcttcagataatttctttatatatagctgtcacgtatctgtataaaaaatatatttctatgaatttatattatatgacagttctttttttttatctgttggctagattatccgtcaagccacgcagtttactaaagtcaatgttaagaatagaagagccaatgctgctggtttctggtctcttggcagcactgacgacgctgtcgtctgacctttctcttttctcaacaacattatgtaaactcctctcctgctgggtctctctgaaacacgaataatgatacactttgtctcccgattgtgtagcattggaccaaacccattcacctgaatcgtcattgaatttgcccaccatttcctctttacaaattccacacgacgtggtcatatcagtgacatcatcaggcaccacaacgtaatgacgagccagctctgctgggtctaattcggctggtctagtattcaaactttgaccaccggtggtcgagatcttggtattattagaggaatccgtttgatcatcagagtctttgtagccaatgatttcaatttccttaaacttaacccatgcagaatcatctaggtagtagcctcttgattgaatattactatagtccttgatccttttattgatacggaagtgccaatccagatgcagactcttcaactgtctgcccgcatcatcctctgtaaatcgcttggaacaactggaacattgatttggtttatctcgatacagtgtatcaatttcagtctgagtaggtttgtggttatttatgtaacccgaatctatggccaaagagcctgataaatcattagatgagagtatatcgttgataggacttaccaagttattgctgtgtttactgtttatgttattaattagccctgattctgccagtgagctcaaaatagagctgacattacctccaagaatatttggaggaggggatttcggttgctgctgctggtattggggagccatggatactgactgtagtactcctcccagcacagacattgcatccgaagataatgcaggtcttggaatagcagcagcaggtgttggtgatttaagcttaaactcttcatcttttcgaattccttgaacctgagtatttaccaaagtcaattcttgaggagacataggctgcgaagtgatgatttttaacagatctcccaatatctgcaatctttcctttgccttaatatcatttggatttgaatgcaagcgttgccctaccaaaccttgcaactgtcggagttgttcaatcaatgactgttgagtgatcatcacaggtttgggctttgcaacctcagttaaaaatctatctattttagcaagttggtcaggcgggaacaatggtgatcctgatggtgtcctggtcactttccaagtttcgaagatatgaatcatccgctgtcttactggatcagcaactagactgtaacacctggaaaatagctgatacaacgagtctccaaacatcagattgtacggagacccgacattcttacagatcgagtcaatcaaatacaacgtgtacagcttatgctcaggagccgaagagttgattcgtttcagaatagcttccactatctggtccgcattagccatgttctcctgggcaatagtagtcagactatggatgatagggtgagagttgaacgtcaattccagaagagattgataaaagtcttctcctatactattactggccatcttacaactagattcaatgttgcgttgaatatatgagagggagtggcgttagaaagagagggtatagagtttggtgatgatggttgggttttttcttggtgagttttctgagcttttttctcctcctcgcctttaaggttgcttaccaagcaaaggtcgtgttgcaaccagtaaaactaaaataggtaataaatctagcgcgcaaaatttttgttcagtatatcaagcagttttccagtcatacagccatcagtttatcccatcgaaatgtccccaaccccttccaacgctgacaagaaacaatctggagtagcccgtatattgggttctgcctctgccggtatttgtgaaatcggtgttttccacccagttgatacaatctccaagagattaatgtctaacaacactaaggtcactagtctatctcagttcaacaaggtcattttcagagagcatgccgccgatcctcttggaagaagactgttgactctgtttcccggtttaggttacgccgcttgttacaagattcttcaaagagtctacaagtacggaggtcaaccatttgctaacgaattcttgaccaccaactaccgttcttcttttgaagaaacttttggaaagaaaacgggcaaggcccttatgtctgctactgctggttcgttgattggtattggtgagatcgtgttgttacccttagatgttttgaagatcaaacgtcagacaaaccctgagtctttcaaaggacgtgggttcttcaagattttggcagatgaaggtcttggtttgtaccgtggatggggatggactgctgctagaaatgcaccaggatcatttgctttattcggtggtaatgcatttgccaaggagtacgttttgggactgaaggattactctgatgctacttggggtcaaaattttattgcttccattttcggtgcttctgcctctttgattgtttctgctccacttgacgtgattaagacccgtattcagaacagaaattttgataacccggagtctggatttactattttgaagaacatggccaagaacgaaggaatcacagcatttttcaaaggattgaccccaaaattgttgaccactggaccaaagctcgtgttttcttttgcccttgcccaaactttaattccaatgtttgacaaggtattgtagggtttcggcaaataagatcgtgttattgtacatacatagagataatagaataatatttccttctaggttcatgcggctcagaaattaaatctggggaaggagagagggaattacagtatcctgtcatcttcttttaaacttctctaactttagcggattcctaaagattgtacccatggtaagcgctgtggaaccagtacctgtccgtgtaagcgaccgtagcgatgatctcatctcggaaccaagcagttttgtcttccgctcattatcaaaagagatttataacactgtacacaataatcaagagacagttgaggaggaatatttctgccccaatttggatacagatctccaccatgagatggctgcattgaagaaagctctgaagcagatttccgagaaattggaatgtttgagccagggagggtctactccaagcagaggacgaccgatttcaagattccaagaaacctccatcaattttgatgctttggtagacagaatcgtaaaaaaggatgaccaatatgcttcttatcagttgcaacaaaaactagaatgccgaaacaaccaggaattagtggaaattatggatagtatacagagatgttctcttgaattgatggtgaatcgttttggaaatttcttgattcaaaaatgctttgaggtattggaaaactcactcattgaagggctgatcattacaattgcaagaaatatcgttcaggtatctacagatgcatttggatgtcatgtagtccaaaaggcgctagagatgatccaagagggccataaaaaatttctagtggaatacctattggaacatctggaatcaacattacttgactcttcagccgaacatgtttggaagcgggtattagagatcaaatgggccatccatcccgaaatggaggaagcaatcactgcaaaacttagttctacattacaatcacgatggttacaggttgccaccactcccaggggaagcttaatagtccaaaatatcctaaccaatttgcctcccaccattcagaaaacttgtttagaagaacttgaaagggacatacctacactgctgaccgatcgtagtggaaattgggtgattcaattcattcttcaacattttgagacatccgaaattcaccaaacgatttttcagacaattttggataattctcaactttacagcacacagatgtattcctccaaagtcattcagaagtgtttgaaagctgaaaggttcaagtcaactttcatcgatccatacattgacgctatctgttcaaccaaaccatcaaaaagacgtaaacctggggccaaacctgtggttatcgagctagcagtggatatttatgggtcgggtattattcgcaagattctagtggaaggatcagtggatgaaaaatccagagtgaatggtttattacaggaacatatggagactgtgtgtacaacaaaatggggtagcaaatgtgcggctgtactttaatacatacacttattccagtaaagatgcaccttcacccaaacgaaggtccctctttcacacaatttggggtgttgaagatacttgacttgggaaccctaagtttggtacaaacgatagtgctgattatcaattgaaagtggcgagtgttgtaatctgtagctatggcttgaagggtgtaggtggtgaaatttaaagcggttatcaggaaatttgaacactataatgagagttcggctccgctactgggggtgtcagacggagtagaggaacttgggaacatttacaaaaaaacatcaatatagctggcagaaagacagttttttaaagcctatactaatagggacctctgattgaacatatgccgagtttataatcgcccaaaagtgacgaatatcagcagttttgacgttccggagttcttctttgcaagagttccgttcaatattcgtgacccgccccaggatctgagtgggaggttttgagactagtgggggtgaaaagtgggcatacattttatagaaaatctaacttagtacagagtgtttactattcaaaaccataaaattcccctcttatccagtaataccatcacatggacagggtccaatttcaccattttccacatgtttatttctaacctttatttgtgggtttaaataccgaccatatccataagatacaagcaccccgagaggttttcaagcgcggccacgcaaaaaacctagactaatatataagcgaggttaaaattcccttaaacttactccgcttaaaaaaacctcaaacaacaaacccgtcaactatgtcttctatcttgaaacaaagagtaagatacgcaccttacctcaagaagctgcgaacccctgagcagtgtgttgagctgtttaaggatggtcaatatctgggatggtctggattcactggtgtcggtgcaccaaaggtgatccccacagcgctagccgatcatgtggagaagaacaaactacaaggcaaatttcaattccacttgtttgttggtgcctcagctgggcctgaagaaggtcgttgggctgaaaacaacatgattctgacaagggctccacaccaagtcggtaagtccatatcaagaggtatcaatgaaaaccgaattcaattctttgacaaacatttgtccatgtttcctcaggacctgacttatggcttctacactaaggagaaggagaatgatctcttagattacaccatcattgaggcaacggcgataaccgaagatggttccattattcccggccctgccgtaggcggttccccagaaatgctgtctgtgtccgacaaggttatcattgaagttaacaccaagactccatccttcgaaggtattcatgatatcgatctacctgtcaaccctcctttaagacaaccatacccttatacttctgtggatcaacgtaacggaagggtagccattccagtagacccatctaaagtcgtagctattgtggaatccactgaaaatgataaagtgccacctaacactccatccgacgccatgtccaaagccattgctgacaacctgttggaattcttggagcatgaagttaaggctggtcgtttaccagagaacttgcatccattgcaatctggtatcggaaacgttgccaatgccatcatcgaaggtttagccggcggtaatttcaagaacttgtctgtgtggacggaagttttgcaagactctttcctcgatttcttcgaatccggtaagctggacttcgccacggctacttccatcagattgaccgagtctggatttgagcgtttgttcgagaactgggacacatactctcacaagttgtgtcttcgttctcaagttgtctccaactccccagaaattattcgtcgtctaggtgtcattgccatgaacactccagtggaagttgatatctatggacatgctaactctaccaacgtcctgggttcccgtatgctgaacggtttgggcgggtccgctgatttccttcgtaatgccaagttgtcaatcatgcataccccagctgcccgtccttcgaagaccgatccaactggtgtgtcatgtatcgttccatttgcctctcatgttgaccaaactgagcatgacttggatgtagttgtgaccgactatggtcttgctgatctgcgtggactggctccaaagaagcgtgcccaagagattatcaagaactgtgcccaccctgactacgtccctattcttcaagagtactatgaccgtgccaacttctactgtcaaaagaagaagtctcttcacgagcctcacatcctacgtgatgccctgaagatgcatttgaactttgaagatttcggaaccatgaagatcgacaactgggacaagaagttctaaatgaagctgtaaacaaaacgaaaaaagaggtttatattacattttaaactctctcctctcctcttgggaaaattaagggtttctgatgaccaagctcctcagtgcgggccctctttcggaagaaggcaaactagtttgcctcagataaaggaggttcgacccgcgactgctgataatataatcttagcatgtgatatgtattgaataaggaatgtagagatgcaaatatattcttacttttatcagtaaccaaccatctactaatgtcatctccccataggaaaagaagacctagtcttgttgaccaaatggatacgcccgtcaaatcggatgtcgaggattcgatgagtcaaactgttcggggctggctggtggttttaccttcggtcttattagtcttgtttgaaggactagtctcactgattacagctaatttaccaaagtttgttctgcgccagtgcactgctgttgtcaggtttctgttcggagtggcaggcgacaaaggggccaagctgaacggtgatatcaaatctaccgactacctgggaagaagggagttgctacatggagctttagacatccatgagatggctggggtattcaattttaccattgaggaccacattgttcagaccgacgataattatctcttgactttacatcgtttgaatcctgtgagtcatggaattaggccgaatggtagagtgctctactttcaccatggactgttgatgaatagtgaaatttggttatgccgtgaagacgtccatgagaatttaccgttgcattttcttctacaaggttatgattgctggttgggaaacaacagaggaaacaaatatagtggaaaacatctgaaatacaagccgtctcaacgtgagttttgggatttcagtattgatgagtttgttagatttgacataccaaacaatgttgattacatcttagagaccacagggaaggaaaccgtctcctatattgggtttagtcaaggtacaactcagattatggctgcattatctgtaaacgttgccttgaattccaagattgacaagttgtgtgttatatctccagcaactacaccaagaggattgaataatgggttactcaattcaattcttcacttttcacccaacttgatgtatctattgtttggcagaaatatcctgtttgcccatgccggcctgtgggcacaggtgatgtatcctaaactgtacttgatatcgatcgatattgctactaatttcctttttggctggaagaacgagaacatggatgaggcagataaatatgtgagttactatcatctttactctaccacctcagtcaagacggtcgtccattggtttcaaatcatgaatggtgcacgattgacaatgtacaaagactcaagcagtcttggtgctaatttttacacacccgaataccctactagaacaagtttggctgtgcccactataataatatatggaaccggagattccttagttgatatagaccagattcgccaacagcttcccagaaagtatcttaaaaaggtggtcggactggagggttatgagcatttggacttaatctggggtagacgtgtaggcgatgtgataaaaagcgtcggtaagttcctacattacaatgaactggatggggaaagcggaaaatccattataataaatacataaataaagagtgcttgataccagtcaagttctctactgttcgtttcccaataaattcggtgataatcttatttcattaacaaaaagctctgtctaaagcacttagagctcgtccatcctcatgcgaaacgtaacccggtgctctcactggtggagctaaatgctgcattggttgttgtggtgggaaatattgttgctgttgctgctgcacgtatgggataggagtgatagagtgtgatctggggagcaggaaggtattctttggggttggatcgtcgagatacgatctagggaccttgtaggcaggaagcgtcgaagccggagtgtgcaatgcaggtagagtgatcacttggtgattcatcatcatctgattctgtggaggaaagcgcaagacaccagcggtaccagtactcaggtgtgaaccaacagaggacgctccacctcccatagttgaaaatgcagtagtggagggtgtagtagaggaagacactggcgaaggcgactttggcacactaatcactcgttcatcagtgatcctacttgcaacacgtttgcttttctttggcttgctaactccaccgctgttagcggatgttgtgcttgaaattggagaagatggaggatattgtaatgtgtatgtttcgttcaaaacagtctccggatataagtcggagttaaggtccaaagattgaaatctgtcatcttcagatggtcgtttcagcagcccgtcctgtgtcatatcagagctagagcccgacagtgttcccacggaattggacatggggttcgaagaaactgacttgtttgacgaattgggacctgacaatgtcttgaggtaagtcgcataaacatagcttatcaggtgcagtttctttccgtttttcagcgtaactgagaaactttgcttcaataggccgttgtccttgtatctgtaactctctgactgtttgccgtaaatgtaagagtttgaattgccactctttgcattttccatctctttgtatgtcaagaacgaaccgcttactctagaagcagaccaggatcttccgtcagtccatcgcttcataccactttctttctcatcccacacaaacacagacccatggccgatttgagtttgcctctcaaactcagttagcctacgtgtaacctgggggatcattttcttgagggcggcgtcaaccagtataatggcgtcttttggagtaactataactccgtgataagactgcattctctaagtacctgtgctcttaaaagaaggactaaaaacaaataagcctagctgaaggtgatctaaaagaagaagaaaagaaaaaaatgcttagaaatggttccgcttaaagtttaagtgaatctaaggtgccctactttatttaaagttttcttttttgctccaactactacgcatgactcgatgcacttgcgcgcgttgtaaattgtccacctaatttccctgcattcttatcaaaacaataaggtcatatgtaaaacgttctggaaattactaagagtggctaagctaaattagtctagagtcaaaactgtttcggcttttacatgtgcttaacgggcatattcggggtcgaatcgcactaccccatgttcgcaaaattgtctacttaacgagacaccgtctcacgtatggccaggtggctgtagaatctacagaatgtgaatttagtcttgtgttgctatttcagtctactcggctagacgtatttccaagcattagccaatttttgcaattttataatttgcttttcttggtttcctgtaagccaagactggtgtgttttttacactatttgcaaccttaaaataaaaactcttggcggcgtctcgttgtgtggcacacagttttttttttatcttttgaaacctaaacacacgagcccggactgatcggccacatcggttgcgcagtctttcttccttttttttttatgtcaacactgcaataacgattactcatgcccccaagaagagacgccagtgcatctgagtcagagtcaagacgaccacattcatcagctccaaagcagacaaagtccagatctcacattactcaacaggtccagaaagagttcgttgcaaagtacgtgaattcaaacggtccaaatgacagaatattacccgatcccctagatttcaatgagtatccaacgagcaatttaagaaattacgcccgtaaactgattaagaatgagcaaattccagattgcaaaacagtcttcggctcgatgttagaaagcaagataggagaggaatccttctcctacaagaagaaccatgctcccaacacatatcgtatatcgaaacctcaactggcctcgatagtccatcagcatttcgtttcccacctccctgtcaaggaaagtgatacgataacgaatttcatatacaaagtcaagaatcaggataaatcgttcaaactgaacattacatgaaacaggaaaggaaagagtatatataatgtatgttgcatgcttagagtaattaatgagatacgattcagccctgagattggcacctctttctggcctgttcaatcatttgctttcgttttagttccatattgcgggccctttcttctttagtgtctgcccagccagggttttgcagtttcactggttctggtttctgttcagcttccttcattccactcttttcgggctttgcttccctaacctgctccaacaacaactcaaccgctctctcaacggaacgtgtcttattcaacacctctcgaacgtcggcatctttggcctggggaactacggtcttgacgacttcaaccataccttctgacacatctcttttactatcggcagttgtagccgttctcttccgactttcaatcgcttctttgatctttagctctgcatctctagactctatcagttcaggagggcgaacaaacacccttagaaacacaaaggctgctaccagagagactgcaaacgcaattgtcgaattatctaccatagtcaaggtgttgtcgtataattctactaataccgcgatctcgatctgtccgaatggcgtaagcggagagcatgtttctgcggaaaagatcctcctatacgcgctatacatcgatgccaacactggaacaaaacccatccgcggatgcaactatcaacgtcttcccgtcactgctccacgtcaagtctgtgattatggcataatgaatattggttaccaaggctagtggtcctgtttgctgtgtgtcatatataacaaccgaatcttgggttgcaacggccaaaagcatcctatatggtaatgaaaatacgctctcatcgggcaaccctggaattaaatctagtttaactggagaaaatcttaccgcaacagctggttttttcaatcctggaagatgggctattggggcctggctcaaactaccacgtccatagagataaactgtatgggactcgggtgaatcgtcactggacttgaatatgcccgcaggcgtcgcaaggatgtttccatctggagaaaatgccattcttcggaaaaatgattgcaatgtttcgttgtggtataatgcaattgttctcttattgctgtctccggaattggctaactctaaacgagacaacttagccatgctcttcacactgatctctccgctagtgcttgctgtcacacgattaacacatatcgttctgtcagcgctttgtgatactacaaactcgttcagaggatcccatgcaactccttgaacatagtgattgtgatccccaatcgtggcgacctgtttgccagttgatgcctcaaacagtcttaccgtactatccattgaacctgccagaatatattttgaatcgggtgaccagcaaagatcatatatttcactggtattgcatctgcaagtaatcttctgaatccaagattctttgatgtcatcatcatcctgtccaaactctaaaactactcctccttcactcgaaagtctccatattaataccaccccatcatctcctccactggccaaatattctcccgttggatcaaatcgtacacaattcactgcctgtgtatgtttcgcaagggttgacagatattctaccgagcttacactttctctatcttcattgtcctcccgtccgtagattagtctccatatacgaacgtttccatctccaccagcggtagcaagccgcctgaatccctcaactttatcctgctgaagatcgcagctatatacaggttgattgtcgtcgtgccaatgaactgtcagggtctttgctttgatccatcgcatgttgttggagaggatccgatggcagagtcgcgtttccttcttctttcccttttcagtttgactcgacatcctacatctttttcactttaagatatcctttattccccacaacagtgtttaccaataagagatcgtccatcacttgccagttggtgatcttgtcacaatctaatggcttcacaattgcatcagtatgtcgggctatcaacaatatagggctcttagtcaagctaggaagttctttgtctcctaacaacttgagagcatagaattgatcatcaaacgacccataatgggaaactccaaatctaatctgagctcctatccccccaagagctttgattgcactctgggaattgttcagggaaatatagatttcctcacactcaaacactaaactgtcagtatcatccggtagaaagtctttttggttctcaatgcaatgcttcaaaacttctatccttgtagtttgagtcaaaaaatacactgtacctaacaacgactgtctaacggtcaagcaatctaaattttgatcttggaattctactagtcttcggttgtgttcatcaatgaggttctccaccaattgtctttctatgagtggatccagatgtgaatataaacggggagtaatcacggtagtgccatcaatcatggaatctccattattcgaccatttcagaaataattggtccattgaggttaaaaattctttatcccaatcgtaaatgttgacctcttgacacatgctatagtagtgtaagaaatccagtacgacgatcttcttaaaatcagccgttggtatatgctttggtcgggtaataatagcatctgccgctatgtcttcggaggctagtacttcacgtagatcgttgtacatttctgcgtctcttaaagaacaaatcaatacgcacacagtggtatcactttgcttggaactcttcattaactcccgtataggaagagaccaacaatccttccatttcttattatctctgacagattcattggtataacagctccaggcttcatgaaagttccaccagtcaatatctcttagccctgctcctgattctatcatatgtatcgaactacgacggaacagttcatcatttaaaactggggatttgaaaagagtaccatcaaactcataaaaatctattattttcacaattggagcgtatggtagttcttcaacgtcaaagtcccaacgagatatcgggtccagcacaggtcgccctatttttgatgccaagttgatcttatcttcatacaatttaacactaaaggtatccagttcgtattctgttgattggtgagctcgtattttctctttagttgtgaccaacgattcttgactattattttcattaactacgatttcagacaagacatccctctcatgagcattaaattccaacttggggtcattttcatactcacaaagcattgatcttactctaaggcaaggtgagttttacagtatcagttattatcagttaccagtaattcgagcgtctaaactcagtacccagttccttcaagtcaagaagcttattcatggccgtccaactcaaatggccttggcttggtattgccataccctgctttctaatatcttttattggatataatgcccactacttcatcttcaccaattacatgacaaagagaaatcagtggtggttccagttctaccttaccatggtatggatctcctattatttagccatcaagaaatcccctggaacccctcctccaaattttcagccagaaccaaacgagtggcggaaatggtgtcggaaatgcaataactacaaaccagaaagatcccaccattgcaagacttgtaagatttgcgtgttagtgatggatcatcattgtccctggacggccaattgcgttggataccagaatatgccccatttcattcgattccttggttgggtagtgtttaccacttcatatgttcttctgcaaatatgcaaaaggttttactttttttatcagaacagaaacttaccctcttatctgttcaaaaaaacggagattgtttttgcagtgattctgttctttatggataccctggttctagtaaccgtgtctgcacttcttttccgaacactctatcatataacttttactggaatgactactattgaaagctgggagcatgaacgtcttgaagaccaattctatactaatcgattatggaggaagattgcctacaattattaccagttccacaagaaaaagctaccggcacttaaaagttggacaaacatcacgggcaagaatgacgagcgacttgattctatgtctaatgagctagccgagactgaatgcccaacgtcgcccgagtaccaattcgacgatgatgaaaatctagttccagatcagtttactatagatgatatcatattcccctatgatacaggttattggtcaaacctgacaaacacattaggacctatttacgaatgggtgcttccgtggggatgtccccatgggactggctattacttttcaaaatctgatttctatcaggacgatcaattgacaataccctggcccatagatggaaatcacacgttgaaaccagatcaagactcaaaagatacagcaacatcctcaagttaccagttatccccctacaagctggatgatgagccatcaccaagaaatactgactggtccaacgattttggtgaacgtatggatgattttggcgttgacactgacgtcgaatgatggatgaggctactttgtgactaattgcttaataataaaaccaaattcattcataaagtacaaatacataaagctacacttgaaacaatgaacaaaagctacctacttacttttccttcttccatttgggtgtcttgctcctcttcatttgggattgtatcgttatcagcttttgcttcagacaacgtagactgatcaactgttttatcttgatcaactgaaatatcaacagctgttttgaagacatcttcttgcagactgtcatcctggccgatggtagactccgcgtccactgtgatttcagaatgcttcagtgcgtcccctttggaaccaccttgggtagtattagagacttcagaagttgacaattgggaaacgaaggctttatactcatcaggcccttttgccaaagtttccagaagctttgcacttttgtcacctgactttagaagagattgtaaatgctggagtttttcctggttgtcctttttggaagcaggttgtggctttaaagctgagctttttacaaaatagtcatagcttccttcctcaaagaatagcttataagtatttaggtcaagcttaaccttcaaattagagtttgcaattccttgtatatccgaagacttctcgtcatcctcagcagcgatagcagagcgtaagaatgggatattgatcttacttttaggaacggactcggtaggttgagataaaatataactagtcatgtagtagttccatttgtcacgttcagacttcagatcacccagcgtaagatcctctaaagcaatgaaggtaatttgggttctatcttgtgacttgtcaaaggagatcttgaacatattgtcttcaggagacattaatgatcgcacttgaattcggtaaagaatttggcttctagcagtggtattggaattctccctatcagctgccattagcgtaatcatctccgagttcttggcatccgatacaacagagtgcatatgttttgttaaaccttgtatcaccttgtcaatgctgaacaacttgtaagctttgtttcggtaggcttgtcttaaagattcttcaaaccattgatgttccacatccccttctatcaattttttactcaattcaaggacttgcaggtaagaattgtcaccagtgatgttgatacccatatcttctagttggtgggacaacaaatcaagctccttggcaaattgaacttcatttcgaccttttatatcagcatcaacatccttggtcattgccttgacttcaactaaacgttcgtaaagaacgtttaagtatctgtagagtacgtagatagtggtattacagaacatgttgtacactgtcctttcttttgtttggtcaaaaataggttcaccaaggtgccctgagacattaatccagtcttcagtgggcttggccagcttttcttctacatccgcttgagttgaataggtctctggtgtcggtgaggcagtcgtgctatctggagtagcttcacggacgacctttttattcttcttaagaacatctctcaacaaatctccatcattgcgaggtctctttttggaagaaaaactagattcggtagaagcacttgacaagttgccctcgtcgtcagctaaagaagcgctattcgaatccccgttttcagcttcagcatcagcttcttttgtcttcctacgctgcaatgcatcgtctacttgttcattaggaagcatgaaaaatgtagtgacgaaaaacttaacaaattcggcaagtttctttttgtcctgctgtgaataggaagaagaatgtcccaaaaagatataaaccaagtttatgatatcaaacattacatcgtagtctttatagtgatactgtaactgttctttggaaacaggagttaaaggatgtaatcttttttgagattgttcgactttgattgtactaacttcagccaccaactgtttagtggtgagcaattttttgtcggattgcttgaacgtcaagcccaaatggtccaaggacttgtagaacactttctgctccatttctctccaaactttgttccactctctatgtgatcttttccattcctcatccttctgcttaagacgtttgagaataatcggaaccgccactgctggattctcatgtaaggcatcaataacttcaaaacctctgtctttgtcataaatctttcgaatgaccttcttgtagatggttgatgatgtatgacccaagcctggaggtaacttgaagtgagccttttcttctggggtcatattagcaattctattagcaattgtctctaaagtctggatagttcttaaattagcctccatataatagtcatattcgtgcctttcttcttcgattctgaataaaacctcttcgtattgatttttacgatgtgcaacaaatccagattcctcagaagcccatgttggatgaccaacccattcatcattgagaacctcccaacacatatcatcccttccggagcatggcatataagtttctgcctttggaagtagtctatagcttgggccacaggatttacaaagtgatagctccagttgatgcttcttaaaggtgatattttcaatgtgcagagatttctcttcgtatccgacgaacgtcttgaaccaggaaaatagctctgggaaagctccaataaaacactcaaccttggcaactaagacatccttatcgatgatatcttgagagtaaaggttgatcaatttcaaaaactcattataggtttgcttgtttgaaatggactttttaactttgtcaaaaaatgatatttcttctgataaattcgaatctgatatgcctgtactgacaggttgtggaactcccatcaataaactagcaggaccggtatttacagggcctcttaaatctgaaacagggtactcctgagtttgacctatctgagccagttgctgttgttgatcgtgaggcataccaactggttgtccttgaaaatgagctgctcccaaagacggaatacgatgcattccatgtgaaatcgatctcctttttccacctggtgcctcattaattacatttccattttgcccataagaaggaggagggaaattgccaacaggaggcagctgaatagtgccatggccattgtgtttttcctcatatcctccttgatgaacattcagcgactggcctgaagtctcagggagaaactgttcaaaatcatccaaaagatcaggagcattttgaaataggacggtaacctgttgataaacttcattaattggcttttgttctttttgataagtctgcaagatttctaaaaagctcttataaatatcaggctgattagcaaatcgagttttgatcttgttcacatagctaatagcatgattgaaccctacctgagcaccgttctgaacttgttcagcagacagattaccctggctatacgccacatctggaccttgatgggaaagatattgtgattgaggttgctgcaattgctgtggaagtgacgagttatgaggctgcggaatttgctgctgctgctggtggtgatgttgttgttcctgttgttggtgtagttgcttttccaacatatcttgggatggtaaacgagaagcttgctgatcttgttctagttttggttgagtagaagaactctgaggactttgatcaagctgtgtgtgaggctgctgagtaagagaaacttgactttggccatccgtcattgttacagtacccataggggttgtaactcgaatggcattcgggtttaaagggtccacaaagcactcaatcttgtaaccctgaggcaagaacgtattgaatccctgaataagatttggatgacctctaaacagggtggacactcgttcaatgacaccgggcgtgtcaatactttggctcttaaaatccttcattatttccaaaaaatgattgtacacatccggctggtccaggaagcgaacctttacctgatctaagtaggacaaagcatctttcacatttagtggtctatactgattggcactagcatgtagagcagtcggtgggggcaactgttggggttgcgggttactgtctgcttgagactgagattggggttgtggttgcgaaagaacaggactctgttgagatcctaaatgtggagggggcaacgtagtggcaccattgttatttgaatctttttcctagcaaatgagttagtatgccgacgatggaacaaatgaaaaaaacaaagagtaaactttggttgaaagtaacatacttgagagagtccttgtgggcctatagacggtataggaaaatgagatccattgttaagcccggaacctaaacctgggagggacggcaaagggtagtaatgctggcctgaacgtgttagtaacaattcatcgggagcggctgctctaataggaaacatacctttatccaacgaggaaggtgggggaggtagcactgttggagtcctaatattgttagtaacctataagtcgaaaggtaacttaaagaataaataattgaccaatgttctaggcaaatcatttacttctctatcagaatcacacatactgaaaaggagggatggaattcttgttcaactccttaacaggattgttattggaagaccaggtatccttgcctgacatttttcacagcacctggtgacaaataaacacggaaaaaacgttgaagttgtcttgttgatcctagttgtcttggaggaagctatcagtgatagtacgaaaaccaataccaaaaaaccaaattcgaaatcaagctaccaaatgtagagtcgatctgatagataaaaagttttcacaaatgacactaatcggccttgagcagtttgattctcagactaacaagtggtggaagagctgtctagtccttgactgatggtagaggaacagagacagaacgctgcagagggtaagtcgtccctaatgttgggacgggtaaccccggcacactaattttaagatggatgctggatggacgggagatacgcctaactggtagtctgattgaaagtagtgtgcttgcgaattgtttagataccaaaaatatgattacataatagaataggatgggcgaaatatcaaaattgaacgtcattacaaagtcgaaactcggtaacaaactagaagaacaacggtataatgaatgctccagacagatttgagctctttatacttcctgatgatgttccaaagtatgtaatagagaatatctaattttcaacctcaaatgtcagttaactaacaattacagattaaagattacaccagactctagagtacctaattgtatcatcatcaagtttgaaagagaagaccatacattggccaacttattgagagaagaactagctttgtatcctgatgttacgtttgtggcgtataaagttgagcatcctctttttgccaactttgtcatgagattacaaacagaagagggcactaggccgaagcaagctttggaaagagcctgcgcaagtattatcaacaaactaaagacattggatcacaagttcaacgaagaatggaacattaagaatttttcattgaatgactaaagctgaaatgtatctttcagtgtttttatactacatttgtacatcaggaacaacacggaaaggaacacacatatatttcaccgtacaaaaagccaaaacataagacctctaatatactcaacatcagatcatttttgtcgtattaaacttttcccttttatagtatcttgctgtatatttatataaactcgtcattgcatttctaatttgtttcttagagatgcaatcatgtattcccacttgactgcaaacatagggtcagaagctcccgggaaatcacccttttccaacacttgagcaagtgggtaagtttcgatagttctatgaggggataagtgggtaatcactaggccgttacttgaaaggcagagtttatggtgatctttgaagttgaattggaacgatccattgctcaattcaaacataatacaatggtcttctcgagtatatcttcgaaggaaaacatcatcattcacattttttccggaatgttctgaaacttcacacagatttgctttcatgtatttgctgaagaaatctactacttcgatttcctttttcaggcgagtagggatatcatgcgccagatatctgtgagctgtccatccatatgaattgtcaatgataatgtgccaaagcgactcctcatcgctgatcttgagcaccgtagatccattattaaataagacaccaatatcattggtagataattggtaagaaaagccgtgcttattggagtagtccacccatttgctgactaaaacaggcctttcatggtcgatatctataaattgtttgacagaattaccagtgcggatatattcttgaatagtctgcatgttctctaaggtagaggtgatgttatgattaagtttttcaagtagtattgggtggttattgatgattttggaaacttgttcaattttagtttttggtctggtttctctggaagcaatcacaggagaaacttcctcgtacttctgtttaacgttacttggggataaagaagtaggcagcaaagcttttggcctttcactttccagatcagatttgagaatctgaacgggatttctgtgccattcattgaacccagccttagccttggcagcggcaagattctttgcggattcttctttggaaatatccataacattacggggggtttgagtcaatgattcaacggtgaacgaagaagggaaagagccgtttctaaaccagctatattccaggatttcgtccaagctcggtctctccaagggattggtagccaagatatcctttatcaacacttttgcctgataagatacatctttggtaggattgaaaatataatcattcttcttgatcttttcgtagatgacctgaacatctttggattggaaaggaggcttgccaaacaaaagagcgtacatcatgatgccaatggcccaaacatctacctcaaagctatggcccacggcctttccacctagaacttcgggggcgatatagttgggagtaccacaaatggtgtactttctggaacccttggaaggaagtacggaggccagcccaaaatctccaatcttcaagttcatgtcagggtcaaaaaagatatttccaagtttcaaatccctgtgaattaccctcctactgtggagatacttaacagcgccaataatctgaaccatgataaacctgacctcaggttcagtgagagccttacgagttttcaaaagttccatcaaggactgattagggcacatttccaataaaatgtaaacgttgacatcgtcttcaaaacagtcgataaaacgaacaatgttgggatgaaccatagatttatggatcttgatttccgataataactttgtcttcgttttttccgacttaatagaggccttggccacagttttggcagcaaacaacttaccgctctcatctttcatttggaagcatctagcaaacccaccttctcccaaaaaaagtcctctatgataaccgatcccagttctcgtcctgacaatcgaagggggagttttacacaaagaggatagcttctccttctttttcttcttcttctgatcttgctgttgtgctatctggttggcagtagcggcaggacctggtggcttgagcggcccagtcttaatgggagtctgtacgttgaaggcatttgacctggagttaatttgtccgttattcaaggactgaagcggtagggaaccccgagcacttgccattttgggttgacgaatattaaggaagcttgggaccgtgagttgttaaacttgctctttcgttcacaaagactaaggatatgaaatatcatatataaacccagggtttcagatctgtgtttagctatgtttatctcttgccttttcggtcttatagaactcacgtgatgtcaacaaagacacagaaagggaaacttttgtgggaagaagctgaattcaataattcgagaagtgaatgggtagaatgtctgtcgttgagtattagagttttaggttttcgcgtattttctgttccatgatgttgagatgtataaggggaatcaattcgcggtcttctcactatctttctagaatttttatttcagtttgttcctgttagtgaaggaccaagattctcaattgacttcgaacaattgtcgtcttcttgctaacggtaaatcaagattgattgagccacaggattatggctaccgaaaagagacaatctacgcctgcgctttcagaaagccatgacggcttctctgtgacggaatcactttcaaacactgatgatacctcaatgaaagatgagacatctgattctccggttccccctgtatctccaattaaaacaaagtctcataaaagaaaaacctctgatgaatccgaaaagaagaggaagaagaaaaaaaccgagaaacataagcacaagcacaagagtggaacaaagaaggagagcgacgacgatttggaaacagtgaaaacttccaaagagaagaaaaaaagggtgaaaaaagaagaaacaccactcgactctcaatcttctcaagctatcgaaatgaaggatgaagaagaggagaagtacaaatggtgggaggaaaacaacgacaatgatgaaattaaatggcactctttgaaacataatggggtgctatttcctccggagcatgtacctctgccttctcatgtcaaactttactacgataaaaagcccgttgatttacctattcaagcagaagaagtggcatgcttttttggtgcaatgttgaacactgaacatgcccaaaaccctgcatttcagaacaattttttttcagatttcaagaaaattgttttggagcatggaggagctaatgtggagattgaaagctttgataaatgtgatttttctaagatttttgatcactacgaaactcagaaaagtctcaagaaatctcttacagccgctcagaaaagggaaataaagtcagaaaaagacaaatttgaagaaaagtacaagtattgtcttttgaatggccgtagagaaagagtgggaaattttagaatagaaccacctggactctttagaggaaggggtagtcatccgaagactggcagagtgaagaaaagaatatatcccgaagatgtaagtttgaacttgagtgaagatgctccaattcctcctcctcctgaaggacaccaatggaaagaaatcaaacatgataatacagttgcttggttggctacctggcgtgaaaatgttaccaacactgtaaaatacgtcttgtttgctgcagactcttcacttaagggaagatcagatttcaaaaaatttgaaaaagccagagaattaaagaaatatatccatcgtatcagaaaggattataagaaaaattttagtagcaaagtcatgttagagagacaaatggcagttgcaacttatctgattgatgtttttgcccttagagctggtggtgaaaaagcagaagatgaagcggatactgtgggatgttgttcattgaggtatgaacacgttactttgaaacctcccaatacagttgtgtttgattttttgggtaaagattccattcgatactaccaagaagttaatgttcacgagaaagtgtttaagaatttgagattgttcaagaaatcgcccaaacaaccaggcgatgatctgtttgacagattgacaccgaatattttaaacaagcatttacagaactaccttcctggattatcggccaaagtgttccgtacttacaatgcttctaagacaatgcaagatcaattggacttaatcccgaacgaagggtctgtgggtgaaaaggtcgtcaagtataatgctgccaacagagaggttgctatattatgtaaccatcaaaggacaaagccaaagtctcacgacatgggagttcaacggatatcggataatattagagagttgttctggcaaaaattgagattgaagaggatgatcttggaactggataaaagtctcaagaaaacaaaaccgtactatttcgaagagcttgatgacttatcagtagaagaggagcaggccatccaggatcgagtgatagcaaaagaacgggaaaaagctaccaagaagtttacgcgtgacaacgagaaattgaagaccgaagactctcctctcttaccagaggcaatgctagaagagaaattgaaaaaaattgatgagttagctgctgagtataagaaggagttgaagacgagaaagcctgaaatcaaatcggtcactgtgactgtggaaaaactagaatcccaagtggagaaattggaacaacgaatcagaaacgctactcttcttttgcaagacaaggaggataattctcaagttgctcttggaacctcaaaactcaattatattgacccaagactgacggctatgttctccaagaagtacgatgtacctattgaaaaactgttctcgaagaccttgagagagaaatttgcatgggccattgagtctgcagatgaaaactggacgttttaaaatatcccagcatacaaaattatatacagaaaatatagcataataattcagtacctgagcagacgtttccttgcagatttctctgtattgtgtgaaaagttctgaacatgtgactgtaggttaccgaaactctcaagattatttcacgcattgcagtttgcacttgtctagtggcatcctggccgattgaagtatccataattgcctcaaactaacattctactccactcacgtctcccccaccgcctctaattcactcaccacccatctagattgtccgatagtatcccgcgatcttatttcacaatctgacacttgcacgtgatcgtttcacttttctgacacagttccgaggttcagttcttagtctcggtcttggtatcgcgcactatttccagcccaggaccgccgtttctgttcgcgatcaattgttacgaacgggttggttgtggttatccttttcctcacaaccaccacgaagccacttgttttctaaaggctcattcaagtgaataagagccccagttcaggcctgtttatttcgtgtgaaccttcaaccactcattttgtttgtattctaaaagcttagccaccaattgtgaacggttttgctacaagtgcaatcagtgtgacacaaccttgagtaaggaaaggcggttacaaatcttcctatttcggttttacactgaatttgtttttttgtcgtcttgcgaaattattcattgcttgtcaaataattctcttgggacgtgctgatcatacagtaatatacgacttgcttataaggtaactaattgtgaagtttttgcagcaggttgtttatgtcgtttttttcatttctgtgttgttcatctcctagcaatgatagaaagctcaaatccgaaattacttattcgaaaccactttcatctacacagaagaatctgaggaaaacattagagagggataatatgaatatacgtggaaagccagcaggtccttccaagcctacacagaaagctaccctggtagtagccgctaggagcgatgacaacaagtcaagtgagagcaaagaaactgtaactattaaagagagcagcagtagctccggagaaactaataatgcacatactgatcaagatggagatctagtaatgaaaggatctgaaccattttctaattcgtcttctccgaagttttcttcggggaaattaccaactgttgaaagcgacacagtcaaccaggaatacgaacatgaccttgacaatgaacacaataaaactattaatgaaaatgaggccaatccattatctaacatttcaagtaattctgagctgcccgttttgaataatgatgagtttgactatttatctaatgaattagatttaacagaaattcagcctggtcaggttgtggctagttcgggatggctgctaaaccctgcaccatcgaacttgaagaagaggaaatgtctcattctagatttggatgaaaccctagtgcattcatcgttcaagtatatcaggcaatgtgattttgtcataccggtggagattgagaatcaagttcacaacgtttatgttattaaaagacccggagtggatcagtttttgaagcggtgtggagagttatatgaagttgtagtgtttaccgccagtgtttccagatatggtgatcctttactagatatcttggatcaacacaaatccattcatcatagattgttcagagaaagttgttacaattatcaaggaaattacatcaagaacttgtcccaaatcggtagaccattagaagacttaattatcatcgacaactctcctgcttcatacatattccatcctcagcattctgtccctgtgtcaagttggtttagtgacactcatgacagcgagttaattgacttgctgccatttttggaggatttggccagagacaaagttgataatgtgtcgctagttcttgatgtgaacatctaattaagaagctggcccttcttgcaattctaacccatccattattattgaagaaactcctctctgctcactaatacttgatttttttgtcgttttctagttaattatagatatcaattgttctaagaaataaggactaataataagttactttttgtgaacggttccaacaatgtgtttctccttctctggcttggttacaacagttcctggcttgctgtgttttctctcattttcttctcttctcttcaaggattgcagttcagttctcttaatctcttgagcagacttgatgacttgtgaaagatgcctgtgtcttgcaattcttctaacttcaggtaaagcagcaaacttttccttcaatttgtcgtcgtaatgcagtctagtcttgagtcgactagatttcacaccagatctttcagacgctctgcttcgccacaatctcacgtttccatcgtctgatcccgagaggatgtacttggagtccatagaaaatttggtaacgaaaacatgttgcattcgcttggtatgatagatgtctctggaatgacctttagtggtttcataaattcttatagttttatcatacgagccggtaactagctcttggcctgttggtgagaaatcgacgtccatgactgcagagacgtgatctttgtaaatgtttgaggatcttgataggtttctcatgtcccataagtaacagttatggtcttcagaagcactgacaaaggagaaaggttcaatagggttccaacacaatgcattggagcgcatggaagttcttaccttttgtgtgggagaattagtcctgatgtcgtatagtacaatagaattgtctgacccggtagatgctataacagacgtctctgacatgttaaatttgacactgacaatattgtcagctccccaactaagatcagaaacagggcttttgcgattaacgtcccataaatttatacgacgtccccctgtgacgaaaacatcattttctctatggtgatcgatggttttgaaactatgctctcccaggtaggtcttgactagaccttgcgaagaaactttagtctcttggtcatccgtcaaattttggccatacatcgtttcattatttatgttccacatcttgattgtcttgtcatcaccacaactcagcaacttttgcgagggggtaacacataagccagataccataccataatgggccttgaagctgactatttcatctctactagtcaaatcccaatatttgattacaccatcaccacttccggaggcaaccctgtttacgattttaaagttctttgcaagagtgtaaacaccatccctatgggatttacctagttgtccgatgaaaggttgggcaaacattctttccaactttgtagcagtcaaagctttcgtatattctcttgctctttcaaatggatgcagtgcagggtttaagtttctgggaatggcagactcctcagtgttcctcactggaacataggcgtctgatgacctacttattgtcttgatcttcattatgggatagaaaggactaggtaggaatttttttttttgaattttcgatggatgccggatgtcgaagagatgttgatagccactttcaacgccagttgatggagaggagagacgattggaatatttaggatagccaatagacgttgttcgtatatgtatcttggttagctttgtcagttgctgtagacaaggattaatagttgataattgtatatatatatataatgctataattattcataccttctagagcgaaactcgtactaacattgataataagaatacgtattttcacgtagggaactagcagatttctagaaacaaattttatcttaacttatcacatattaatatatttacaattatttaccaaatttactgtgaaactcctctctttttgctctaagttctttagtaaacttttcattcttctcttcttcgaatagatcatcataacactgataatacttggtgaatagactatcagcaacatatttgatctcctcaaactctctgatacttgtcattgaattgtaatcaaaaaatttgaaaatcatagactgtttggttaaacaactttgatagaaattatttttcacattacagcctctcattctttcggcaaattttccatctgtcaaacagttcaaaaatgccaattgaagctcagcacaattgactagtacagaggcatgtaaaggattttctctcttgtactggctcagctctctggcgttttttagttgttcctgagtcaacggcttcggatcttgtctagaatctgggagcaacggaccattttcaaacaaagctgtctttaccgtaaaaattttatccttgggttctgaaggtagtatttccgattgctcttcggcagttgaatccttgggtaccaaagttggattaggatctattggtctatggttggttaactcactaagatgtttcaaatttgatttgaactcgcgttcacttaaagttggctcttcttgcttcaacagttcatccaggtcgttgggtatcctaaactcatctctagtctgtatttttttagatgtgaaaggccataccatcttgagtaagaggagcgtgggagcgtaaaaattatgttagcgatttagaatatattagatatttactatgaggctttcgttgggttgtggggaaatgaaggagatggtgagtgaaaggacgtaaaagtgtctcaaattttaaagaatcatatagaagttcgatctattatcccttcataaacctgacctactagctgatcatattccggccagatattaaactctgcagtaatgggatgacgaacagttttcagttcctcatactttgacagcaataaaagcttgaaccgcgtagccagagataatagccttaccttttcggttttatcaatgaaatctttcttcgctgaaggtgtggagactgtgtcttgatcaactagtacaattaccacgttatccagcttcgcaaccagtgctaatagctctctcaactcatctacacttgaaaggggaaatttttccacataatcaatcaagtcgccaataattcttataaaataatgaggttgtccaaataaatcaacagatgaggcatggttcaaactcgtggagttacgccctagaatggctgagtgaaaaactaccggaatctgttccactctaaaaattgaataccatagtatggatatagtctcatttatttgcctaatcagttggcttaatgtgtatgtggagtcttcttctgaaagatacttgatgaagtttctttgaatctggagtaacttgtcatccacgaaactaatgaatctactttgttgtgtgagagataatgctggacccaaaccagagggaagtttaaaatccaagacaagttcctcggttaaatcttgcttgaatgtatcggacttgtaaacgtcttcctctttgaagctcttgtcttgctctattttgatgggctcctcctcatcatccgaaagatcggggttcaattgaagctcattctccaattctcgaggaatttctctaatgtttgtaaggtcaacttccgagttggcgttgggatgtggaggcgtaatcggagtggacatttctgatgtggaggtgttcaatactaagggtagaaaactggagtagagttccctttcatacttgcgcgggtacctctgtggtggtggggagaagtggagaaagaagttgcgtgataggtaaacggtttacattatatttttgacatttccgcaagaaataacttttgatatggagcagccttgagctactctccgttggaatctcccaactgggcatgatcaattactacaaactcttattcataaatctccttctagtgaaagcaagccaatatttggatggcttggaatcactttcactgtacaatctctcaatcaatcgagtggccagttcttgcctgaattgctggacatagcctcggagaaggtcagcttcggtcttatctcttggtggctgataaagagaattcaaaggaaatccgacgtctcctgggatcgaaaagtcatccaacgagagattgcttagaattctaacggcctcattcttggtagtattcgacttcaattgctgcaaacagctagaaatgaacaaaattccgtaaatcaataacctatcagcaggtcctttgatctcaaaatttttgaaaaatgagttggccctaaacaaatctagacattcgtcaataatgtcgtaatcagagttggaaggataagctgggcctctaaacttggttttgatagggagaatgcttgtgttaccaacaactctaaagtcgctgctttcgttaagaaacgtggaatgataagccttacatggttagtacaaaatttcttcttttcctaacacaatggaaaacaataacttactggcattgttgattgaccgtgatccctctttctaaagatcttcggtgtcgtgtatctgttgacaacctagctatccgagaatgtatcggaggtgaggcagaaatctctcaaggttgagagatcgagggaggtccaaaatagatgcttacataattaccgtaaatggtgaccagtgggttcgacaacaacccaagtgaaccaacagctcttcaaaacaaagctctccgcctattctactaggccaaggatttttgtaaccacccccataaactcttatccccctccttttttacctcatttttcaacgctgacctacacttcgtttcattgcttccgaagcccctcttgtagtagcctttactcagtcacatgacccggccggttctcaaaactctctagattcctcagatagatgtcagggcacacacattgccataagccactaccaacactagaagaaccgagctacgagaaggagattcacaatagagttttctgattggtttatcatcctaatttcatttctaaagcagcttgtaattgatataacttttgttttcatttgaagcagcagaccaatctattttggtggcaagcaagaaatacaaattttcccctttccataactgttgatcatttcgatttacggattctttggaatcgacttttgttaagcttccaataatggctccggttcagaatgctttgcaaagagatgctgtctataatgacatatttggcacatctcgtgagccagtcaagcgtcaggagagttacaatgcatcatccttcgatgcatacagaccggatgaacagatacctaccgaaccaagatctttttatgatggcagcacccaccatcctagtggcccccagctccaacagtcccataatcctgattcaactcctcggaagaagcttccgcctcgtattcctccagccatcccgagggaacaagcccagcagcattcagagtctccttataatccttcaggccatgcagcagatattcctgtgcggttgccctcaaatgggccaccgccaccacagaatcatcatttcaagactaaactccctgttttaggccaatcgcttgcggtgctaagaggacagtcttcctcccagtcgcctgcttcacagaatcagcaacagcaacagaatcatcatcatcagcagcaacagccacagcagcagtcacaacaacactatctacatcatcacgagcataacccaacacaacagcgcgccgtaagcgcaggagcatccacatctcaatcagacctttatgcaaagtttgccaatgcttatgctcaaggtaatagatccatgtctctcaattcatcagttcgcaatccggcctatgataagtatcaccagggtaacaaaagtcatgctgtgaatggtagagttattcctcaaaagcttgatatttacactgcccaaaatcactcacaaaattaccagtacactcatcagaatcaacaacaagtgcaatatcatcagcagctgcacaccgagcatcatcaaagtattccccctccatcaaatcaaagatctcctacttctaagtcatcggccactttaaccaaagccaaaagtagaaactctttgttaggatctagatcaagaagcttttcttcattaacgaaacttaccaggaataatcaaagctccacgtctccagttttgaaacaagccacaagaactgtaagttcttcgagtctcaacttgaagacaattgtcacaagcagtaaaaaagcctctgtttaccctgcaatgctttcccgggtggcacgtaaatttcaggaaacaattacacttggaatcaaagtgaaagatggattggaatacaaggattcttttactggtgttgaagcagttgatgtcatttgtcgacttatccgaacgacagataggaatctagctttactattggggcgtgcgttagatgctcagaaactgttcagagatgttacctatgaacaccgattgagagattcgaaaaatgaggtttacattttcaattccacaaacgatactgacttctatcaattagcggcgcaaaataaggctaataatgagacgacaacttcttttagcgtttcggtaactaactacggagaggttgagcagactaaagtcaatggggtattcactttacttacagagtgttattcaccaacttgcacccgggacaagctatgctatagtattgcttgtcctagaaggctagaacaacaagctcgcaataatatgaagattaatggtgatctaatgagagcagattctaagatttctatgagtggagaagagagcaagtcattcttatggtccaagactgttagtcaagccgcattagatgctgttgacaaggaagagttaaagaaacaagaaattgtttttgaaacgattatgaaccaaagagattttgtcaaggacttggattatatcaagaagttctggattcgacctcttagtgaatcgtccatcattagagataaggaaagggatcattttattcgaaccatttttcatggagttaacgcggtttatcaagctaatctccgatttgcagatgcactgacaaagcgacaaaaggaacaagaaatcgtcgaacgaattggtgatatacttgttgaatatatcccatcatttgaatcatttattgagtatagtactggctacaacattgcaaagtatgaattcaagagacaaagggagattaatcctttgtttgcccggtttattcgggaaactgaatctttgaaagaaagtaggcggctagaatatgatggatttgcagctaaacctttgcaacgtttgcctcgttatcagctattattaaagaacatcatcaagcataccaagaaggatagtaaggatatggaagatttgctgaaggctcaggatatgctgcagaaattggttgtgcgttacaatcaggaatatggacatgcagtcagtagatttgaaatgctgttactcaaagcaagcttggtatttagagctggtgaatacgtggatctaaagttggagaacgagaatcgaagatatttgcacaagtgcgaattgaagaaacgtaactaccaagataaggaaaaccaaggtattgtagatgtccacctgtttgatcatgctttattgtttgcaagaaagaagatgacaaacaagaaggagcaatataaagcccatcagagaccaataccaatcccactattgtacatttccatgtcagagaatgcacccacagtgaaacagattcgaaaagctgctgctagaggtacagctctggtggataatattaatgctccacttcctgtctctagctcgtctttgctggcaagcgacaaagtactctctagtcagggattatcaaggattactactgcaagtacaacaaccagtattggaaccaatgctgaagattctagtacatccaacgttcaaagtagtgcagtgggcttaacacagacaggaaacttatttgtaacaaatggatcccctgttgctagcgcaagtactagtacgactagtatgctagaaattgccaatccaaatgatgatcatttcaataattatggttctaccaaccataataatggaaagttccctatcacattcacgtattttggaagaaagggatatgaattgactttgtacgctccttcaaaacaggcacagaaagagcttgttgaaaagattgataatcaatatcgaaagttgatccaggataatgacattttcacattgacaccactgaaggagagattttttgactttagtaatagaatcaattgtgttgttccatgtgaaggtggaacgcgtttagtttacggaacagattcaggagtttattgttcggacattattaacaaacaggatggaagaaacagaatagtgactaagccagtgaatatcatcaagaaagtcaatgtgatgcagatttcagtgttggacaactaccaaactgtattaatccttagtgacaagaagttgttagtttggccactggatattttgcagaacgtacagggatgtgatccagtgaagaatgccaagtcaggtaaggagttgatgtcccatgtctcattcttcagagtgggtatttgttccggtacaacgttagtttgtgctgccaaacagggctcctcacacttgatcaaggtatttgagcctttaaatccgatcgaacaaagaaaggtcaacaagaaaaaattcaagaatgagactagggatttccaattcagcagtgaacctgttagtatttcatttttgaaaaataagctatgtgtgggatgcaccaaaggctttgagatcgtggatgttgagaatagagtaactgaattcttgctagatccggcagatacatccctagattttgtgattggtaaagacggactcaagccattgaagattgatcgtatcaactacgatttcttactgtcgtactcagatttttcgtttttcatcaacaccagtggttggaagagccgaccccgatggatgatctactgggaaggagtacctcagcagtttgccatctggtatccatatttggtagcctttgaccctggattcatcgagatcagaaatgtggagactggagatttgctgcgaacaatcatcgctgataatataaggttcctgcattcgtccacacaggagatcctatttgtttatgaagatgagaacggatttgatgtagttacgtcactagatttctggctcaagaggcacaataagggcaagaaattgaagaacgtcaatgaataggaataatgattaaaatatatatttataactaatactttattttccctcgtatagcgtataaatcccagatgcgaggaaacgagagtgttttattttttttttttttttccgtctggtccgttgctgatccaacgacctcgatcaaagtggagcagattcttcttttttttctttgcgttgacatttgtttccggtagacccaccatccaagtaatgagtgacattaatactctgtcgcagaagattccgtcgtatgttcaatacggtattcccagtattgatcatccttttggaatccgtttatggccaattttcagtcatttctttgaagcggttgttggatacccggctgaagatttccgctttattcagggtctgactaccatggccaatctaaaagacgccctcggtgttattgctgtttattactttgtgatttttggtggacaatggttgatgaggaccctgaacgctcgtcctttcaagttgaatttcttgtttcaattgcacaatttggttttgaccggggcgtcgtttaccttgttgatattgatcgtggaacagttaatcccaggtatttatcgccatggaatattttgggctatttgccacaaggattctttcaccaacgaacttgtcacgctatattacctgaactacttgatcaagtacgtggagttgatcgataccgtgtttttggtcctgaaacgcaaaaagttacttttcttgcacacttaccaccatggtgccactgcattactatgctacacccagctactcggacacactgccgtcgaatgggtcccaattgccctgaatctggctgttcacgtcgtcttgtactggtactacttcctctctgcacgtggaattcgtgtatggtggaagcaatgggtgaccagattccaaattattcagttcttgatcgacctagggtttgtctactttgctacctataccttctacgctgacaaatacttccccgagctacccaacatgggaacatgttatgggactgaggaagctgctgctttcggatacttgatcctcacatcgtatttggtcctattcattctcttttacattcgtgtctacaagtccgggcccacaacaagcaaggggaaatcaaaggcagctgctactaccggtcaaaaaactgagactgcctccccttctggcaaaagcactagtgtccgtcgtgcctaagttataaaatatagaataaaaaaaatcaagttcgagctttgttgtttgtagtgatttgagggttttcaaacctcggctctatttctggcaatgccgagacatacctgcgcggctctgggcagattccgcgaatctgcggtcaaagattgcctttcgaaatatgtggtatgcagcgtgaaatactgatccgaactacttttgagaaggaccacggtatgcaaaagctaagaaaaggtcccagtcttcccgtttaaggtttgagctgtagggaggcaataaggtaaacttgtgcaatcatatttttcttcccctcagtgtctgtttgccacctgccttagtaatgttttgcacgggtccggaattctccagcacagccgcgcacctgcatataatcccgaaaggcacaagtatgtattgtttactgatgatataatgtcaccagccgctgcggtatgcacctcacactgtttattcgtcctttctttttcgctctcgtcacagtatccctgtaaaatatataacttgcccgaaagtataatctgatgtctgttatgaatttccataactccacgatgttcatgagccaacaacctaataactcatatcaactccctccattgttacctccaccgcttccattggcatacgcgtccgcccccaatcacccaggacatgcgatcccctatccaataaatacaattccgtcaactcacccgacgacaacaacaacgactacgatagttcccccaaacaacaacacacttactctcaggggttcgccaccgtacttcgatcatcttccccatttcaagcatgtactaccgccaatttccctgccgatcgtgccccctttagtgccagaattgcaccctgttgaagttaatgaccagaaagtcaggaagacgaagactcccaggaaaaagcgccaatgtccagaatgccatctttttttctccaacctggcaacccacaagtccactcacctatccgtgatggcaaggcctcatctgtgtcccacttgtcacagaggttttgctaggcccaatgatctaattcgtcataaaaaacgccatctacaagatttgggagagaatggttacaaatgtcccttttattcctttgacaacaaggagcaaggcccagaaaagtctacaacaccaaagtgccattctaaaggcgtcttttcccgctgtgatacttacaaaaatcatctaaaggctcttcatttcgaatacccaactggaacaaaaaaaaggatcggagttcggtagccggtcactgtaaaagttgctaccaacggttcaataccctcgatgagtggttaacaaaccatattgaaaagggacaatgtcccaatatgcacttggagaatctacataagtaggaaaggcgcaaccataccccaatcatcgagcaagttactccggttttttggtattcaaatcggcaatcctgaaacgttgtgtgccgatcttcagtatatgatctgcaactcccgggtaacacggaaatagttactgttccagttccgttctcgggttttcagcagaatccaattgacacactaccaacaatagtgtatccatcgagaaactaaatcaccttcactctcatactaagctacattttacacaaggggatgaatgataaatgatctcgtacaaacaccttgaatttcacccggagaagcctacggacaataacgagattaaccaaataatagagctggtcaaagtgaatttgtcagaaccatattgcatatacacataccgctatttcctcaatcagtgtcctcaactttgttacatagcatatgacgatgagaaacctaagggacagaatatcattgcggtttccatctcgaaagctgaaactcatcaaggcgtaagagttcgtggctacctcggaatgatagctgttgatccggcttatcgtggcaaaggcatagcaaagactcttattgataaatctattgacgtgatgattgattcgtaccactgtgatgaaattgtgctagagacagaggtagacaacccacaggctctcaatttgtatgagtcatttgggttcattaggactagacgcctttttaggtactacctcaataagaacgatgcttatcggttggtcttaccattgactgagaaatcaaccataagaacatactttttataaatgacatgactgacgaagtaagaatttatgtatatattaataggaaaaactatttagttactttcgtcaaacttaggagctaggtaaaacctcaggtacccacttggaagcttatattcaaacacccccggtgactggtccgttagcttaatggtaactttttgcgataatgatgtagcctttataatatcgctcagatacttggaaccaaaactcaaatcgattggtttgtccaaactaattgtaacagactcctcaggatggtcaatgtcagtctttggtctgattacaatgtttcctgttccaatatctccaacactctggaaaagggcggagtctttcgttacgatgatttgtagagattcactcaacactttcatatctttgcaaattttagcaaaatctgcagaagggagcgtaatggtggcatcagtatccataggacccacgtctaataaatctgcatcaatatctaatagtttcaagttgtactcactgattttgtctttgactttgtcttcgaagataatgtttaatttgtccgcatcatcgtcagcagaaatagttaagtagtcgctgttggctccatttccaatgattttactcaagctacccagaccaacacctagagtgatattacgatcacatctgtactcttcaaaagtatccttttcaatcaatagggaaatcaaaaggacacgagagttgtcgactgcttggacagaaataccgttttcagtgcagttgaagttacagctactgacacaatctttcatggcctcaacgatctttttcaacaaagaagcttcttcaaactttccttctaacattcttttggtattagtatctggcaacgagagttctagagtgcactgtagagaagaaaagaaagaccaaagtgcgtgtcagctaatataacgcgttggtggaccgcgaatgattttcgggtcaactatcatcaaccatctaacatctactaatcattagtattacctttaaccaattaaatacatattaattctttataacccacctattaacggttcaatgggacccccatatctaggccaaagaagaaatcatctggctgctcctctgacaaagttccagtttcattattacctggtagatttccattttcacctatattagaaggtccagcaaggatgtcatccatgacaactgtagctaccggtttcatcatcggcatatcaccaaattcttcgtcaagccttgttagagtagcgttcgtttttgtattgttcagctggaaccctaccaaggaatccgtactgtccatgctgcggaacgaacgttgagaggaaagacttggagatacagaaccaggaacttgggctccaatactaacggagctggagctggaatggatactattagcaggttttggagctgagtacggtgtaaactgatgcatcaaatggtgatggtgatgatgtccatgatggtgtggtgcatggctggagtaggtcccggattttgagctaatatgactcgaaccagttaagttcgcttgtaagttagagggaggggatgtgtaaggttcataatcgggggtaccaccagggccaattaaaggatacagaggaaaaacttcctcgggaccaaacgaagcagctccgtttgtgttcgtactcgtattacctccactgttccaagtggattgtggctgaagaggatattgttgctgtttacttgccgtacgggatgaatgtatctccgacttgtaggatttttcctcgttaagcatttccaacaatcctcctgaggaaaagggatacggaatattctgataggtgtttggggtctcttcgttatcgcccgcccttctagaggctcgagaggcacttctggaagcttcacgagaagccgacgacaatgcatcatccagcttcctatctcttagtagatgattaaggttctggtccatggagagtagtggttgggtatactcggtcaaaggaactgaaatctccccggcatgtttcgtatcgtccccgactctatgaaagttatccaactgctccattccaacttgacgaggcccggatactgcagatccagaactcatgcttttctcgacctgggctaataaattagttgacgacggatattccattatagatgttgagacggagggcgagagtcccatatcccaagaaactaactcggaattaatgggttgctgttcaaggaacaaatcgtctccattctttgtgtcagttttcagtttgtggccagggtttttagtcttatcctgctcatctaatttttcttttccggtggtgactttttcttctttgggtgacaacaggtacagtggccctcaagtttaacagtgcctacatcattggaacaggcacaaccattttcatggtatttcatctttgtgtttgtcttcttaccgcaagtacacttagcatgatggttccgcaacttcctttgttcacggcaaaatgcacattggctagacggtctccccttaggctttatcattactaacggttgatcagtatgagtacaagcagacaccctatgtccacgaatacatcgttcacaggcgtatttgacgccgtttataagcaccatgcttccactggcggtgacactattaccagagtttatttaaacgatttctagacaagcaatagctgtcaacagtgtagaggttaccaagaaaggcttcttttttaggttcacattttcaaccttcctaggcaggacatttattgcctaatgcatagcgcacgacctccgagaatgctgtgaaccaaagcggaaaacaagcccagggatgcatgtataatagaaaatgcctgtttcgagggcagaggggagctatctcccgctgattgtgtgcgccgcatgatggtcgatagccggtagccgtttttgccgcgcaccaacaaagtcgtctccaacactaagctccaggaggcgagggaaagcgagtgaggcaactgggctgggctcctatcataaagctagcaacattttgtcatcttacgccttaagtaagagtacttctccttcgcaaatgaccatcaaaaaagattccaatgttgccaattctcccagggtatggacaacgttgatcaccaatacggcgtaccttccagggctgctgaatctggactattcactgaaaaaagtagggtccaagtaccctttggtggcgctatacactgatacgtttggccctgaggggcacgccgaactagatgcaaggaatattcccaaattgaggattgaatacttgcttcctctggaatccaaggactatagcaatgataccaggttttacgattgttggaccaaactacaaccattcagtttagttcagtttgaaagggttgtccagatcgattctgatatgttagtggtgcaaaatatggacgagctgatggagttggatcttggaaactatgactttgctgcaactcatgcttgtgtttgcaacccttataaaaaacctcattatccttccgattggatagctaccaattgtgcgtactctagtgggaatcatcagcaaagagctaaaatctcccctcatttgcttgagtttgctgaagaatacaacctagtaggtcctcctgctactctgagtttaggtacctgcaatggaggccttcaggtagtcaatccttctaaagaacgttatgaaaagatcattagtgccctatcggccccagaaaaaacctctaattatgagtttgctgaccagtctttgttgagtgacgttttccgtggcaactggctccctctatcctacaagtataatgccctcaaaactctcgcaacgtttcattccgatttatggaaaccagaggaggtgaagaatatccattacattatcaccccgaaaccttgggatgtcactagtaacgacgagaagttccaggatgatacaggtacattcgtccactggtggaaaattaatgaacagcgtctagaagctgaacgacaagtagacaccaccaatcagtcttagaacattacataaccaaaaatcaatgagatatataaacttagaaacacttgaggtgcacaatggatggtccagattcgtcgtactcttgctttgagatccacatttgttggaaagtacccaaagaagcgaggatagaaccaccgatccatacggagtactttctttctggtggagcagaaatcttgaccttcatcgaagatggagccaaggcagtaagctccttttgcatacgctcagcaatacctgggaacatagtagtaccaccggacataacgatgttactgtagagttccttacgaacatcaacatcacacttcatgatggagttgtaagtggtttggtcgataccagaagcctcaaggccaagtacagatgggtggaacaaagcctcaggagctctgaatctctcgttaccgatagtgataacttggccatctggcaactcgtaagacttctcaatggatgaagattgagaagaagtttgcaattcctggtcaaagtcaagagcaacgtaacaaagcttctccttgatgtcacggacgatttctctctcagcagaggtagaaaaagtgtaaccacgctcagacaagatcttcatcaagtagtcggtcaaatctctaccggccaagtcgatacgcaaaatagcgtgtggtaaggagaaaccggcataaattgggacaacgtgggtaacaccgtcaccagagtccaaaacgataccagtggttctaccggaagcgtacagggacaaaacggcctgaatagaaacgtagaaggctggaacgttgaaagtctcgaacatgatttgggtcatcttctctctgttggactttgggttcattggagcctcagtcaaaagaactgggtgctcttctggggccagacgcaactcgttgtagaaggtgtggtgccagatcttttccatatcgtcccagttagtgacgataccgtgctcgattgggtatctcaaggtcaagatacctctcttggattgagcctcgtcaccgacgaaggagtccttttgacccataccgaccatgacaccttggtgtcttggtctacctacgaccgatgggaacactgtgtgtggggcgtcgtctccggcgtatccggccttacacataccggaaccattgtcgataactaactaaaagtctgtgttagtatactatcatgatacaatattgcctcattaggaaatgaaagatgaaaaaacaagcgcgaggctgcacagtcaacacagaatcctgctacgaaatcaaattctaatcccttcccaacggtaagaaatgggcgcgctaccattgaaaaatcctaaccgccactgagggaagaatcaatcagacagtgacttcgattgactgcgccacatttgctttcatggattacatgtaagggtacttactgctgcaacgtcttctaaaatgggagttagtattatgagcttggattcggcagattgccaaaaggagtggacaaaattggggggacaaacagatacgaaaactcaaccgaggacaaccaacagaaatgcacatgtagatactctcagtaccatgcttccactcaatcaatccgtataaaatgctccaccaatgagatgactgcgtattcatacaaatcaaacggagatcgcatcgaaactgtgtgtttggccaaccactcgcaaatctactgttgaatcaatcggaagaataagaatcgcagaagtcgttgccaatctgattccatgctcccttgctgaaagagctgacttacctccgtccattgtattgatgaatttcttttactaaactgtttctaagttaaaagatccgttatgtaaaaggaagcgaggaaacttgacaagtttcattcattggtttcagtagcatccatggaatcgcgcagtcgctcacaaccattggtgggtacactactatgatgcttctgtaattctcggaggagaatgaaagagagagaagaaaatatgatattacgttgctcactggagattgcgctacttactggacgctctacaagctcagcaatcgtttgcagttttctttatggttatgggctgtcatcatgtagaaacagctagatggctattgaatttctacttggtattataaaaatggtccagattcgcgtatgcgaacttatcggtaggtcactccgaaagtagagctagtagggcttaggaattgacacagccttcttttgattcaagaatacattggccttaagtcacttgtcactaacgaagtaaagaagtaatggaaggcctagcaaaaaccaaaaaaaagtaaacgactcgaatagtgcgcaagagcttcactaaagcttccatgtggcagagcccagtgatagcaatcgagtttatcacctaaaattgtccaatagcatccttgcaagttatgtttttcagctaccttggttcactcgcaaagattctatctgtatctcaccttttgtcctctcttttctagtttctgttgtctcttgctctgtcccttttcttttgacccagaagctggctcctcctctttgaaactgctgcgaccacccaataattgtctacctcctagaaataatccgtaaagcttgtaagcagcaaaagccgggattaccagcgacagataccacacattatttgtccccaaaatcaccagcacgatgttctgcagtaaagtgaaataaattatgtcgaataagtattctgtaagcccagactgactaagatcttcacctgaggagactagtttgggaacagtacgccctccactgaccttttccagtgtgaatcgtggccttccaatcttttcaactatgagctcacagatcactaaaggaacattgaagaaaaaaaacggttttttgtttgatggtctgttcaacagaaaaataatcaacagtgttagagcattgaccccaagagatattagatggatctctttaagaatcttagtgtttttggtggcctgtttcttctctgcgttgccagccattttagatagtaggttgtcgaaaagtatgtaatttttcgtggtagctaggttcggggttctggcaagaaccaacgagcaggcaacaacaccaaatggcaaatacttgctactcagaagaacggcaacgcctcagaatgtatatactcttactctttgatttaccaattaacaattatcttaaactaactaacagcaactagagttttgactgcctccaacggattgacccctcaggttgattgatgccttctcggtaccactaccagcttggttgttcaccatctgagatttgatttgacgagccatgttgaagaatgcttgctcaacatttgtagagtccaaggctgatgtctctattaatgggatctccagagcatctgcaaactccttggcaacagtgtaatccacaaccttcttatccttgagatcggacttgttcccaaccaacaacttcatcactccgccagtggcgtatcggtcaatctcttgcaaccactggttgacgttattaaatgactcttggtcggtaacatcatatacgatgatgataccatgagctcctcgataataggaggatgtaatagtgcggaatctttcttgaccagccgtgtcccagatttgtaacttgattgtcttaccatctagctctatagttctaatcttgaaatcaactccgatcgtcgaaatatagtcctgggtgtaagtatcctcggcaaatctcagcaagagacaagattttcccactccagagtccccaataagcagcaacttgaataagtagtcgtactcgctgttcatgactgctattatctctgtgtgtatgtgtgtattgggcaacaagagcttgtgaatctgtccttataaaagacacccgaagaggcaagattgggtagtacactaattagtggagggcaactggtttaggggttttggctggcttattatagtgtcagcgatactatacaatctacgatgcccgatgtcggcatacagcacattattagatccaaaatttccttaatttcctattcacgttatatatattaaccagaatttatccgttgaattgcttaatcgacttcttccacggttggtccgctgtctccgcctggggcagcaccacctggggcaccgccagctgcgccagctccgccagggaaacctccagggaagccaccaggagctccaccaggagctccaccagcagctccatagaacttgctcattattgggttagcaacttcttccaattccttttgcctgtccttgtactcgtctgtggaagcagattgtgactcatctaaccaagatattgtctcttcaactgacttgttcaacttggcaagatcatcctctccaaccttgtccttgaatccagattcagctgcagagttcttcagagagtaagcatatgattccaagccattcttggcagcaactctctcggcttccttctcgtcttcatccttgaatttttcagcttcagaaaccattctctcgatgtcttccttggacaatcttcccttatcgttggtaatagtaatcttttgagtcttaccggtacccttctcaacagcagatacattcaaaataccgttggcatccatatcgaaggtgacctcaatttgaggaacacctcttggagcaggaggaataccagaaagttcaaacttacccaacaggttgttgtccttggttctagttctctcaccttcaaagacttgaatcaaaacacctggttggttgtcagcatatgtcgaaaagatttctgactttttggctgggattgtggagtttcttgggatcagcttggtcatgataccaccagcggtttcaatacccaaagatagaggagcaacatccagcaataacaagtcttgtgtcttggaagaagtatctccagacaaaatagctgcttggacagcagcaccatatgcaacggcttcgtctgggttgatggacttgtttggctccttaccattgaaaaagtcagaaactaatttctgaacctttggaattctggtagaaccaccaaccaaaacaatctcatgaacttgagatttgtccaacttggagtctttcaagactctctcaacaggctcgatggtggatctgaacaagtcggcacagagctcctcgaatctagctctagtgatcgaggtgtagaagtcgataccctcgaacaaagaatcaatctcgatggaggtctgagcagaagaagacaaagttctctttgcacgctcacaagcggttcttagtcttctaagggatctctggtttgtagaaagatctttcttggtctttctcttgaactcggcgataaagtggttgactaatctgttatcgaagtcctcaccacccaagtgggtgtcacctgcggtggccttgacttcgaaaataccctcatcaatagatagtagagaaacatcgaaagttcctccacctagatcgaagattagaatgttgtgctcaccgtggcctgcatccttcttgtccaacccgtaagcaattgcggcagcggtgggctcattaatgattctttgaacgttcaaaccagcaatcaaaccagcatccttggtggcttgtctttgagagtcattgaagtaagcaggaacagtgacaactgcatcgttgattttctcacccaaatactgctcagcagtatccttcatttttgttagaaccatggaggaaatctcttcggggctgaaaaccttagtctcacccttaaattcgacttggatattaggctttccccccttgttgataactttgaaagggaagtgcttaatatcggcctgagtttccgggtcgtcgaattttctaccgattaaacgtttggcatcgaaaacagtgttagctggattcatggcagcttggttctttgcagcatcaccaatcaatctttcagtgtcggtaaaggcgacgaacgatggagtcgtcctgttaccttggtcgttagctatgatctcaacacgatcattagcaaaatgtgccacacaagagtatgtggtacccaaatcaattccaattgatttacccataatgtttaactttgtttaatttctatgcttctgtgaagttagtcttgtaaactaatggtcgagtaaggggtggaactaggttctccttatatatacgaattgcttcaattcgatcggagtcgatcggcttccatcgaattccatcgaattctaccagagttgtttaagaccacttgtggtaccacatatggttcctgcggctctctttgcggtgtttatcttgattgctagaaccttcgagaaaagtgtggggtgaacaaaaatcgcggaacaaaaacctctcaatcgagtgattgagctgaaccatccgggaggtacaaaaaaatggcctattgttagcgccgcacaaagtgaggcgcgtgagaatttggcgtcatctgaaaagttgtaccaacaagctctggtgaaaagcgttgcctgtatttgctgtgacagaaatggtctcatggaggtaaacatgaaaacaccttcaataatctaaatgaattcttcgtcatatgggtgatcctaaatttcgagttcaatctcattatctggtctttttttccaattctaagtatcctagcgtgcttgttaatagactcttaaatcgtaaatatcccaacctgaatccttgaggaagttggggatggtataagagttgactgatcttcaaatcataactatcaactaattgtttcatgtaaacattctgttgatatcttaatctcagaaacgagatcacggagaataccacgattaattgcctgataaatgaaaagggagccctataccattccagcaatataatcgacttcaaagaggatagcaacaaagaaggaactaaaaataattcacaactagccgcaaggtacatggacttttcattgtaagagctcacgaacattctaatcaaattgcgaacctggtctgcgtttgagactggtagagttgccagcagagtagtatccaaataattcaagaaatgaaacaaagagtaaatagtgaatggatacaacccaccaaagactggacctggatcagtggctgtcagcctgaaaacaagagccagtagcaaatactgaacgttactttctttcaggagggaccgtaattgtgaaataatcattgtgactggcttgcccttgtgtacctgtctaagcacaatgacatatgtgatgatgatcgcatttagtgcattcttataaaagcctaatggagtgtccgaaaatggagatcggaagaaagacgtggcaaatgtcaatgcagtgaatagaatggcaaaggcatgacccaaaaaccagtataactgggcagacttcgctaattgtaacagtccttgtcgtttgggctgaggaggcggcatgctagctgatgcttgtttgtggcagatggttgatgtgaatcgggcgttcaaatggttgtcaagtagtacttcgttcagatgtaatcgttggaacgctgactacaaggaatcttctcttcgcgaaggttgacattgttcggaaggatgctagagcgagcgcccttggagcatacgataatgatttcgaagcaatagattttaacgttcttcttttccgtctacacaggctaatacagtccatccagcatccttcttcaagaaaattcagagagatgactgatctgtcgtcgttggatcccaatatttatacctcctcatcgaatgaggcactgtcaatttcattggctggtaacggaaaagctgtgtcgtttcatcctgactttacgtatcccatatttggcgacgcggaacaaatttttgggtacaaggacctggtaatacatctggtatttgacagcatgtcattgtatccctttttgaatgtcaggtacagtgagaagagagatgatgctgatgaagtggagtccaagttgttggagttgttaccagaggaaactgttgtgaaagatgaagcgttatggcaggacaaaatcgatggagaaaactttgaaatccccggtgaaatattatcaacttacactcacaaggatgaaaattatcacgtatacaaactctcaatcaataaatgtgccgagagccttcaattgcaccgtcgtatgcaaatcttcgtgttattttttatcgaagcaggctcctatatcgatgcaaaggatgacatgtgggagatttatgttgtttacaaagaggacaagacgttcattggatttgccaccggatactcgtattggaagtatcctggccatgaaatcttcgactccgatgcgaaatacctttggagaaagaagatctcacagtttgttatcttacctccataccaaggacaatctcacggaagccaactttacaagacgatatttgaacaatggttcaaggatgaccaagtggcagaaattactgtcgaagaccctagtgaggcatttgacgatctaagggacagatgtgatctggagagactttatcaaagagggttgttggaaacattaccggaaccagtaatctctcccgaatggtttcaaacacagcaagcaaaagagaaaatagagaagagacagttccagcggtgtgttgaaatgctcttattacacgccttgaaatcaaagaaaaacacccgtcttcaaataaaaaagagacttttcatcaagaacagagacgcactcttggacctcgacgaagccaccagaaaggacaaactgcaagttgcttatgaacgcttagaagaagactaccagagaatattggaaaaagttagatttgtcaaaaaacgacctcatcaggacacttaatatataattccgacctacgtaataacctaacaatatgaataataagatagaaacaaccctcccgcaaacataagcaagaacaattggaaacaatgccatacttgctatattgggttattttgattacctcattgggatatcgaatttctagttccaattcgaaattacggtcggaaatttctcggtttggcttttgatgcagcaatattccatcctcggaatggcgtaatgcaggaagcaccgaggatgacggcctcagtcatgttctttcgttttgaattgcttccttctcccaggagactgctataaaaatcaaacaatctctcccccatttcaagttcactttcatcaattgaaaacaaatcatcggaatatgcatagaacttactccctacgttcaggccgtgctcctacggctgctgatgtcaacaaccctccaccacctacctctactaccaagagcaagttctttggtaaaaactccattgcttcttctcttcgaaaaaacgccgctggcgcttttggacctgaattgtccaagaagttggctcaattgatcaaaattgagaagaacttggagcgatccatcgagcttgttgccagagagagaagaactgttgctaagcagttgtctctgtggggtgaggaaaacgatgatgacgtgtctgatgttaccgacaaattgggtgttctcatttacgagattggtgaattagaagatcaatttgttgacaagtacgatcaatacagaatcactctgaaatccatccgtaacatagaatcttctgtccaaccatccagagacagaaagcaaaaaatcaccgatgagattgcccacctcaagtacaaagaccctcaatctccaaagattccagtcttggagcaagagctcgtccgtgctgaggccgaatctttggttgctgaggctcaattgtccaacattaccagagagaaactgaaggctgctttcaactaccaattcgacgcccttgctgaattgtctgagaagctagcattgattgctggttatggtaaggctttgctagagttgttggatgactctccagtcactcctggtgaaaccagacctgcctatgatggttacgaggcttccaaacaaattattatcgatgctgagaatgctctttcctcttggactcaggacaatgctgctgtcagaccgtcactttctatcagaaatagtgaatatgatgaggagcccaacgaagagtgggaagaaaaggaagagggtgacgaaactcgtgacgaaactcaagcctaagatgtcccatttagtattagcattgaacgatgttgatgttgtctgagtatatggttaatacgtaatagctccggggagctaatttaagtctcccttaataattgattctagccaacaattagtgttattgtaatatcttttccttccaaaattccatagttctgtagaggctcatgatcgatagctaccaggttatgagtcgcaagcgtcaatatgccataaaagacactagctgcgatgctcttattacacccagcctcggtgatattgctggaaactagctcttgaaaggtgacttttgaaaacaccttgtttgaaatggggttaacttttcgttgaccaacaattgaagatttattacgcaaaaaatggtagaatcgctcatctctgggattcgaaggagctttgtcttccaaatgattgtacagagagtcatgggttgtaaactcagcatcaaaactctgttcgtaaagtgcttcatcaatgatattgtgtctattgaagccatctagcgtagaagtgggtcgcctacgggatatagtcgaagaagatgaggatgaattgcctattctcaatctaaaatctggaatgtcaaagaaggagtcgttttcttcaaaataggagtcgttgtttaaaggttgctcataatgctcatcttgattcatttcatccaggatattttcattcaagttgaaagatgctaaacttgtccttgagctgtgcctagaatgggattgatttctagcgtactctagttcattagaggtagtggattctcttcttgatgctgcattcctaacgtaagcatctagtgtctcatctggtgcagctttgccagaaggagataattgacttaataaggtagtaaacggatttgtttctttgagcatcttcgcattagtcttcgtaacattctctggaatcattctttgtaagtagttacctgtccagtcattaaattcagaaacggacacagttatcttgttgtcaaagacaagttgccgtttagacaacttcttcgggactgtatcttttttctgaggacttttaggttctgtattcagtgcattggaatcaccttcattctcagtctgtaaattaaggacatcaaattccagccctaaatcaacattttcagcagcaacaaaagatgattcatgatctttgtcattcccatggacggaagcaaattcttggccatcgaatagaaaatcgacatcaggaattatgtcgtctagatcaaggttgtttatattgatatctctcccttcgaaagtattaccctttaaagactggtggttttcggcattgccttcaaaaatagaagataagttttcgttctcgatatcgtttaaattgatggagttggaaggacttatgtcttgtaaataggaaaccttttgcaagatatcaacctcaatattaaaacaaggatcatcactgagaatattcttcttctgtttagggacaacatacttgttgaaagtaacgtatggcgtaaaaagcttttttgaaagctttgtttttgcaataatggtgtcgtctaacacttgattagtaccacttatccggaaaatctggggtaaaagataaaacaaaatctgggttggactcactgtaaaagtattcaatttttttcttatagcaaacagtcacaccgaacaaaaggtttgaagtaaaacgtaacgatatggatcggttgttattgataaacttgcacatttcgtcaatagacaccttaagaatatcttttctggaaactgttgagcctgagcctaaagtggctaggagcctacaaagttgttagcggggtacaattaaggctgaatttgttggtgaaagtaccaaagagtcgcaacactgtgctcttcaactaagagatttgggaacatggtttttgacaaggaaagaatgttaagtttaataaatgattgtctggacgcattatgacgcgactaagtaatgtatatgatgttacataagccttccattaagcatacaacgcggcggctatagttcccatgattgccaatattatgaagacaaagatgaccaatttgaaaccggccttctgattatatgacagttcatctttgaagagcaagatataaaacgtcgtcggtaagataatgcaaattgtggtacagataaagcttccaagaatcgccaatacttgcgaaaaactgttgaaggtcaccgaaagcataatcgctattacgacagctgttattctggaaaatattctcttaacttgagtggatggtgatattattccttgagagctgttgagtagttctgtttcgctgaaagtcaaatcatctatagctgtaacaactggccttaggactaaaggtgttttagatagaggtagtaatgtcatgaatagacagaccactgtggggatccatttgggaaaaccttcagtcagcatgatgcttctagtaatttctgagtcggcatccatgccgaacattaaaaatccgaaaacacctatgaacagattgaccaccaacgtgaagctaaaggacttgctcatgcaacttggataatcttctggagtacgcatatctctgtaaagttctaccaacactgggtggcctccaaagggacataagaatataccataggcaattaaaacgttgacaaatgaagtaggccaaaagttggttacctcaggttgaaaaatagaccctggagcttcctttttcaggagtccactgactactacaattactgccacacttgaagtactcacaatgccaataaagctcaaaaaagacaaaccgcttaatggcaaaaagttaaaaacaatcactactccaccaaatacaagtctcaaagcctttcgtgacacttcagggaaaaatgaggataaggaatccacaaataaaatggccaatgaagccgcaccacccagtaagtcgatgagaaacaccaacaagatggcatagtttaccttccgacccagaacctttttcccgatgtcgttatatgaccgcaatgctggatctctctcggtgcagcgtcctaacaggattgcagtgtatttcgtaaggaaggcagcacccgaaagaaaggtaattcccaaaatccagccggataaatagagtcccaggggcagggacaataaccctatcccaatcaaaacgttgacagcgttcaaaatagtttggtggttgttggatttatctaagccaattgatagaagtcgatcctcatcttcttcctcaatggtactttctgggtaatgatacttgttaatggggtgtcttcctgatattaatgatgtttcttcatcaatggacaactctgttctgttactgtttttgcgtgaaagggtctccctcaaatctgacacatccaaatgtccaaagctttgggatcttttccaagaagaagtgtagtcagttaaagtgggagatgccaccaggtctaaaatactgcttctcctgctacttcttcggctcaaagcctccgaagttacactatgaattcctgttgagttcgtcttattgaggttcatcgggtattcgtgcgagaaaaaataaaaaaagaaaataagaatccgaagtggaatgcgattgtcttttgattacagccacaatttaaatacattggcagtacgaactgggtgactcactcaattaattattatctattcgaattcacagtttatggtaattacttagagattttaagagatagctggatgctgtcaacgctgccctctttccgaatacaacgcactctagcagggagttaccaccgagacggttgtcaccatgcaggccgcctgtcacttctcctgcaccaaataatccagacaccacccttccatcttgatgttctatttccgcattcccattgaatttgagtcctcccatcgtaaaatgaacagccctggaaacgtaagatacgtaaaaagattcctgggcagactcagaattgagcaagttgaatggtatgtttggaaaatggacttttccgaattcatccctttgtaggtcagcaaacaaattgtagtttgaaaatgtttgatgaaggtcttgttggtcacacccaatttcttcgatcagctcttcagcggttagctttttcattagcccctttgctgtgtagaactgaacattcaattgcaattgcttggcagcttcttcgttcaaaactaaaagaaccctgtcgtcaccagtttctttgatcgtattttctatagctgcactgacataatctctggttccaagttcgttacaaaatctttcacctcttgcatttagcaaaagacctcctgctccccttaacatttcagcacccagaattagaaactgatcgtctttgacaatcttgctgtcaaatggcactaacgccgtggggtgaacttgaatcttatccagatcaatacctgcgattcccttctctaatgccaagctcaaaacatccccagatgcatacgggccatttgtggttggtaaagagctcagctctggtctaaacttggagatcagttccttgttggcagagtagccacctgaagctagaattacgggcccaagaattctgtacttcgaatcctgaaattctataaccactccatcaacttcgtgatcatggactatgatatcggtcaacttggcctgattaatcacctttacattttgagggtaccgttcagatatatctgatagaatagagataaccgtggaagtaatagcaaacccaggtggtttacttaatcctctgtgagtccttggctgagaatgtcctcccagaaggctgactgtggataaatctattttgcaaactttagtcaaccatttaatggcatccgcactctcatctgttaaaatctccaggagacttctagcatgatccttccctgatctggcggaaagaatagagtcttccaagaacgaatcgacagagtcattaacgtgcaagctgatttgctggctggtcaaagctccactgatcccactactggctttcattgagtttccacccaacttagcctccttctccactagtacaacatttgccccagaattgactgactgaatagcagcggtgacacctgctaaaccacctccaacgacaattattgggtttggaggtaaatttgggaataatggtataacagacattattttcaaagtgctctgaactggaaatctctagttcttttattcttcgtagtctactatgcccagatttgataataaggtgatttctcctccttattccttgtgggattacgtcagcatacttagattcgttagtttcagtaagaaagacgacgaaactaccaataaaaagtcgacattgactatccaataatagacaagatttgattcacggggctttactcattttttgaaagagatcaaacccataaaactgctttttgatggtcggcctgttccatcccattaactttaatttcaaatcctcctaataaacgcgacataagcaaaaagacgcgattgtttatctaacctatacgcttgtgtggtctgtttatatggcaaagaaacttcataaaccgactaatgaattaggcacgggtgctgggttaccccttgataagcgtcccaggccagtttccaatcctctggccattatttccagacctttcaagataccggtggcaagagatacttcacgcaatcattccaccctaaatggaaggcaagtaagaaaagctcgtctgaaaggaccatcctcctatgctctaatggagattgataccaacatagtcgctgatagtgatttgtcggtcggtgcggatggagaggtagttgttcgtggcaaaaaaggtgctttgacttccagaagaatgctggatagtgagggtagatctagtccaatcttgaacaagaagtttacagtaccaatcaaaattgataaagaaaatgcatttgagagacaaaactctcaacccccaccaccattaggaactaaaagaaagccaacattgcctcctaggcctcttcatgatcctatgagtgagtatgctattgtcttgtatgatcccacagtggatatcattcctgaaatcaaagaggaagacgatagattacgcaaggagcaagaagaattagaaatggaacgcaagaaggctgaacaaatcacaaacaaaaacaaaagaataaaacctggaaagtccttagcagaaatattaggtattgctaaggatggatcttcactcaaaaagtatcccaatgtaccagttgtgattgatccaaaacttgccaagattttaagacctcatcagatatcaggtgtaaaatttctctttcgttgcacttcaggtttagtagatgcgagtgctaaaggttgtatcatggctgacgaaatgggattgggaaagacattacaatgtattgcattgctgtggaccctcttgagacaaagtcctcggggtaccaaaacaattgaaaaagctattgttgtctgtccatcatccttggtcaaaaactgggcgaatgaatttgacaaatggcttggaaagggaacactgacgccacttgcaatcgatggaaagtcagctaaaggctctactatctcctcacaactatcacagtgggcgatggccactggtaggaatatcgtccgaccggtactcatcgttagttatgaaacattgagaagaaatgtggagagtctaaaaggaactaaggtaggactgatgcttgctgatgagggtcacaggctaaaaaatggagactctttaacttttactgctctcaactctctagactgcgaacgtagagtcattctatctggaacacccattcaaaatgacttatcagagtatttttctctcttgacgtttgctaatcctggccttttggggacaagaaacgagtttagaaaaaactatgaaaacccaattttaaggggaagagattctttggctgatgataaggaacgtgaaaagggtgaccagaaactgaaagagttgaccgaaattgttgcaagattcatcattagaagaaccaatgatatcctatcaaagtacttgcctgtgaagtatgagtacgttatcttctgcaatctttcggaaactcaaaagagtctttatcagagattcactgcatcgaagtccatttcaaagctagtcaaagaagtcggtggaggagctcagtctttacagtccattggattattgaaaaagctttgcactcatcctaatcttttgaatttacctgaagacatagaaggttgcgagaacttgcttccagacgactatgattatgggcatggaaatcgaagaaatcgggaagtacaggtatggcatagtagcaagttcctaattcttcaaagattcttgtacaaaataaacaaagaaacgaatgacaaaatagtgattatttcaaattacactcaaacgctggatcttattgagaagctttgtattagctcaagatatggatcactgagactggatggtactatgaacattaataaacgacaaaaattggtcgacaaattcaataatccagagggtaaagagtttgttttcctgctaagttccaaagctggtggatgtggaattaatctgatcggagctaatagattaattcttgtagatcctgattggaacccagcgtctgatcaacaagctctggcccgtgtgtggagagatggacagacaaagaactgttttatttatagatttattgccactggtagtattgaagaaaagattttccaaagacaatcagctaaactgcaattgagttcatgtgtcgttgactcaaatgatgatgtggaaagattattttctgcagataatttgaaacaactatttcaattcaaagagaacacgttttcagagactcacagcacctacaactgtaaacgttgtcatcccgatggaaaacaattcattaaatccagtgctatgttatacggtgatccaaccacttggaatcatatacaccccgggagtttggcaagcaatgaagatacgttaattgccaacgaagcccaattcaatgacatcagctactgtttccaatatatatcacattagtacaacatgatccttttaaatcatttaagacaattcccagtactggatttcactggcttgttcgtctatccaaagcagcccattggcgaccatatcttccagtactgtggtagccctggctttcttccagcgaaaattgtcgataagtagagaaacagtgacgaaaccgatgttaccacaagtctctagcactgtggaattatctttatttagctcttgaggaacagatttgcaatagagtttgtggcctatggtgattatctgtaattctgttcctaaagcttctgtaagtgcgtttatgcttttgactatgtcatcctgtgttaattgaattccaaataatttggtgagaggcttattagaaagaatttgaagtatctctttgatcgagatgactcctccgttaatatcagcagtatcctgacagatttccataatcttaatgcccaaatcattataaaaatcttgctcgctctgattagcagttgaatcgtttttaaccactttttgtttggacttctctgtagactgtcccccttcaccattataagctatactaaatgcagctaggggatcaacaccaaaattgaggcaaatttgactgaattcagttcgaaatttgggatcatcttcgatatcctttttatgctctttgataaaactgataagtccattctgaaatactgtcagttgagtttgtaattggtttgtctgatcttcgagaagcttctttccaacctcctgatacctctggttatgattttgaacattgtccaaagcggaaagccccagacgtttcatattgtgggtgagtaaagtgcatgcatactaaaaaaaacaatcacaagacatcgcgaagttcttacaggggagatactccattaaagggtctacctactctacttctacttttgactctacagttcatcatcaaagacactcaacgagtaagctaatagctcctcttcagaatctttgttatccggggcgtttttgttatcaattctgtttgcactcaatggataacgcatagctttgacactctcattgtgtagttgcatacagaacttaatacgttcgtcaaatacactctgtggttctctagtagaatacacatccagcacctccttactttgcatgtatcctttttcgtgatcaatggtggcttctatgacgccatctctaatagacttagcaacaatatactcggcacttagttcactatccaaatgcaacttaatacagatgtcctttagggagattctagtataagctaatgaaatgattcttattccagtcttgataacgttttgacgtaatttcaaaaccaaattgtaattcttttcatctttgaacgtgtctccgtattcagccaatgccttattaaacaagttcaaatcacccaatctcacagcacgagtgacggccaaatatggcaacaatgatttctccagtttcggatctctgaaagtatctaacgatggaatctctcccatcagtaactctaccaaaatgttcaacttggtggcagtttgcaaaaatccagtggcaagctcggactggggagcttttctaattgaggtaaccgcgtagttgtgagctgtcgaataagcaagttgaaccgcgtggattcttgccaagtaatagtaataacgggctactaaagcattggaagcatcttcagggaactctgtcttttctaccaaatttgaagcttggttgatgtcattggataaaatgtaatttctcaaaagcaaggtaattgttgaagctctcgtccctatatcatgacgcagagttgatgtacgaagcgctaacaaaagatctggacgaattgaggtcaactctccagctaactcttttattctagcgatgtagaaccatgccctcgatgaaatataatctaatgttcgacgattataggattttaaagcactaattgtgaagggaacaaacttgtttgcaagtttgatctctttgtggtcatgtaagtaaatcaatattagtacatgaatgaatatgtcaatttcaggcagaactgtattgacagaccctgagtctacttccatgtggtcaccttcttgtgaggaatgtgcacccagtttcactagaatatcctttaggtactgtctgttttcatcttgcggatagtttttctctacgacttgtagcagggaattgacatctagtcgtcttctcaaaggacccaattctcggaaaacctttaaagtaaaacggggatcaaagtgtgataccgacttttgaattaattgaaacctaagttcaatgtcttcgttcgtaggaatggtctcttccgtcgttgaagacatgatatttaaagtagtcttgagaggatgatcaacaatcggtggcaatatggagtctagagtgattaatggtgtaaaggtgtatccttatatgtggttggcgcacattgaagaagtattattatgtaagcgtgtataggaattatgcatattattgttctaagatccgtcaggcccagtactaacgtaaggttggcctagtacccaaataattcgatcagcacgtttatggtggtaccaacgcaccaaaatgccactataaccgtacctatccatctttcaaaataccagttattgagcggtatcgcaactaacaggaaaaccaaactgagtagaaggaataaagaggaagtaaacagtgttgacgagatgtctatgtgaaatgacgtttcattattgctgaggagcactataagcccattgactccaattcccatcagtaagttcaataaaggacctccaaaacaagccgccagggccattaatggcatacccatttttgcaatagtaagattagatatgaaatctccgatggaatttccaatcgcaaagatagtcaaacccaaaatagcctcggatatcttgaaaaaaacagaatagaacttgaatatgttgatcaattcttctgcaaaaattgagatccatgcaatggaagaggcaaaccctataaatgataaggcaatgttgactaagttggaggatttggtaggggactttgatacaggtgacactagaaccgaataaataatcattgatacgattgaagagcagatcagtgaaaatacaacgtagattgcaaaaccatctgatgttccaacggttgcaaatgtaaggagtaaaaatgagaaaaatgcttgtgttatcagcagagagacttgggctcgaaggctggttgttctattagtagtagttccggatccttcaattgtttcagattcaggaatgtcttggaaatctgatattaatctgactggaatcgtcagggtcaacgacaatactattggtgctgaagatagtatgaatattttattgatccacgaagaatctttgaagttggcaaatgtcggaataagtagcaagactaatcgctgaaatctccttcttggacttgaatgtcgtttcttgtaaaacgcagacattagagtttttaagttctcggaatcatcaacatcaaggtcgatatcatgagtacgagcttcgtaatcgccatctctgtaggctagtattggctctgtaacaggtctattttccacatctgtagggtcatcgaagtacgctggttctgattcagggcgtaagtttattaaagcgtgtcgatcaacagggaaagattgctctttagacaagttttcgaacacattcttgaattctaatgctcctaaaactgaggatcttattctgctagtattattttgtgttccagttacattcattagctcgttcaacacatggctgttctcattgtcttccacttcgatatcgttcagttgatggaaaatgttgagctctccatctacctcatcgtcgtcgtaaagacttcgaactgtttgatctctctgtatcaattcctcgttaaacttaactatccaattccaggaaacaatcaccgcaacatagagagcataaagtgacaccataactaggcattcaactagagacaactcacgatctgataaaaatatgatgactagcacaactgcaagcgcaaaaaacaatagatctctgacaaagactagtttctcgtttcgtatcgtgaaatcagagcttccatctttgaacaacctgaaaggtctcactaccaccatcgctcccacgatgaacgaagtaatcagataggcacttccaattaattcaccaatggctaatgaaccatcaccagacatgaaagaagcgtaagttcccataatatcggggcttccgttaccaaaagccaaaagggttaatcctgacaggttgtctgggatatcaaaaaagtgactgatcgtagaaagatttggacatagaaattctgatgatgtaagtcccaaactcacaaataaaacgctcattagccctaaggtgagaggaatcacaagcaatggcctggctgcaggagactcaattttgcaatagtaaagttcgaagtagttaagtgttccaacctgtagatcttgacagttttcccttacaaacgaacattgttgcttgagaggcaaatgattgatattatggcaagaactaggggaactaggatctgataacgaatccgttccattgtaggccgtcacataaaccagaagcaggaagaacgttgcaagcctcttcatattgtactggaggaagtaaggatggatggtctcgaaaccggattattattaggtaagtattctccgatattgatagtggtgaccagatcggagaaacattaacaaagagttatttctctgcttgatgagagagctgccaggtttaccacatatttatggatgacaggacatgttaggacttttcaaaataatttgaatttgactgtgaaaaagctggaactgttatttcatttaaagtgtgatgtttcaaagagccgtctctcaattcagaacatccaattggactcaattggctactgagagtgcctgactacgaatttcactggatcaatctatctaatacctactttctgattacctagatgtcatagtattatatgaagagcttatatacgcgaatgccagtgtcaggtcgaaaccccaacagttcttttctgccagtccaggccacacatcatttcatcatgactactcctgcctggttggtctcatacaatgcattgtcctccatagcatggttttctgtactcgtgctagccacgtcgtatccagaagcccaacctcaatttttccaggacactcaagcctatgtccgattggttcaaacatttgctattgttgaagtctataactcacttgtcggaaacgtccgctccccagttttcactacagcagtccaggttgcatctagattacttgtcgtttggggtgttttttatgtcctccccaattccccggccaacacccactgggcatacatcactctttgtctctcatggtctattactgagatcattcgatatggatactatgcactgaacattgtcaccgaggggaacccgcccaagtttttaacttggctacgttacaacacatttcttgttttgtatcctactggtgttggaagtgaggtaactatacttttcaaatctctcgatgaagctgaacgtgtagttggagcttggtacaagtatttgttcattgctattctggctacgtacatccctgggttctacatgcttttctcctatatgttgaaacaaagaggcaagactttgaagaagttgagtcctaaaaaagaaaaataggtcgtaagtacgttagtatcacttgataacgggtatattagtagtgtgaggctctttgacgtctgaatgttttctcgcatttttcaaacatctccattttcttttttttttttcttgccatttggtaatccttgccatctatccatcatgaatctcattccaagagcccttaactcggccaagatatgctttcaacgaattcctactcgttcatttaccacacaatttgctttattgcaaaatcagcaaaagcaaacgattagttccaaactaccagacttacagcctttgaagttcgaaaaagacttgtatgccacaattaggattcacaacagaccatacctgataaccgagggagataagataattctaccttttcggttgaagaacgctgaagttggagatgttttgaactttgatgatgtcaccactattggctccagaaacttcacctactctgacacccccatagactcttcactgtactccatcaaagctacagtcattgaaaaaacaaagaaaccaatgtacaccaaagagattacaaaaagaagacagcgtcatgtgcgccacgttaatgttaagcatgaccttactgtcctccgggtttctgaattaaaattgagctgaacaggaacggggaattgaagaatcttgtatgtaataaccaaaatactttcttgagtcaaagaacgtgtaaatagtataatagttgtccattaattaggcttttgttacacacttatctcctgtaaaggaggctttgtctttcacctcaccgcactgatttttgatcctcgatctcccttctagcaaaaactaaacatacctctcgcctttatcatgatctataatggagaccgatagtgccaatcatttggatccagttgaacctacatacgacactactctcttgccgtatttgcactctagaaagagttccagaaagagtttcggtggtgatgatataaccaatcccaatgcagatctatctacaactccatctaggattccattaccatcatcttttatgtcagaggaaggctccaaaggcgagtcaagattctcttttgaattaaatggaatggattcttccactccagaaaagtcggcttggaccggtattctggagtccccgaaacccagtgaatcctttagttttttcacggagcatccttctattgcacatttcaacaattcctcaggaaaccatatagagtcgttgtccaacagtacatccccttccaatgctgatagtgacttatcgaagagattaagtcgcataaagaagagtgccacgcattctcgtcaatcttctatctcctggaacgtggatcttccagaggaatggactctaaataatatcacattttggttaaacctgtacaatttcaacgagtcgtggctctcaatgatcaaagcacataatttggtcggcgcttctttccttagtttggcaaattatccggtcctgaaaacatatacccatgaagttgacacagtcaacgactcaacaccttcaagatttattcatcttttaaggaaaacaatggggagaaagactagtgaaacattgtctcttgcatctgccaacgtgaatgattattatgcaagcaacgtttcggcagagtcgtttgactcaattattcaatctcctgtggaagaattccatgaaacaagcaaccttgagacaaagagttcctccgaatcacccaaaagttcagttaagcattttgcagacccagcaaaattaacgacaaacatacccaaaccttcgcctttgaggtcttcgtcgccgtcatcttcctcaaccaccctcaaacatagtgtttcccaaagaactacaaatacccgtcaagcaactgaaaatgttaagagaccagtttctacgatagagtattccacgtccagatcggattctccaacatccactttttcctacaacgtgtttcggaagcatcagaaaagcaactcctcagaatctaactttttctccaagatatattcaaacgctcccacaaatgaggtagaagtcgaaaggagaagcagtgtgaaatccaagaaaggtcttttgacaaagttcaaaaagataggggaggaaatatcaaaaagtaataagagcagggataagctgtctgaatctccaatcagccctgcatcagcaacttcgttggtaggaggtaaagacagatggaaaagacaccaaagttctgtaactactgaactatcaaacaaagattggaaacaagcttccagaaaatctgtagacaaaactaaaaataatgtggaaactaacaaagaaagattaagcatctccaagaaagataaggtcctctcggatatatacgagaagcacaagccaacacctttgaaagatacacacactaagacttcttctagcttcgtgttggctactagcaatgataacaacttcatacccattgatgtgagtgaagttcaggatttgaggcagttcaaagttgtggttatcaaagctctaaatataatgaacattgagcccatttcgttccatcttacggattttggtcatattcatggtgcagagttagacgatgaaagtttggaaaaatttcgtctggatggctttcgaaatgggtctttaaaacttcacgttaaaggaactaagtttgaaacatcatctagtactgcttcctcaatgacactctcattcaaaagtattgaggaaggaaaactggagaaaggatcttccagatatcctactactccgcaatatctacttgatacaatgaatgctcactcaaaagatatgtctgtggattacttgaacattaaagataaagtcagagaaagtcaagaattaaaaaatgaacttgtcccacagtctgcgtcaacaactacggtgccaatgtctaaagaaagatcgttttctttcagatctactaaagaagagcatcaaaacaacacgttcagagttataaggaacaagagttgggaggtcgacttcgataagaagcggaagtctccttacgagagaactagacaactggttgctaaacgagatcctcctcccccaccctccccatattcacccccaaagaattccttggcaaatagagaaaagagggagctacctgttttaaacccagcaaatcagtcctcagctacaagtcgtacctttggcttagatcacaatcttgaatttcctagtaagacaaatgacgagccaacccgaatatctccgtttacgccgggctcttccaacactctgattcccaaaccttataagggttcatcccctcacgaaagaaggcccgtattgtctaacgagagaagggggtcccggagaagatcgtccagtttgttgactacttcaagtatagtgagcgggaatagttaccagaatttcaacacaaaatcggaatcctttcatgatccttcatctggcgattcgcatggtacgtttgaagaaagtaatactttcgatgaactacctacatttgacatcagtaatcccattgagtcatgttctgaagaggaagaagaggatttttgggcaaaacctcccagttcgactacaaatacacaacctgccgctgttgccattgatgctaaggaagaccaggaagaaaaaattacgaggatgcctagtatggccgtcagacccccggcagaagttgtttatgataatcttgaattatttttcccaaatacggatttggataaaccactaatggatgatgcttcccctccgccctcgccaaattctcccattcctgaagtgtcgccagttaataatacaagacctcaaatacacagaaaaatctccagcgtccgaagtgcaagcgatcatcttgctaggccaaatgaactaggaaggggcagagtgaaaacaattaggattgtcgcccaagaagccaaaaagtcaagagccagactcgcagagaatttcgaaagcaataagaaagctgatggtcttcttagacgaagaagtactaagttctggggtagaaaggttgtagaaatgaagcctggagatgcccgaaatctatccaaattgaaggatggtaatggagattataaacaattttcctgggtaagaggtgaaatgattggtaaggggacatatggaaaagtcttcttggctcttaacgtgacaactggtgagatgatggctgtgaaacaagttgatctaccttcgagcgggcataacagctccgtcttcaaggaagttgtcgacgccattctttctgaagtcgataccctaagtgacttggatcatgacaacattgttcagtatctaggatttgaacaaagagctcaaacctatacattattcttagaatatgttgcaggggggtcagttggttggtgtcttcgagtatttggcaggtttccagaggaagtaatcagattcttgactaagcaggtattagaaggtcttgcttatattcacagtcgtggtatattgcatagagatttgaagggcgataatttgttgctagaaacggatgggacctgtaaaataacagactttggtatatccaagagaagtcgcaatatctactcgaatgatgctgaaatgtcaatgcaagggtctatattttggatggctcctgaagtaattgataatgtggtcaacgacaaaaagcagggttatagtgccaaagttgatgtttggtcgctagggtgtgtcgtgttagagatgtttgctggcaaacgtccttggtctaacttcgaagttataagcgcaatgtacaacttaggaaggtcaaaatctgctccgccaatttcggatgaagttaaggcatatatttcttcagatggaattgatttcatcaataaatgttttacagtcgatcctgatgagaggccaactgcccagtcattgatctgtcacccattctgtaaaactagttccgattttaaatttgaatcaacggaattagcaaagttggtcaaagtcaacgacaagcaggctaatctggtgtttgaataatttagtttatattcgccttctgactcctagtcttctctttttgttatttgatctgtcaggtacatatgatggcgctgtggtgcttttagttagcaaaggtgatttgaattgcttatttttgagaaaatctttggttgagacgatgtgatttcttgatctgtttgattctgttaaaatatttgacactggcttgtactctttacccattgcttcgtacagatccctccaagagtttttggacatgttgctgattgaagtaaccagctgattttgaaacattttaagggttggttttaaaaagcacgatacttcatttgattcttctccactccagggggttgatctctctttgtatgatgataaatatagcattgattttgctcttgttagtgcaacataaaaacatcgtctatcttcgtccaaatttgtagacgaatcgggaccatcatcttctaaagtccatttggagggaataacaccgtcggtgcaacctggaataaatactaccggccattccaaacccttcgcaccatgaattgtagatatcgtcactcttcccttttttgaatcttttttgttctcgttgttcgatgtttcatacaagtcgattgaatccaaaaagctggaaaggacatccctagtagtgagcggagtatcaccagcttctgcagtaatgatctggtcaatgattggcttatactctattaattgtcgcttgaactcattcaagttttcctctacagctttgagggcattttctgaatcatgagttccctttgaagtctcaggcgttttcttaatctctttcaagtttgctagttggacaatttgatcaaaacaggcttccaaacttgcttcgcaatctaaagatgtagaatctagtagtctaccacattcctttagaatgtctatatattgtctcactccactttcggatttcacattcaaaaatccattcttcttgtcatgtattgccatttcaagggtttcgatgacaggacaatcggacttgtcaatcaattcttctagtctttgtagagttttgtttcctactcctcttggggggaagttcaaagtccggagaatggccaggttgtctgaattgttaacaattgctctcaaatagtccattgctacacgaatttcctttagttcccagaatgctcttccatgtacgacttcataaggtatgcgattggtcaccaaactctgttcgatgacacgagactgaaaagaagaacgtaaaaggatagcaatatcgttatagctggttaatagaccggacattaatccaagcttagctacttctgaagctatgtggtctgcttctttgaaggtattctgagtcctcacataaacaatcgggatatttagatgtgaaatttgtgatcttaatgacttttgtttcctgtctttctgttgggtcatgatctgctcagaaaaattaaggatattagaagtcgatctatagttctccttcaaggttatttcctgacagttttgatagtgaatgatcatgttttcaaaatttgaagccactgcgtttcgaaacatgtagatactttgatcagagtctcccacaaccgtgacattgtcctcaaaattttgatcatcagtgcactgtcctagaagatagagcagctccatttgaattttgttcgtgtcttgaaattcatctaccaggacgtgcttcagttcctttagtaaaacgcgtcccttttttcttgtctctgaaagaagcaaataagtgtacaagagacaatcatcaaagtcaataagattatgctttcgtagactctcctggtataaagagtaaatcacagcaagatcaaatgatcttgcagaagtagtactatatgtctgcggcgtggtagtcaacgatttaagtttggagatctgcgattttgcctttttcagatcatatccatgcaatttatcagtctctttgggatccttttgatagatgtcaactgaaacagaagatggatgaaattttaatctaacaacatcatctgacaaggtggtcaaaattttgcttaaaatagtgttagaatcccgttcatcggctattttaaacttgggagtcaacccaatttgggttccatatcttctcaataacttgacacaaattgaatgaaaagtgcctatcaagagaccttttagatatttgtcgggatcaaggttctcttttgcaaatagaacctgcagtctttctaccatctcgttggctgccttctttgtaaaggttgtgacaataatattcgaaggagggatcttgtgctctatcaaaagataagctacgcgtgaggtcaaaactttggtcttcccagttccaggtccagcaattatttgcaatggcttatgaatatctgcagtcactgcctcatactgctgagagtttaatgatgcaagcatctccttcctaaagtggttgacaatgccctacttataaaaagttcacgagtaggtgacgcgataatgaaaatatgcatttacttagggtctacaaacatgacatgaaaatatcttacacaacaattaaaaaagatactggctcaacttcactcgacaattcgtagctccaaggatccagcattaaacctctccttattctgctcaaaaactcgtttcagttcttcgacatatagggaatggtaatggtcaatctgttcttgggttggtgaatgaatgtaaggaaccgggatgggtctaccgatgaccaagttgataggtttccgatatggtagaaggccaaagtcgtgattgaaaacacccctagcatgaaaaaatggaaaggtaaagccaaagtgttgttttaaccataattgaaacccacacatttgcttccgcacgtaatttaggacagagcaagacttgccagatacacttgggtcaaaaacattataggcagtgttttctccaaaaccaaatactggaactaactcagtgtcacccagctctagtgcgactttcacaaagcctttcctttttttcaggacaatatcaatagtatgtggtttggataatagggactccgaagcacctccaatgacaatacagacagactgatttcgttttatcagtgcagtcacattacgtttcgaaacagaagaaatacccaatgccattaagtaatctctcaatagaggaagtttgaattgagtgatgagggttaataaatatattctgattcctggtagtaactcgccaatgttacaaccattggtgccaaaagctccagtgatccccagggaaactaccccatgagggtgataaccaaatatgtatcttggccctgttttgatctccttttctatgagaactctgtgtgtcggtatgtactttctaacagaacttggcaaataagtggttacttggtgatacttcggaagaataatttcaatcttcttagtcttgaacgtcggttccaggtcaacagttttgtacacagatatagggtaataattgacaaaatgtttccaaatatgcaaacttctgaaccattccactcttcggtcagcagactttccattgcttggagtattggcatcgatgtaaaaataaaccaagtaaactattataagaggccacaacatgggaattgtacacagaacgaaaaatagtgatgctaaaaatggaatcgtgatagtatgccacaatattactagagtttccaatctcctgtttagggaactcctcaacaaagcaaacctcctttgcttctctatcttgttgtgtggcccaccctgtcttctttgtaatagtttgttatttataatgtcatcttgtgagtcgtcgtaatcttggtagtgatcttctcttgaagataccgtgtcgggcgttatgttccctgtcttagagtaatgcatcgggcgctctacgttcgttttagcaagaaagctaagagcttcgtcagcggaacgactgttcttcttttcaggcatttttatcgccagtttgcggaaaaaaaaatgtttgccgttttgacaggatctagatgcaatataaggtaggagcaagtaagtagattgcgaacacgaactaggggtgcgggtcttttttcaaggttatttccgaaagtcaacaatcggaaatcaagatgtgacaataatatctaggcactcgaggagctttataccttcataagccggtgtctcaggaaactctagatactggcacataacacaagtttcttcggtcacctgtcgtgcttcttcccggtatcaggccattccatccatggataacaggaatgtactaaagggatcggggcttatctaaaatctcagtcgacgtgactaggcgtatcatggcatcaaagtttcaggtttaaatccgatgatgcatcgactgtctagggaagaaagtgtgtaacatctgaggcaggacggacttactcttctggcaatcgtcttcgagcacaacacactttgcctggcgggttgtttggtcgcgcactactatcccagaataacggcaaacctcagaagctgaacatctcaattactcaagaccacaaagtactatagataggtgttcttattaaaagcgtatctaccttttaattctcataaagatcattttggggtatcaatcccaaactcctaaaagctacacactttttcactccccatttttattatttttttttacatctcagctcagaaatattatagaccttaatcatgccagaaagaggaccagatcagtggtttgaagaagtcaaaagctgcaaggctttaagtgaaaatgatatgaagcatctttgcgaacgggtgaaggatttgctgatggaggaatccaatatacagccagtgcagagtccagtgacagtatgcggagatattcacggccaatttcacgatctactggaacttttcaagattagtggtgggtttcccggatcctcctctaatggaataaaacagaactatatcttcctaggagactatgtggatagaggctatttctcgttggagacgttcacgttactcatgattttaaaaattaagtttcctcaacatatcacattggtaaggggaaatcatgaatccagacagatcactcaggtttatggattttatgaggaatgtctcaataaatatggttccaccactgtctggaagtactgttgccaggtgttcgactttttaacccttagtgccatcattgatggtaaaatattatgtatccatggtggtctctctcccgatattcgcatgttagatcaaatcagagttctcagccgagcgcaagaggtccctcatgaaggaggattttgtgacttggtttggtctgacccagatgaagtcgacagttgggctgtttctcctcgtggagctggctggttattcggtgctcgagtagcacgtgagttcaaccacattaataacttgcaactcatcgctagagcccatcaattggtcatggaaggcttcagataccatttcaaagagaaagatgtcgtcactgtgtggtccgctcctaattattgctaccgttgcggaaacgtggctagtgtgatgaacgtcgatgatgagctcgatgttaacttcaagatattcagcgctgtacctgatgacacccagaaaatgaatcctgttaagaatcaaagaaacgaatactttttgtaatgatttattcttcgtatatataattgtacaactatccttttacttgagttaaagtcccaaaaactttcccttctctctgacactttctccgtacttcttgattctgatggcttgtgttgtgataaatcctccagcttcttgagggtggaatccggtcaactcatccatggaagattcggtagcatcgtacaatttctcggtttcagagtatcttcctaggttatacacattacctttgtaggccttggctctaacaacaccgttgacggtgttttgagaaggctgaatcatagttctgacgtactcaccttctggggtaaagtacaacccgttgtataacaacttagagtaggttggggtaacaaaagtgtctctgatcgatctaacttcacggtcaacggtaagaccttccaagtcgatgtgagtggttctcagtagagtcaaacctggagtttcataacaacctctggacttgattccgatgaatctgttctcgacaatgtcaattctaccaacaccgtttcttctagcaatggcgttagcagtcaaaaagatctcaaccggatcggtgacctcagttttgttctcgagaactaatttaactggcttacccttctcaaagtggacgtcaaagaactctggcttgtctggtgcatcttctgggtcaacagtgagcttccacatgtcctttggaggagtagtgtttggatcttctagaataccagcctcgaaggagatgtgagccatgttctcatcagtagaccatggcttggctttagtctgagcaactggaatatccttctcagcagcgtaattcagcaagtcatttctaccagcgaatctttcgaagaattctgggtctctccatggggcgatacagacaacgtcaggcttcagagcataaaaggaaagctcaaatctaacctgatcgttaccctttccggtacaaccgtgggcaacagcaaaacaaccttcttgttcagcaacctctatttgggccttggcaatgactggtctggccaaagaggtacccagtaagtagacgttctcgtagatagcgttaacttggactgctgggaacaaaacttcctcaacaaattccttcctaacgtcactgacgataaacttggtagcaccgatcttcagagctttctctctagcagcctcaaagtcttcctcttgaccaatgttggctaaaaaggcaacgacttcgtatccctgctccaacaaccaagctaggatgatggaggtatccaaaccaccggagtaggccaaacaaacttttcctttagacattgtgttatttaaataatagtcttcaatgactgatatatactttctacgctggaaaagggtgagcttttttctccttttatacttttttcgccagaagattttgtcaattttgggcgataatctgtgcggctcatgactcagaatagggagtccctccaacggaaaacgtcaagaaaaaggagccaaacaaagatagtaaggcatacaacaaatagcataaagcagaaccgcagtggctatcactagctactaaataagcgcctcatttatgagtaggatctctcttactgtgtgaatctaactttgcaggcatcttttttaccactgtctcacaattgcctgatttggcaattggtatgcgtttagcgcggtctggctcaactgaaaaaaaaaaaaaaaaaaaaaaaagaaaacgacagatagagagaagaggtcaagaagcctcaacctcatcaccatagagtttgtcaagtttctctcttaattgagacgcattttcacctagttcttcaagtgaatttgaaaggtcctccagtactcgcttgttgtaaagtttgagttttttaccggcagtgttttcatggaagaactcatctaccaatctatgaattagcattccaattggaccttctagcgcttccacacactcaaacagtgcattgtcagcacccaacaattcaaagtatttcgaatcaatcaaatggatccagcatttcattttctttgaataagagtagatgtctttcgtgctaagagccacaattggagcgccatttttggaaagttcgcagtctagaatctggggtaacggattgttgtctccttcggcagatacaatagaatagttccttgcatctccaactttcttaactagcatgtgtgaattgactataggtgctaatgaaatgctgtttagaacacattcttgcttctttaaattccatgaaaagcatgttccttcacaagttattgccaaaaggtgttcgttgtacgatcttaagacacagacggatgccccgacttctaggatcggggaagttattcttcctgcagaagacactactataattgatcctgtgtcactagacaaagcccattgattgtctgatgttgatattgcattattgagattcatttgaaaagtcagctcaaatcttctgttgccattagtgtcactagaatagactttagaaagattcaagtctttgggttccacttggttgcgaatttcgattgacgattccagttctactttttcattggtttcgatattagtttccgtggtaggtggagcaagtacaaccaaaactttaggttgaaacttcatttcaggaaatacagtcacaacggatcgtatagctggacgtaaaaattcagggaaagccagatctcttttctttttgaatgcatttgatgaattattggtcttgggaacagagttcttcaaatggtggtgatgttcaatatgatcaatattaatgtcttcctcttgaagaaccgactcctcctttggtgtctgaatctcaacgtttggtcttaaagaggtggtcaatgaaggaagaccattttttggaaatttataagtactttttgataacaagttgctcgtcagattttctcgttctttgttgggtacgggtatgaacctattactggttgaggaactagaagtcaacaacagaggcgaaacccttttcttcccattcttcatagtaattttctgagtctttaggacgtttatattattgacttttttcggtttaacgactttatgttgcagggtagttcttattgcggtttgaggtattctcttctccatcatttgatcaagatgagggtttcttaagagtaactgggcattgtgacttttttcttcaagtattaactgttctacactttcaggaaataccatgccttctctttcccctccataaatttccagctgctcttggttccgttctatcggagtcttcacccctaaatcgttattttcaaatactataactgttattgtgccatctagtgaactaattgtcagaacatcaccatccggtgtccaacacagatccgtgattgctttatagacaatgtcatgaatgacaactagtggcttcggacgagctgtattccaaattgctagagttttatcttgaccaccagtggctagaacagaacatagctgtttctcttctttggaagttgccacttcgaatagtcgagggcagaatgacacaacttcgcaaggggaatcatgaccaatcaagctaatatcagattcccaagaccctctgtttacgattgccacggaggaaacaggtccatttgttgcgtttggaatagcaatacttaaaccatctggtgaccacgacaatcttcgaaaataagtcgtcattggagatttggtgaacggttctgtaatcacatgttccacactaaaaatcatctcagtgggtgaagttttgtgatatctgaagacacggcaagttctatcgtcagaagatgtaatgaaatatttgtttgcaggatcaaacacaattccctttacgtgagaattgtgaatgtcataccttttcattttttcaaatgtttgtccgttccatatgataattgatctatcgagacccacggtaacaaggatgctgccatcgggcgcccaagccatgtcctgaatgtcattatcatgagccactaatcttttacggacagtccagcgctccatgtccatttgatctccagatgacccgttggaaaaaactgggttcatgccctccataacagaagaatcgtactcatactcttcatcttgttcccatattaacactattttatcgtccgagccagaagccaggaatctattgtttggagaaaatcgaagacaagtgacagctccagtgtgtcttgacatagaacagagaggacgacagatattctcactaactttcaatgcattttttgattcatccgactgaactgaaccttgtaagtacctaagatcattctctttatcgctcctcttgtattgataaattgagtccatagaccatattttgatcttaccatctaaacctccagaagctagtcttttaccatcagcagaaacggaaattgtgtaaacctcgaacttcctctgctcttcttgatgacagagccatggaagtttgatgatctgcataagcaaactgatgcaacgttagcaaggatgaaacgtaaactccctcaagaatcttttgaaagtttatagaactgaaatcgagtacaagattgtttcgactatacatttttctagatagcacacatcgcgcctatgtaagaccatagttaaaactaaaattacccactgaaagcttcccaacccttgggcctcttcatgttattcacagtgaagaactctggcacacaagagtatcccttccaagtgaaatcgtccttaggattacacatacatctcctttcctctctgagatcggcgtctactggacaattgttgaatggattgtggaagtatccaacgtcatcaaagaagtgaatttgatcacgatgtaaaaacaaagcagccgcaattgagtgtactggagcatcaccccaacgctcatagaagaatccaccagctttatccaagtggtcaaaatacttgaggtaagcctcagaacgccataagctgagggaaccaacttcaaaattggaccagaaatggcatccattataagacaagccatcgtcatcagaaataaagtccatcatgttatcctcaggtaagtattgagggttctccttaatgaatgcacgagtagtgtcccataaagtctcaatggtagcaacgtattcaggcaaagaaacagtaaaaccgtacatcttattattatccttcatgaacttgaacacatcgtagtcgatatcacagtaaatcttgatatcaggctccacacgccagtaccattcatactcttgcatcaattcgtgtctaaagaagaaacccgattcaaaacgacacatatgtctgtaagaaatggagtcaccgtagatgaccttcttagcagccatttccttcctggtcttagcagcacgctccttgtcgatccactccgggaacgaccaatgttcctttggaatcagaccgtatttagcttttccagaagttaaagcagaggtgacacgcttgaactcgtcactgaattcctcgtcattcaagaagacccaatcatagtggaacttgtggttgaatctatcttcgacgtgtctgatagagctagccaaactccatacgtcactatttctagcaagagaaacgaaagtagccttttcctttccgtccgtggtataagtcttcttcagttcagttgcaccactgctgccttgggaagaaggtttagactcagatttgggagatgagccagttgattgtgacgtgtcactagtcaaccctgagggaagagagtacgatgtggcagaccctcttgataggatgaatcctaacagtaccaggattgatgcgaaaatagcaaaccgaactactcgtgaattgatcctagttgcacctgccatttgtaccgttgtcctgtctggtctggtagttgagagaaggaagaaaagtggaacgcgatatatattgctttgctcgaaagggtggttgacgttgacaagattggccaggcgcactaattccatggaatttcacactcacatatgtaggaataggtagatgtcgcggagatgtttctattgtctttgggtacggtacatgttccacgcatagtgatgggtaccaggtgttctttttaaatattatatactgcaggcgttttttaagtagaccaaatgaaaaacggttttgagtttcttttttttattgtatccttctttcaattttagtcataatctttccagtttgaaggtctggtcagaccagtagctttgtagtattgtcttccacatgaatatcccctaaaagtgaaatccgtgttgggatcacagtagcatttacggttcttccatatgtctttgtcaattggacacatggagtaaacactatgtttgtagcccacttcattgaaaaaatggactttttctttcggtagaaatagcgagacagcaagggaatgaacaggagcatctccccatctttcatagaaaaatttcccggtatcgtccaaaaatttgaaatacttctcgtaaacgtcagatctccaaaaatccatgtctgccacttcaaaattcgaccagaaatggcacaagttataagtcttaccgttatcatcggagataaaattcatcaggttgttttcagcaatgtagctgggattttgtttcatgaactctttagtagtctcccaaagtgtggggatagtcttctcaaactcatggattgatatagtgaagccatacgtcttattgttttctcgcatgtatctgaacaagtctgtctcaacgtcacataaaatttcgatttcaggctccactctccagtaatatcgatagtccagcatcagcgggtgtttgtagaagaatccagagttgaatcgacacatgtgtctgtagctttccagacctccatatactacgtgctggtcttctaactgccttcttgactctgcagctctttcttgatcaatgtaatcaggatacgaccaatgctctttggggatcaatccgtactttgcttgaccactgattaacacgctcgttctctccttgaactcatcggtgaaaggaacttcattcaaaaacacccagtcataagcaaatttgttattgaatctgtcctctactttctttattgattggatgattgagtaaaggtcttcatttctacagagagtgacaaaagtggcgttttctctgttgtagctattcccagaatgataaagtggatcctgtgagtggttcacgtaaggtggttgataacggcttgccctactcccgtcaaaggtcgtgacaatcccgtacagaatcaatgacgaaagggccaaaatgaacaccgctttcaagcttctgaaccctatgtgtaccattttactagatagctaagaaagacgagcctggagaaatgttaaatagcttagccccccctcggtcgctggttcttggagcaaaaaaaaaaaacactaggaagaaaaaaccttaatacacttcgtccctaatggggttcctcatccctggaagaactcataaacgaatcaagaaatatcttagaaaggtacccagtaagaaggcaagaaagataggttttgaagatttgcctccagagctaatctatgaagtattttccttcagtaagttggctccgctctacgccctgaatcgtcatttctacagtgttctcaacttaaactctgcaccaaaaaaagaaagggattttttaatctacaaagtaatctccaagagttttataagccaaaaatgtgattcagattctagtgaggaatttcatttggtattagacgcagaggtctgcaagtacaaattcatgagtctatccctcctgatagagatcatagatagattcagaatctcttctattgaaaatcccgaagattatccattgcttttccagttggatttagaactgtctaacaaagccaatataattgaacaattgaaaaaattgattagtctatttggaggagttcgaagcttagaatttgcacttactgccctgctaggcaataagcaggataatatcaacacagtgactcttgccaaatatgctaaaatcttgacaaaagcttcacgtcattgcaaaatgacgacgttcgataatcgttcatacatggtgctggacaccatatccccattaatcatcgccctagatcaacaccaaaacgaagtttttgaatatcttctgaaggaaatctatgtgagggcagaaaaaatgaaagttgcagctacagagcgcaatcaactagaaacgtacagtaatatcataggttggaatcttcgtatttgggataacgaacaattttggcattttctgagagataaagaagatccatcgttgcttgaatacgtgacaaaactcggtttcaacccacacactctatagaaatacaatttctcccctaaacatactctctaaaatagggatgttgtagcgcctgtcgggcactgatacgtgcttcaggtcgaagctgtaaaaggttggtcaacaaattgagagccagcggctctatcttgggcaaaattgttcctaaatcttgcggaacatagacggggaagtctgccttataatgtggatagttggatactccaggccaagtatgctcattaggtgttcccatcagtctaaatattttggtcaattgactttcgttggactctccaggaaaaagaggcttgcctgtaaccatttcagctaggatacaaccacaggaccacatgtcaattccagtagagtagttattggaccccagtaagacatcaggtgctctataccaaagtgtaaccacctcatgcgaaaatgtgttcacggggattccaaacgctctgccaagaccaaaatctcccaatttcaactctcctttagaattaatcaacagattctgtggtttcaaatctctgtgaagcactctgttatcatggcaaaacatgacaccttttagaagttggaacataaacgacttgataacctgaggctccagagccccactactgtcaccatgagtgtccatgtactttttcagatcttgatccatgtattcaaaaaccagcgtcaatttgttctccgtgtgaataacgtcatagagatctacaatattgtcatgcttcagctctttcataagagaaatttctctaattgctgtcgaaggagtcccctcctcggagtctaaacgaatttctttcagagcaaccagtgttccattggttttgttacgacctttgtagacagtggcatacgttccttctcctagtttctccaatcttcaagggttagtaaaaattcaggtcatcgtagagcaacgcagtgcgaataacgacaaattgtgcttactgttggaacctaacgggttaatatttgaattggtatacatgtaacggtggtgacgcagagacttactgtgatgatgacattgccgtgttaattaatgggttaatcgatggtcgttgcaaaactgacgctacaagaaagactaggtgaatcgcgacaaaagaggaccagggatcttgctatataactcctggattcctagacaaaacctgtaattagtcactctagagcaacgagctggcattgtgacgatgcccactcaagaagaaactaaacattggtgcatcgttttcaacttcgatagaccagagttttcagacgatcattaaatcggctccccttccatctccctttattcccctcctattgcgggtaggtaccacagaaaaaatctcctcactaccaccggatgactcgcgggtgaatatctaaactctcctctgatcttgggaaaaaaaaatttcagtaccatggagaacctgaaaccagacgaactacctaacattttgcccggacaatctcttctggggaaggaatggcatggcttatttgaaaccaaggttgatttttcctctaaacatttcaaaaaggcgatgttgaaccttattagagaacccaatataaactcaactgtcatcttacgagctgatattttgatagaaaacgactacattgacaaatcgtttgtggacaaggcaagtgatcatatagatttgccaaacatggagaacaaagagaattcggttctaaccaaaaacattgatgatactacagttagaacgataccactcagctcaaatctaaagttggtaccagctttggaaattgttcgtcgcataattcctaggaatcccttcaaagattgcataattaaccaaacctgcttgttgttacaggactctcttaatgacgatgctgaagttacacaatctcttattgtatacgtggcccacttagatgacccggaggatattccgttctatctgccatgtgttaaagccgttgcattgttttttgataaaggatctctctctgttcactaccttccatttgatatcgaagaggtccaaaaatggaaaccaacagaccgcccagtcagaactgcttaccgtctgttaaaaacatgtaagaaacattctgaaggtgtgatgtctggttatgaaaaacgggtcaaccatgacttaattgtgcctaaagaagattttcaaaatcgatatatttctttgaaaagaaaatattcaaagaaccttgtggataattggaaagaatcaacagatccaagaaaacatgtctttgaagacttagctatagcagcattcttaattgaactttggagtcaaaaatacccttctaaggattccttccaatttagagatctaggctgtggcaatgggttgctggtatacatccttatcatggagggctatcatggaatgggaattgatgcacgtcgtagaaaatcatgggattcctatccagaatctattcaagaaaatcttctagaacaagtcatcattcctagtgtcttacttcgtccacatccagcaatgattgctgttaacccatatctcaccgacaatgggtgcattttccaggtccccgtgccgttaaaacacattcacgatactactagcagatctctgattgattctaatgtccccataatggcatactactcaagcgccacgttattggaatcacctcatgtgaatactgccgaatttcccccaaacacttttttgattggtaatcattctgacgagcttacttgctggatgcctttattgaggtttcccttcttggttatcccttgctgctcacatgcattagatggctctaaagccagatttcctcctcgtaaggttaaacgcaacgataaagttcagcctacttcattccaatcagcttcttcatacgcaggattagtagaccacgtagaggatcttgcaactcaagtcggctggaaagtggagaaggagatgctccgtatccctagcactagaaatgctgctctgattggattcgattgtttaaacccagaaaccgatgggccttttaagtcaatctatgagatacttgctatggagggaggggcagagggttgggttgagaacgccatggcattatccagtagaagccctagagggcactaatatctcaagaatataaattacctacttaatgtacaagtttggacgcttaatctaatgcttctgtcgtttctttctcctacgtttgtctgcgatgatttgcctgacatcttcagcctttttatcttcttcggcctttttagcttcagccttgagctcgtcctcagtctttttcatctcgtcagcctttctcttcagagactcttttcggaaattgattgccttctccttccttcttctgacaacttgagcattttcgattgcaaattcaacaataagtcttcgtttggaaaatccttccatatttatagattttttctcgtcctcatttagaccttcgaaaatttcctcgggagttactaagtgtgcattcaaccatctaagacccatcaacgcatgtttatgatccctgtattctaaaaatccataacctctagacctaccttgttctccagtacctttgacttccgtaataattttagactgtaagacgacacctttcttcttgttctttttctgaagggtcacagaagcatgtccagtggtagcttcatcaagcaattcttgaaagttaccgccttccatttcaaacctatgcttggatgatctaaccaattcttctttactgaatggattacgttttccttgtctcaactcggtagcaaactcgacaattgccttcctacctagagctttcaacgatttttcggtcattgcacgaggcaagtttctaatagctaacctggttaacgataaatgtaatgttgggtttttgtttagttgttgtacacgaagtttataggattcctccctggcttttaaatctgcaggggttaacaaactagccaacacggagttttcagatattcttccctcatgcaacaagtaaatgtttcttttgtccttttcaccttttccaagcgcttcttgacgctttttttcatttctctccattagccttcctgcactgtctcgatcaacagcaggtgcaatggataatactcttccttggtaaacatagaggggagaaacttcatcgggaagaagaacagagttggaggttggtttaggagcgttcagaagacagtcttcataatcttgagagttcttaaaggcaacaaatcccgttcctttagcttgtcctgtgttatgatcaaccaccggcaaagcatacctgataggaccaaacttctcaaaatgttcttgaagcgtctcttccgaggcatcatagggaagattacgaatgaaaatacaatatggagtttgtctgtttggtttatggtcttcatcttcctcatcctcatcttcatcatcttcaatttccccatcttcatcgacttcatcttcatcgtcatcgtcatcgtcatcctcgtcgtcgctctcctctttcgtttcaacctttttcttttccaaaaacttttctttctctagtgccagttctacttgtacttccctgccgtcaattttcagatcttttgatccggcaactgctgcctcggcgcctgattgctttctcatagtaacaaatgcaaatccactcattctacctccggcttttctaggaataatcacatcaacgacattgccaaacttctcaaacacttccttcaagtcttgtgaacttcgtgcggaccatggcagatttctgacaatcaaacgaggtcttcttttctcaatcgattctttatcatatttaggtttttcacgagcaatctctccgctagcttttttctcctttctctctcttcttttggcaatatcaacctttaaaaggaccttgttgaacttctttgccttggctcctgcaagagccaacacggagtcatcttcggacgtaaaggagacaaatccaaaccctttggaatcttcagctttatctgtgacgatgattgcatgtttcacaggagcaaattgggagaaaaaatcggacaactgttctttggaagcattagttggaattcctcttacaaagagggtattcttatccacctttccttctttattggaatcgctcatgggtggttttgttctttagacaaactttccttgaattaatttttttcttccctaatttttttttcctctaccgtttcgcgctgcgatgagcttccatgagaagggctaaacaaatcttccctatctaacatggacaccacagcttcccaagttatttcgaatagctacattcctccaaggttggcagagcaaaactcccgatttctaaaccgggtcgccctaaaatcccttttggaactggtcaaaatatggagcaggtggcccgcaacgaaaccaaaacacaatattggatcagaggttgatttgttcaccgagtctaacataaccaagaagaaactcatagataagatcttagtagaatattggccgaatggtttgaatctgctacaattgagtcaaattgatacacagctaattgtcaagaagccctctgcttcgtctatgggcagctcaggctggaccagctctatggcgaaaataccactctccggggaagagttgatgataactatcgagccacagttgttcttggatcaattgatgacacacctttcaaaagtttacttgtgtcacagttatgtagccaagcatccggttctaccactaacaataataagagttcaagtatttgatttcattcctatgaaaaagcggattccttcgaaagatgaactggtctcccataaacctttcttcttggcaattcctcaaaattccccgttcgttattcataccgcttttcaagacagtgttacgaaaactattatgcagtctattgagttaacacttagttcttctacgaggcaggttgtgctggcacctacgaatgatcctccggtgaaaactttggaagcattgcacatattcaaaggaaatagtaggttttcaaattcattagggagctggcagccatatgctgatggagatgtggatatgcctgttttgggagaggagaaaaatcaccccattgtcaaagtgaacagaattgacaataacgcagtttccaatcgtcctacgcgagaacaaatagccatgttacgtttcaaaggtactgtggatcccctcaaatcggaaaggttgtttgaagatacaagggcaattaaggaggttgaggaagacaatacaaacccttactcatcgattgcaccggtgcaatttgtaaaactggcacttaagtcggcagatgattcgaatgaaaatccgatcaccattaaattcacaggtacagatgtttacgcaggattatacgagctagcagttaaagggcctgtggatgcagcgctcattccagaggcgttaactggtgaatatggtgttgagtccgggactttggaaaatggaaaattcaccaaagaggaaacgatattgctggacaataattaatagattccttcataacagtgactatcctattctggttacataatcttcgattagtctcgtaatgccaacattcgtagacccagccgtatccttcaccaactgtagtaggtcaatatctttcttcttggaagcttcatctgctgccagtctgtattcaccaatctttaagtaaagatcggccctggctttgtaagtaagttctttgcacattccaatgtaaagtccagcctgccttttttcgttttggaggtaacattccctgaaaaacaactcgtaccccacaggagattttttcgatttggcaaactggaagagtttatcccattggtgtgatttggccaacgactttacaacactgtggtaaagctgtgtcgagctaattccaaattgataggcatacttttgcgtttcagttagcttttcatcatccaacctggccaactcagaaatagtttcaatcttcgaaaaggcaacaaaagagtggttaaacttgttagtcaaagtttcttgataattgagtagcttcaagtgagattctatgatcgggacatcattttcataaaattttttgccttcatatgctttcagcagctccaataatcgatttcgcttggtttccgcatctaaggaataagttgaatcctgtaacaagttcgattcggctatcttaatcagttgatcatcctgatagtaatactctaatagtaaatcaggtttcacggatccaattatatctttaaaaataccaatgcttacatcagttgagtctgataaaagtatgaaaaattgtgacagggaaaacttgtaatacagacgtagtagaaccgaacatatcaaatccacattgccactttgttcagactttaacaaagcatttttgtcctgacccatttgcaacaaaagaggcacctgattctcaaggacaggttcatgatctagtaacaaatgtgccagttcgactctcccttcgttgtaagcaacctcgcttaacccagtataagagacccttttagtctcagctaacttgtcaagaattatctcgcttaattctttgtcattagtattgtatgaactctttatctttaacttggcccaagcaaagtatatgttatctggaaaaagagaaaggaatttgcagatcttagaagccaataaaaacaagcgccttctgatcaaagattgaattagcccttggtgtccataattcagcaactgagcatatgtgataaacatgcctacctcaggttgccgaacagcattaagaactctcaaattgttgcaaatctcaacaaactcttcactactatagaaatccaagatactcttaccaaaactggcagctcgtaacagtttcttttgccattgcggatcaaactcttcacttgctgaacgaatgcaattatcgactgcttccaccaaatttggtttcactattctcaagttttcatcagcttttggggaatgtctatccaattgatcaatggaatctagtaaaattgcacttgccttagtggaaccaattctgaaagtttcttcagtgaaatttgcaactctagatagaaactccagcttggattgagtaagtacagttaagccatcattctgtgaccttatgaatggcctgttttcatagtaaaaagaaatggaatcatcacctggaccaattacctgcagctcgtcattagtagctaggaccacagcatcattactacaccactgcatggaacgaatgtgtttaaaattgtgtgaaaactctgacaataagttctccaagtcagacgttgctatgattaagttatctggggtcaaaagagatgcaaacgaaccattaggaggaaactcgattccagtaataacctgcccaaattttactgatgtttctgtcgtcagtgtgcttatgtgaattgatttgttggaagaaacaaacagttgtaatacccgatccgagtagaggatattccagcagtctatggaatctacgttaagagtgaaatgcctgggtacttgactgaaagagctgaaaaatacaaatttcttttcatttgtaagtacaacaataccatcctggaaaaatttggcctcttgcactatcgagtcctcaggaagattaagtccaaactcatcaaactcactggtcaggtctgagaactttcgaatagtaccgttctgaagaacaaccagcagttcttcgttgtctgtccagctcattgaaacaatttgaccattggaaagtagccacggaatggaattgagcaatactccagatccagagaagatatctatggatgtatgcgaagaatgactgttgaacactgcaattgcagctgcagaattggagatcgctacaggctgttcatcaagctcaatatcccattgaagaggggaatagcattctctcagcctataaaagactgtatcaagtctttcccagcctaaacttgggttgttcattgatagcgaaggaaagtacaatgctagatagaaggagagttaatcttacaagaattcgagaaagtatcagatctaaaatgggcaaacttttatgaaaaattctatagaagtcacaatggcagttacaccatttgaggatgcagtgatataggtaaacaagcagccggacggtaatagacgtaattaacctgtagatgttcctgggctgagccagtttgtttcccgttaaaaacgtttccagctatcgcgaaaatgtgagattatactaggaaacccattcgacgcacctttgctagatattccgaagaatctaatcttcaactcacatatttcatcagccttgaatgtccgacgaagagggggattttgataaagaggagtttgtcacgcttatttcttccgatggtttcaagttcataatttctaaggaaatcgcagaggtgtctggcacacttagaaacatgctgggaacttccttccaagaggcagaatctaacagaatcacactacacgaaattgatggcgtactgatggagaaaataatacaatacttacactacaattttcaatataaagatcaagttgacgttcctgagtttgatatacctactgaaatggcattagaattgttggtggcagcagacttcttggacgtctaatgggttcacatccagcagctacctcctagactggttattatcactaaaacttgcatataacaaagggtcaaataccgacggatttttgtatggatcctgatcgctgtcctttggtggccttggtggtggttgagaagtgccttccaaattcaagcttccgagtccataacttagggaatcttggcctagagcattagcttccatttgtctttggttcgtatagttcaccactgaattgtgctgttcgttaacaaggttaaatagctgtttgtaaaagctgttagcttgtttcaacccagtaacatatgttttccattgtttgtatgcatccaagtaattgtttagctgtttagattgagtttccttctgggaatgtttggagagacggttctttttgatagtggggtcattcaagacctcactcatcaacactttgatttcttgcatcaaaagattctgtcgctccccggtagcttcgattctgtttctgtatggttgaaactttaacagctctttcctgaatacattctcttccatgtttggattatccttgttgatgagaataatgctggaaatatcatcttttcgaacagcagtcttgaggtcattgtaagtatttgctctctcctttcttaaattgtgtagctcttgcacttttgagtccagttggccaatctttgctttagtattgaaagatctgtcatcaatatcaagaagggagacttcactgtctggtaatgaagggttgaaagcatttctaagctctgaagagtgaggcccacctgataggatattaagtacatattggtaagggctaatcattgattcaagtttcttatctgacaatgacgcatcttccaatgattttctagtcctggtcaagttctgtttgtaggaggaattcaacatggtagatggctgctgtgtccacttagcgccatatctcaatttgttctcgctatagttgcgttcttcattcaaaagtagattctgcgtattgttgagtttgcttaataactcttcttttattcttctaacagcttgggcttcagtgacgtaggacgagtcttgaatctccagtgcagcactcagaattctgggatccaactcttgagttgagtcgctaaagtctagacgaagctcatccggttttatttctaacaactcctttaattctagtatagatttcggaaggttcaagtatgacatgagtgacgagagttcttcatctaacagctccacgtttgacccttcctctctcaaaagttgggcctgcatctccgaatacaaagaactttgttcgtgaaccgacataggaatgatcttttcaaaaagatcttttcctaccgtagccgaaaaatcttgatcggctaaggatattggtctggcaccttccagaggtttaattattggggctgtggaaggaacatgatcgttgaaaacaaactcgttgtctttttcaattgaaggtaactcaatcttaattagttcggatagttcggactggaaatcaccgatttgcttgaagtcagacggcaagaaagtgttttcacattccttcagctgggactcagcctctttcaaatcagcaatggcagcaccatactttgaagtggctttattatgcagggcattgtgataatgagctagcgcatcgtagtaaatagctttgtatgcagtcaactgagagaaagtaattgggacacctttagaaaggaatcccttcaaaggttcagtgatagactcgtacatatttgaagcagctttggctaatttagcagccaatgaatgttttacattagcagagtcgtcatcgaacattttgagtagaaagatttcttgcgcttgggctatcataactttttggaatgttgttacaacttcgggatctagatcacctgaaggagcatgcaagaaattctctgcaataaattgcaatataccggcgctatattgaaaattggtataacttgccttgaagttgccttctgaaagactggattttccaagctctgaaaatgtggctgccaagttaaagagaacagaggctttttcaaacgcagttgaatgctgtttaactttactagaagttttaaaagcatcataccatgtgaaagaaacattgaggtgctttattggaattcgaagtcccaatagctctagttgtccataatacttgtacaggatgtcccggcctagtacatctggtttgaggttatgtatgtcagatctgattgcggaaaaggtgtcaatttcattggaaaactcgtggttggctccataagccagttttatgtggctgtccaaagcacttttccaatcagtgtcatcctttgtctttttcaaggggagggtgataagaggggttttcatgagttgggggtttggaacaagcttaatgctgctattgtaggaacctgggtccttatccatttttgagtagtgcagttcagggttactagaagtcaagagacacaatgcaagacttgaaattagataacgaaagcctagttcagttttcgtcattcggtgaggccttctatctcatacgttcaccatcctgatcctatatacgagtttcccccttgggagcaaatggcatctgtctgttagtcaacccctaaatataggtagaatactgcgcgaacaaagattatctcaaacttgacgttccggcaattaaacgggccttgcttattttaactgatcatcgatgaacatagtccaggaagaagttgaacgccttggaaagaataaggcactagaaaagtgtatcaaagagagtaatgacttactgagctatttgaaacagaaacaagaacaattgaatcaggacactgacgacttgaaagtacaagatgtgcagataaagattaactattgggcaaatcagtcattgaaacatgagaaatccctcaataccgttatcaaaaagtatcagaagagtatcgataaagtgtttaattttgacttgagtgaagtttacagacatcgtattccattggaaagcacaagatgtagacagttagtcgatagagcactaataatgcatttgttacgaattggggatttcgaagctgccaataccattgcaaaaatggataacattcaggtgcctgatcagctactcaacaagtttcatgaattggaagaaatatctgaagatttgacagttcatcaccgattggaaaaagcaattgcatgggccaatgtcaataaacacaatcttcaaagaataggatcagatttacagttcaatctgcataaactaaagttcatcgatatttacaagaagaatccttcatccccttatcctgcctatgagtatgcgaagatcaattttcctcactttggaaatactcacttggacgtgatatcaaagttaatgtcatccactatatttactcccaatgagccagaaaatccgtatttggattcaatagacttgacaagttctccctaccagaaacttttcacgcagctgtccagagatttctgttcattcgtggggctctcctcagaatctcctattttcaacacacttcaagcgagctatattgcgattccaaattttgttaagttcaacaagatctcgaagatgaagaatgagaagctggattggacctcagagaatgaacttccatttgaagttgagcttccaaaatctctacaattccactcaatattcatttgtccagtcagcaaagaagaaacaacgcctcaaaattcaccaatggccctaggctgccgacatctgataagtaaagactctttagcgaaactaaagaagagaaactcctctatcaagtgcccatattgcccaaagacgtttgctgcgaatgagatccaggaagttcagttcatataggggacctattcacaggctgggcctgtggtcccgtcaaagccctttctttataagctctatgattacacccactgtctgttcccgatcctctaagataaacctgtttgaattggttagcttggatcttctgactataacctgacgtggctactactaaaaatcttgcatcgtttgaggtatgtttatgcagttggtggcggttgaatagttataaagcgtgtttctagctctgccaaacgcaattccggttattgattggacaatttttgcatggctgtgaatacgtcgcgatggtaagtgaaaatatttaccacacaaccatggcaaccagcgatccatgctcgactaatttgtttactattttattttgccttgaccctgaactttctttggtcttttctctttagtaaacaacttattcttgttccatacctaccctagtctttcattttcaacgaacaatcaatcaagtgtcatcatgaaattgctcaatatcgcatctcttttggctatcgctgcctctgcttccgctgaggcaaccaccactttgcaaactacgattactattactgaaacgcaattgtctccagaggagagctcttcactgttatcagtttcctctgccagtgttgcatctgaggcttctgctgcttctgctgcttctgaagcctccgctgcttctgtagcttcggagctttctgctgcatctgaagcttctgtagcctctgaggctgcgcaccaaacgctattccgcaactacgctattgctattaacagtactgtgaccccttctgtcagctcatcctcaccaacaattgcagctaactccacagtggtttcgtctacactaactccctacctcaatacgacgagtgcgctgcccacgaacagaacagttactacgactgcctccttttactccaatacttcaagtttccacaacagttctaccatttccagtactagaagaagttccattacatcatcttcttcttcgtcttcttcctcttccagtgaaagtggtgcccctacaacatcctctacttcagcaacggatggtgctgccatttaccaagtatctggtgcatctttagggttggctgctattgctgcaattgcactgttgtaaatgattttgagtttgattcttacgattcaaaagatatttattaatggttcttttttcaattctataccgttacttctgaattaatatcgattacaaattttaacctccgttaacttatactaactgttctttggacgcttcaagttttgtaggtctaaaactgcgctgtataatgcatttcttcctttcgttttaatccatctacccaatctatgctctttggataacgtggcaaacagtctaatcttcccgtcaaactcgcagctgtctatcttggtgacaacaccgttggcgttagggagttctcccaaaagctcaaatgaccgtaagttggagttgatcttccacactctaatagtcccattccaggaaccagtgaaaaacacgtcagaaagtggtaatgaatgaatggcggtgacccagtaagggtttcgcttggggacctgaaactctgcagcttgctcatttatctctcctgatgcgtcaccagatggaatccgtggttccaggccatgcgcctgtctaattacaaaaattggcttcttcttgttgatggcccaaaatgaaacattaccattatctgacccagtaacaaagtgggactcatcaaccatagaaatacaatctaatgagccctcggcgtaaaagctcaatttatcagactccttagaattcaaatttccaaacttgttcttcttttcctctgaatctcctcctctgaaagttaacttagactcttcaggaatcttccaaagcatggctgttctgtctctagaaccgacagttacacatctttcctgactcaaggctgaaatatctgccacaaagtcttgatggccatataaggtctccaactgagacatctgggccaccccataagtcctaactttcaaatcaccacatgcagcatataattgatcactctgtttcctgaatacggtactaaatatcacaccgtttctgttcctaatttcccaaacccttaacggggataatgcctcagtactccatactattagtctttgatcccttccaccagtgactacgtacttcccgttagagctagctgaacatgtcaagacctcaccacaatgcccgttcaaatgttgctctttattcaagtttctatacttgacaccaccctttacgtacttcaccttttggggctttttgttaaagtcatcaattttccacttgctcaactccatatcttttgatgtagtataacagaacggatagcttgcagacacacacgtcattcctttagaaccaactctactgattgtaggtttgcaatccctgacaagcaacttgtcagcaatgaatttgtatagtgttcccttgttttcgttgacgtccatctgtaaccttcttgccagaatatcgttgtccagatcttgagcatcgaactcgtagctctcttgttcagcttgcaggttttcaaggtattgcttggccaaacgacgtcttttatctgcagcggtctctgcaaagtcttcttcatcttcagattcactggattgctcttccttcacttctccatcagaacttaaattttcggtctcagactcactggtgatatcttcatcagctctttccgtttggtttttgttttgcgtttttgatatcctgttcacattggaagtggggggatttgttctcttacgcttacgggaaccatccgataaaaacggatcttttgccattgtgattgtgaggtaatgttaggaactgattgaatttttttattttctatttttttagtgagcacttgatgaggttacccgggtgaaaaaaaaatcaactcttctcgctagaaggagctacttgacgctacatggtggcagatggctgggagggagactagaaggagattcgttaacatataataatagtccccggtgattatggttatatattttctattcatctggttcggaaaacagcttgttgtttccagtgtaaggataaaaagtcaaaatcgtcatcacttgctcttgaagttctgatactgacttagggtcttgaggttgagaactggtcattttcttgatttcactctttaggccagagatatacgtatccataatgctttgatactcgtatctagatgagttcacctgtgactttaacttttctagaattactatcggtccgtcttctggtttgtgctcttccaatatagaatccaagatggaagtgatggacagatagagactagtcagcttgttgatttgctcaaaggttactacttcatcttggatcttttttgcgatatatttctcaaacatgtccacctgagtatgtaagagaaccaacgcttcggccttccatttcaatttggatagattagttttctgggatttaagctttttcactgtatttatcacattatcgatgtacttttggttgctggcaaggctattcttgtatgaggtaacgtcaaacttgaccatttgtatcgtttccactgtgcctcccactgactgtcctaacgtgatgaaatcctggtagtccctatttatgagatccacaagctggtcgtcaagctgatctagaagatcaccaagctccttacgaaggtcctctagcatcataaatctatagttttggtacaggagtagatcagcatcaaatttgccgtcattctcctgttctacttggtcaacttgataatcgaataagtcctttgtcatgtgctgtgtaaatggaaaatctgaatcctcatcttggttctcttgttgatcattaaactgatcgtcagcaagaagagaatcaatgttgacactcgacgtcgttgccattggaattgtaagttcagtcttggtcaatgggtccactctatttggctaacggatcgtagattacaactttcgagtaggtcggatggtgttatgattacttaatcacaaaataaattggacttagactgattacaagaagtacgtactcttcaaatggtttactgaatgctttttcggcatgatccgctaatacaacaagcatacatatccgtatgaatacagcaataaatccaagatttcacaagctcatcaccaatgagctttcttttattggacccgaacaccacctcatcgtggctatttttcagacgcgtacttaaactcacgtctcagttgtgccaacccatcacacgccatgtcattggagccagtcaatcaactggtgttttccggtggaggtcaaacaattgtcaaagttacagatgacttcaagcatttacttgttgcaagtcaaaaaggtttactgaaaattttcgacgctgatcatcaagagaatgaaccaacaacgatagatatcctgcaagatatatcttctttttcaacttgtaccaacacagacaatatcatagcgacttccaagaaaggaactgtaggtttttactccttttcgaaccacagtctcaacaatatattattctcttcagtgttacctttaagagactcatgtttaactaacggtggaaatctggctgtggtaggaggtgatgactcagagctaattctgttagatcctcagggagaaacaaagcttattaagaaaattgggctgaacaatgaaatcacatcactgtcttataatcgggtttctaatcttgtggctgtatcgctttctagcagggttgtaagagtatactcgttaagttcacaaagtccggaattcgtatccagcattgaaggtcaaatacccaaaaaattgttccaggatgagtttgacgatagtctagaagatgagtttgacgaattggatgaagaagataatttcacgttcaaggatgacaaaactaagaataaagcaaaggataacaacagagtttccacgaagccaagctggagaccagacggtgaagtaattgccattccttgtgaagataatattatccgtttattttccagaagcgatgacttttctgagggagttgcttttcctggaaaacaccgtctttctttggtggatctatcttggtcgccaaacggtaactacctagcatctgttgacttggatgacaggctgataatttgggacactcagcaaaaaattgtcactcactcgtacaacctccccaagcctgtttacaatgtcgattggatatccataggtgatcgttttgacgttgttctgggtacgtttgatggccacattttgcgatttaatggcgtcgttcctcgaactggtacaacctctgtcgataaggcaacgtccttgtttatcgatgccgaagctggcgtttccgacgtagagaataatggcaatgttgcagaagccattccggacgctgatggtgaccttgacgattttattatagatactgaaacaagtacgacaaaaaggcctccaaatggattccttgatgaagatgatgaactgtttggtgaacatagcaagaaacgaaaacctcctaccattgtgtctagttcttggaaaattacaccttattctccaggagccactccttggtcgtacgataaaaggtatttgactatcaattcatttggatactgttggtctgtagagcagacagcaaattacactataacagttgattttttcaataaggacctccatcgatcttatcatttcaaagatgtttatggatacgacctagcatctatgaatgagaatgctcttgttttagcaaccagtggttccaattccattaatccaaaggcatcctctactaaacgaatccttttccgaccgcatgacactgatatatctcagaattgggaaagagaggttccgtgccagaaagatgaatatatcacatgtgtatctgtcagcaattctgttgttgtcgtagcaacttcttatggttatatcagatcttacagtctttttggtgttgcccaaaccatagaaaagacttctccattagttgcatgtatggcacatggaaactacatttttagtgcgacattgcatggaaactctttgagattcagtatgcaggacttagatggaaagtattatcagagagatgcagcattacctgtgaatgtcgatggcaagaacgattttgtattcaagggactcttcttcagtgatgatggagatccttgcctagtgggacatgacgatatgttgctggttctgtctcgttggagagacccacttcaggcccgttgggtgccaatattagatatcgcagctggtatcaagaaagcagcttcaagtggggataaaataaagagctggcccctgggacttatgggtgaaaaatttaattgtataatacaaagaacaggaattattcaatccagttcatatccggattttcctctccgcttgcctacagagattgaaattgagttaccggttaatagtgaagcatactcagaggaggaggaatctttgaattctgaggaaaactatgtcaaggctaaagttctaggagagctactaaatgacgccattcagaacgcagatgaagatgaagacagccttgaagattcagaattgagattgtttgaatattcaaggttatacgacaaatcattgcttctactccttgctgacgcatgctccaaagagaactcaatgaaggcttttgcattggctaacgagcttagagatgataaggcccttagtagtgccattaaaattgcagaaagaagtaacctggagactctagtacagcaaattgcagaattaagagaagagagacttgaacagagccaaagtcaaacataaataagataagttggcaagttttttcaatttacatataataatagctaacgtttcttcctcttattgcttggccctgaaactttggctatttcttttggagtgatcaccaatccattacgagtgcttcttccaacggagttaattttcagtcctctatctctcattttggtggcctttttgatacccgtacctattctatcagatttgtttgtaacacggtcaccggttgccaagtttctaaattcgcctttcctcttctttgacaggacgataccagcttccttagcttctttttcaaattcagcttctctttcaagctgctttttgatcatacctttcctcatactcatgggcatcttctccaagcgagcaggcagtccaccattctttccattaattgaggccagttttcgaacacgagcgttcaatgtacgtagcctagccttgccaatggggtcttcaaagtcaatagtatctaatagatcagcaccagaaaatctctcagaagatccagccaaaaggtgggactcatccaacaatctctgtagttgcaagtcattgaccaaatgttcctgttcttcagagttattagcggtagcatttttcagagccagtctctgtttctccttaagttcctttaatgaaataggttttcccgctctggccatttttagttcatctttagatggccctttgaatgtattgaagttttcagtaaacttaactgtttttggttgtccctttaactgtgtatcattttcatcgtaatcgtcttcccctttctcttcgttttcactaaaaccattaaactcttcactatcagattcactgtcattagagctatcatttcctgatccagaatcatcttcactatcattatgttctttattcttcttcgagctttttcggacctttgttttatctatatatcccatatcttctaaagagccaaactgggcctcaaagtttcgcctctggatttctagagcatccaacttttcactgtccgacatcatagggtatgcagtagatgatatttttttcttccagtatcttatgtaatcggaattctctgtgattatgtaagagtggtttttcggggtgaacaaaggaggaatcaacttctttagcttcgaagccctccacctaccaactcacttctcaaaaggaaatgtctcgtttttctgattacacactctcctgctttgtcatggttttccccttgaggacgtttcaattcatactagctacaagtggcttgaactgtttcgcacacgaaactagttatcaatacaagcctgatttcgagctgattagctcatcgctttaacaaccaaccctcggcctcctcactgcccatgtccttcaacaagtcattcaataagctaggatcggccaaggcgacagcctccgtctctactgcgaaaggagattctgtatctgccaaccctacaagatcggaatccgaaagcgatagaggacacaagcagctgatcaacatcttgggtcaatttgaacctcaccacgacaacaagcaatggaccagtatagaagcttcgactgtctcagaccaagatctctttgcaaatgatgatgacagtgatgatgatggcgatgaagatgatgaagaggaggagggagatgtcatagaaaatgagaaactaccttttaaagaaggaccctcaatcgcagaaaaggatgagcaaagaatagataagaagcccgaatcatcaaagctagctgctgaagtagaaccacaggtcaatgtttctaatgagaatgaagattcttccgagccagatcattctgctatcccttctacggctaaggagggcattgaaaacatcactaaaggagtagatagtattcaagtaaagtctgaaaacaaaagcaaaagtgagagactaactaagcaaaattcagcaaaaaaaaccttgacaaaatttgactttcaaaggtttctgaaacagttaagaagtaaagattgtgagcctgtcttgaagtatattaaatcgttcttaactcaatttcaagctagaacatggtctgtagatgagcagattaaattggtcaaagaatttcaacagttcatttttggaaaacttattgaatgcaaaccttttgacaacttatcaactgatgaggatgtgaacaacactatggaaggtcttgagaaatttattatgagtagaatatacaatgatacttttcctcctctgatggtggaaagaaagttatcaccatctcatagagaagatttatcgagggacaaaatctatcatattaatttaaagaagtacaggtggatccagccaaaacatcttgacatccacttgaagattgattcagaaacctctttcgttaaacttgcaggaaccgaactttccaaagttaatgactataaatccccaagagataaaattatatgcattttgaactgttgtaaagtgatctttgctttgattaggcaacaacagaaaatccacaaagtggaggagaatgctgatatttttgtccctttgctagtttttgtcatactcaaatgtaagactagaaacctcatcagcaacctttcttttatcgaaagatttagaaacgataggtttcttgttggagaatctagctactacgtcagctccttacaaattgcagctaacttcataacaactattgagcaatctctgctgactatttctgcagaggattttgcggctgaaatcgaaaataatgagcgtaaacttaaggaagagtctatcaagagaaaacgagaacagaagatcttggaagaaaaaaaggcacaagaagatgctcagaaacaaggtttgttttcaccattgacggagatgattgctggaacgggaaaaggtgaggactttgctccttctcaagtactgaaaagttccgcgggtatctttcagcaatctctaagtactcttttctcttcaccctcacgtgaatcttcgcctgttagctcttctgtggacgaattgaaaactgcaaagaagcaatcgttggaagaaagcaagaaagaggcaagaataaaaagtgagagagaaacaactttaaaaaaccttaagcaaatgttcccagacatggactctgagattttattagatattgccattgctaagaattcgaacattggagattgcatagatgcctgcttggagttgactgaatgagggtatttctgttagtttaacttacatcgctagacctacattagcagccatacaaaggtggtcactcccaaacattcctgccttaggaaacccttcgttccctaattctgcggggagaggcattctcaaaagagaattaattgctattccagtttgctggaatagttggacattatcgatcggggccgttctatccccaaacccccaatcctgaataaccaaaatataatccaacaatcctctccaagcatgagcccagttagaaattagtggctcgtttctatcattgtccttgcccgcattttctgagtgaatttttgcgtacgcagcactatataaagaagtcgcaataactggtaaagagttatgtaatacctgtatttttttgactagttctttttgctcatctgtaggactaaattggtctggaacaggagtttgtggttgttctgggccaaatttctcaatatttcccccatcttcatcttcagtcgactcgccatttctctttttagaatactggaaagatgttgagcattctaagaccgttttagctctccccgagtacagaactggttttgaggtcatcgaaaggtagggggcatcgaatggctgagagttaagatctcctgcgaacagagtaaaccactcgtcgttcattttatcctccttttctgaccctgttaacgacatatggaactctttcatttttttcaggattaaatacgtttggcgtgttctttcatatgtgccaaatggatgccagaacagatgtgttgtcccgatcagtatcccttttctgttgctgaagggaaacttttgttttattttctctgaaaactcaagagctactaagacacccacattctgtgcaacagttctaggtgctatatctgatgttttctcctgatcatgatttatatggctaactttaatgcagttgaatagcgctttcctccaaaacaccactactccatgattcttagtcccttccctgtagaattgagaatcgtagccaagttttcctagctcatcgttccagaaagagttgaattggatataatcaacttcttggagacacatgatatcacaattgtaatacttcaactcattaagtaacaccacggatcggttaccccatttaagggcatcaccactggtggggaatagctttcttctgattaaagcttgagccaacatattataagtcataatgctaatgttaagcctttcatcacttggcacagcaacttgaagcatttttcttttgataaacttcaaatatggtttttcaattgtggacactggatcaattcccagtttggtcaataagtctcgtttcttattcttctcttcaagcttcaaggctctctgttgggcgatatactctggagtaagcagagcagggttcatggctcctttcttcttggattttttagactttttacccgcattctgtgggggcagtgggtcttgttcaggcattagagatggaagaaacttagagcaaaaactgagcgagaaaatgaaatttgataggtaagtttaatgcagagttttgatgtcctgctgtaaaatcttccccacagacgatataatgcgatcaacagtaagttagcctcttagttagtcacaaaacagtgaagagcaatttatcagctctatggggaagacacataacgaaagagcagtcactaacctaagagatactttcataccaacatctatcagtacagaaagtggaaactctaaattatacagacaaataataatatatatttacatatcctttacaaattcttttgcagtcttgccaatgtagacaaaaggtcgttaccactagattcattggaaccactaccactattaggattctggttgttttgagaatgctggtgatttggtaaaggtcctgagttggattgaggttggttatactgtccaataagagcacttatatcgttgctggatggagtatgttgacggttgttgccataaggatcgtaatgctgttggcgttgctgctgctgctgctgtggcggtatctgatgatttccatagtcctgttgaggcatttgaggtggagatccgctacctcctcccataccttgcaccaacgaaagaacattttggagagcacttggatccagattctgtagttgttgcagagcttgctgttgttgagcattgtaaccttgttgttgggggggctgctgccaaccttgctgttgtggaacagattgttgctggggtggttgttgatatctattattgttgccccattgattaccgttgtttccgctatttccatatcgatcctctctttctctgtacctattttgtccagagatgttccttctcatattaccttgaccttggctcatctgattaggattagagttttgattcatgttttggttttgattttggttcattcccatgttaccatagtttccgccataggaacttgatcccggcatgcgtctgcctctttcttcattcctttgctttttcatggcaggcggtcttgtggtatggttagaaagtaaaatgttgacagcctcatcaacattgatacgtgcatactcttcaaacttgattcctccatctggcgatttttgaaagaccttcaaatttacagtgttgttattatttgtaacaataactccactggtgccgttgtatgcagcgtcattgaccaggtcatcactaacatgaggatatttattatccagctcgtaattgaaactatgcttttgcaaagatttaatgatggcacggttgaaagcagcatttgaaacagatgtggcaaagactttaacttctggaacgttgttgtcaacgggtggtgagttatctctatagtcaggaggcgatctagatctacttcttctagaactggcctgagctgtgacaggtttccttccctgctgctccagagccttttgaatctgagcctttgagatctccaagtgcagcatctttccatgcagagggacgttcgtttcacctttgatagcatccgaacaggattcggcggaatcaaactgaacaaaaccatacccttgtttgatgttgatttgctttacgttaccataagcgtggtagatacgaaagacgtcttgcttgttcactgtggaaacaggaagattaccaatgaacaatctagaaccgatcgggaaattatcccatttaccacttttcaagaaagtcgactcctgtgctacaaactgagagtagtctctcagctcatcaaaggacatctgaccaacaagatcaggtctctggcaatagacgttgatggggattagcgggaactcggcgttattggtccttgattgcgggttattgaaggacgtagtagcgccaaagttgatactgattgtgtaggatttattgttagattcattgaaggccttaagaagggcggcctccttgtcagcaggttgcagattttgaaagttccggtcacttactagtggactattcatgaaccaagagatgatttcgttgaattgccttacctttagaacatcagagtcttcttcttcttcatctggcacaactggagcagagatagtagtattggcatatccagagttgagtggctccccagtagaagaaggagttgcagtagtagggagaatagtagaagtagtagtgataggtggcgcggtggacacagaaacagattcagatgcagattcagcaggtttaggttcagtttcgaagcctccttccggatcgtactcgtcgtcgtcagcgttagaggcttcttctggagcggtgacagatgcggtgtcctcaggttttgagaccacctcctcggtgggaggagtttccttgatagtttcttcttcttggggaacttgaggtgttgattctggatcagacatgattaattagcaaagtttacttgcccttgagtcaattcagaaaaagaaaggagagtgggtaatggtgaactgaaagaaaagcaaaataacgagaacagtaacgccatccatttgggagaactttgtagtaggcagttgggttacccgacgtgaaattttgataatatggtgtagagatggatacgatttggcgctcgtctatcttgcaggtattcctgcttatgtaatgataccctattactaaagatcagagatagtcaatcttcttgataaacatgcctataaaggggcggttcaccaaaaagaagccaaaaaggaaagatgagccaaatcgaccgtcccccacccagtccatcaaaaaaatagcctcattgaaaaagcagaccaggagagatgaggccctggatgtgctacacgaactagcagttgttgtgtcacctttgatgaaagagaacggtttcactgttggattattatgcgaaatgttcccgaagaatgcctctttattggggctgaatgtgaatatgggttcaaagatcatgatccgattgagacctagccacaacatgaacttgtttttgccaaaaagagagatcatcggtacaatgctccatgagttaacccataatcgcttttcggcccatgatgtaaggttttatgactttcttgagggtctcaagagcaggttttttgagattcaggtgaaaggatctttacaaactacagggtatgttaactttagtgaagttctatctggtaatgcggcgagagggcaactgattcaaaaggaaaaagagaaaggacaaagattgggtggtaataagcatgcaaaacctatgagagtcctaatcttggaggcggccgagaagagaatgatagactctaaatggtgcggaggagctagcaatgaagtaggccttccaaaaattgaagatctaatggacgatgaagaagctcaacactctgaactaaaggaagagaatacaaagaaggtcagaaaaattgttcaacctagcaaaaagaaaattgtagatttggaaaacctaccgaatggcaagtccattattattgatctaactaatgacgatgactaaagatatatacatgtacatcacactggatgaaaactaggctagtttgtcagttcctttcattttaccagaaccagcttccattttagcacttttggcaccaaattgaatagctctcttggcctcattactgacccaacccatgtccagttggtcagctacgtgtctcaaggtccactttctggtaatatcaccagattgaggatcataatgcaattttaagcttaaaggaacagatgtggcatagttgataaagtgtgtgtccaaaaatgggtaccgaacttcctttgaccaacatgcaatcaccttatcgtctctggaaaggttacgaatccacaagttcgataaatccttctgtagctcttgttgaagaaggtggtataagttggcatcaactgtttcaggcaccgtagacttgtcttgtttctttctaatattactgataggagtgaagaatcgttcatgtctagtgtagccaccaaacagctcgtctgcacccaagccgcttaacagaactttacaagtactttcataaggtattttttcatttgcattgattctggagaatcctttacctcttgatgcaaaatagaacgcaatggcaattgaaagatccatttctgtatcattagggtatatcaattgtttcactttctccttgtggcccatgtattcctcataggtaacgtcgacttctacaagctgaaatcgaatactagggtacattttacgtagattctcccaattttgtatacctaactttctatctggtgtattttgtggtaaagtcttcgttcttgggttgtagaatgatacgttcagtaaatcgatgattgttcccgcaggtgaggtttttgctgctagggaagccaaaatagaacagtcaatgcctccactaaacaatattgcatactttgcgatacttgtatttaatgtgtggatgttgttggttctggtacacactgcactagtcaatgattctacgatctgagaaatcaagggctgatatatttcaatatccctcacatcagaaaccgaatactccttaggaaaataatcattgtctttgaaaggcaagactacaatttcagatgtctccatatcgaaaatatacatgctcaggttcttgcattcatgaaaagatgttctagttggcacatcgggaatacaactggatatatacagggtgccgtcaatcacggtgtatgccaatgatttcttgcccagttgatccttgccaaaatatattttgttttccctgtgagctaatatcgtgtatgcaaactcgccttccaaagttccaaccactttgaatatgtcatcataatcattcagcagttcaagaatccaatggccgtcattcttatccctggtttctttgttgtaaagctctccattaaactgaacagtgtacagttcggatcggagtggctgctgggtgaaagggcttctaatggatagcacgctggagtataacgatgcaactccattgtttgcaggtatatggataagattttgataatccgttcctctttctgagacgagttgctttgcactctgaaaggtatagtcattatctatttccagattactagatcttgagaatcttagtaagataccacacatgggtaagaaggatgaaaatcaactctgaatgggttagatagggagaaatattttatttcctgtttcgctatcagttgagatacatcaccttacagatcagatcttccacagatccacaaagggtacatcccaatgatagaaagaatacgggatctaatagccagttggaacggaaataaatttattttgaaatggcgtatatgtgacgtaatatctttggtcattataatcgtactgaattttattttccacagagctaaaccgttccaaagacagttcaccattaacgatccaacattatcacatccccttgtcgagatagaacgagtctcaggaacaatgtgctgggtttatgccatgtttattccttttggatttatcgggatcgtgtgtctcgtcgtgacggaacgacaaagtgcagcccacatggcctttatctcgttgttgggattaactagttctgtgttcacgacatcctttatcactggaatactgaaaggctggataggaagatgtcgtccagattttttagagcgttgtttgccatcggagacagcgctggagggcgtgtggtatgaagctcctgacgtttgtaccaccgacgacttggcagcattgtatgatggattcaaaaccactccttctggtcattcttcggtttcatttgccggcctctcctacagtgcgttttggcttgcagggcagctaggtgcaggggttgaaggcagtgatacttggaagtcatgggtgtctagcatgcccctttttggcgcatgctacatcgcactatcaagaactcaagactacaggcatcattttgttgatgtgatcattggggcaattataggcatcgtgtttgcttatacatattatagaaagtacttccctggcttgcggagtgaagtctccaatatcccaatgatcttagaacaattcaaaaatactgatccatccactctcgaggaggaagctcctgactttgaactccaagaactaccctgagaaagcccattcttagaaattgaaagcagctctaatggcaaataccacaacaacgatgcttaaatcaaaaagaaacattgaaagcagtacctgatatttggatgcagtctgcaataggtttcggtaagttgctggaataaaggctccaccaatatttaaaagtttagatatcaaagagtcgtcagtaaaattcttgttctttgaaatgaagaaaaacaaactggtttgaaatataagttccaaagtaaggaacactctcatgaatgatgatccattgggtgcataggtctgtgtaaatagagataaagaaaaatcacgcccatagacgaacagtagtgacagaatcagcaccaacctaactaccaatatttttgccttcaagacttcattttggtgcttcttgtaggctattgatttcttgttgaactcaatctcctccggcgtggatccgtattcttcctgcgcttttccaatgttggaaccacctagagagttcagcagatcaagagggttaattcctcctgcttcagctcccaatccagcggctcctgaatcacctccctgcaaaatagaggagaatcttctcatgagttctggtacaccttgttcctcgctgttagggttttcatgtccagcacttttattgaacatactagctatcagctgatccaaatctggctcctttccgtcaaatccctcattcaatgggtctggaatctcacttacagggtcatcatgggcgttaattctggtttctagaccttgtgtgggtaattcagttgctgttgtagttgcatcggctgttggctccttcgtgggaacatcagtactgagctttgagttgttttcaccagtgattttcttcaatctgtctaatcctcctccttggctcaacttggcctttcttttctctctcaagagttgtctcttctctgcttccgttagttctgacattcaataggggtgctaataagtgggtttagcgattattttaattttgattttgatattttcaggctctgttcccctatcactagaatttgaaaataattttaatcggtgaacacaggtttggattaccggctaaattggcacatcccttttcgattgtttttgagtgctgattctgacctgtacttgcttgcaatgaactcgggatcggaatcgtcgtttaaatcatctgagcaagaatcaaagaaaaccgtatactttgagactaaaaggcagaccactttactcaatttgatggagaatcaagatcatttgatagttaaagcattgaatatgtcagcagatggtaaacccgtatctctaagtgatgccagacacgcttgtttagaaatgtttctaggtaggaagtgactgtccacattggttacaacggtcagttttatgagttttgagcttaaactggttatatttagatcatactaattacttcgtttatcactgttaccaagtctgtattcaaccctattctgaatgtagtatttctacacacccaagaatctcaaagtgttgtaggttcacatttcatcttctagtctaataaggctacggatactatgaacagttaatagtcctttatgagcaccaacgttagctaacaattcattgcaatggtccataaattcactgttctctcctgtgaaataaatgattactgcttgccactacgcattagcctctatggccaagttggtaaggcacctcactagtaatgaggagatcatcagttcaaatctgattggaggcattttttgttgaagtggtcttgcttaaacttgtcaaaagtcagaagtcttgcccattttacagattgtacaatcgtaaatctatttgtatgtttacaaagccctacaaagcattcttcctagttaaataatcgaaacggctataagtataaccaatgaatggtaggtcttcttttgagtttccttcagtcttaccctgctttgctaaacgatctctatgcttagcagcgttagccatggcaggagaatcaggaacattctccaagtcatccgcaggaaagtaccgaatatctgtaattgatttcaaccttggaacgaatggagcatcaacttgtctgatggtgtcccaattgacacctctgaagaaaggatgcgattttatctcgtcagcacccccgtatctacctagacggtgatccgccgaggtcaacagtcttctaataagatcaacactttcgggactcaagtgaatatcatcaggaaaataaagagtctcttgccagtgaagaatttttttataagtttcttgaggagtgtcagaacaaaacggaggccatcccaccaaacattcaaacataatggcaccaagcgaccaccaatcacattcttgtccataaccttgattgatgaatatttctggtgcaatgtaatcgggggttcccacagtggaatatgccatcaaccttcttgaacgtctccatgtttgcatttgctgtctcttggacatggtcaggtgaatagcatctaccatcatagaatttctccctccattggatactggaggttgtggcaaaggatctttctctaacaactgtttataatattttgaatcatgcgtcttatggaatccggtagagagaccaaaatcagccaatttaatatgccctcttatgtcgatcaatatattgtcaggtttgatatctctgtgaataaatcccagcttatgaatagcttcgatggcgagaacacattcagccatgtagaatcgagtaatgtcctctgtaaatatctgccaattgataagttgcgacatcaaatcgcctccgggcagatattccatgattaaataaagatacaaggagtcctggaatgaatagtacaatgaaacgacccaaggggagtcggatactgccagtacgtctctttcagccttgacatgagcaagctgttctctttcgaacatttcggactttagaatggtcttcatagcatatatggttcctgtatcctttttctgtactaatcttacctcaccaaaggcacctttaccgataactttgaccgtggtgaaatcatccaaagaaagtctagttctacgtaatcttaagaactgagactctttctttcccaagttatgcaattctctgtttttacgttcagttgatccctcttcattggcaagacgatactccaaatccaccctcctttggtttctctcaatggcgtgatcgatactcattttatagaaatgttctagcttcaacttgatggcagcggcacgatcttgtgctgatttagacagaaggtctggtcttctttcaaaataaacgtagtctgtcatgttttgtggtcgtccttgagaaatggtagacaatcgattgttatccaaattatccaccagactatttctgaacgacgattgctgattaatattgctattactcgacattgggtttgccaatgaaaatactcccccaccttgcttagaagcgtttttcagcgagtttcctgttgggacaggaaccagattgctacgaatactgcgctgtggactggacggtggttgggaagaactcataacattttgttgctccgtaaagggagacgagctgtacaggctgttcgatggagacgatccgtacgtactgtagtgctctggaggcggtggaatatttggaatactgttgaactgttgttgatgttgttgttggtattgttgttgttgtgatgcgaactcttgctgagaagcttgatttgtaggtctatgctgttgttgttgctgttgctgctgtagcagctgctgttgatgcagttgataggcataattttgatccgtttcctggttggagtacatcttgcctttagtgaagcaaaggctgtagtggacaaggaggaaaggtagataaagagagtttcaagacgttaaccttgatctaggcaaatcgcgatttccgaaagcacggtaaaaggagtttcaaaggtgttgggagggcgacaactaaacccgtactgcttacatttagggcaagcaacaactccttatctcagatcctaggtaattaagactatgcagctggacatgtcagttgataacatctatgaaactctctgaatggtatgcaataaaacaatccgcatactaaacctactcaagccatccctagtaataatctaccaacatgacaccaatctacatcagttctgaaaaagactgctaactcgtaaattaaagtactatcatatctagaattgcagagcttgacccttttgtttcttgtcaccacctagctcgaagtgcttacatctctttaaagccaactgagccttggtcttacagacaacacattccaaacgcaaaacaaccttcttggtagtcttagctttcttgtggaaaatctgcttggtttgaccaccgtaaccagattgcttacggtcataacgtctcttaccctgagcgaacagggaagcagcaccagccttgtattgggtaaccttgtgttgagtgtgcttacggcattgcttacctttgcaaaaggtctttctagtcttaggaacgttaactatgatatgttagtatgtgcttgcaactcttgctatttgcgtgaaagggattgaaaagaattttctactggtggctaaaagtaacccaccaaaattggtgatgatcactgcatctcactgttgaaataatcatctatcatctagcttgttccacgtgtccaaccctttcaatcctgcttgcttcatatagtacatacccattgtgactggagttatctgtgtctaaaacttttacagttgaacttttgaaatcctcgaaggtgtgagtgagagttggaaagaatcgcgcgataggagtcacccggcctgaaaattttcatactgtaaggatgtccagaaacttacacgtgatgatcagtagggcagccagattctggaaaccgttttcctccagcttcggtttagtgcacgactagtgtcaatataatggtgcggcgtgagtgaaattttgtaaaaaagccgcacacgtagattaccagttaatgtaaggaaataccagccttctgcaataaagcgtccttaaaccgttcctaactctaccagtttaggaagtaaaatccatccacttcaaccgtaattggtacctagcaagtatgaattagggcaattaattagtccccatcctataaagccaggagatggccttcccatttgaaaccattattatttccaaatattccattagagcccgttcattttcaaattaaaaacagttgaaacaacagaaccaaccatcgtctttcctttcctttacttttgacctaaccaactttatacactcattaaccctttagtttccaactatttactttcattaaaatctcaaaaccatgttgttcttcaacttacttcaatataccctccttctgataattccaatggtccaaagttacccacttgttattaaaaagagagacgaaacaattaacagtgttgttgtcgagactagtgtcgtgaccgtagatggtaatacttatactaccaagattacttccactagtacaatcacagttaccgctccagacagaaccgtgtacgtcactttagatgaagacgagccaacgaatgctccggcttccagtgtcaatgttcagacaacatcaactagtcctgctcaaacttcaggagcacaggcatccactccaatcaccacttccatagctgcacagacgagtcaagtagttctatcctctagtcgagcaagtccaacctcgagccagtcaagttcttcgtctacaagttctccaactaaaacgacgcaagtctcatcgactagcagttctgagggtaccccttattttacggccacagacgatggtacttgctacatctactatgctgaagatgatgagacggccacctattcagatgacgcaccgtacacaacttccactgtttatcaggtggtagcaacggtgacgttgacaaagtgaacaaaaaacgctaccaaagtcaacttgtgtgcagtttatgtgtatttgtcttattataatgtttctcttatttttaatcatttctctgtattttcatagtttcttgctcccttagtaccaagagtactgccaacattgccatgcaattggaacttggaattcttgagtccacatgatcaaatgtttgaatctcgcctactttctgtattcgttttgtgatgactgaagttggctccaatctcaatgtggcaaaaggaataaacttggacaactctttgatatttttcaccgcaactttgttcaactttggtttcaaatcattagaggacgccagttcatcaactgaataaccatctgttaaaagctcaatatcattgtttgtaacagtaactgctgtgatagctcttgatccaaatgtggaataacttccagttgtcccaagaaaccttaatctagtagatttgaactcacaatcggtaaaaggtccagacttagaattgatcagcacaactattgatgagtctcggaataccatggtatacttgtgattattatttttgagaatgtcatgatacatacgggcgtgctcaactctatcctttccgtcataactgtacagtatgcattgagggctgttcttctttagtgactgaatccctcgttgagaatgcaatgtcaaaataggagttacttcgccatttttcccctgtgccttaaactgctcgacatctaatttgcttgcaaacacatgaactgacttgccaaaaaaattgcttgtgacaattggtaatttcctaatgtaagtataagaaatcgctggtacttcaaacactgagccgaatgcatcttcggtcaaagtggcctgcaatgactctgtatcagagtcaattcgtgattccatatttaacattgtgacattttcaactattgctggtgaggttcctgttgccgctaaggggtttataagtgttgtgagtgtctcttgactgagtcgcctatgtgatagtgaatgtgttgggtccacagtgctattactacttcgacgcagggcgggattatttgacacaactgcttggtcgcttaatctgctcaaaagaggaattctgtgcattaacagtatataattttaaaattaaagcaatgagataagcaaacagaagatccatcttgatgagatagatccattatgagaaaatgtattaaatctttgagtgcggcacgacaaaataagaaagtatataaagagccgcgatgccttttttttccaatctttgtagaattttatgcctctgaaatatgctagagcccttggctgttttctctatcagctaagaggtgtggacagcagaggcagatcgaaacttgtgtgtgttgtgccattaattactggcacgcaattcctgtgatctaagtgcacggaatgataagtacaccagcctggacattgtagaagtatgttttacttaagaggagagaaaatgattgatcatttgttcaatcattcgctctgcggggaatccttctatggatatcactggcacggatggctggggagtacttggtcacgttcacgggaacattcagtgaagaagctatcgaagtactggatcgcaacgacgataacgatgtcaatgatgatcccttgtgcagttgcataggttcagcggtgactatgggagaatcttgtgatttttcgttttggaaaggcgccggcgcttttcggtcaggtctgagatgtagcactttggttgcgtagagcaccaaatcgacaaccatcatcaggaagattgggaacattattatgattgccatggtgtacttgaagtgttagtatgtttgttctttttctaaaacagaagaacgggtgttgttctgggtaggaataaaaaacttactgctaggtaaacaataagcattcggagttgtaagcacaccctcagcgagagatctatatatggttgcactgctgagggatccacgaaggaggccaagacgtttagcatttctctataagagtcctctaaacggcacatttgccaaattgggaacttgacagtgggattaagcatgaaaacgatcgacgtctggattgtggaatggttggaatgaagaggaaaaggagagatgggatgatatggttttaaactcgcgaaaaaaaatatggaaagcaaaagaggtacacgggtcgtcccggagcgatagagttttggtgagggatgaagggaagtggaggagagagaggtccggtccggggatcttaaacattttggggcaaatgatgaacaatatccacatcttatctacattgactgaacagcattgaagataaaaaaacgttctgatttctctgattgtttaaatacaattgtgtaattaacaccatctgagatctgagtgtcctgtctttttttttttttttactttggcatgtgatatgtcatggacatgccatgcaaggccggaaacctgagatcgacagagggttttttaggtatgtttcttttttagaacattggtagccgggttttatctgtgcgatgtagagtgccaatcgtgaaacttggctggacatctgacgttcttcttgttccaactgcataaacaatagacttttgtttaggcaagctttgttcgcatctggcactttttctgtaactcaagtggccctcatcgactgtttcttcttcgcattgcctagatacatgaaggcatggaaggatttagggcgaatgaaagatatggtaaagttgaaaaaaacatattcaccaaattgctagaagggttagcctcttcgcagttcttggctggaggatgatagcattgtgctttcaaaaactctaacatatggtggtaactttaggccgtctctgcacctgactttgaaagaggtatcgtagcataaaaaacattcattgttcattgagggctgagtataaatgacggctgcggcctcttgataaacgagatgctctgacaatgacacacaaaaaaattgagggtaaacactttacggaaaacactgccacatgacactaaccatgaaaccccataagttgtaccattgcaatctactatcctttcctgtaaaactttgaaggttcgctctgcgataatggggaagacgataccatccaacatcctctacttcaggaaaaaatacccgcgagcacatgataaagtatcactttctccactccaactcgcaacacgtcgattaaccttcttcttccattatttattccttttctgacctaatttccaatcctccttgtatgcaatggcctacaacaactcaaccaatggcgaacgactgttgaatacgtcagacgccctgttgaatgaagatataggcgccttaggggtgtttgcttctcatatcaactcctctcggctagtgacgccgaaacgaaactccaggcttgacagtttagattctgtatcaaagcccagcacggtggacgaaattacaccaccgacctcggacaaggaaggtgaaattcaagaaaataaccaagcttggaagactcagaatgcccccagcttgttatccccagatcacatgcagcatccagcaatgaccaaacacctccaaaacggaaatggcttttctcatataaacaacaatacgaacactcttaagccatttaatctccccccaatatctccatcaccgctaccaatgaatggcggcagcctgagaaacataaacggcgtacttaatgattcttcagcagtaaccgacaaacagccaacagctaccacaacatcgcccagggtatcagcattcacacttttggcagcaatattggaacaacttggaggcaaagacagactcggaaaggtcatacaatatgggctcagaattctgctaatttattccaagagatcatcaacatttttaagcacagtttacgaagtttccgatgcaagtctgaacaagtccggagggaggttttctttactggtctctcttctgagaaggcctgaacttttgttgtattggttccttaagcagtttgagaagaaggccacgggtctatcttccggcctctcaatgtatcgtcaaatgctacgtgcaggtaaaactcctttccggctagtcaatctcggttacaagattaatgatactttccaagttttcaagaagaaaggagtagacgatggcattgtttacttccgcaagaattgggtcaatgagaagactgtcactgaactggcacaactgtattatagttggtttgatgagtcgttactatgttttaagctaaagatgatagacgaccctaaatatcggggaattgccactagacaggagcgcctggcatggctttccaccattctcctaactctaaagaagaacatattcaaataccaagcaaataaacgcaaagagcaacatattaggataaaccaacaggttaagtatagagctaaagcattgctgagcaatatttcggatcaacatcaacagaatagatcgtcaccacgaagtatatccaactattccccaagaatccaggcttatccctcaagaatggcctctccatctccttcaatgaagatggcattgacaaactccgtcagcttgcaggatacaatggatgcggaactagaagcgttggcaaacgaacaatattacgtcatgctagatatccttaagggattttgcgatctttcatttgacatggtaaacatattttctatccagatccctgaggtattacatctcctcttcggctttggtgcagggtcactggccttaacgggagtcgtatccaaaacgagacaagaactaataaataaacagatataagggacaagcacacgattacccaatcacttgatatgcaccaatttgttccgttgtttatgccatatttaccgaattttcttcccaggtttttccgaatggacatctgtagtccactttttggttatcataatcgtcccacaagtcgtggatttaaccagaacctagtaattttaagttcgctattaatcactcagaatggtctcaccttgctattggccaagtctggagtcgccagctaccacctcagaggctacatagacctcccaatgtcatctcctcagtgcgctcttcaatctcgtgtcttttccgttaaaactccgttcgtttcaccctatactgcccctggttgtgcagctcttaccacttcgcgccgctactatccgtagtggtcgagccgcatcaatatcacgttgaaatagaataactccctacaaaagccgcacgcaaccatcaaatctatataaggaacctcaaatatctagcaacatcttttcaatttactacaacatattcgttaatcatcaatcaattagctagtacacaacaatggctgaaataacactaggaacttacatcttcgaacgtctgaagcaaatcgacgtcaagactatctttggtgttccaggagatttcaacttggctttgttggatcacatctatgaagttgagggcatgagatgggcaggaaacgccaatgaattgaacgctgcttacgctgcagatggttattccagagtgaagtcaatggctgctttgatcaccaccttcggtgtcggtgagctcagtgccgtcaatggtatcgctggttcctttgccgagcatgtcggtctgctgcatattgtcggtgtcccagctatctcttcccaggagaagaagctgttgcttcaccacaccctcggtaacggagacttcggtgtcttcaagcgtgtcttcaagaacgtctccaagtctgccaactttatctctgatatcaacgaggctcaagatatgatcgacggtgccatccgtgaagctttcatttaccaacgtcctatctaccttggactgccaactaaccttgtcgagatgaaggttgacagaactcgtttgaacaccccaattgacttgaagccagttccaaacccagtcgaggctgaggaggaggcattacagtccatcttggaactgatctcaaaggcttcaaagccagttattctggttgatgcctgtgcatccagacacttctgtcaaaaagaggttgaccaactcattgacgtcaccaacttcccagtctttgtcactccaatgggtaaaggtggtgttgacgaacaaaagccacagtttggtggtgcttatgtgggttctctgtctaacccagacattacagagttcgtggagaaggctgatcttgtcatctctgttggtgctcttctgtctgacttcaacactggatctttctcttactcccactccaagaacattgttgagttccactctgactacactcaaatccgtagtgcagtgttccaaggcgttcagatgaaggccctattgcaaaagctgttaccacttgtcggtaaggcatctaagcacattactgctcaagttcctccaaagattgctcctcctatcgaaaagggtgccagcgaagatttgacccaggactggttgtggagcaacatcagcaagttcctcagagctggtgacgtcgtcatcacagagaccggaacctctgctttcggtatcgttcaatcaagattcccaacccacgtatctggtatttcccaggtcctgtggggttccattggtttctccgtcggtgctaccctaggagctgtctgtgctactgaggagctcgaccccaacagaagagtcatcctgtttgttggtgatggttctttgcaactgaccgtccaggagatttccactatggctcgctggaacttgaagccatacctgttcatccttaataacgatggttacactatcgagagattgattcacggtgagaaggcttcttataacgatattcaaccatgggaccaccttaagctgctagacacctttaaggccaagaactctgaaagtactagagtctctactgtcggagagttgaccaaattgttcaaggaccaaggtttcaacaagcctgacaagatccgtgtcatcgagatcatgttggagactatggatgctccaatttccttagtcaagcaagctgaaatcactgccaagaccaacgcagcttaaatgtgttcacgatcataattgttttttagtctgtatatgttacaatattaacgtccatttgaaatcttatccttcgcgtaatcttctctggagatttcttcctacttatctacttgaacattgtacctacgcaccaaaatggaacaccctgcttttagtctttcaggtctgtctttagttggaggagtcatgggatagtaagtgtagacattgctttttgttggagtgtactaactcgtcagtgcccgtaaaggttcccttccttccctaatagctggagtcactttttcggcaatttatgccggagctggatatttgctgaagaataacatggaatatggggttcaaactgctttgggagcctccactctgatgtttattgccggaatcaaccggggaattgtgtcaagatataagaaacccgttccaattgttctgacaattctaggagccgcttccactctgtactatgctaagaagtatgaagaattttacctttaaagctattgaaacttatctaagtcgtatgaatataaacttttgttcaccatccatggaaaggaacccaaatatctactactgtatcttcctcaattacaaaataccatgggaacgctgcagcagcgatgcaattatgttgggggaccactttgatcttggtgcctagaggtataaactcgcaattagaatcttctttaaaagggaacaagatgccgtgttcctggctaagctttccaacaatccaatctccataggtagaagggtcgactactattccatgacctggaatggaactaaactctcgagccaatgcaattactccagcatttatcaactgttctccgggattcctattgtttctattagggtaatgtgataccacttctgctagaacatgagccgacacgtcatctagtgacacgcagtttgttgcaacctgttgtaagtcacaacatggatagtttccagcgtgtaactccagcactccctctagttggcctaggtcaggagcctcccattccgccgatgcatgggcggttggagttgcacctactgaaagtaccagctgcaaggtaccatcaatctgtttagcaactctggcggcattgtttgcattctcaatctcttgtagcaaaaagttagtggcctccgctttatcggcagatccataggaatgccctgcatggcaataaaagccataaagagaaacataatctttggcttctgagtttaaaagttgatccaaaagctctttcaactcttgcgaatcatgggtcaacccagctctcttggtacccatgtcaatctttataaagaccgaccattttgtggcgagcttcgattcctctttagagtaccgaactaacatttctagctgaccaatatcgtctaccatcagtctcaaatggggaacctcaaaagagtacaattctagttctgccaaacgagacttcactacgggaagactataatgaacatcgttgatcaacccctgtttgaccagggggaggataccccaaccttctggcagcgtagatatgacaattctgtccgtcttatactcagaatcagtattaattcccaattgcaagctagttccctccagcgttttatgagttttgatatgagctctgaaaggtgcattcagccttcgggctgaccacagcattttctcacaattccctcgaaacctggatctttctaccagatacgagggagttggtaggtctgcaacttttttacctagatactgctttgatagggcatatttgtttcgtgattgagttaggctggaaggaggagttgtcattgggtgctgcgtgactgtttaagcttcaacaccggtgatgagtatctcgataatgcgagattaagcgtacatccttaccgcaatctaggtgtatctgtttggcaacttcccttgatcaaactacatcaacgtgaacatggctattagggttaacggctctaacaggcagtggtagtaagaaggtcgtgctgcagaagtatcagaaatattaaacggtaaatatgttgataaaatttcaaggcatctgccttttttctcaagctccgaatggaataagacgcccggtactgtcaaggggcaaactcttttctaagggtctgatacccagcctaaggttgaccatatggttagtccaaatccgcactgcgacctttatttgcggcttgtaattttagcatgtcaaatatgacattcactcttgttgtcctcctattgtctttctatcacccagttggcccttgtcttcaattactgacaacaagtatccctcctagttttctaactatggtccctgaacactacattggttccaaatccgtagatgaagtcccaacttcggaagacccacgggtcaatgcctgcccatacatctgtgacattggtgattgttccagaggctactctcgtgcttcccatctaaaaaggcataaggagacatttcacctaaaaacccgtgtgttccattgccctatcgaaggttgtggtagatcgttcaatcgcaaagatgtcagagatcgccattacaggagacatgctgcagatatttctgataatagtcttggatcgggtccccatacaatctcaattgtaggcatagaaagaaccgatgaaaacactaatcccattgaggcacagtcaatagaatccctagagctgatgagttccactcctttaacaccgaaaagcataacatattcaacgcaaaaacagtaccacgttgtccaaactccaaagtttatcttgggaaatttgatctgtactgggagaatctttggcatcaatggaagaaaagggagcattcctcaaactaccacggatcagactcatcatgcaattcgaaatgtatgtgatgttttaagggaggctaaagcttccttggatgaggttattcgagtaagtgtctttttagtatgcttggaagagtgcaccgcagtccaaagtatatgttcccagtattttcctgatggagcagtttatgactttattcacataaaattttctcctggtgaatgctttagggtgcaattgcaagtggttggtagaggtgaatagacagcaggaatattttaaagtggctaaattgtcttcaacagttctttgaaagaatctaatgaagaagcaacacatctctctttctataatataattactccattatcctagtttgtattattcgggcgtgtggcgtagttggtagcgcgctccccttgcaagggagaggtcttgggttcgattcccaactcgtccaatcattttttttttggtagactctaacataagatggagctagcagttgtgataaacaggagtactccacgtaggtttctcccattcggttctcagaatccatattcttaattaaaactttcaatattacagattattatttgcaatgctattgttggacgatttctcaacgctaaaccccagagaaacacaaagtcgaccatccgcaaagtctaacccaactactaaagctataacaagatgctatatttggtgacagttcttttgtttctcgtgcatgtggtccttggctatatccatcccatcaccattaaggggaagcacttttatgactctcttacgggtgagcttttcatggtcaagggagttgattatcagccaggaggtgcctctggagtttcaacggacaaagatcctttatcagaaatagaggaatgtgctagagatattctcttgttccaggaacttggaataaatactattagagtttattcggttaatcctgacttgaatcatgacaaatgcatgtcgcttttggcttctgctgggatatacttgatcttggatgttaattcacctttgccaaatcaaagcattaatagatatgagccttggagctcctataatcatgattatctataccatatcttcaaagtggttgaacaattttctcattataacaataccttggccttttttgctggtaatgaagtcgtgaatgataaggtctccgccacacattcttctaactatatgaaagcagttgtaagagatttgaaaacatacatcacacatcatagcgatagacctatccctgttggatattctgcagccgatgatctttcttttcgaattccattggcaaagtacctagaatgctcaaatagtacagctgaattggatagcgttgacttttatggagtcaacagctaccaatggtgtggctatcaaaacatgcaaacgagcggctatgaccagttggtagctcattatgcggattataccaaaccaatcatgttctcagaatacggatgtaacgaagtgactccaagaattttccaagaggtggaggctatttattcttctaagatgagctctgttttcaacggaggtcttgcttatgagtttgcccaagaaccgaataattatggaatggtggaatatctttcagatgggagagttaaactattgaaggattttgaaactttcaagaaccaattagctaaggcctcagaaacttaccacataaagcagatgaatgaaaatgttagatccgcaccgcttaaatgtcagggcacttatgaaaatttgggggacaaattggttgttcctcaaagtctaggaatggccttcattacgcagggagtcaaaggtgagaaaggctcctacgtagagttgagtgatgatgattttgttgtaaagaaagaaatctttctatcagatggaacaaaattccagaagagcaaaattgttgctacccataatttgaatggaccagatacacagcaaacagttccagaaaaatcccagggctcaaaaaatggtaagtacctccaaatcttaaacgtagaaacttcaacaagttctagtaggttaactttaaaatcgaaccctatcatcaagaatgaactactaaccattttttaggacaaataacaaacccaaatcccaaacccaaaccccaaaccaggaagattccaaacaaaaagaccaaaccaaagcagaataaacaggaaaagtcaaaggtacagaagcaaattgcaagagaaaaaaaaatcagagcaatcaggcaaaggcaacaggaatggaactttaaggtttgagtgcttctggtcttattactaacacaacttcaaggaaatttaagcaaattcgttggtcttttctcacccgtaatggtagccatggtgtcctgcttctctattatttaacatacattaacaattagctacccttggaattcataagatccttcatcgtatttgatggaaactttacaaccagtatcaacaaatggccataagatactcaaccagtcacgattcataaatagaggatatcttgtgtttgcggtgattctcttcggggtagttagaatgaaactgacattttcaatacggcccaaatgcgtgaacaaccggtagatagatactttataggagttataatctaattcattgacaggctctcttggaattaaagataagttgaaaaatttgacgttgacgaatgttattgtttgaattttatggagtgaacacaatacactgaagaacgaatcgaactgaactgggaaatcattcaaaaaattccaaaagattttggagtctaaatcaatggttaatgcttttatgttaggaaaatatgtgatagaagccaaatcgtgtaagtttttgatgttaagtagacataattcagtaacattgtgaaaatagtttcgaagaaaatgcaatgcggaagatgaaacggtggtagcatttagggtaagtttctctatcggagagtggtagctcttcttatgttttggtatcgtatcgatggttgggaagccagtaattggttgagtgatttgattaatggggtcaataatccaattaccggaggaagcatctactaaatacctcgtgtctacaagagattcttcatcaatattcatgtttcgaaggatcagctctttgatcaatccaaatgaccataataagtggcttcgtaatgggatggaaatcccgtcttgactttccaatctgacagttttgatggaatctctcctcaagtcatcgtaagtgtaattctttggacattcaatcctatcattaactttgtagtaaagagaacattctatgggaaaatttagtcggggtgaaacttgagttagagaaatggagttgagggaaagtaaatgtgtcatgaggttcttgtacaagttaaacgtgttcaataaatctttgtaattggtagattttatggatgaagagtatcccaacttccctatgctcacactgataaactcgtttgcactatttccaatgtcaatatccaactgtagtgaatcaatagcgtacaaccatggcttttgttccactgagtttctatccaaagttctacagagttgtaacaactttaaagtggaggatacacggatagctctgtaaagtgtcttttgactgaccgcctggagtcttttgttaatttgggaaagagcgcatagtgtcttcttatctaagttcttgaatatgagagttaaaatttcatctggaaggctcactaaatgaatttcagggtacacaactggttcttttgggactttctttgaaaatttcttcttaagtcccataagctgcagcttcttcattcttcctgggtagaaggaaagttcggctggcgtccaagtttagagagagaaattaagcttgcgaaaacgatatttaaacttagtttttcgaatcccggtgctcgcagttacccgaataagagatgtatctcgatgcggtaaaaccttttagaactttaaaagaacagcaggtgaccttggagaaatacctgctctcaatgtccaaatattaattgcttaaagagttatctacgacatcgaagttgctacagtctatccctttcgatactttgttgtggatcaagaaaatggaacaaatatggatgctagatgtcgaatgtccataacatagatgttaactcgcatatatgactagttcccgaagaacacaattaaacaatttaatttcaaaagatctttgcctgaaaagggccagagagtgttgttcaattttatttttgattctttgctgtaccgagaggccgttgacaggccgcacattttgcagcacttatcttagtaacgctctatagcagctacatgcttgaagcaattgggatacaatagcctagctctacttattacaaaaggccagcatttgaaattgagctcttcccctaacttttacatcctcgggtgtttccaggtccgggtagactaaaaacttaagtttcgatgccgatgtaaggaggtacgtcaatttttcagacaagccgcgccatcttgcatatactacatcagcttgttgtaattacaagttctggcagattcctccctcagctcaaaatggctttcgtatcttcactatctgcagataatgaatggcaatgatcgtttattagcttgtagatatcctcaactcccttttctcttatagcaagccaaatgtcagaactaaagtctgaattagacacaagcacagacctaaaaaaaaccctcaacgcccgtaatgtttccattattgcaatggggggaggtattggagtgggcttgatggttggaactgcaaaagcactttatgatgctggcccaggtgcagtactgatatctttcctagctgtaggaatgattgcctttggtgttatcgctgcaatcggggaaatggccacgtttattccctgtgattttgctggttacgcccatcgttactgtcatcctgcattgggatttgcaactggatggacctatatgctactctatttattctccatgcccaaccaaattgtctctaccagtttggtcatggagttttgggtcagcaccgatcaagttaattcgggagtttggatatttgtttttatggtagtagtgtgggttgccaacttattacccgtaaaatattttggaaattttgaatgcgtgctttcttctgttaaaataatcaccattgtggggttgtggattgttatgatggtcatcatgtcaggaggagcccccaaccgccaaccatcaggattccgctactggcatgatccgggtgccttcagagattatcatcaggcaaccgtgatagaaggaccaaaaggtaaagctttgtcgtttatgtcggtaatggttaatgctgttttctcttatgtggggattgaattcgtctgtgtcgcaattgttgaggcagaaaatccaagaagagctttaccaaaagccatcaaactgaccttctggagaatcatattgatctactgctttacagtgttcttacttggatgctgtgtgccatctaatgatccgttaatggaacaagccatcaaatcaaccacatctgccgcgtcttctccgttcgttgttgcaatgaaaatagcaaaaatcaacggactaccgcatctaatcaacggttgtatcctgttatttgcagtctcttcagccacttccgacttctacgtagctgtaagaacattgcatggactggctgtgaaaaggcaggctccaaggatctttgctcagaccacaaagcacggtgtgccaatctacggggttcttgttgggtgtggattttcccttttggctttcatgaccttgacctcttctgctagaacagtgttcaattactttgtcaatgtcgtttctgtatttgggctgttagtttggatatcattactagttgctcatatttcatttatgaaagcaattaagaaacaaaactttgatcgaaacagcttcctaccgtggcgagcacctttccagccattgtattcttatgtttgcattctattttgcattgtcattgtcctgatgaacaactttggagtgtttcttggggacaaatttgattataagaatttcatcactggatacattggaattcctatctatctggcattattgggaggctacaaattgatgaacaaaagtaaaagagtaagttcttccgaatgtgatctgtttacaggtaaggccacaatagatgaagatgaaaagaggttgaaaaataaggaatttgaacaaagaaaaggaagagaagggacagtaatgctctggttagaggaccacttaatcaaccattttgtatagctcatgtgatagttcaaatatttgagaaataatattagagatgatattagtctatgactgatgcgtatggatttcgggaactcgttccaccttcaccatgggtctatattctggtcgccacatttgggatttgacccatgcaacacaaccctcaaagtctctagggacagaaactttatctccatttggagacagctcttcttccactctggcagtgccttccttgatactttgaaggattaaggcggctgccactttagcagatgtctcatttatcacttcgactggggcaagcaaacctgctttagggtccttgaatgcaggggaaccactggcaagttcatcaactgcagcggaaatcatagtgtcggagatggttgtagctctagaaagaacggctcccaatccgatacctgggaatgagaagcagttattgttttcactgatgacatgaccacgaacaggcttaaagggagaaccagtagcaattagggcattatcatccgtccatcgcataacatcaacaggaacagcttcatgaagtctagtagggttggaaagagggaacactattggcctggggttgtatttgtacattgtcttaatgacttcctctgtgaaggctccggcttgggtggagcaaccaattaatgtggtgggtttgagtttctcgatgacatcaactagggatttggtattaataccatcccagctgctaggatcatccgcaaagagcatttgatctttgttggatacatcgctcatgtttgtgagaatcaagccatgacgatctagcaaatgaatccttgagtaagcttcttctttagtggcaccatggttaaccatgtgattgacgatctggaaagcaattccaagaccagcagaaccagcgccataaataacgatggtggaatctaacaaatctcgattcgtaagtttcaatgcggctgccatagatgccattacaacggccccagtaccttgaatgtcgtcattgaagcaaggaagaacggaacgatacttgtccaataggggcttggcattagttacaccgaaatcttcaaaatgcaacactgcagatgggaatctacgcttgacaacttcaataaacttgtcaaaaaaagaatagtactcttcaccacgaactcgagggaagcggctacccatgtatagttcgtcatccagaagagccttattgtttgtaccggcatcaacaacgacagggataactcttccaggatgaataccaccgcaaagagtcattaaagctaacttggaaatggcaatacgaacaccacctataccctgatcaccaattcccaaaattccttctccgtcagaaactacaatataatccacatctttactctcaccgaaacgagataaacgatcctctatggattcagggtccgtgacatcaaggaaacaaccctcaggtttacggaatctatgtgaatatgcggcaatggcatccccctccgtaggagtatagatgatgggcagtagctctctaatgtgtcgcctcaccaactcgtagaaaagaaccttattttgctgtctcatggaggtacaaaaatcattctttgctagtggggttttcaagaaagacagctgcttgtaagctctctctgcttgttcgtttaagtcattggctactggaggaagtaacccttctaacccaaaggctgctctttcctctggagtgaacgcagaacccttgttaaacaatggagagtttaatagctcaaatccttgcaagtggcattcgatagggccttccacagaaagacgggtcgtcttgggaacatctactttggctgccgcttctgtcccaactggtgtgagtattttgtgtgtaacaatttttggttgagccgaagatataaaacgacgacagctcacagtaagccgtttcattgattttgagggcatgtaaagagagctcattatgtccgaatatatatcattcaactaaccacgaggacgatcgaagatgttgaattgcggaaggttgcctttatttataaatttttctgtagaagatggaggaggggaggccgatatgagaggggcactggaagtctagacggaacgccagaaggacagcgcaataaagattgcaacgcacgcttttaggtgcgggcatcgcgcatttctatgcactctacgggtggatgcgggtagattaggggtgtaggcctatcaggcgcgtatgtccgccggaagatttaggaaacaagtctattgttaagtgagaaatttatccatttgacaggggtgaaatgttgatgaaaaattcttatgcatctgacatctataaaactaggagccaacaaaagtgatcgagctagaacggagaaaagagaccaaaggagaacgccttaaacgttacgaaatacacgtaaagagagaaaagcacttggtgacgcttcaaaggttcttaaatacagagaagatgtgaataatcttccattcttcttcctcaatagacaagattctcttccatccaggttgaaatccacgtaaaagggcgcatctcctaaactgggagaccgttgatatgtatatccgctggtaaaggacccgcgtgatcttctatcagaagccggtagcgctctcgcaaaagaggcgcattcttgttggcggtggtgaatggcactgaaacttggccacgcgcagcacagataaactgacgttgggaaacgagctgcgccatctccagatcaggtaaagattggatatgatcgtcctgaattggtgggagggcaccacccaagacgttgtgtcgaggagctattcgaaaaattcggccatggccaatatcgtatcgccgaacccatccgttgaagaaaggcccgcacaggttaccaaaaacgtttagccgcactacggataacaataatgctgcactaagtattgagaacctggaattcgatacatttgccgtcaactcatccagtcctatttggtgtgacacgcttaaagtgatttcttctaagcgaagatgctggatcgcagcaaaaaatccgacgatatctggtagatacgatggatataacttggtggtaactagttgaatcgaatcctgatcttcaatggatctgggagtttctccaagaaaaaatattcccaatgattgaagatttggacccaacaataccgctatctttctaaggaactctgatataccatctgtttcttgaaaagtccaaaatcgtaaacgaagctcatttacttcttgaatactgtttttcataatttctaaaagtcttgtgtagtcgtaatctggaggaatatcactagaggatccaaaatccagggtcaaagactttaagcggaactgttcagaggtgcccaaggaactgcaaacctcgcaaaagaccaaaggatcgcccacttcaagactctccaattgaaatggatgcatagcactgaaaagatcagtcaccaatggtaaagttttagaccagtgagttgctttgacggagagcttcttcaaggaaggcaaatgaagcgctctaccacgttgcagcccataaaagggaatactatcatcaactgcgagctcttccagcctcaactgcgctatattattggtaattgcatttcctatgatccaaaaagaacttccccaactgtgatggggaaggatcacgtaagccatgtccatgcaaaccagagccgcatgcggtagatgacttgcgagttcgaaaagaatgacagaattaagtttgcacccgacataaacggtctccactgctaacttactaccatggcttgttcgaagcatcttgaggaacctggttgcagtggtaacagtgtagttccactcatcgtacgaagttgatggcatctgcgaattctcagcagtgatatacactcttcgatagagccgcgtggcagataagctgcacgtgatgcggttggtaagcatcaacgctatcacgtctttttggttcagctgattgagaatttgagtccaaatttcaggagggtagttgacagcagcataagctgaatagtgcgagtcgtcaaaccactgacttatcactgcaaaaagaataaaggggatcagttgttccattcaaaacagagccacaaacgggctgatgatggtgatgaggggacgtttagttctcgaaatatcggttcttaacctttaggtgtaggcaaactgtccttgcaatttagagttcatctttgaaaggtatcaccttgaaaggggcatgtgactctccttcagcaatctcctttaccagataaacattgtcttcactgaaacatccaactgggctccgcaccacgagatggtattcacacttctctggttccgacacagaaaccaattgttcaacatcaccacattgcacaacggctattgcctttctaacagggccgttccaacatttagctcccttttcatagtaaactctataggaataaccaccaacactttgttcgtcttccaacacctctatcttatctctagtcccaatcgaaaccctttggccattagaagaaatttgggtcaaggaacccgtaaagcagtattcataatcataatctccaattttttcaacgaaacatctcccgtcatatgctctgaaaatgtcttcaagtccgtatcggctttctgaattctctaaatcagaatcaattttcactatttccttattatgcgaatcaatgcttttctgtatctcttgagctgttccagatatgggtttcaaaggctttgaagctgttttcagcggcaccgcggtaaactcttgataaatcttaacgattttgtctgctaatacctctttccagaagctccaaatcgattcgtatttagaatcgtttgaagtgtcgaaagcaaatgtgttaatggtcttttggatatctttgacgatattttccggttcaacagaatccaagtcagaataagagtcatcgttagaattacttgaataatctctgaacccttgaactgctgccttcacagcggcgtcattaaagtttgggttgtagtttttctctagctccttgagtaatctctctaacgaatctgctttggttttgagaagtaaaatttcatctttttgaactttcagaatctgtacgactttttctaattggggatccacttcctttcgcaaggcagaatcatttggatcttgctcattaagatagtttagttgctgttgttccaattggattgttttctccagctcggcgcgtctttgggagatttctcttaatttattctgggattggacaattaaatctctctttgctttcaatccgttttccaatcgtgcctttctttccaaccgcagcaattccgccttctcagctagttcaaggcacctgttagggcatttaccagatttttcatctgaaccatcacagcacaccttgtaatcgcacactccatcatccaccaagaaggtaggtatgaaattcggttcaaagccttcatttgcacagtaaaactttccattttcacacgctgcagttcctggctcatctgatccatctggacaatcacagtagtcgtcatttacttgatcgaaatgcagaacgatctcaggatgaccgagacacttccaatttccatccttatcaggaacgtacttctccaaaaggtcaggagctacccctcttaaaggtggaatctcagcagaagcagggaaaagggacactgctatacttccaatggtcagaagtctcaacattgcacacactgaagctggcttttttttccttctacagaatttaacagcactcaatatcaaatctgctccccccgcgaactgatcctagggtaaatctctgtcaactacacctccactgaattatctgttcaccattttcctctcgtagccaccatggattacgagctggcaacctctttgattaggttcgttgtaagaggcttttataccaaacattatgttttggttgtagaggccctactgatgcactgggttctttccgaggatgatctgatttaccttttaggaatgcaaaggaagggtttgagggcgctttgcaacagacttgttgaggacaggctgatctctgcccagcatcagaaagaggagaatctacatcagaggatgacgactagaacttattactatattcgttttgttgatgcaatcgatgctatcaagtggaaaatgcacagcgttgttaaaagcttaaaggatcaaatggcacacgatagtgatcctcaaggttatgtgtgtccccgttgtcgaaagcgttattctcagctggatgcactttccatggtcagtgacaacaaactaaattttgtctgcgatatttgtaatggggtcttgatagaagatgattctggaattcaagccaaacgtcgccaagagaaattgacgcaattaatgggtgagcttgaccctatcattggctacctcaaaaggatcgatgaaggccatgtggtggataatacttttgaaacatcgctgaccagggcagttcctgctcaatcttcaactgtttctgcggctgaatctggcagttatgctttacgtgctggtcaggaatcaaagagagaattgtcacagtcattgaagaatgcaactgctcgttcacaggctgtgttgcatgttgacatcactacaagtgatgagaatcagaccagagaagagaaggttaaagctgagaaacaagagaaactcaaacaaaacgcacttccttcttggcactcagaaagtactgttgggaaaggtacattaggaaagttaggaactcaagatattgcttcagagattcttgagaaggaggtttctgctgacgatcatgtagtggaaggaaaggatcaagtacaggaaatacctaaggtggaaacaacgggcacaaatctcgaagatatagaagcacaagatgctctggctgcatattatgctcagcttgctgaaaagcaggctaaagaagatgccgatgacgatgctgaagatggtgatgaagacgaagattttgatattgatgatgacgaattcgaagatatcttagagacgggtaacaacgacgaacaagatcaataactgcggtactttatttggaaaaacccaatgtcgaagataaaaaagtaccgttcctacagcattcataaatagacagaaacttaaacattaatggcttaaatatataataacaaaaaattatcgggctgacacctaacatccaacatacttgccatctgacatcgttgtcaacactgactaacttcctcgaaactttcatctatcttgaatcgttcgttaattttaccagtgtgacatgccagagaaaaggaaggttgatcctttccattcattcatcgccggaggtacagcaggtgctgtcgaaggtgtggttacgtatccttttgagtttgccaaaacacgtctacaactagtagacaaatcggcaaatatgtcacgcaaccccttgaagttgattgcaacaattgcaagaactcaaggtgtaggtgcactgtatacaggatgtccagcatttgtggtgggaaacactgccaaagcaagtgttcgtttcctgggatttgatgcaatcaagaaaatgttggccgataaagatggaaaactgagtggacccagaggagtgctggcaggattaggagcggggctgttggaatccgtggtcgcagtcacacccgccgaagctattaagactgctatgattgatgacaaacaaagtgctaaacccaagtaccaaggtggtatcatctcaggaactgtcaagctcgttaaagacttgggtttcaaagggatttatgcaggtgtccttccagtatctttgagacaagccgcaaactctgccgttagattgggttcatacaatgccatcaagacatttctccaacaagctagtagcacagatccgggcgctccactgagttcgtcattaactttcgctgtcggatcttttgcgggggtagtcacggtgtatgctacaatgccaatagatactgttaaaaccagaatgcaagctttgggagcagacaagatgtactcttccacattaaattgctttgtaaaaatttttaaggaagaaggccttcttaccttctggaaaggagcaaccccccgactaggtcgtttggtgcttagtggaggtattgtgttcaccatttatgaaaaagtcctgcttctgcttaattagaaaattcactataatcacacgggacttgggtttgtaactgggttcaaaatcaatctttccatgcgtttggccctaaagtagccagctattgcccgtagaaataaaaacattcccaacgctatcaaagcgtatgcggcaattggcgatctagtaggttcttgctcaaccttggctccagagtccaaagcactggtgaatccatcagtgtacccgtctagagtttctgaagtatcgacgtcgtaatcattgggagcagcaggttcaaaacggctcgcttgtccattattccgatgaaaaattgaaaaaggcagtaaatcaaatcccaaagtgatgatagtaatacctagaccggcacaggatccttctttggcagcatgggacgtgtgtaataaatatgtaagtacgaacccgaggtactggaatatcacagataccatcaagttccagaaaaagttgagtagattaccgactggcaaaccttccacaaaaacttcatcctcgtagccaggagtaacaacagtagactcccaatatgttggtgccgaatcagcagctgcttcatcgtaagaaggtagttcctcttctccacgacctaaaggatcacctgattcagaggtggctgttatattggcaaatactccatcattttcggctccacgaacgttaggatgttcaccctcaaccctcgtataccgaaagtgacgcccttgattaaaaattggtaacgactttaatttatcccgaaactgtttaaatatggttttacctttgctaccttgtgcttcgtttgcgatgtcaccattatctactgcatcggatgacgttccttgttgtacgccattgtccatattcataaaaaaagaggcgttggtgagggcatccccggaatcttgagctgtttcaatctctctagagtctccttcgggttccatctggtcaagttcgtgttcatgcacggaatcctttattgagttatcgccttcgaatgaagacaacaaatgcacactttgggaaaccaaaggatcctttgccactgagttagaatttatacttgaaggaaacgtctcaaaagagggatctaacctgtcatggatgctctcagaagagtagatgtgacatgcagaaacactccagtgactcgttggttgatttttacttactttttgcggttcgttactcatgttagtaaaggaggctgttcctgtctgcatatacgaatccctctttaccgcgatatcagatgtcagatgtcaatccggctttagtaacctatttaaatactattttgggacagttgcactaaaaacccattcatttcattgcccatttgatggcagttggaaggtggttgggtacatggccttttgaccgtttgattgcagttttggggtgttattaattcagtttctcacttcgcaaatatactctctaatgtattcttcggcttattaaactacgttatactatacaaaaacaacggtttgttttgacaaccaaagttcaccttcgtagcttgatggtgacatagagcgagttaccatagtcgtgttgaaccgaaacaacaccattatttccacctatattcggtgttcctgtgctggaatttatggcactaggttctcggactctttccacaactttgggatctttgggatcctcaatagactccacgatatcaacaaaagaatctacagagggtccaacctctataccatatggtaaaacagtagaagctatgggcgtacgaattgttttcggtgcatctgataattcaggaagaactagtccgttcctgcgtccaactcttcccattccccttcgtttcctacgactctccctttctttatctttgtctaaacgttgcaattcttcaatgctgatttctaagagattaggagaataatcctggaattgagttcttgatcgcaaaatgctttcattgggcaatatatgtggtttaaccaatcttctcacctgttcctgctcaattacagatccatcaaaagggtaatttatgaggtgcaaagctttgatgaatatttgtacttgttctctgatagaatgtgctactgcagtaacaaattcccctgggactgctaattcagcacacaatactgttgcaaactcttctggatcattatttggatccgagatatcccattcaaattggtcaatcaactgattattacccatagcaatatcaagcttgatatcaacccttaagtcttgcggtcttgtgttcgttgctgttcgatattcgttaatctgttctttcatattagctaagatggtgtccaaaaacaatggatttttaaacttgtagtcttccatcaaaacggcaacaaatcgttctaaagttacaaccttttcattcaagttccaaaggaaagtgtcattaagtttgaaattgtccctttcgatatcaaaatccattctaatcggcacccattcgtctatactctccgcctgctgttccatcaattcgtctggaatatagctttccggaattctggaatacttctttcttttttgaggataaacaaattgtgtggtagttttgcctgtaaatccatggccatatccttgatatccttctccccagatgctcggtggtccttccaccatgccattatttactgcctgaatggatttcattcggtagctcttgagttcattgtaaaatttgagatcctttatcaaggactctaaaacctttttttcctgttcattttgtgctctggcttctatattagctttatcccgagtaataatttgttcatagagaagtgtatttgtgtccaccggtttaccttctttttccagcttctctgaccagtaacgcaagctactcagcctgggaagttcgggttgtaaaggagcagagccacctggtagttttggacgaaaagaagaacctactggtggtgttgatattgcaggagaaacaccaggtactccatgagccaaacttccaggatgaccagcagcaccaacgggtatttgctctggcatcataggtccgccttgcccttgcataccttgagccgcttgaataccagctccaacgcccataccaggcggtgcctgtccttgtttgtttataaactgttgttgtcgctgttggacctgtcgaaggaacatggctagctgggggttttgtcgaagaatttgttgctgctgttgtggtggcagggtcgccagttgttgcagaatctgcatattcggggctgcattggacatggcgactaaatttcctgtcttatgtccaatgtaccttacgagataatgtggattggaggagtatctcttcagttcccatctgcgcgcatgggacaagacgaaaacttaaaagatgatgctgacataatctataactttataacctacctactaggatctgtagtcaccattgatggtaacgtattcatgagaaagatcacaagtccagaaattagcttcttgaccacctccagttcctagactaatacggatttccaaatcttcaagttccagtatttcgctggctctttcctcgtcgactttttctggttcaccattcaccaagagtttaagctcagcagagccatcagcaggaataaaactgacattggttttgagaacgttaacatctgcatcggcataaccaactgcacaaagaatacgaccccagttggcatcctttccgtacatagcagttttgaataaggcagaattagcgatggaagatgcaacttttttagcatcagcatagctttgagcatcctgaacgttgatagtaatgaattttgtggcaccttcaccgtctctgaccaccagctgggctaattgctgggcaaaaagtgtaatttcatcttggatcttggagaattgggatgatgtctcagatatctcttctcctccagcagccccattcgccattgcacaaatggtatcgttagtggacatatcaccatcaacagagatacagttgaacgaccgatccgtggcgtatgttaagatcttcgacagcgcaccgggcgtcactggtgcatcagtgacaaaaaatcctagcaaggtagccatattgggacaaatcataccagcacctttagccaaccctgccaatgagtatttgcggccatctatttcaaaagatttggaaactaatttagggaaagtgtccgtagtcatgattccttgggcacatctgagccagtcttcatgggaggaaccaacatccttcaatgctaccggaattccttttaaaatattatcaattgggagacgctgaccaattacaccagtagacatcaccagtgtggaagatggtgcatttttcagggttgagtcaacagtgtcaaccatcttcaaggcatcttcaattcctcctttaccagtgacagcattggcatttccactgtttaccacaattgatgatatgccttttccattcttgtcattgaggatttgtctggagacttggactggggcagctttgaacttattggttgtgaatacagctgctgcacttgctggtgtctctgaaacaagaacagctagatctagagtagaattctttttcactccacaatgaatagcccctaccttgtaacctaggggatagctacctgagtttgggacatacttggactctttggagattgtagcaaagaagcgggctaatttcaaattattcatgggaggttggtggaggagaagataacagtcgcgagatataatctggcatatagattagaagtcacgtagtggcattctttgaaggtagtctcacattagcattacacgacacgatggccaggtcattttgtgctaacatgcattccaaactagttagaagatttaaccttctagttcgtttgttcatctgtagtgactcctaacgtcgaagtactcaataactttgaaaaattgattcttgtaacatccaacatcaagaattatctcgatgttttccacatttctttcgagtttcttctattaagtaacttactttcgaaatgtccaaaaccaaagtcgactattctttcaacaaccccgatgttgttacccaatactcaacagcaggctcaattgctgctcaagttttgaaagaagtcaaggcaaaatgtgtggaaggtgccaaaacttttgatatttgcgtttttggggacaatcgattgaaggaggaacttgaaaaagtctatgaagaggaaaagcaagggaagaagacaacgtccaagggtatcgcatttccaacttccattacgcccaacaatttggtggcctacttgtctcctactgcccctgaagatgaggctaatttagaactcaagaaaggagacttgatcaaagtttctttgggtgctgaaattggaggatttccttccattatctccgaaactctagttattggggaggatgaagttacaggaagaaaagcagacgttattgctgccgcttattatgcactccagtctgctattagaacaattagaccaggaaagagaaacatggaagtcaccaaagtggtggatgatgttgctaaggcctttgattgtgttccagttgaaagcatgttgtcccacaatcaagaaagaaacatcttaaccggagaaaaggagatcataatcaatcctactccagagcaccgtaaacagattggaactttcgaattcaatgaaggtgaagtgtatgggttggatattctaatttcctcttctaagactggtaaggtcaagaaatcttcctatttgacttccattttcaagtatactggaaccagttatagattgaaactgaaaacttctcagtcatccctgaaccaggtcaagaagctttctccctacttcccagttagtctgagatcttttgctgactcaaaaagaggacgtatgggattgcatgaatgtgtcagtcatcaagtagtggttccttacgatgttgttcaggaaaaagaagatgaactcgtcgcccaattctacgcaaccattggagtgggcaaagatgctaccgtccagctaacccccttttcctttgatatttcaaccatcaaatctgagcattcggtctcagacgagtctttgttgaaccttctggcacaaccattggtcgagcaagaataaacgctcttttaaaatcccaccatcggatatgtgactcagatattatctagcaatcaataacacgtacagaagtgatcactaatcgctccctcctattcatcaagcacctgaaatttcgggttgtccctttactttgatatactcaccaacttttaaagttggttggttcatgtcgcgcgcacaccttctcttctctttctctttctatcaatgtcagacacgattcgtagaaaacgtcttcgaaatcaaaagcccgccaacggctctactgcggcgacgacagaaatgtcacatggtacttcacagcaatcctcacaagaaggatcaaaaggcccatcaatagggtcttctcctgataattttacgcccgatttgcaatggtttcaacccgatgacacaagttctcccataattacaggattaccattagaggctccgcctccagccaaagttcgaaaagaatctttatggcctaaaattgctgctacgtctaaaaaaaaaaaaacggagacctgctggccctggatcgttgaagttgtttgcaactactcagcaggaggaatctcaacaactggcaaccgaagccgattacaaactaaaattggtgacaaatgaatccgagtcacttacgaagccaagtctcgaaagaactcgtaatctacggcctacaccaaaaagcggtgctccaaactatcaaataaaactgaaattaactggtccaagatctcccaagtcgaccaatcgtacaatccaacctccccgaactccgagcaaaaaatccgcagcgtcccctagagacggccgtcatgttcaaaaaataaagaaatctcccagaaagcaaagagcaaaagcgtttcctccggctcagtttggagctattttaccatcagcatcagcatccccgtcatcttcgtcatctttatcagcattaaactccacaaatcctttatcaggtaatactgactcggagccaaacttgaattcaatatctgtagcagcacctaatggctcgtccacctctccggaacctgacaacgacgatttttgttctggatgtggtggcccaggtacgtttatttgttgtgaaggatgtccaaggtcatttcattttatttgctgcgaccctcctttacatgaagaagatctctcagatgacgcttggttctgcaccgaatgtaaggcacagagacaccctccaccaaagcatagaggtggcttttttgccgctttacttgaccaagcggttgttcgaaacccaaggtcctttttattgcccaaaaagatccgtgaaacatttgtcgacgtggctactacccgtctaggctcctattcggatggttcttcaaaagttgatcagttttcgagagctagtgataaaggtaacaatgcttcatcacaggcgagccaggatgtcaagttctgttatcgttgcaaggaatctgatttgcgaaagccaattatagcttgtgaatattgcccactggtatggcatctcgattgtttagatcctcctctagcagctcccaaactacttggagttcgttggaagtgtccgaatcacacagacgatctatacaaccaccgtcgcaggctcaagaatcaaccacaaatcgaagttgccatggtacgggggttcaagaataatggtgatgtcgagatcataaacgaccaaaatgaaaacgatcaagattttgttcaactccccactccaccttatttcgacaacatctctacaaccgaaggtattgcgtcacttcagaaaccggcattcaaaattgttcagatcgataatatcacatacagaattccagaaaatggagtaatactcgattttattgaaacagctaagataaaaaagctgaacgagattgagcaactcaagaaagagaatgagtcgatactgacacgtgttgataagtccaaacgggaagtgttgggtggcttgattgccctgaaacagtcgccaatagagcagaaactctccaattcggcgaacctttcgaatgaagttgattttcgacagctagttgaaattgctgaagctcagctcggttgcgaccaacacattactgttcctcctctcgaaacagagacccgtgatctcgtctacattaaacaactaattcagttgaaaggaagagatgccatgatcaagtttctagaatcgtagttatctatatatattatcttcaacttcaccatcatgattattcctgagatttaagtgtaatacctgcaagggtggttggtggtcaatttaattacaataaactcaggcagccgtctttatccttttgttccgacgtaaaccatcttttctggaattcgttctggcaatccttgctcttaccgcattctctacttccacaacaacctgatcgggtaaaaaggaaatcgaaacaatgtcctgagcttctttgatgctcttcatggaagaaaatatgtcacctgggagttggaccttccctggccaagtttgaacattccagcttttcgatagtgataatagctttatgcagacttgcgctaattcagatactcgatacagattataaatgaccggattttcgtccaggtcataatctgcagcactaaaaagcccatcctgatatttcttaacttgtgtcgcaaggtaatagagtaatgagatattcttttctgtggccacaacctctaggaattcgataatgtattccgaggctgatattaaagtcggtactagacttgccttctcgggttctttagggagtatcttcaacgaatcgacaaattcaggaaagtgtgcgatcatgtgaattagtctcaccagggatttttcaaaaattaaaggcttactcttgtcactagaaaagcgcttgtacgtagagcgcatccaagttaaagttttggcctttaacccatcgagtggctcatacgcagtaaaaaagaccaagggaagaaacttgtcagaaatatggttctctgctaaatatttctgcagttcattgagaaaagcttctctgattgtttcattttcatcttgaaccaagaagattaatctgtaaaccaatgaaggtttcatcatcttgctatatgttggatatttggccagtttcaaaaaactcaggcccgccataagtcgcagcctggttttgaaatgttggggagatggatacgaggaatctttttcattaacaatctccccagaatttcctataatgaagaaaagtaatttcagcacaggctctgccagttccttgctattttcagcgtcatgactagctctcagtcggttgacaattactttcagagaatatatcttgatggcacaagaagtgaattcttttgtctctaattcatcgtcactcacaaattcagaatggtcttctttctgtttaattttgtttttcaaaagataatcttttatcaaagtcgacgtaagatcactttcgacgctttccaaaagagaatcatccaagaggaacatttcacttataacacaaagatgtgaagcaagatgttcactggtatcatcgagtgggtatattgttgccagaattcttttcaaaatagatttttcaccctgcaatcctaatattttgactgcaaaccttgattctgtcggtgttcctttctcgcagataaactgtaaagcaatggttagagattcatccatgttcatctcttgaggatactgcttagcataatgatatattgtttttagagtttttactagcgatctttcttcggtagctttatgatagcttttagctgaacagatagaacgaaggatattagtgaactgatgtatctgacttttgaaaacagccggtgaggtttctgatattgtttcgattagttcctgtgcagtgtttgcaagttcaccattctggttggctatttcaaataaagaatgcatgttgctttggttagaaattattacggctgttctatatagcaacagcttaaatgtgctaaccatttgctcaggagtgacctgagcagaatccatactagttttttccttacttggtgacgaaaggtgattgaatagttctttcaaggcatttctaacagtatcatagttgctttcggtggatatggctatcttgatcagtttgtagtacctcttgctgttttctgcaacaaagcggtttagacaggagatagggcgtatgtccggaggaatagacaaactgatccagttggacaccttgtcaatcttcttgataagggtctccttgttttctttatctgcaggattgcctccgttgtaggcctcacaaaggccaacaaattgggtcagtacatcggataattgccgttgtcttttcaaaatagcaacgaacgcagatcttgcctttgtatctaaatgttttaagacagtcagacatcttctggcacgattttcatctatgttatcaaatggaagtattttttcaaacagtgccaaatccaaatgttgatttatttcagtcgaattaatgtacactaaattaagtatagcactcggtattgttccaattgtatcgtcaagttttttgtcagccgcatagaggtcaataaaagttctattgtacaagttgctgacgaatgaaatggactctttgcgtatctcatagtttttctccctcaataaatggatcaagacatccataattgagcgactcaaaagcttactaacaaaagtttccggttgtagcttgttgaaaaccttgactgtgttcaatctaacgtgaaggtctgtgtctaacaatgcttttgtaattcctgtgacgatatcatcgttgatatctgttctattttctatgatattaaacgtagctgatacccaggatgcccgcaccctagaagaaatatccagtatctttttcctccaattgttccatgaatcttggtgaaccttgacaaagttaacatccgagggttgaacagatgcaattttcccgatagttagggtagccaattctctgatttgttcactatcagcatccaattcgttatctagtacccccatgactgaaagaagcaagtctggcacatatttccatatttcgatacataatccgtgcaacttgcgtaattgatcaagagtatccggatctaaagatacttgatttgttccattttcattagcggtgacctcgtaaattacttccgaaaaatattgtgtaacttgtcgtgataaacgatcagtattggttttgcagatattcaaagtaatcgaaaagcctggaaccctgatgtttttatgttgtgaatctgagacagttttattcgccataaatttgttaagtatcagttttaacacgggtagactgatagaatcagattcagaaataacttctgagagaaggtcgctgattagtgtgtccactttttctgggaacgcagaatgtttgcaaatatcgtatattcctttgaacaattcatcggtcaacttctcagcagcaggtaaatctgtcattaaagcaatgctctttacctccacaaccctcttgagtaggttatataagttcaagtagtatggactctcttcatccaatagtttcttgaattgactgataaataaacggaatatgttagtcaattgggtagcagtatacggagcatcaggagcataaagtcttaagatttctgccaaacaacagctcacgtaagcttgaactccttgattgttatgttttattaacttttggtttacaagatcctttttgatctccgccaaagagtcaagatctactaaatcttggtctaaagctgataattggtcgcagacattcctcaacctatcgacaagctctttcgtcgttattggctcacttatagaggatatgattggactttccagttcaaagactacttttttagccatttatatagtcagatatggaaagtggacgggcaaagctaagtgattgagttgtagaacaagtaaacttatagacgttttaagacgcgtctcgtatttcatgctgatgtaaggatgtcccttaataattatcggttcttatttaaaccatcggcagatttaatactctttacctttgatcattatttggtgtgtattatctataaataactcttgatacattcttaatacattagaggtcacagtaacgctttcaattattactccaatggaaggataaagttgcagggttggttcatattcttgttcttatattagattcagtagagtctgtttcattagaactcatgggctcctcatcttctttcagctggtctatatgataggagctgctcatacgagattgttgactgtagtttgaattcattcgatgagatcgagccatcattttaatagcgttggaatctgtccctgcgatttcatcagatgccccagcagctgcaggggttattcctgcttgggagactttctgttgtagtatctcaaactctgaggacgctgatttgtgactatttttccttgagggagcaaatcgtcggaacagtcctagttctctttctgagacagttccccgggaggcaaacttatcgagtttgaaactaccagctttcgattctacatcagtattagagttttttctcttggtcatcattcttttgagattataacttggcttgaactggtcagcatctaaaacctggtcaatatcatcatccccttcacagtccatatccacgacagggaatacaccttttggtgttgagcggacagaatttgtagttttgaacctagtcaacccagttgagccaatggaatccctcgtttctggaactctgacaactctagagtccatactgagatacggttgttcatccttctccacgtaatctggcaggtctaaacgttctctatcttgttccaccacgtaaaggtgtaagtaccatggaatggcaatggcaaaaaacactcctcctatgatatttccaatggtggcaggaatcattattttccaaatgtactcaccaatgcttacagagcttccgtttattattcccgtaagacagagataaaaatcagccacaacatgcgtgaaccccatggtaacaaaagtgaagatcggtaagaatatcattaaaaatttgacatgcagaggttttaccattaattgtagatatatggccaggcaaacaaagaagtttccaggtatacctcggagcaaagttttaacgaacccgcaacttgccttttcttcaataatctgaattgaaccaagcctcatggtctctgtagaagtgattccagataggtggcagatgacttcacaaacgaacaacgtagaagcaaaattgaacacaaaagaaacaacccagttgacaatcaaatccactatactcacacttcctcttattaaggccactgtgaagaacaaaacgttggaattgaacagttctgttcctaaaactacgacataaaacaaaccaatagggtaaactgatccttgtagaagattgataattcccatgtattcggacataaatccttgcaaatgagcttgtgtcaataagtgaagcatcccacccactgtgaacagcatccctgctatgatcgaacttataactagcatctctggtcttaaacgagcctttttcatagcagtggctacgagtgccagagctgcctcatgaggcgtgctgaagtagttatcgtcagccatccagagatgtttagggatgtcggagaagaaatgattgcataggagggggtgcgaatttcaggataaagttcggagtagataatacaattgtggggactagtttggcctaaacaacggttacagaatcgttgaagaaacgaaatattgttcatcaactcggaatagtttcgcatctgatacttctagagttttgggatgtcaagtcttgaaatttttctttccttgatagggatcttgcgatctctgtagtgctcttcatataaaataatcaccgaaaaaacattgtctattaatatcttcttgaagggagacttaattaggatatcatggccaaaattatgttccagatcaatgtcacaaagcaatttagtggaaatatgtaatcctcgtgaagatggaaaaaactaaggaacgaaactaggggccaaatcatgtaagaatatctcaaacatgtcagatatgtggatttcaaggacgcataattgagtgaagattcccaaaatgcattgaagaacacaaatataagctgtccagttagaactcccaccgtttgatcaagaaggaatcggtggatattattgtccaaggaatgcaaaagtattccgatccaaaagttggaaatgagactgtttatgcaaccccagagaaagaacttgaagtgtttgtcaaagctgaaagattgcctgtataactgtgatattgattgtgaaaataatgtagaaaacgaccccagacacactcccgcaagatactcgctgtgttcatacaactgttgatagttggttactataccgtataatatcagtatttccagaaagatcgcataatagatgctggtgtttttggactttggatagtttgtgtatgaacctttagttatggggagctgatgatcttgtttctccatgaacttgtagtcaaaagggagaaaatctggcaaaaatcgaagggacaaaaaagtcaaaagatcaagcaaatgtgtgattaaaacgattggtttatggaataaacgatttaggatcctggacactagccaggaggaattgagtctggttgtgtgatgatttggatggggctatggaagacgcgtgtcaatagaaccagatatgattacgtaagattattgagccaggagattctgctgggaagtaacctgccagccaataattacagtctgcgaaggtgcaatggatacactttccactagtaaacttaaattacagatttagtgagttacaacatcctgttggaattcatatttttatgttcgacagtttatttttcagcgttcaggtaatcttccccacaaatgagtaagacaatcgtgaagcctgggattaatattccttccagtacattcttttcaggctccttccacgaccatcccgcctatttaaaatcgtgaaaattccccgggaggttccactccaggtttataatggtggtgcacaaccctaataactggtaagtttttcttagagctgcggttaatagtgtaacatatcctaacgtttcaggcactgggtcgacaagaactgccttccttgggccaaaagctactttcaggaagtccttccaaacaccactcagaagaatgacgcctatgaaatagtggtaacatctgtggaccttgtagatggagactgcgatgtcactcaacgtaaaggtgttaccaaatgtatttttgatctgaagatacaggtatctgcaaccgtcaaagtcaacacgaacagtgaagtagaggagatcagttatacagtgacattacctgaactggtgcacgaccaggacgaggatgaatatgaatacgtaatagagggaaatttggatcacaagtctcaaattagaaagctactcactcctctgttgaccgagaagttatcaaagtttcaacaagctttgatagacgctcatactcaggatgttcagcatagtacctagatgataaattatgtggttacataatctgtattgtgtagatcgcgcataaaattaatcccatctcttagaatgatcttcagcttagtgcactagcagcatcctgtatctatccaatgtcttcatcttccgagagcgaagaagagctaggaatcattgctacaagagagcgaagggcaaatgctggttcaaggctgaagcagttacttcagcaagaagaattggatattgggtcccaagattttgagcaggacgatgacgatgagaatgtcaatttgttattccaggaagatgagaatgacgatgaatttgtggaggaaaatgaagaagaagaagaaggagaggaagatgaggaagaagatgatgaagaagataaggaaaatactccctccaacaaagcggtttccgaagaacccaatgacgagatgtttagttccgaatctgaaatcagcgcgtccgattctgatgaaagtgaaggtgagcgtgaatttcgaagagaggaaaagttaaagcggaaaaagagggcagagaaggccaaattcattcctcctgtgatcaataagagtacacctaagaagacaaaaccgaaaactaaggtgaccgcacattcctttttgaatgcttcaagcagagcttctacaagaaaatctgcagtggagaataaactagctattgtggaacgattgaaagaggaagaagagcggagaagcaaactgaaacccgttataagaaaggaggttgtagcattaacccagaaagaaagattagcagaagccaaaaccacagagagaacaaatgtgttatctttgaacaagtttcacgagcaggagcaggaacgaaaagaaaaacagaaacagatgatgctgaatagaagaaagaagttggaaaatgtgctaaggttttattctgcttcagcattagtttaccccattgatgagctaaaagatctggagaaggtcaaaaaaatcgaagccgaattcatgaagagtcacaagaaacgtgtttacaagaaacgaaagaagaagacagaggctaataaggatgagagcacagagactccgaaaggtgaggtcaaagttgaagcttcggagaatacaaaagatggaaagaaagatgaccatgcccctattaagacgaatgaattggacacgaaagagaccgataatcaaggagagaatctcccgattagggatgataacaaacaggatgaaacgactctttcaacagtagataatagtcctgacataaataaagcaccaacggagattgatattgttgaggacagagatgtcgttatgaaagatgccacagattctgctgaagtagttgagtcgacttcaagtccactactttcctccaaagagaagatagataatgaaaatgtacaatcaaaagagtcttctgaacctactgttgacattaagactgaagccgagtcatcaatagaacctagccaaaaaaccaagaaagtttcatttaatgaagaaagtagtcaacttgagttttcaacagaaagtccggtagcttctttgataaacaataatgtaaaggaaactgaaattaaaaaagatgtgaatcagacttttgttaagccggaatcagagacagagatagaaacagaaacagagccacgcacacaatcaaatgacaaacaagaagaagaagaagaagaagaagaagaagaagaaaagacagattctaaggaggaggaagttcagtatgaaggtcccccacagtttgtggcacgtaatacgattgagcttttagaattttcaaaaaagcttaccaagctggaatatacaaagtacatacttggagatcaagctgttctcccggctcaaagaagaaccagccacttgaaaccgttaattcgaattaaacagctacctacaatgatagaaacactttttattccatactcatccactcatgagaaagaatttcacgaaatacttactttgccgaaatttggcgaagagaacaaaactgttcataagcagctcttagtgaaagaaagtgacaccaagaagattgaaattattacgcctgcacccattggtatttaccttcccaatggaagcaagaaaatatgtcctatttccggtaaaccagcctcatactttgatcccaagaatggcgttccctatgcttcagtggaggcttataaggtgctgaaggatgttcaagatgagcaattcgcttggattcaaccagataaaggaggtgaatatagtaggtataagggtggtataggcgcttatcttcaaagatgggatgtcaggcacgccaagaatgttcctgactggttctaagtaacgttcatatactgaatatacagtagaatttcagaccttcatcgcggattttgaaatttcctctcacaaacaacccatgcatcacttaagacgacaattcagccatgttggtaggcttcttcagcagtctaagctgacagctacaagtgagattgagatgtctcattttaatcaacttgcgagtacatggtgggatgtcaatggaccccagagaattctgcataagatgaacctgttgagaatggatttcattaatgacaccatcaaatctcacttaaaactgaacaaaggcgtcacagaccctgaagaacagatttatatacctcctttcaatgttgacaacgttcttcccaaagagatagcggaccggatcaatggtgagcaagagattcgaagacaacaactgtggcagcaattgaaattggatgccctggatatcggttgtggtggaggtattcttagtgaaagtctagcccgattacccgtggtaaatagagtgaagggcattgatttgtctacagaagttttggaggtggcaagacaacacaagaagcttgatcccatggttagggaaaaactgacatacgagctaaaggccgtagaggatctggatccaaataccgaacagtacgatgtggtaacaatgtttgagatgttagagcatgtgaattatcctgctgaggtcttgaaggctgctctacgccatgtgaagcctggaggatggatttttattagtaccattaatagagatctaatttcttggttcacgactattttcatgggggaacacatactaaagattgtacctcttggaacacacacatatgacaaatacattaacgagaaagagctggaaaaatgggttgaagatggtcacgagaattcggatcttggtgaccttaggaaacaatttgaggtggcaggttccaaaggatgtgtgtacttgccttgttatggctggaagttcactgacaatgttgaggtcggtaattatttcatggctctgaaaagaagggactgagtgtgtgcagcaatacttgaatcaggcagccacttcttcctttttctcttgttcgtcatcaacaaatgttggcagttcatcattgttctgtagatagctaggtaatccatttgactcacctaattcggcatcaaagtccatctcctctcctaaagcatctagttccgcatcaagttcagattcacttatatcatcaggaacgtcataactttgggccaatgaatcctgcaactcattagatttatctatcagatcaagcatttcgtcttgcaaagattcaattttgtcaatatcaatcttaccgtacgttttcttcaattctttattggcagacttcatggcactgactgtgatcattgtgtttttgagattatccgtggtcatggaagcttgagacatgttccaagattgtgattccaattgatctttttgggcttccagctgtttacgttgtttaagtagcttcatcgccttctgtttaacagcgtttttagcaggaccatctctcatacgagaaagcttctgctgataagtagagagctcagtgttgactttggtgagtttgacatcgatggacgagacacgttcctcgatactattgattgcatcattgagattgggcttgggttcgttgcttctgcctccgaacaaacggttcatcttgtgtgctagtggcgtgtatgaggtaaaactgctactttctcgatattgagagaaattactgataggggcgaccagaacgatttcaggttgaataagagtctaagtacaaggatggtagataattagcaaggagctacaatgtagacatataacggccatctcaacggtgggcttgacagcactgagctgaatcttaccaatcaaataaaaatgtcgcaaacgatgaactgattgtgattcattcgtagtcaaccattttcaagagttgaccaaggcagacccttcatagcttgtgcaaaccatcctttcaaccttcaagaatcttctttcctttcaacttgagactacattaccatgacctttctccccaactgtagtgaataaccggcctttcaatcacgcaaattccccaaaaatccctgtaactatgggaaattcatcgaataaaatgagggaggggcattaaaataataaagaagttgtccgtcattagccctccgtcaacgggattatttaatgttactaaccgcttaatcagccggggatgcgatgcactttttttcaccttataaccatatcgtttagcttcaggttgtttctattcccaccgtttccggccactatttagctagtagaaagatcagaaatgtccgtgtttacgccaatagaggacgccctgaaggcttacagtatgttactcttcctgctacttgaaaacgaatcatatgattactaacgcatctagaaaatggagaatttctcatcgtgatggacgatgaagacagagaaaacgaaggcgacctgattgttgccgcagaattgataacgacacagaaaatggccttcctcgtgaggtattcctctggatatgtttgcgttccactttccaccaagagagctgcagagttagaactaccaccgatgatcaagaacagaacagacaggcagggcactgcgtacacacacactgtggacgccagagatggcactaccactgggatttccgcctctgacagagcgttgacctgccaggttttggccaaccccaggtcaaaacccgaagagttgatgagaccgggacatatttgccctctgattgcacgagaaggcctgttgaaagagagaagagggcacacggaagctgctgttcaattgtgtgaattgaccggattacaacctgctggagtgataggagagctggttcgtgacgaggacggctctatgatgcgattagacgactgtgttcagtttggtctccgccacaacgtaaaaattatcaaccttgaccagatcattgaatacatggattccaagaacagctagatacgatggataggaatacagagatatcatgattgaggaacgtaagagctttttcgaaagtgtgagtttgtggtgagggccaggcggtggggaggtggtggggagcctccttggtcgaatgtagatatagtaagcaagacacaagagcgcgcgaagtcttcaacgaggcggcgttgggtcttgtacgcaacgtaatgactacacagttgagcttgtcgcgaaccggtcgacattttgatcatgcatactatgttgagacaccatctcgtactattgcggcaaccagctgtaaatttgactaattaaagctgatgaaggatgcagggcgtcgtcaattttttgattgattgcatttaattgtttgagccattcaaggctgaatgcccggcaccctagacccttcttgtgagtactataaacccgcaggcagggtacccttggccttctgcgagactaccagtcataacgtatatccacaatgtactagtaatagccccggaaaactctaatcccacagaacgtctaacgcctcctatgtcatcgatacccattcgcactactgccatggccccccttacgtgatcatttcacttactcccgcctaagcttcgcccacatgcctgcgttttgccaagatttactgacgagtttggtttactcatcctctatttataactactagactttcaccattcttcaccaccctcgtgccaatgatcatcaaccacttggtattgacagccctcagcattgcactagcaagtgcgcaactccaatcgcctttcaaggctaacaagttgccattcaaaaaagtttatcattccaacgacccaaaggaccgtttaattaagagagatgactacgagtccctcgacttgagacacatcggagtcttgtacactgcagagatccaaattggatctgacgaaactgaaattgaggtcattgtcgacactggttctgccgacttgtgggtcatcgattccgacgctgccgtctgtgagttatcctacgatgagattgaggccaatagcttttcctcggcttctgccaaattcatggacaagatagctcctccatcacaagagctcctggatgggctgagtgagtttggatttgctctcgatggtgaaatttctcaatacctagccgataaatctggacgtgtttcgaaaagagaggaaaatcaacaagatttcaacattaaccgtgacgagcctgtgtgtgaacagtttggttccttcgattctagttcttccgacactttccaaagcaacaattcagcttttggtattgcttaccttgatggaaccactgctaacggaacttgggtcagggacacagtccgcatcggcgactttgccatcagccaacagagttttgccttagtcaacatcacagataactacatgggaatcttgggtctcggtcctgctacccaacaaaccaccaatagtaacccaattgcagcaaacagatttacttatgatggtgttgtggattcattgcggtcccaaggatttatcaattcagcatcgttttctgtttacttgtctccagatgaagataacgagcacgacgaattcagcgacggagaaattttatttggtgctattgatagggccaagatagacgggccatttagacttttcccatatgtcaatccttacaaaccagtttaccccgatcaatatacttcctacgttacagtgtccacaattgcggtgtcttcgtcagatgaaactctcattattgaaagacgtcctcgtttggcattaatcgatacaggtgccaccttctcctatttgccaacctacccattgattcgtttagcgttttccatccatggaggctttgaatatgtttctcaattgggactatttgtcattcgtacaagttctctgtctgttgctagaaataaggtgattgagttcaagtttggtgaagacgttgtgatccaatccccagtttctgatcatctattggacgtctcaggcctttttactgatggccaacaatactccgcattaactgtacgtgaaagtcttgacggactttccattctaggtgatacattcatcaaatcggcctacttattctttgacaatgaaaacagccagctgggtattggtcagatcaacgtcactgatgacgaggatattgaggtggtcggtgatttcactattgaacgagacccagcctactcctctacttggtctagcgatttacctcatgaaacacccactagggctttgagtactgcttcagggggaggccttggtaccggaataaacacggccacaagtcgtgcaagttctcgttccacatctggctctacttcacgaacttcttctacatctggctctgcttctggtacttcttcaggtgcatcttctgctactcaaaatgacgaaacatccactgatcttggagctccagctgcatctttaagtgcaacgccatgtctttttgccatcttgctgctcatgttgtagtagacttttttttttcactgagtttttatgtactactgattacattgtgtaggtgtaatgatgtgcactataatactaatatagtcaaaatgctacagaggaaagtgcaggttgcctgtggtggtttttcttattagcaccctctgaacactctttacctctaacatcctcagccatgctaatcgcgcataaaataaatcttcgaacttttttccattttatgctcataaagcttccttactgtcaccttatcaaaagagcttttgccactaaagtagtcacacccagaattgctcccgaatatcgtccaacaatgctaggatctgtggaaagtttgacaaataatttgaacaccttgagcttgaagcttcctgaagttaatatccaaggctcctttccagaaagtaacccagtggaccttttgagaaactacatcactcaagaacttagtaaaatttctggagttgacaaagaattgattttcccagccttggaatggggtaccacactggaaaaaggtgatcttttgatcccagttcctcgtctgagaataaagggtgctaatcctaaagatttagccgaacaatgggctgctgcattcccaaagggtggatatcttaaagacgttattgcgcaaggacctttcttgcagttcttttttaacacatcggttctgtacaagttggtgatatctgatgctctggagagaggcgatgactttggtgcacttcctctaggaaagggacaaaaagttatagtggagttttcttctccaaatattgccaaacctttccacgctggccatcttagaagtacaatcatcggtggttttatttccaatctgtatgaaaagctgggtcatgaagttatgaggatgaattatttgggagactggggaaaacaatttggtgttcttgcagtaggatttgagcgttacggtgatgaggcaaaattaaagactgatccaatcaaccatttgtttgaggtctatgttaaaatcaaccaagatattaaggctcaatcagagtctactgaggagattgcagaagggcaatcattagatgaccaggcaagagcttttttcaagaaaatggaaaatggcgacgaatcggctgtaagcttgtggaaaagattccgtgagttatccattgagaagtacattgatacttatgcccgcctcaacatcaaatatgatctttattctggtgagtcacaagtcccccaggaaattatggacgaagccaccaagatctttgaagaaaaaggcctgcttagcgaagatcagggtgctaaactgatcgatctaacaaagttcaacaagaaattaggaaaagctatcgttcagaagaaggatggtacttcattatatttaactcgtgatgttggtgctgccattgatcgttacagaaagtataaattcgataaaatgatctacgtgattgccagtcaacaagatctgcacactgctcagttctttgaaattctgaaacggatggattttgaatgggctaagaatttgactcacatcaactttggtatggtgttgggtatgtctagccgaaagggaacagttgttttcttagacactattctggaagagaccaaggaaaagatgcacgatgtcatgcgtaagaatgactccaaataccaacagattgccaatccagaggaagttgctgatttggttggtatatcagctgtcatgatccaggacatgcagtctaaacgtattaacaattatgaattcaaatgggagcgtatgacttcatttgaaggtgacacgggtccctatttgcaatatgctcactctagattggcgtcaattaccagaaatgctgacattgatctcgctgagcttccaggtgctgatttcgggctgttagttgagcctcaagctgaatacttggttcgtttgttagctcagtacccagatgttcttaggacttctttgaagaaccacgaaccatccactttagtgacttatctgttcaagttgactcaccaggtgtcttcatgttatgatgttctatgggttgccggacaagaaaaaccattggcaaccgctcgtttagccctttacgcatctgctcgacaagttctatataacggtatgttgttgttaggtttgactccagttgaaagaatgtaatagagaagaatgataataattgaattagattgaattgaattgaagttagaactaagtgtaagtctaagatatacgatgaggcttcataaatgcattcaacgtgtcttcgtcgatggccgctctgcggtcttgaaagttctttacaaactcttgcaatacctgaatacatgcttgcttcatttcaccagtaagaagatcccctgacttgtatgcatcatacgtttgcctgagaaattcatcatcatctttgaataccttcatgtactggtaggagacatcaacatcgggatcaccgcctagttctcgatgttcttccacagtggtctggcccccactaaaagcgtacttattaatcttctttttgatctgagcaggagtatcagtcatgaaaatggcggtgttggtgtcagatgctgacatcttagaggaggcaccttgaagggcagggaagaatttggaatgcagaagagcaggcttggagaattttagcttctcggccacatctctcgatactctaaaatatggatcttgatctatagcacaaggaatcaaagccggtgcagttggaggcaagtccaagacatcagggaatgatgaggggaaagaaggagcgatttgaatcgaagcgaaatgcatcttacccacacaatcagaatctccaaaaccaaagacagactttgcagttgaagtggtaatctgtctggaaattcttacaacgttttcgtaaaacccgcccgaaatgtactccaagttggagaatatgaaggttttctttgggtcaaatccaacagcgatgatatccttagcattgtccttggaaaattgcttaacatcttcaatggtcagcttgggtttgaataaaaacttttcatcatctgtcaactgaatgaccaacggaacatcgaatacatcttgcaaccatttggtgaagataaaagggaccatgtgccccaaatgcatactatcactcgacggacctctaccagtgtacaggaaaaacggctgtttcttctcgtacaaatctagaatcttaccaaaatctctctcactaaaaaagacaccctttgtaataaaatgatgaggtttgtgtcctgtgagtttggtgaatcggtctaaagtttcctgtgtaatatgtctagtaccaaaatccttgataagtttgtcataatcaatagattgggcctttccgtcaactattgctccttcgacttcccatggagtgactacttgggattcctccttgatgtgcaactgttctgtggcagtttccagctccttttgactcatatattcgttgtagttgaaggtttttttttagcctggaagaaactttaagtagttctacgagtagaccttcgcgaagatgtcaggtgatgaagttctctctcatctggaggataacttagtatcttcgttcacactactatgcgttagtcactttcttctacttcaagtccatcatctattgctctgaacggtctaatggggagatgattccataggtcttggtttggacttgaatcactcagaggagaagcaatgaatgtttgactgtcgttgtcagtggattctggaagattgtcaaatattgctccaaaatcagcaggtttataagaataacgactcagttgagatttttgacgtcgaaaagagtgatccttttttaaaggaatgatgcctgatcctggactgacaattgaagctagtgaagattcttcagaatctctcaaagaccctcgtcttggaattgaatactcataatctgatgacatgtacttctgattcaaactactggaaaatatagtgcagttcatgggagaactttggcctttgggtgtttgggtttcgtccattgtggactttttccaattcctcaccactttcctatacagcctagtgaaggtggacggcttctcttgatcaggttttgacaagatgtaatttcgtgtcctcactcgttccttccatgcagaataggtaagatccatttttatgttgggctttagtatggacaatttagagctcttctgaaaagaatagcggatcaatttttgccttgtctctcgtccccaagtcgcagtctttctcatctcttccaagtctaactcttctgcctcgccacgttcaagttgaattcttcctggacacgtagcccacatttccccttgttttttgttgacgccccgtctattcttgtagaggtttcagtcctagaacagtctaaatcttcaatctcagatcttctcgtctggggtaacacagaattagatttctctaggaaacctgatcacgtgaccaatcccaaacggaacaggggttctcttttgggcatccgacatattgtcttgtctttgctccatttttggaacagaatcctatcttccaatccaatacatgaacaatcccttatgattgctcaggacgaatctatcaactccgagttggacataatcaattgttatgcgtcgacgcgtgttagtacccctgagtatcctgtacccgggacatcggtatcccaggttaagcctcgtgactacccagtaactcatgtgtcctctcatttatcttccttgaagggagaaagcggaatacataccaatccagaaccttcaacggataatttgctgagttacaaagagaacaggaaggcgaataccaatccatcattgacattggtcgatgaaatgttgtcgatgtcctctgtgaggaaagtgagaaatgaaaatggacaggaagccaccagtgataatgacagtgagatggagggtcctgatcttccatttattcccacttcttcttctgagtggcaggataggggtgccgcaaagatcgttaccacaactacggatgagaatggtgttactcggaccactgtcgtgaagaagtcgattaaggactttatcatgggaaaaacccttggtgaggggtcttactctacagtcatacttgcaaaggacaaatccacaaagaagaagtacgccatgaagatattggataaaaggtacattgtcaatgaaaagaaagtaaaatacgtcaacatagagaagcatacgttgaacagattgagcaaacatgttggtatcattcacttattctatacattccaggatgagcaaagcttgtattttgtgctggactatgccagcaatggtgaattgtacaccttaattaagaagtacggtagcatggacttggatagcgtcaggtattacagcgcccagatattagatgcgataaaatacatacacgataacggagtcattcatcgtgatatcaaaccggaaaatattttgattaatgagcaaatgaagattcaaatcaccgattttggtacagcgaagttgttagaaaagaatgaagatggagagtaccctaccaatgttagagccacttcttttgtaggtacagctgagtatgtttcacctgagctgttgaatgagaagtacgttggcaaaccttgcgatatatgggccttcggctgtttgatttaccagatgatttcaggcaagccagctttcaaagccaccaatgattatcttgtttttcaaaaaatatgcaagctgaattatgctttcaccgctggatttcccactattgttcgtgatctggtgaaacgtatttttgtgctgaagccaagtaatcgtataaccatttctgaaattcaaaagcatatgttctttgagtcaatcgattggagcgaccccgatgcaatttggaacacggatcctccagaattaggcccttataagatgagtgcacagtcgatgctgccaattcccggattgaaaaataagactaagccatacttgccatccaagacgaatagttctcctatcgttaagcgggccacatcttcaacgaactcacctacacaacctaaacttgtgtcgcaaaattctagtccagtattgatgcaaggcaaaaatgctcctgatcaaaggagtgctagctctgcagctgcagtagccttatcaagaagcgttccaaacaatgcctctacatcgcgtttacaggcgccaaactctgcatcttcaacttcttcaaataagcaggactttattcctggtaccaatattccgcgtccgacagtgcagagacattcctctaaacagctacttgctagcggggctggatcccgcaagtctagtacaagctctcttccgccaagtaaacctgaacctgttcacccaatgacagtccttgatctaaaatggtcttcatacttaacacatcacgatgaaagaattttgaaagcggacgtcgttgatgttttcgaaatgaccactgatcaggttgagaagaagtttcgtggtcaattggtggactcaccgttaggttctaatggaaggcgaacaagtggtacatccatgcttactcaagttgtcaacggagcttctggttttcgaaagcagtccaccgtgaataccaatggtggatcgccagagcccaacactgacagttcgattccagatcaggcaatcacctatgttgaaccacaacagttggaagacggttctaaagattccacagaacgagacagggagaaagaaccagataaggaaaaggacactaaaaaatcatcagttgctgagagatttatgaaagctttacacggaaatgtttcatctcaaccagtggagactaaaccaatcaaacacatgcttgtcatcacttcatttggccgtgcacttttattcgaagtatcaggagtccagccaaatccaacttatgaacttcgatctacaatcgacctggtcaacttaaacgtcaagttcaaagaagtaatgggagaaacaagaaaacagaaaaattcaatgatcaatacaggactatttgtaatagaatctacaaaatactcttttgtgtttgaggttcctaagcatgaaatctcaatttggacttcaactttattacgttccagaacaaacgaacatgatagaaaatactggagagactcaatggcagctggtaatgtaggaacatctacaggcggggagggagctttgaaggctgcaacgcaggcagccagtgtcagtgccaatcataaagaactcgagccgagtctactagccccaatgaagcctattagcccgcttagctctcactttgattgggatgctacagcaacagatatagcacacgagaaggtaacctccagaaagtcgcaagatggtgggggtttagcagaggtcgatatactattatcacccgcccaagaaataagtaaatcctctgagaggccctctgaatcccacactccagcaccatccactcataactcaaagaatcgaggcgaacggatgatgaagacaattgaaagctcccatggccgtaggaaacctcctcctccaatacctcaaacggggcatttgagcaatggcttacctcttcggtcacgtgccagtaacactgacaatgcaatggtgaatgctgccatcaattctattatgaatcacccagaagtcgcttccggacccgaaagtagtgccagagagggttcggtgaataggtttgttacaggcttgaactcccgatttcttgccagatcctcaaggaagagatgaaaacccctatattggtttcggttgcctttttgggaagtcagcgtcacgggctcagaattacacacagattactttctgtaaccctgacccgcacacgacctatagtttttttcactgcagagattggtcgcgacactgtaagcgtcaggtaaaaatttcaaaaaattgctttatcatatagaaaaatacattccatatagtaaaatggccaaattcattaaatctggtaaagttggtatgtatcaagaatctatttcaggtgaagagagtagtgaatggtagttgattgtccagttgatttgacagaggcagcaatttgagaagagtcgtagagaaaagccgatctgaaacgcagacaaaagccaacaagattcaagtgagattaaaccaatggcagagttactgttgttttcagacgactcaaatggattgaataaacgtcagctaagctttcacttatgaattcgtctttcaaatcacctcttaatctatgctgacccctcacttcttcaccatctaggccatcccgcatgaacaaagtactaacatcatttttagctgttgtcgtccgtggtagatttgccggtaagaaagtggtaatcgtttcggtcaacgaggagggttccaagacccatcctttcccacacgccattgtagctggtattgagaagtacccagccaaggttaactccgacatggactcaaagaccattgccaagaacttgaaggttaagactttcgtcaaggctatcaactacaaccacattatgccaactagatacactttcgatgttgaggctttcaagtctgttgttacaccagagactatcgctgagccatctcaacgtgaggaggccaagaacgttgttaaggaggcatttgaagagagacaccaggctggtaagaacaagtggtttttctccaagttggatttctaagcaaactgtgtacagtgtctgtatgtataattgaacggaaaaataaaatgccttagaagtactaaatagatagtaattccgtatatggcaagtattgcttctggcgtttaccgtttcgcgggccctgcttctccctgcctctccgcatacgtaggtctatccttacaaacgtgaaccgtttcatacgaactaagcagagcatcagggtccaagaactgcaaaggttggctgttactattattcactggcctttcatcctttagttccccagcccgtacttgtctgattagttttcttttttcttttctttttttttttgcaattgtacgatttggttccttgtgttctttttatttgaacccgtcaaagtcatatcataccaggagcaaccacgcccaagatgagtgaatctttagtggcatcgatctacgtcaagattgccagtcttcttccacagaagaccggtgtcagtgtgtcggacctggaaattgatccctacttcagcagctgtaggaactccctgttcaaaatatccgagactaaattgttctcggaaatgttttaccagacgagtctcatactggagaatataaatcggactgatagatatgtgccattgtcagaacgatctgccacttctctgagttccatatcgattatgattagtctactagccgacatatcagattatgtgtgggcgaggcagaatggtgtgttgttaatgaatcactcttccaatatgcaaaaaacagctgttctttatgctgaaactttggggcagcagtcttctcgttattatcgagttcacccacgtcctatagatgatacacatgctcggaaggctgtttatactatttccaagtttagatcgaatacaaaattagtacagaccatcaacaagtttaaacaagacaaaatggaacctgcggtagccaatgcagttattcaagagattgataagaatacaaactttatattagaattcttatccggttcgaacaaggacatattctttgagttcgtatctagcaagctacagatactcaggaaaagaacaagtgaagaatctgatattgttccccatattgatatattgtctttagtattgttggatcagcaatactttttgaagtatgttaagttattatgggctctctatgacagcattcgtaaaccgatacatcagcgactcatattgtcattcatggcaacctccctaagacattggattatatgcaacccgcaagactaccttggaatcactgatgactcggtctacaccctagagctggaacttttttttgatttcctttacaggaagcaggagtttttctacgatcctcctcgtcaaatgatgcttatgcttttggtaatgtcgttaccaaaacatttggaatcttttttagagccaagtgtacagccttcccgtttgcgaataaagaaagcacagccggtttctaacaagtttacttttctagatttcatgttttcatctttaaaagacgaagattttgcatctcaatatctacctcatacgtttgagggtcttattgcattgatatgcattggagccatagtgtctgtttataggcctgacaatgccttggtgaagctggcctcaaagtatcttcaagattttgggactgcactttctattgaaacccccgactacatgatacaaggaatagatacacagaaatgccacgctgcacgttacatgtggtatgcgagcgccatgcaattgaagcgggatactttttcgacaagagtggctttcgaattatcttctcctaccacgccagtttccttggtcactattataaccgctgccatcaatgtactttcatccattcctgcgtttgattcagcatactttcattattcaaagctgtgcagccgatcattagagaatcatcttttaagagcagcttccatcataggcattgacaccgaatggaagtataacgaggtcgaattttttgaacagagcagagaaaagcggaacagtaacgattcattggttgatatgttacaagctttgaaaaccagcccgtcctcgcattctactaccccaacacctaaaattgatgaaggaagcttatcaaacgaggaatcacaaatgtcaacctcatactctagttccacaataccattgaaacaacctacaccgtcgaaaattcaaagaactaaggatactttaaaatctcatctttctcttacatccaaaagtccatctcatgacacggattcatcacgagctaatgcatcaatgctttcaaggacccccaaaccttcgaggttattgacatccatcgaaccaaaaccaaagcaaatggctaggtcgattttattcagtttattatccaccctggataaatatccgtttctattaacattcgacagaactggtggagagattgaaaatgattgccgtgtatatgcgtcccattttcaagagtttgcggttccgattgtttttgctatgctttccaatgacaaacagatagctgaagtagcccagaatgctgttttgagcttcttttatccatcaaaaatactatgccaagctcaatcatggcgaacttatcactttttatattgtaccctatctgttaatattgttgcatccgtcttaattgaaaacaagatgacaaaagaaaaagacagagaagttttggaagttttggtgagccttctagatgaaaggcgcaaacttggcttcactttcgatccggcgttaaaattttatcatcgcactgtttgtcgtgacatcacctgcaacgttgaagtggctcttctttacagtttgttcaccaccaccattgagacctatgactttgtgaaacgaggatttagagattttatgttggaacatcgctcaggaatccattttgactcgtgctattcttcagtggacaaactattttattccctcatttcggaggatactaaaattcctcctggtagagttgctttacaaaagaagcttatcgagatactgagaactataacctctccctcacgtagtttcatcaaagcttggacgttactatatgacaactggaaaaaaagcactaatgaagaacggaggcacgagtacgctataatattatgtgtggtttgcggagtgtttattacatacgacccctccaatattaaacaaaaagagagacttttgaatcaaaccaataccttgattgatgatgtcatgcatgatgcatattcatcaaatgctgatacaagaaaaagagccaaaagttgtttagaatacttacatcctggcacaatgggaattcttcttgaaagagttaaatctgatgttggagagacgcatgatatatttgattggagggatgccatcattgctgacaataccgtaactgttttgacatcaatgctgtcgcaaccagcacacgcctaccggtacttttcagatatcatctctatcctagaggtggtactcaataacgttctcaagaatgagtacggattaacagttataagacttcaaattacggccatctcttgtttgtcattattacacagctataaagatgactataacttaacaagttttatcctgatgcgaaacaagtttgcagattttgtctcaatatgccttgaaggtgcaatgtcgcatttggacataatctccaagttggatacaaccgagcaagattctaaagatattgaacactactcgtttgatcttgttttgggtgctgtaaaatacctggcaattggtttttatgaattaccgttggacgtattgagctcatctaaccatgtggatcacaaatcttctctgaatgtcatgttcaagagatactttacactgttattgaaagttatggaaagatttagctataatgtcagtgaaaatagttattcaaaacatcaagcgcttgctgttagtgagtatacaattaaggcattgaccaatctattgagatcaaatgttgaaataggtttaagatatgctttgaagctaggattttcggaagatcaaaaaaccagacttgctttcatcaacgttttcgcaaatattgttgaagatgttactgaagaatttactgaaagttctgatgaaatgaattatgaaaatcttttcaaaattctacagctactaattgaatatggccctttagtatttgcaatgatggaatgctgtcctcattctgaggttgacagtctagtcaattcctttttatctttacctttcaagatcgaggaatcaagggctttcattagtcatttaatcgactatgaaattacgaacacagatagtgatacagagttattgcggtataacacattttcagcaaagctcattggcaattttgccaaggtttacgggacttcttacttaaggagtcttttggggtcagtgttctcagagatcaaagattcccatgactactttaatgttttcgacaactttacgaatcacaatgaaaaacccaatcccgaccttctcatgaagtatacgcgcatgctggtttcaagccttgagagcactatttcgtcattacctcactcaataaggatgatatgttctcttataaaaaaggcaacttccagaaaatttcccgaatctagcttgctagcgtcgggtgcttttttgtttttaaggtttattactccaagtataattgagccagcatgggaagtattttctgatcctcccccgatgcaactacgaaagcagctagcgaaagtcatacaggcaatggctaataactccgtcagctcgctgaaatctgatacgttaagcccttacatgaacgagctagcgggtctgacaaagagagtacaaagctttatcgatgttgtctctacatatgacaacgaactgttggccacccacaaaagcacttatgagcgcaaggaatacacagcaggtcttcgctacctccactatttcatttatcatcaccttttaagcattagatctcggttgatcaaacctaagaatcctcatcttggaatttcattggatgcaactaaagtgttatttgatcaattgaaatgtattcttttaaatctgggtgtcccgaagcattttggaaacaaagtttcagatttggtacgtaatgatacctctgaaacaggaagcagattgaatttgtttttgacaaaacactcactgattgaggtacccccagatcaacccattattgccagagagtacctgactgacgatcgagtgaggtctgcgattattgaactagttcactttgcagagctagatgttgagacaatcctctatcaaatcttaaacgtactcagtaacttgtgggattctaactttgaaatcatggtcgattgcacaggccttcaagcacttccgggtgacaagagcgaaaagctgttaactagtctcaactcactaattcctccatttgcgtttggaaaatgtaacaagataacctacttcaacccgtcaactaaaatataccaattttacaataacaagttggcctatttggataagctggttttcttgagtccaaatttggatttttactttaaatcatttgaggataatctccattttgacgagtcgcagtacaccattcgtgtaagggaagatcccagagtcaccttcagtaatgttaaaatggcatttgaacctacaaaagaggatataccaatcaagctcagaataggaaatgagtttgttcatttcgtatacaagagaaatatctttattcacacaactcaggagtatgtccctatcgtttgtattgatattgtgaatgtggcagacctcaccgaagttgtgacaggtgaaaatgacgaggtttatctctttaactcagctactggctcgagaatagttttgaagtctcccaaaaagattgaaataatgaggactttatactacgtgaagccctccagtgttgacgtggtatccaaagctcatatggaagatgaattcagcctgaatagttttctgggcttactgctcaatttggactttgtcggtttattatcgagagacacagaaatcaggaaggcctcttataaccttttggtttcgttggctcattatttcaaactagattttagccgaactctgtcctcaactgaggagctcagtctaccccaagattatctaccctatgttgcgagtctttctgaatctttggccaagttccatccggagattacgcttgagttcgtaggggaatttttcttttcctacgagcatgcttcgaagaataggaaaatgttcgtgccatttattttaaggccttgggtgcgcaacatctatgaatatgtgtacgtccaagatcctgaacttgggccagatagggtgagtgaccttcttaaaaaaataattaggttgactattcaatccccctcaagccagtttgttttcagaaaagctttttggagtgagatctgcatgaacaatgagcttcatgggttgataatccaggaactagtccacgctgctttggaccatgaagctgaaggaaaagactgggatcatatcatttcgctagtgcatttatctccttccattgaaatatgtggacatgttattcatttgcttattggaagcgccaaaaccttttcatctgacatcaatgaaattgctgtacacagtaactggatcaagatttcagttctttgtgccattgcagataatctcttatttgactgcctgaagtatgcgttggctttcttgcctgaaatattgtttatcgtttcgctctatatggatttgggtccatctagactgaggcggtcactttacgggctaactgtcaacacactacactccttgctttcaaatgataaactttcatcggaatccaaaaccgagttgaaacttttgctttcaaaagttagcgatgatcgtggtaagatgctttttggattatctcataaggatgattctaggtcgaatggaaaaggctctggagatttcataaagaaaattggtgagatggaacacttttgtcaactagttatgagaattcctagattggtgggtgaccaaggtctggaaatggctgcaactacaaaatggaatagctatgtgatcaacttctcttttaattggcaccacttgtttcaagtcagaggtctcgttatgctgggttgcctcagtagtcaaggtgtcagtgacactcttttgtacaaggtagtctccctcagtggctccgtcctaaactcatacgcaaagaagcattaccactgggaaggccctgcaacaggtattgtactggctattgcctatgccttagggaagcttgttgaaggcctaccaactagttctcaattgattggcaagatgttttggcatgctttcgcactgtgtatcatacgggattccacaaattatcagatgtgcttagttttcttcactaaagcaattctaaagctgtccgagagagctgagtatagcaacatcgattgctttgatgcactgttggaggagaagaaagtatttggagaagccttggacaatatggaaaagctttacgaaatacacctttctcgagattcctttgatattgtgattttatcgtttctagggtttggtttgcgaatgccctctgtcaagctagcagcatacaaatgcttagttcaaattgctgcagtaagatgttcagacgtggtgattagcaagctaaaatctagcgaagaaagattctgcccggcaagatactcttatttggcttttgtatatcttatttcacggactgatgaacgaatgattgagtacttagaaaactgtggcatcaaagatccagcactgataaagctatcgaactcgataagtgtgcccagccaattgatagactttctggctactgaatcccctcatgcagtgtttactttgtaccattgtgctctttcatttaatgaatgtgccaacgacgaatctgtacaattacgattcttggaactattcaaatacatcagcaagaaacacccttaccttaaatggatgatatacccccagattattcaaagaattcgccatataaatgcccactctttgtttttacggcttttggagtcttcaatggaactatcctcgcaagcggcaagagaaactgaatatggaaacattgagaaacataataaagaattgtttgatatgataaaagaacatggactttttggcataactttgggcattgaacaaagaggatgtttctctttggacccttcaaccaatgataagattggaatgtatttgcgaattatcttggaccgcatcatctgctccagttctgattaacctatttaagattgataatgaatgattaagagatttagtttgttctatgagctagaacgttaatgatagatagttacttataatatacaaacactttacaagtgatattcttttttttagtcattatgtgatcaaaaaattaatcttactgacaatttccctacattgtttcgagtttaaagcttcaaggtcgtatcttttaaacttggaattcttctggataataattttgaaattgttggggtattttcggctctgtttgcacttgatgatccggctaataaggaaactagtagtcttcccatccgatataccgcctttgtcgtcactaaatggaagaatgtatatgaagtcaccgtctataaccaaagatcgttcatgtcttgatatgaacataggctgcttctttctatacacagtccacttttgaaaattttcggttgcccacaggggtgatccagcaccactaattggcaatattgtactcctctttggcttgggtcccattctgaaagaggaagcaatgttagatttgtgcaaactcaacgagccaaagtgagaaaatgggttctgcttagaagtatgaagtaaagctggtttttttgctttggaagcaactttcttggtgacagggggttttcgttcctttccttcataagcgctaaggtccgtgatttcctttggtacattctgatcatgcaagaggttgtgatttggtaaagagaatggcgctaattccactgagtcttgtgaaccatgagaaatattacccatacctccacgtatcttggttttatttaaaactaagtcatcaatatcttcaccaagaaaaaaggacgattctttgggaggaggtaccgcatcggttgtaggagccccttctgttgaaacggggtcaaacacaaatgccatcggtgttattcgttcgttctcttggaatcccttttcatcgactttggctaaagttacttcatctaactcataggaagagactttacgtgttcgatccaatgtaaagctcggtatatcaggatcatgtaatctccaatagttgggattttcatcactttggcttttcagttcctgcaacttgcttaatgtgagcaaaatgtatccaattgtatctactactgtgaaggccggatttatacgcaactccaatggagagtcacaatatcgactggacgaaggaacgtatacctctagattaaccatatgatcacccgttccaacaaacttgtaattctccaaaggtgattccttcatcattaatgtaagtctggaggtcaaaattggtttgtgatatttttctctagtttttcgagtcaaggcagactcttccaaacctatcgaggaatcagagcgattagcgttgagtaaattgttgaatgatttggaagttttcaattgttcagaaaccgttgtaagaccagtattgaaggaagaagcaccgataagacttcccagagtttttgaacggctcctgttatgggtgtatcttgatttgaagctgtcattgctgttcctcctcttagcaaagctcaagttttttgttcctgctgtggtttctgacgtcaacggaacagatctcagttcaggatcaatagaggagggaaaatcggagtactcttcatcgaatgaatcttcatcatcagatgaaaaaaagtcaacactggagtcaatctcaagatcactattattggtttctattcctttatctgtttctgtgtttattttgtcaggaatctcatcagaagaggtattattctgagacgtagactcacttttcagcgtccctatcgatccgtttggttccttggtgatagtggaaggagaatcagcttcattatgtggagaagtttctggactgaattctgaatgattcacttctattggaggagaaactgaaaggtcattcccattgccgttatcactaagaagtggttgaaggaccgagtcgtagccggaggtttgaaccgatgagattgctagtatactgcgccgcatgtaaaaaacagcatccctatgactcaatggaaaggccattttcgaaaaggccgatggacttgacttatcaattcaacgaagacccagaagagaaagcaaaatggagtaagttgaatcgactttaagataattcacataatatgatgatagaccgcgaacacagataactttatacttgcataccacacaccagagagaacacacctttacaccacactgcagaccaatgaaaaacatcaatggacaaactgttcaagtccttctctacctttatcgacaacatcaaatatgggagccgcatacaccatcctaggtaaaacattccagccacaccaggtaagtgattagaacgaagaagattctgtcattaggtcgaactagcaagtactaacttttattttcagctcgctttggctactattggattagttacacttttggcaattcctaaaccaggtggagccaagaaggagacaacccctcagattaatgcttcttctcccgaggaagaggctttcatcaaagaatatttggctaagcacgatcagaagcacgactagaatatactgaataatacaacaaaatagagaaggaaagagatctccttttttctgccattttctctttatatatatttcaattttcctatttgaagattacaggtgactctttacaatcaaccatttttgaacaggacctcattatccaacggatcagcctccaagacctggtctctgatcttgatttttctatctagtgtggctttagatctgttggcggcagcttcagcttccaattgtttctgttgagctctaacaacgttaggcgaaacatattctttgttctcgtagatcttaggacctccaaatgatccttcaagtactgtaatcaatgtgagcacaactcttggtccaatctccaccaaggtgagatctttaagtatagaatcgtcgatagtagctgcctcttcattttctttcaattcctcggtctcagcgatctggaagtttctgatccaaaccttcccatcgacaatgctgaaactcataacgtggtcaataaacggttttgatttacgagctaaaggaggaactccgaacacgtgaatgaacagctctttcatcagctgaaattgagcctctccatcatcaaatgccttatcaaaggaaagtattggtctagaacctttcaaacagttaccggtaaagttgagttcatctaaggtgtgcatgttttgtacatggaattttaaacttggtccattaggaggtttggatatccacagatacaaatcttggtgttttttggcttcaaaatacatcacattattacagttgtacagctcagcaatttcgttgagctcatatagtctctttttgtgatctaacttgggctctttctttgcatgtggaagtaaactgaacaagtcttgcaccaaatgtctatgtctgtaagtgacgcccctagaggtcatcagcagaactctttgtctgttaactctctttgctgtgtgcttagattctgaacgtttatttagagctttgtaaatggctgacatgagttatggagggaacaaagagtctgatagaaaaaaaaaatttcttgctgaaaaataagtttccctttcgctaaagaaaaataagaaggaacttccagggaatcaacatcgtcccaatgaagaggtattatacaggaaagaaggtagatgatattgacagtgatagcagtgaagaagggacggatagtgacttgcaggaagaaccacctttaacggttgaagggtccttaagggaggttccaaaagataatatcttgtcactgcatagtgaccttgatgagagaacccaagaacgaaacacagataagaaaacgatcaactccacagagcacaagaatgatgacgttttgaaaatggagtcaaaccatgattatgagtcggtgcaaaagactgaagaccaaacccctccgtcgtccaatgcggagtacctgacttccactgctaaggaaacaactttaaaagttaatgatttctccgaacaagttcctaatgcttcactggttgagtcatcggaagaatccttggacgaatctgtcgaagaatcatcagaagattcttcggattccagttccacgggccaagtgctgaagccagtctttgtaaaaagatcgaaaaatgtcaagcccgattctgaacttgatcctgacaaggagaagaacataatcttgaacaatcttcaacactatgctgacaaagccagggagaccagaataatccctacccaaaaagactacctcataattgatgacacagacgacatagacccggaaaaggaaaagcttgactggaagatacgggaacttcacagactcaagcgagatagagatattctagtggccaaagaccaggaatatgaagagatgcaagcccgaagatctctccaagatttgacctagattatgtatacaaatatatttcctaaagtgcccgacatctggcatctccgcggctacttatcttagtgggattatctaggatctgcaactttctcatccaatttcccagctttcctaattttcagttccttcatgaccagtgtttcgtataccctggacacgtcggaggttacaggtcacaagctgggggtcaattctttggcgttctctggtgacaggctattttctgctggaagagatgggatggtcgcctcatggtcgataaataagtctgtgtcaaatgatgcacaaggggatgacaaatatgacgagtttgacaccaactataagactcatcctcagatagacaattatatcgctaaaaatgtggacaatgaaacagaattgtcaaaattagagcgcagcattgctaggggtctaaatttcaggcaaagttcttttaatggttttgaactggataaatattctatgcttcattcagactggatcaatgatattagtgttttagatgatagcaccattgctagttgctcttctgatttatcggtgaaattgtggaaccacaaaacttctcaagtggacactttgggccaccacagtgactacgttaagtgtcttgatttcaacgaagaaaataactttttggtttcaggtggcttggataggcaattaaaactttgggatgtcgatcatagaaaggaatcaagtcattataccggaaagtctgataggtcatccatttattcagtagcaacgagtaaccatatgatatgtgcgggaggccccgagaatgctattcaaatgtatgatcacagaattgccacgcctgttttatcccttatgggccatagaagtactgtgagatgtttgaaaatttccccttcatatattctctctggttcttccgatacgtcagtgaaattatggtgtctgagaacaaatcgaatattaaggacattagatatgcacctggcgccagtttggtctttgcatgctccagacccagactttggggtcttttactcgggtgataaatcgggacttttattcaagactgatttgcgttcctgtaattatgacgactacttagacgagagcaacaatgataacttcatacttcaaaacaaaattaacgaaaacttgggtgttgccacgttaatagctgatctgtcaaaatcatccaaaagtgaaaacagtgtcctttccattgtttcaaatggatctaatgttttcacttccacaaccactatccagaatagtacagagaaaagtttgaaaaatacctgtattcaagcttggaaaatacccataacgaataagattattattcaccaagctatcagattaaggaagaatattcttttactgaacagtttccgaccaggaaacttggaggacggtgatgagtcaagagatgtctacgatttggtgtctatgctatctcatgaaacatctaactatgatctagctcagatagatgacgctctttcaatttcccatatttctcctgaagcgactcctattgaagatgtgattggcctcaaaagtaccccttttgcttctttccaaggcggctcttctggcgagtttgcttatgctgacattaacactggccagttgactattaacatcgatccaattgatcccgatcaatttgaacttttaccaatgaacgacaagccatcattttcctgttctggaaatccgggacttatcagataccaacttttgaacaatagacgccaagtggctaccatggacgatagtctcaatacccagctctgggatttattgaattttaaaaaagtagatgaatgcatgttgtatgataccaaagatgtcgagcttgaaggcagcgatgaggaaagttacagatttgagtcgtacgctgagaagtttcaaacaaatgaaactttaccaatttggtgcaaagttcaagtcagagctggtaagctctttataaccttagaagagaatactctcacgaatactgaaatctacatggatgatttattcgaactatatccggagttggggaagtactactcaactcaccataactcggaatctcacgattacacagctttaaggttcaacattggaaagttagtactgactagtttatttcagaactttgttgatctagagattgttaaacaaaaaacaggttcagtttcaacttcatcctctggaatttcgaaaaaaactgaagatccttctgattcaacgtccaaaaagtttagattgtttggacgcacaaagagttctaataataccggtgccagctcaattatctccactgaagatttggtagaatcgatatttgatccgaaccagccatttaagttcaataattttgaggttcctcgcatcagctcaaccaagaatgttcagctcatcgtcaaccaacaattccaagatctaagaaatgtcactattgaagtctatgagacaaatttatctattttaaagacactggatcaaggttccattgatcaagttttgaaggacttagaaacgcatctgcctaaatggatcataaatgcattattctacaacaaatacatggagaagcccctgaataaggtaaactttgtgcttttagacggcactccaaaggactctcctcacaagcttccaccactcgagaataatagcctcaaactatcagcctacaatatgctacggatgaggaaagtgctttgctatattgtcgaaaagttttccgagaagccgcccgaagcctcaatttatccagatccaagtagttggttgactgttcattgtcagggacagaaactcgacttgaatatgacgcttgccacggtgaaggcccgtatctggaaaaacagtggagatattgagctcaattacactaggactgtcccaccatcgggtggagattaggtagactgttctctttcaccttctggttaaggttgtaggtcgcgcgcgaacaaaaattttttttcaacatctatctgtactaatctctaatttatccaactccacgactcacaacacaacaatcatggaagacaacaaccgaatcatttctagattgtggagatcatttcgtacagtcaaggaaatggccgctgacagaggctattttatttcacaagaagaaatggatcaaagcttggaggaatttcgatcaaagatttgtgactccatgggaaatcctcaaagaaaactaatgtcgttcttggctaacccaacaccagaagctttagagaagtactctgatcttggaacattgtgggtggagttttgcgacgaacctagtgtgggaatcaagaccatgagaaacttttgcctcagaatacaggagaaaaactttagcactggaattttcatttaccagaacaatattacacctagcgccaacaaaatgatccctaccgtttcacctgccatcattgaaacatttcaagaaagtgatcttgttgttaacattacacaccatgaattggtgcccaaacacattcgattaagcgatggtgaaaaatcacagctactgcagagatacaagttgaaagagagccagttgccgcgtatccaaagagaggacccggtagcacgatatctcggtttgaagaggggacaagtggtgaagatcattagaaggtctgagaccagtggtcggtatgccagttatagaatctgtttgtagtttttaaaattatatcgtcattaactcattattccaaactggctgccactacagcatcttgtattccgtgccaccagcgaacattgcctagcttaacgctacgggctggtgtgacttcgaccccatccttacccaagtatactggacctactgtgatgataagggaggcaaccaggggaacgctgttctgcctacaaatgagcaaatcgttaatgattgtggcacctccttctaccatgacgctatgaatttcagcatctttcaggattttcaatatggcaaaccaagacatttttcctcggtggacatctctatcagcaatctccacgatagaaataccataatccgaccttaaatttgcctgtaaatctggagataccacccctttgcgagtaataaataccggaggttcaccttctcctgagaggcctagcttaatgagctttaatgatgctatcttagaaagtaactggaaagttggatcgagtatgatcggacggataggagttcccagcttacaattgagccctggatcgtctgccaaaaccgttttcaccccaacgagaatggcgtcatgtttagatctaagatactgggtcatattttttgtctcctgatgagatataaccgttcgttctccctttttggccgctattcttgagtcaagcgattgagcataagtaagggtcacaaagggtagttctggaagcaatgtgttttcatgggggatgaatggttcaagaaagggcacaaatgacattgaagtcgtcaaattggtttaaggagaataaactgagggttcggtcgtgataaattggaaccgatttcgcaaattatgtgataaaacctggagaaataaatcgctaagtgctttgaattctcctatctccatccaacatccttaagcaagatatgaaggtattgaccccagaggaaagggatatagcccaagtaagtcattgctcgtgcattcaagaacagtttactaacatcttaagcatctaaaagctagtctttggacggcggtgtgtagaatggtggatgaacaactaaaggagttgggatctgtcagcgtgaccccgagtttttctgctgcattagtggaactggtgtacaaccaagtattgtctctgggccaagatctggagtcattttcaaggcatgctaaaaggaaagtaataatgccggaggatttgtacatggttacgaggcgaaatgacatgctgactgcacttttgaaggaacatcttttgggatttgaggagggatctgcagcaaatggaaacaaagaaaaatctgcagaaggaaatgatttattggagaatgatacagcggagaaactaaatgaacaggaggttgacgatgaagaagaggaggaggtagaggaggaggaagaagaaattgattttgacgaaatattaaatgatgctaacgcagataatcgagtaacagaaacaataccaccaaattctgccaataaacggcagaggcttaagaaagatccgaaatcaaaagtcaaagtcaagaccgaaattaaagaagagaataacccagatcgagccagattatttacgaatgactcttttgatgatattgacgatgaagaactagttaacctcacgtgagagattagagataataaataatacactgggttcaggttataggttaaacggtatatatttctctaacttcctaccgcgtctttctaagcttccacagcttccacctacctaaacccaccaaatcttgactcccaggaaaaagtcgcgaacagttcaatattttccacattactacagtacttctctcattgacaaaatttttaccgatgtcaagaacattcgccagcattagacggtttagcaccgtgatgcggctgcttcagcagaggccgacttctgcagttcaaaggcaaggtagaaaccaaaatcccaatactatacctgaactggaagttaagcggattattccagctctaccaactttctactcatccaatcccctccatgaccaaaatgtccaggaactcacaaaagccctacgcaaacatgtttcctttccctatgatcttagtagaaatgctactgtgaagtggtttaattttgaacagtataaacaaatagctggtggatccaggctgaaggttatccaacatcaagaactcctcaagcttttaaacagattaagtgctattgatcctcagttacaaaatgatgatttagtggctttattaaacaagttcaaagttgcagaatctgctcagaactcacgtttagaggtccctcaattggacgctaatggaagggctattgcagttggacggagaaaggcttcctctgccaaagtctatttggttcgtggagaagggcatgtaatgatcaacaactcttctctagtgagctatcttcctcgatcatccgacagactcaaagtaacgtacccgctaaaagtcacagactctgaagggaaatacaatgttttcgttaaggtgagaggtggagggctctctggacaagcaggagccatttctttgggtatttccagagcgctggtaattcacaatccattattgaagagtcgtttgtataaagctggttgtatgactcgtgaccatcgtgtggtggagagaaagaagccaggtaaggtcaaggccaggaaatctcctacctgggttaaacgttagtgtaaatagcataggaagaataaattacattttatcaccaagtttattaaattatgagtcccttggggagatgcgaacaaatggtactgatccattttctgcgtccgcgattcggaactcttcatgttcaatgtctgttcaaaggacgttaaccagatatgcccatagaagtagccggttgaagaacattccccccttagaggagtttctttttagaaacactgtgaaagagtttcaacggcgagttcttcgaaccatttatcgtaggtaatttcatcgtttcactttttcaggctctaactaacatgaattcagaaatcccatcagcacagactcgtaaagatttaaagaagcatcttcgggaagaattcgaagcagtgtctactgtaaaagatattcagcatagaaagtatctgttaagcatgggagagaggcagtattcagatgttgtaaaagcgatgggactttcaaggtgagtgtgggaagataaattgtaaagccatctcaaaaggtgaattgcaagtctccaatcattctatcaaatcaatattgtccatagatttatgacgacagtcttttttatcaatttaaacgtcctagttaagaatctcctattccatcagattctgggcgcatcttaacattgtctgattagagtaaaaacagctgctagacaactaccatgttctctttgatgatttgcctccgactctgtatagggtagtagagtgaaggtacagacagtattaccgaaacctgaatacttcgtattatgtacaactggaggggctatgaacttgtaacgaaatcgatccagactcgccagatggctccggcttggtaaatattctaggcaaaattaaacgcttagtaaaatgcccatagccactttaatacattttgaacagggactaaatccagacatggggctcaaaacagctgatcccatacctacacccgcgtttttcagaacatatatatatatcttatctatatcccctaccctactcggcaaagaaaccagaatgttcctaattttactcagttcggcattgacctatgtcatatgctggtttggatacacatttttgttacacagctacagggacgtcgatccactggttttgtaccatcagtcaagtgttgcaaacactagaaaagaaggcgaaactgcagtctatagatcagttgatactccacatggcattgacctcgtgactggcctccgtatcagctggaaatataaactcagggatggaaatctgaaagatatctggaaacttggtattaaccacaattcaaagatcacatttgggcaggaggagtactcaatggatagcttgacgaaaactatgcaagcactgagtaattacatcgagtccagtcaattctcctgtattggtgtcgacttatcccaatacgaatggtttatcattatattgaccggattgtgctctttaagagattttactctccattttcatgaagatctgattgaaacatatacttcaactgagcccaaagtaatcttcacttctttcgcttacttggatcgtgtgctgaaatcagattttgacacaattgtcttagttgactccccaccttgcccattagtcattgattctcgtgtggctactttttcttcgttgaatttaataaacgaaaatgccgaagaatacgaatacacttttgacctcaaagatgataccagaaacttacttgttcaacattcacagggagacgcattcacatacaaccaaagatgctttgtctcttcaatttcagctttgctccaatcgttgcccactgaacatgaatggtcaacaaaggacaggttgcttacaacgtttacaaacgatatcacattcaatttaaactctttggtcaagatctttggtgcgctggttacaggtattaacgtcagaattttgccgccacagaagctgatttctgagctggataactccaccatcttaaatattccagataatctattgtatcaactgatgccaaagagaaattcttttttggtatctagatcaaggtggcttttttcaaaaggtgtcttcaacaaaattgcagagctaccatcgtttagacctctgagactaatttacacttcgatcttggaaccaccgagtgtttcttctccgttttcgtcttcctacaactacgttcaggccattactggggctcgcattataaatgaaaggttatatgagcatatagttggccctattgtcaaaactaacctatttgattatcgaattaccggtggatttgttgaccgaaaacacacttttcccagaaagcttggagtttctgctaataatggtgagttaattctcagagattaccaggattattcagctgatcaaaaagaaggaaagctatccgtaaggggcttcaatgttggaatcaaggatattgacgagttcagaaaggatgactactggacccacactgatattgtgggtaagtttggtggtgatggtgttttatacgaagacatagctactcactgatatgattatttccctttatccaccttttggatatttcgtcttttaatctattaccgtttccccagactcccacggaccaaaaatgcattttcttaaatactggcgcgtccttgaaactttgactgaatctggaaacgaaaggaaagatcggaccatgagctttcctatcggagtaatcagggggaatacgatggaccaacatctggttggaaacatctctatcagaatgcaattctccaggctttgtgaatttggatggatcgtgaatgttaggattttctatcaaatggtcccccagttcactttctgtctctgcagcactcttttgcagttgctcaagtagtgacatattgtttggcttgctttctgattctatgaccacatcttcaagtttttcccagggtcgcatcgaggcatcgatgggcagccaatctcgagactccctccacatctccgaaccagtcatttctctaagcctactgacggctctcttgtatgcaaacatttcgtcctccccagtgaatcttttcatattttgaaagtcgttatcaattttgcacatgggcctatctatcgtactgtgttgtgcggattcgaaatctctggcacctacaccagtatcataagaagaaacatttggtctgtaagggtttgataggtacatttgcgttcttgaaaacatttcctcattttgcacctgtagactattactaccttctagggagttttctgaagtctttaggtctgggaagaacaaatcgtctgggccagcctcagatcgaataatcagctggcacctagcttcataaattgcgtctaaaaaggtaatgaatcttcgtgcgtcgttccgcatcctaattgttaaaatgggaacgttgtcaacgatgaaagtatgataattagaagccaatgaaatatagtctcctggaccaaacaacgcctgacacaaatctgagaaattaaatttggcaattcctctaacatgccatgggatgggcaactttctaccatagacagtaagagtggcagggttccccatctcatagtttgtagccttagcaatcaacttagcccattgagactcctcgggatcgtcttttttaataaccaggtgcgacactatttgccctttggcttcgtttgaaagtatctgtctataatcttgtttgcttctcatatcataagtctcgcatcggagcttcaaaacagcttcaaaggacttaaactgggtcttattaaaagccgtggaatacaattgttctggaagtcgattagaagtagcaacaagaacaccaccaagcttgaaaaaataagtgaagagtatcttgacaatctttgctgatgccagatctggaagcatgaactcatctagcatcaaaatggtgtttttttcaatcattttagaggcaacctctaaaagaataaactcattttctagtgacaaacatgaatggttgtcctggttatctagctttctcctttcgtatattacatgaatttcattataaacccaaagaatgaagttgttgtaatgccatcgacacttactgctatggggtaaactatgagcgaacatatccatcaacatgctcttaccacagccaacttcaccatttaccagcaaccccatgggagaaggaaagttggccagttcttcctcatccgttagaaccttgataagatcctttttttcgttatcttttattttctcaaaccactttggacgataggagtatcgtaaacctaacacgtttttcttgcgatcagcgagttctatttgcctaatgtaagagtttatcttcacttgggtgtcgccatgaggcttgtagtctttcactcttttatagagcttttggaactggattgcggccctaagttgagcttcatcttggcgcaaaagacccctactgacatagttctggtaaatatgaaggggatctgttagtgtgggacacaagccatggtctacatgaacagaatgccatcgtctaatgaggagcctgaccatttgatgaaaaagataacggtgaggtgtaaggaagtgaaagagtatctgtcaagaaaggggcatcgcggaaagctgcgaatacgcgtctattcggttatgggcagaaacagatccgatccgattccatgattaatgtttgaaggtacttgagggagcacatacagtagcaatgggattccgttgcattgatagtggactccaagttacataaggctgtacctagtttggtctgttctagtccgaacattagtaaaatcactataattgtctacggaaactgccaaattcatgccaaacccttcagtacccgtttacgttgctctagcactcgatagagccttttgtagccgctcaaatatgcagttagctccacattcttatttttccaaaataaattctttgtttcaaaatccatgtcgtctggggattcaacatgacaagattcgccgtcactagaagtagagctcatgctctcctttccaagaagataactgatgttgagaggatgaacatcatctgagtcatctagctgcttcgtctggatatctgacatgaaagatgccaactttcgttgatcatgtggaatctttgagtacttgaaagacacaattttcttcaatctagattgcttcttcttcgaaggtttagatttgtaatagaatttcactagcatcatcactggaaccgaactggagggacaaaatcaacgcagcgttcacccctgatgtgttgggtgggcctggtaatgttcactcctaggaactactagaaaaactgtgctaaacggattacgtaattattatacaaattctctatggtctatggtacatatgggctggttcaataatgaatctatgaagaatttgtgcccatggggaccgtttctataaacgttctcttctttatgttttccacctgctctttgagttccggaaattcgttgacaatcttttgtcccaatgtcgattgggcgtatttaaagcccagctgttttcctctgagaaattgattcaacttcctcaccacctccacaaactcacgcgtgtatatatcagggtttctaccgtcttcgatataattgactacgtccacggggatgggaatgttcaaatctgtgttgtggagcttttgcaagtgctctacaaccttgttaatgttgttggaaagacccaattgactttccgctgtaccggcgtaatcgtgcacctgaacacccaaatggatgagggtttcgatgagttgacttagttcattttcaacttgatctaatgttgtcgcaggtgcactcatacttgtcatggagaatgaaagtaagttgatagagagcagacttcgaggatgggatgaacttgattaggtaatctttgacaatgtcttagaggtaggcagaggatgctggaaaaaaaaaattgaaaacgcccaagcttccagctttgcaaggaaagaagaaaagggagttgccagcacgaaatcggcttcctccgaaaggttcacaattgcagaattgtcaccattcaaatgcctttacccttcatctgtggtacctcaggctaagaacgggtcacgtgatatttcgacactcatcgccacaatatgtactagcaagaacttttcagatttagtaatccgttcgaaacgggaaaaatgttttacccttctatcaactgctaatctttctaggtttatactgccagcagcccgttccagataccaacatgccattcactataggccagtcaaaaaccagtttgaacctctccaaggtccaagtggaccaccttaacctttctcttcagaatctcagtccagaagaaatcatacaatggtctatcattaccttcccacacctgtatcaaactacggcattcggattgactgggttgtgtataactgacatggttcacaaaataacagccaaaagaggcaaaaagcatgctattgacttgattttcatagacaccttacatcattttccacagactttagatctcgttgaacgagtcaaagataaataccactgcaatgttcatgtcttcaaaccacagaatgccactactgagctcgagtttggggcgcaatatggcgaaaacttatgggaaacagatgataacaagtatgactacctcgtaaaagttgaaccctcacaacgtgcctaccatgcattagacgtctgcgccgtcttcacaggaagaagacggtctcaaggtggtaaaaggggagaattgcccgtgattgaaattgatgaaatttctcaggtggtcaagattaatccgttagcatcctgggggtttgaacaagttcaaaactatatccaagctaatagcgttccatacaacgaattgctggatttgggatacaagtcagttggagattaccattccacacaacccactaaaaatggtgaagatgaaagagcaggcaggtggagaggtaaacaaaagagtgagtgtggtatccacgaagcttctagatttgcacaatatttgaaagctcagcaaaacatatgaatataattttttttttctctacactatttatcctgtaagtttctgtttccccatgtaggatctttttctccttctctgtctcccattttttttgttccctgtagtcttgccttgcctgagatgcgagctcgtccgcccatccagtcgtgtgaagggcctagcttttcaaaaagaaaatacctcccgctaaaggaggcgttgccccttctatcagtagtgtcgtaaccaattttcacaaacaataaaaaaaggacaccaacaacgaaatcaactatttacacacatccagatccgtccccctccccatccaagagttaaagacaaatatggctgttaataatccgtctgaatttagaaagaagttggtcgtagtaggagatggtgcttgcggtaaaacttgtctattgatggtgtttgccgagggcgagttccctccatcttatgttccaactgtttttgagaactatgccaccccagtagaggttgacaacagaatagtacaactcactctatgggatactgccggacaggaagattatgatagactgagacctctttcctatcccgatgccaatgtggtcttgatttgttttgctattgacattcctgacaccttagataacgttcaagagaagtggattagtgaggtgttgcatttctgtcctggagtccctatcattttagttggttgtaaacttgacttgagaaacgatccagaggttatccgtgaattacaagctgttggaaagcaaccagtctccaccagtgagggtcaggccgttgccgacaagattggtgctctgaaatacctagagtgttccgccaagaccggtgagggtgtcagagctgtttttgaaaacgctacaagagcaacactcatggctaaggaaagaaagcaacgtaagaagaagtgtaacattgtttaaatctatatcgttgttgttttttattatataattttaggcataggtgaaggtcgattgagtccgtttaacgcgtgactgattggtagtaagtatactgtatcaaagagatctattatttgttaggtccaggcagacttggctagacattctgaacgcgtagtttatggtgctcaaacaaaaagtctttctggattggcagcacattatggattattagaattggtagtagctatctaataaaaagatagcgtaccacctctttgattttacgaattgttgatttgcctaacagggtattattcatattcagcacagaaatctttcagagatcttattctggcagattcgagatctgttattgtaaccaaagtatatagtaaacatgaacatcctggaaaccaggcgtatgtattacacacaaattcaacagtagcctgtgacaggctactgtccttgactgttgtctaaatcctaagcattctctcgtgtgaatgaaaatgtaattgccttccacatttgcaatacacttcacaatacatcgctgataaccgtccaattgaatctcttctgtaacacttcagatccagctgcctagcatttccaccatttcttattgaaacccaaaatctttggtctcattgactccgcgtcatctcggtatgttctagtcgaactatttccaacatcttctcttgaaacaaataaagcgcgttcgaaacatgcaggatcaccataaagtttcatactgctaccaccatgaaactagtgcaataaatcattagattggatcggaaggagctgtcgtatgcaattgaacagacaaaacctaggattcatgcaccctctaacgtgcctgtatacttatataccacactgtcgctccactcttgatccagctaaggcaccaaatggaatctatactactactgccaaatgagaggatactcaagattatacctatagaatcatgctatttggcaccgtttacgaccaaagaatgctacggtcttgttggaacggcagataaccgcggactatccatcctgctggagttctaccattacaactcaaccaattataccaatgttaccgtatatgtcacttctagcagactggtggttgtaccccacaatcagttcagagtattgaataggcaacgactaagcaagtatgcgttcagtataccttatttcagcctcagttcgttcaacttgtcagaaaatagatcctgtggcaggatcaactttcgtgctccagcttctgtcacatcaatatcaatctccttggaattcacagacaagaacaaaaacgcgttgacttccttgacttctttagtctcttctttgatctttgctcaaggagtctcgcaatgcctagaagacaaaaaaaccgataaaattgacgtctcttggatcaatagaattgatatgggggaaggtcttttcttcatagaaggttccaccatccccattcaaacattttcaaatcagccaaacaaacaggaagaggaaattcttcctacatatgaacattctgaaatggccactggtcgttttttacaagcacagaaacttctgaaccgagttcgaatatccctgaaatcaagaacagatgatgcttacccagaggaagaagactgcattacacttaaagaattcgtttcccaagacgaccattatgatcatagagaggcttccatatcaattaaagaaatcagggacttaacccaagtgaccggtacgtggctggccaaagttctaattactaactgtgttcgattcatacaacgaaatctgcccaagatatcactcttaagagaaataatgaacgatataccaccgacataccaaagtctagctgaagagttctttttcaggtgccaaaatgaactgtatgacacagctgacccagcagatatcgaagaggagccagaacttgtcatccctgtgcgacacaatgctatgattgtagctgaaacgattgcatcggaacagaacacccccaagcttcgaagatccaaatcaaaaagattcatgacaggaatgaagaaattagttaattcgcactcatgtcaaccaaacatcccaaatattcctaggggaaatcgtcacacattgtatacacctagccactctgccgcctcaccaaacagctctctcgatagaagcaaaagtgtcactttaggagccagtagagctaggctcttgcaacaattctgattgcgatctaatgagcatgagccatgttgaaacttggcactgaaacgagactttcactgtctgaaattgcttcctgagcatccataatcttcacctcactgaatagattgatacaatgttttatagcttcaatagtcgcaggcttttcaataacatagtcaaaaacaccgctggagcttgcctccttgaaataggccgtaacacaaactatcggagtatcagaattcacacttgctgtgttctttatgagcttcactaaatccgccgaatccaaattagggagcttgaaggtggtaaagatgaagtcaaatttgacacccgcagatgctcttctgatcagttctgcaggatctttaatactaacaacatttacaccgatctttttcaacaagacttccatgttatacctgtggataggaataggttccaaaagtaagatatcatatcggaaaacccagggcttgtttctagtagaagatgatgaagttcgaaactttcttgagttccttcttttcttcagtctcaataacgcagcattcttggtatcatcggtatcggaactggttgccgataaatcacttgatcttctagtgctgttattattgttgtagttgaaaagcattttggatgcactggagaaagaatcaaatcgcccgtgtcctgggtgaccgttggagtccgttggcgatgattgtactggagttttcgaatctgccttcaatgctttatgaatgggagatccatggtcagttgatcgagatccggagcttcgatggaggcgagcatgcgttgtcaaaagattggggcccactggagagttcgtgtcctctttggtgatcgcacttgaagcaacctcttcacctgaagagtaaccagtgttagacacagctccgaatttcggattcaaaattgccccactgtttagagagctagctctcttaattggagagtttaacacattcgatggagaagaatccgcacgtctaatagtaccactgctatttgaaaattgtcttcccttctgtatcgttggagatcctggctcacttgaaaagctgcctctattctccaaatgctcatttttcaaccgtttaatgacgtccttgttagctttctccaacgcagaaatgttacggaaactaaaaagaccaaattctccatttgagccttcagcaagacggctacctcggcgctctttacctttgaggggaactcccaattggctgttacttccgggagaaccagaaccagaacttggtgtaatataagcagaagttttcaaagaaggagagcttgcttgtgtttgtggaatattgtcagtttctttgtttgattcatgtgcactttctgaatcgctggggaaaatcatcatctctgcccctcttgagtcaaaataatcggtgtcctcaacgttttcaacaagtggaacaaaagaggcctcttcagtaaatagagtttcccagtgaatttctttaaaatatgggtgactctttatctccacagctccatttattccgagtcttttacttggatctttttgaagcaaattcgttattaaatctttagctgtgttggaacaaagttcttgaaataattgatcaggtatctcgggccactgaatctctccatgaagaatattatcaaaaactaattctggcgttttagcatggaaaggtgggtacccaaagagaaactcaaataggatacatccaattgaccaccaatccgatgcttcatcctgtgttacaccttggatagtttctggtgcaagataatctggagtaccaacaaacttccgagtttgggttgaagttttaggatcaaataaagccaaattcatacttggaaaaggtgagttcattcttgaggggaccatgtcttcatcatgaattataaaagaagtttgagaattagagcggtttactaatggcttgaccaagggagagttaagtgagcttgaagttgaagaagttctggcggcttgcttatcacttttaagaacagactctaacgcatagtaggatgaaggtgaatgcgttacaacgttgtcggaatcatgagtgccaaatggtcctacaccaggtgatagtgatagttggggaatggaaccagccctactccttcttctcgcattgatggatggctgagactggaacacttccatttctggagggcctaaaaacccggttgagttttctctggccctagaatgtcttccaaccaaccccatcctacttaacccaaaatctgttaacttcaaatgtccttcatgatcaatcaaaaaattgtcaggtttcaaatctctatggacaatccctttattatgaagatcttccacacatacaataacctctgcaatatatcgcttggcccacatgtcaggaagctgtcccatattcttgagaagagttgcacagtctccaccatttaagtactccataacaagatatagatagtccctactctgaaaactagagtacaattgcacaacgtgcggagactctgattgaagcatcattatagctctttcggatttgacattggtaacttgattctttgctatcatatctgattttttaagaactttaatggcaaaatattctccagtaatcttccttttggtgagatatactgaaccaaaagctccgcgactaattggtttaattatctcgtagtctcttattgaaggacccatagcttgcttgggaatgttagatgataacagtaatggagacaacggcggcgctattcggttaatagagcttctggtagaatctttctcgacatcacttacaggggggatatcgatagtattcatctttggagagctttgaggtgtacttgctctggatgagtcagatagtctgacaattctggacattgtattcttttgtattgagctcattggcgatcccgaaaagtaattaggtgctggcgaaagctgtcgtctaggagagttaagattgttcttggttaaagaccttgaagatctcgagcctgctttctgcagcagagtctgagaggcttggccttttggaggtgcattttgagaacttgccgtttgtatgacttcaattccatcgttgctagacatatttgaagaaatgctgatcaccggtgtcgaagtttcagaaagctctttaggcgtcaaagatcttgaagtctcttttcctaactcggtgatagctggagatttgcttagagcattcgatggtatggagtcatttgtcaagtacgtttgattgaacagatctacatgtgacgaagtattcctggtctgaggctgaggtgaatggattgtgctcactgcgtcttcatattcggtaacgttttcaaactcaagggagcggtcttgttcgctctcgttgaacttgtatatttggccaaatgtattaggtttcatgggagttggatcaattacacgatcatccaaatcatcgctggaagacgtgatgttataatcatcacgttcaatttgatcccttattttctcaatggtatgtttcactgcatcaagtatcaaatcatccatttccctagtcactttttcaacatattgattcacatagctcagtctcatgatggcatccagtttctctttgcaaattgcctcagtatcctcagttaatagttttatagctttgtcagtcgattctggcagctttcgttccgataagcttttaatagcagcttctgaattgggagaatatgccactatgtaatctccattatgtagttcaactgttccgtagttcacacgaatggcatcatcgcacatatcctgtaatgcaaataaattcttaaatggaaaccgattcaggttcatcactgccggggtcatctttgtgattagctgtctagcaactgatgcatgtttttgtttaggatgggttactgtgggcagcggaaagcctctgtaggaagcaatactactggaagatgaactggaagaagcgctggagggataatcatcgctgtttgtaaatttagagggtaaagaaataccgtcgctgttggataacgtaagaagcatttgttttattagctttttttggtcaacaacagcatcatgcttaagttctacgatggtttctgttttgtgctgtgtaacacaaaattcactgtgcctttccatccaccaagacggaacctgagtttcgcatattcgacaaagctcatgtgttggaggaggtatattatcctcgtcaacaattccagcttccgttagttgatacaaataactctcaaaaatattgataccaaaacctaggccttcgaccagttgctgcggtaattccaatgacaaatcgtcaatttgtttggagggctttagcatccaaatagagtgtgtaggggtgtgcgttgtgttattatgaatcaagatcccctgtccctccagttgaatgaagccgccgtcggtggataaatctgaacatatgttgctgtttcgttctagggattttggagaagaatgtatgtctggcgcttgttcttcttcttctccttctgattctgaaggctcgtgctttaaagtattagtgggggtcgtgaacttaactctataactgttatcgtcgacaatcatgatgtctgtagccttttgtagtacagctttatcgtcttcactgccaacaatgatctcagatatgggtgtgccaattagcttctctatcgaagttccaacaatagattcccaggacttgctgatgtactttatcttactgtccaaggtcaactctaacactaaaactgggtttcttgcagtagcttcctggaggaaaacctctgaattctcactgtttgaatccgatttatcgtgaaagtcaacatcttgagctttcacttctggtgcctccattggaacccagtatgcttaattgatgtacttggaaagagggtcaataatacttgtgtggggatagaaaaggtagaggcggagaagagaaggtcacttttaagcaggtgcgaatgggaaggaccatacaaattgatccgccccaacaggtagagacgctagaagggacatggaaaaaggtgcgaggattcattatcaaattccttccgcaatctctttcagagtaaaggatatgtcattagaaaggttacggcaacaaccaacccttcaagagttaaatgaggtactagatgagttgttacctataataagtgactctgctgtaaaagagagcgtaaaactagatatccgatcgaccctgattacagtcactgtgaggcagatctacccagacttatctaacttggccaaaaggaaactggctgagatttttcaaggagccgttggtatcaaactgttaatttcttcaattcaacatgccgaatctttggagatcaaatgttccctttgtgacttattgatcatatttctacacaatgagtcgtcgttggaatctatatttgagtccaatatcagacaggccagatcgcttctctttggatccacagtgtttaatgttcttaatgaaacatatcaagatgtaagacaatataaacatacagtgacaggcaaattgcaagagataaccactctgaaaggatatacttctgtcgttttacccaccctcgtggccaatctgaagaaagaacgaaatccacagttactattagcagctttacagctatgttcgcccaatgaatcacaattggttttcgatcacttcttccaatctccggaaccattcagcacgcttgtatcaacctacaatacttttacacctgttcagaagcccgcattcatcaaggctctgttaggttactgcatatcacgctactctttacgggctcctcaaaacttggataatttgcagaaggtttacagtattctgtcacagtttccatgggacagctggagctcgtttttcattactgtgttggattatcaaaatcttccacttctgaaagtatatgtgaagttaatcaacaaatatcaagtatctgacttactaaaatccctggtgcagatatggggtgctccaacgttcatcaataaaacacccttgaccttacaaaaacattatttgcatttgatagtattgttattgtcccacaatccggcaacaaatactgaaatatcctctgaccatacgtttctcacaacgatcactaatagaattgattctacttctctttcagtccgtgcacaaggaatgctactagcaaacttggtgctgcaaaattctgatagtcaaaataaaaaggtgttcattatgaaggaacaagatgactatgagtccacctttttcgaagacttgggggacgaacttaaagattcagaagccttcgatctggtcacttcactagtatctgatgtttgcttcccgccactgcaaacagtatcaagggtggagaaagttacagaagttacaaatatgacccctcagaactcgaacctgcacatagtcactgatgatgaattgtcagatcctgaagattctgatgacgatgaccctagtgtctctaggaaggattatccaaccagaccagtgtatatcaaagagcttctacagtatctcctcgcggatgagaaagatcccaaggcctttgataaacttgaagtggctttgaaagtggcacccacattgattcgtcaaaagtctcattttggtgatgaaatcaaacatttcactaatgaacttcttgctactttagtgggattgtctaacagatttgaaatggaaaattttgatcagcaaagaactaacagcattatttcaatcatagttagtaactccgagcatgcaatcaaagaattgctgaatctttttctcacgggagactactctcttcagcagagattaattatattgacttctttttcactagctgcaagagagctgaagggacaccaggatgagaacgttaccagatcttttaacaaagttaagacggaatttgcttccagtttactgccgaaacatattcatgaccagttcattgaactagagcacaaacagaatggccttctcacttttgatcagcatgcagtacaacaactggaagatgattatttgaattccacagttgaatctgcggagaagaatctaatgccccatggaaaagttttacgcgtttctagagggcttgaactgaagaaggctcaaaagtccctccagttatctaagagcagacaaaagaagttttttaagttagttggtcccaagttcttttttcctttagccactacatggcacgccttgaattctcaatcaggattcaaaattggccgatactctccgatactaacctcacattttatccgaactttgtccctaattttggacacagcctatccctcagcccctgatttacttgatatgatacaggaaatggtttcaattcttattcccttgaaagactcatatttcgaccagttcagtgcgccagagttggttgataagggtatgaacgacgaactacttattttggattctttagtattatcctttcttgttattcttcagaataccaatcaagagtttttacttcaaaattatggccaagagttatctcaaataagcgattggctacagagtatcttagaaacggtgattgatgatggtattcgaagaaaatgtgcaggagttcttgtttctataaacaacttatttggaaatgcttaaggcattgttgttttcatctttatgttcaaactacggcattcatagcttttcgttccgttgagtcacatcatttttactactaaaattagaagacccatgttaaattacgtcaagtacagattcattgcaaacatcctttttgaatgcactgctatctgtttttccaattgatggaacaagaatgtcaccaccaagaaatgaattgagaatctgcttggaatatgcaacacgtttagctagtgaatgtttgagtttcctacacagaatcccaaggatacttttgtgagtgttgaggttctctttttcaacgtttggactgtgatttttgttgttcgacaacgagtcaggttgacgaagatgcaatgcagtgttcttggaaagatacgaactattttgtgttgcctcaaagagagctacgaaggaagggaattttttttcagtctccaaatacttccaaaccttgatgtcattaagggtttcagaaatgttcagtggaaaatacttggcagttgaataatcaaatgttacgtactccttatattgagactctagtgaaagtttcaaaatttttccattttcacttctctccagtgcatcagatagcggtgcttcacataagctagacatgtgtttcaaaactttactcaaaagatcaaaggagttttgccaaatggaagtttgcttgcctttcatttggttcaagaaatccacgagccaactaatgatttcctcaaaatttcttgaggtttcagttacaactgcaacagtatccagcactttcaaacaccatacatccaacgtatgggtattttcggcttcttgaagcattgtcaaaaaaatgtaaaagtctgttagcacggaaatagtgggctcaaaaggctggcactcttgagcattttccaaaatgtaaatggattcaattatttgcatgagactatttactatctctggctcttcttccaagtagagctgaatgttttccattacttgcaccgtggatggtaacactgttttctgtagtagttttgatatccgaggcttgagtatgagtgaaaaatttctggatcttgcattcatcaggagaatgtcagaaattttttgaagacggcaggctaaagaaagattgtcatttttcattaagaacgccaattctatgtgatgcttgcgatattgaggcatgccgctgtcgtaataggtgctactgaagttctcctcatccttaaaggcttcgcaatggacatgatcttccagtgaacgacttctactgttgagtgatagagaggttggtactttagagatacgaagctccattagatagctaaagaaaaatttactctgtttacacaaagaagcccgattcacgaattgagaggaacctaattgtgagtcaaattcgatgagatacggtcgttacctttgggaaaaacttgttctcaataggcacacaaaatgtctgcgtcttcatagaagtggtgcaccagtcagacgattcaacttctttgagtttactatacttgattcatgataattattctacttaacatctgggaagaattaagacaattgtgatctggggaatccctaacgggcaacgattccgtcccttcttatagaattgttaaatttaatggaacagatcatagcataccaacttaggagtttccctccgcaatcgtcgtagtcaaccacttccctctactagtcactcgtctcgtttactagaatgcccctgctattagtcctggttctgttcgcgcagcgacaagacccaacatcgacctgagatcataataaaatctaccccaaaccttatacaatagaaatgctcatttggccccttgaaaactaatggtatcacatcaagaaaacaaagatggaacttccttggacgtttccaatctgaaaccttttacgccggcgcatgttttaaacgattacagaagagacagcatagtaacccaatctttaaatagctcatcagaaatcgttaatgattcttacgataagaaaaaaagctcttcatattcgtcatcgtttttacccttgcccaaattagacaataaccgagaggaagattcactggtccccacagagttctgtaccaatcacgaacaagctggatctcaagttgtggagtttcagtttgaccagaccaaacgttccatctacagcactaaagaaacagcttcagtaccaaaactaaacgtgtacagttctttcaaattgatggcagaagatataaatccttccacagaccacctagctcacaccgcatctcccactgcatccgccacggcctcggccaaagaagcaatagttgaggaagaagttaaagatggtagcgatgataattcttcagatgatgctggctggaaggagatggatacagaaataagctacacaatttatgataataaaggggaaaagattgatgctagcattaaacaacaaatcatctcacaaaaaaaggacgacgctccagatggatatactaggatcaacgccgaagaacaagcgcaaaaatatgaagagattgacaagaagatggactttttatttgaaaaagagaactccaatctgaacagacttttgaacggctcgcatgatgtagagcattacgaggaagaggacgtttattctgatgatgatgattacactcctttgtcacagttggacacaacaaagaaaatgttaaaggaaagccaaaaagttgcctacgttggattagttcaactttgcattgttgaaatgggtatagctttggctgaagttcatggtactcaaactagaacgatggggaaaaaactgagcaaggcgcacgcaacttttagctcgtgggcttcaagtttaatgaccaagttgcataaacacattggtctttctgaggaagagcaattaatgattgaaaagttgtcgacgcacggcgtcagacctgaagacatgacaccaagtctattggaaagtagaaagattgaaaatcctttgcatcagaatgatatagatggaaaactccaatctcatcaacacaaaaatactgaatcttcagcaaaagacgttttatcaccagaagatattgccgacaagaaaatgatcgacatagatgttaggtggactgtcatctgtgacctgtttctcattcttttatcaggttctatatatgactcaagatccagaacactacttcttctattttctagacatcttaatttaactactgtggagatatgccaatttgaacgacgaatcacagattctttagaaatgaacgagaataatcccgaagactggaatgaggaggaaatattgactacaagaaaaagaatagcaaaaaagagaaaatacatgtatgtgggtatagctactattggcggaggtcttgtaataggtctctctgccggtttatttgctccagtgattggtgcgggtatagcagccggtttgtcaactgtcggtattactggtgcctccggattcctggctggcgtgggcggaacagctctagtaaccacgacaggcgtagtcacaggagcaaggattggatcaaagggaatgctgaaacgagtaggggatgtaaagacgtttcaattccgtcctttgcacaacaatgggagagttaatctgataataaccgtaagtggatggatgaacagtaaaggtgatgatgtgagacttccattttccactgtagatcctgttatgggagatttgtactctgtcttttgggaaccagagctattgcagtccatgggccaaactatcagcattttagcaaccgaagcgttgactcagtcaattcaacaaatattaggaaatacgattttggtcgctttaatgtcttcaattcaattaccaatggccttatcgaagcttgggtatctgctagataatccttggaatgtttctttagaccgtgcttggaaagcaggtctggttttagctgacaatcttatgaacagaaacttgggtgtaaggcccgtaactcttgtagggttttctttgggggctagagttatttattcatgtttattacatctttccaagaacaacgcttacggacttgtggaagatgttattttgatgggaactcctattgtttccagagtggacgaattagcgttagcacgggcgactgttagtggtaggtttgttaactgctattctaaaacagattggattcttggttatctgtttcgattgacgagcagtgggattcgttcagttgctggtttatccgctgtagaacttattccaggaattgaaaatttggactgcactgagtgggttgagggacatatggcttatagaaaggccattccgaagattatggcaactcttggttggcaagttatttctgaagagtttgtcgatatcgatgaacctgacctaaaacaaacagaacgacagcgcaaattgattattgattttgaagaggcaagaaagaaaatgctagaagaggataagaccaagaaaaagaaagggtggtcctggctgcgacctaaaaaaaaggaatggtgggatgtttacgacgaaggaaggaaagaagtggagaagaaaaagaagcaggaagtcaacaaagatgatgatggttccgatgttaacggagagactttgcccgaagagttgaaggaaagcggagaagaagcctcaaacgaggaggcagtattatttgacgtcgatgctctcaataaggagatagaaacaatcgaacaaactgaaattgaacgaatgcagaataaatctcagactaccaatttgagtaaagaggagcctcatatgacacaaacgtctccagaatctaacaaattgaaagatcttaaattacccaagagaaaatccgtcaactcttctccagaaggaagacgaaccacgtccataaatcttaacattttggagtctccgatttcaaaagtagaggcattgccacctatcgaaatagatcacattcgtcctacaatggggttcaatatcaacaagtatattcctgagaaatcacagctaaaagagtctgaacgattagacgttaatttagagtctccaaaaacaccaacaatgtcagctcacattgcggatgatgatgaattggagtttagtacgacagagaacattaccatgagttttggtccatgattaatatatgttatcaatgataaaatataaagtctacaagaatttttcagtgttaatctctacagaagaagcagcaaaaggaatttcaaaaaatcctagcacttcggggtgaagaacaccaatagaaccgatctcgttagcctcagctccgtcagccgctctaaagaaaattttggcacctctgccagggaagaaggtggcattagcatcatcttgttcgatccagtaacctctcttgcctgcagatggtttctccagccaatcagttcttaatgtctgcatgatcttacctaaaagaccttgaacaaactcgaatccggcggttttgccaacaaaaacagcagcccaatttctctggttcttagcacgcctctccaaagtctcatcttttaacacgatgtcgccacattcaaagactttaatagggagagagtgttttctattttctttgacagtcttcaacagaccaggtagtaaagttgttctgacaacttggtattcaatggtctttggattggccaacttcacagcctttgaatcgtcattttgtctaaggaatttgaaattttcatcatgtgagcacagggtcaagggcaatgtctcactccatccattttgagaggtggccagtctgacaatatcggcgattttgttgattggtagaggttgggcaactaaagcttgggactgggcttgagtttttactaaattattataaccgtaggcaatggaagcatcctccataatatcacattgatgtaggacatcaggtctagttatgggaatgtaaacatctaacaagtcgtttttcgactcattttgcttaggctgtaaacccattttctttagtaattggataatagtgtcgacatccagattcagaccaagacatgagttgatgtaagagatttcagcctgcatgagtcttggtttaatatctggaaaaactcttgtctccttgttgtgctcggacacaacattaacaggctcaatggagaatggagtagaacaatagcgagagaacatagccactaattgattgacaacaatggcgactttagtcttatcggtacctgtgatatctaggaagacgtttgtggtttccaaggtaatcttggagcgatcagagttgataattggaggcatactggcgacatttctgttcttgtccagaatgactgggaaaacgggagaatctttgatgatgtgcaagtactttccgagatttttgtccttctcataaaattccattaattggttaccatccatagctttagtctggtttaaaggaataaatgtgatctcagatggaggtagcgcctcgtatgtaaaaggaccttccaaagtgtccagatcatgagtacccatggcgactagagttctatttcggcacaagttcgtgtgcagtttgtcctggagggcaatgaaagaatcgtaagatctttgtgtaaacttgatacctctcaaaatggcagctgctgcgtatggacgaatggtggaagtagactccttaatagtcatggtaacttgaggaactgctggctgcagagagtaagccggagcgctagaacgacctaagtattcgtttagagcttgagcaataccttcaatgcacaacatgtcgtatcgattggcaggtatttctatcttcaactgaggtctttctcccttggcacaatcattagtggtgtcctcgtccagctcaataccgaactcaaaacaaagttcgtcaaactcttcggtggtgtatgaccttcccaacaactggtacaggtcttctttatcgacagctacggtaggcattgcaagtttgaagtaaagttggcgaaactttgggaacctttggttaaaactttgtaatttttgtcgctacccattaggcagaatctgcatcttgggagggggatgtggtggcgttctgagatgtacgcgaagaatgaagagccagtggtaacaacaggcctagagagatacgggcataatgggtataacctacaagttaagaatgtagcagccctggaaaccagattgaaacgaaaaacgaaatcatttaaactgtaggatgttttggctcattgtctggaaggctggctgtttattgccctgttctttgcatgggaataagctattatatccctcacataatcccagaaaatagattgaagcaacgcgaaatccttacgtatcgaagtagccttcttacacattcacgttgtacggataagaaaactactcaaacgaacaatcatggcatcaagaggcacatcaaggcaacagtatgacctcactatgaagctattgctagtaggagactctggtgtaggaaagtcctgtcttttattgagatttgtggacgactcgttcaacccttccttcatcactactattggtattgactttaagattcgaaccgtggagatcaatggaaagaaagtcaagctgcaaatttgggataccgctggccaagagagattcagaactattactactgcctactacagaggggccatgggtatcatcttggtgtatgacgttactgacgagaggtcgtttaacagtgtacacaattggtaccagacattgaaccagcacgccaatgaggacgcccagctgtttttggtaggtaacaaatgtgatgacgaggagtccagacaggtcactaaagagcaaggtgaacagttggctagtgagttaggtgttccattcctggaagcttcggccaagagtaacaagaacgtggacgcaatctttttggagctagccaaacgattcgaagagaagatgagaaatacacaacagggccctggttctgctggtattgatgtaaattcctccaacgacaccaaatcgtcttgttgttgaacgatgagaccacatggagtagaagtagaagaagagtaaacttatccttagcagtatctctaataaagcttctgcgtcacggaaggaatcaagaaggagcttttgaactttggacgttttcgatgaacatttccaagtaggtagctaagcaaagacacattattatgctgttataattcgaagtaagttaagatcggccgcgtttggcgataaccgtagtgattgactaaaggtgtatgtatatcaagagcggaataagagactgattacaaatgtttgcagtatggttttacccaacgaccatcggtcaacgaccagttcgaaggtttaggaatataccgccgcaacacgctgaccgaactcgatcacccttgcgaatgagaattcaaagtctgtgctgctttgttatacaatccgtcgatggagttactctgttccatagggatataaatatcctactaacgaatcatcaaacaccaaaagaggtggacaattccatattgaacttacttcacgagcatcgaatatgtgcaggcgattctaaattgctttacaccaaaaccaaatccgaaaatctgatccggcttaacactttaaagaaaataacacaacacggattgatgatgaaagaaaaaatttttggaggatctctttcccttttatatgaggaagcgatgaattttcgcgctttttctatctatcgattctctgtagggttggcatatcgtaagctcatctttaacccaatgagcgacagagtagccagatacaaggcgaagagagaggaagagagagcagctgccgctgtccattttgaagaagaggagaatattgatgataatgagattgtggagtcaaagtgtatcccatgcacaagtgaatatcaatacgaacctgagaggataataaaagttttccaaacttgctttcaggacatgtttgaagaccaaactgaactaaatcagcttgttcaatcagttaagggagatctatataatcgtgattatgctgccgcctttggggaagaaagaaagcgagatgcttatgttattaggtggtctccagccagagctttggcctattcttccctcttctcccaattgaaggaagtgagggaactgatctatgatttttcagatgaaaaaaaggacctagacgtgcttgctgtcgggggtggcgctgggagtgagcttgttgcgttgaactcgatctattgttttgcaaaggaggcttacccaaacacagagaagaagattactgtcacattggttgatattgcagactggtcattagtcgtcgataaaattacggactttacaaaaaaatactggttgtacaaaacagctacttataaaccagagtttgtcaatcatgatatcttgaaaccgggagtttcctttgtcaacagagacttgataactctgttgttcaccaccaatgagctttttgcggaggacaggacagaggccacaaagtttctccagaggctcagctctgaatgtaaaagtggagcactgctgttgattgctgagagtgctggatccttcagccatattcaagtcggcaagaaaaaatttccactcactttcttgatagacaccatattgtgtggtaggcctggatctgataatggtgcttggaccattattgatggaaatgatagtgtctggtacagaactcccaaggtacagtacgatttgaagcttgaaaatatgcgatttttctacagattatatcgcaagaggtaaaattcatttcttgagatttgaactggaatagaagtgagcgttgagttaacccatcagtcaggcaaaatgtttcatagcatttgacaacatttttgtaaagtgtctcgagtgagctttgaacgcaatgctggtggttccggtgtattagttgtatctgggacctcattgtcacttcatctatcctctgttccttttccaatgctgtttggtagtgttaaactgaatacatggtagaaagttgtcaatctcaacataattcaagtcagtttagggactttgagactggaaaattactaggtaaagctatggatccatgtcatcagattaagagcatcgagaatttatgtcaatggcaggttgttgaactgcatcttttgaaatgattattgccatttttcggcatatcccgcaagtattaatagcggttcaccatcacagttatataagtattgcctgatcatatgagaaaacataatttctaagaaatgacctctattattttggttagtaattctctcacggtagtattcttgttgtgacaatgacgggaggtatagtttaagcttccattcttggatcttgtggggatggtgtattctttagagtgcttcctaccattgtttcacctccttctttgtttggctggaattgtctgcctagttccttgtattgccatcttgatagaaagtttctcgttacttttagggtggaaatttgtcagtaaatgagcttattctcagaagcgcaaatgtgtatcatgaaaagaataacgtcttttgagtttcagcttttctattagagccttttcttcaactatcttcaagattgagagatgctggacaatggttgtaaccagttaatctctcttcgaatcatgagggtcatattgcacaaactttttcgtagttggagattgtttggttgaatcatcctgaattgataataacagatgcaaccagattaacgatcaattttgccgatactacgatcatcagatggtgcagattgaagatgagtacaattgatccttcatgaatacatacacttcgaaaagaccagatgttctgaattctggataaagcgctaatacaatctaccagtaaatgctgaatgatcaatcactgttcaggggtttttattattatcgggaaattctttggtgaagtggctttatcagctattgatccgcaatacacgctggtgggtgtgcataaagaaaagggctcacttgtccacacgacgggatatttaaaatgctaacgcgaaagtgccgtctagacacataattgtgttaaacctacgtatatttgagctagtaaaagtcagataactacaatttgcgacttcttgatctgtaagctgcttccaattcggctgaccaagaacggtagaactcgtccagaccaaatagttgctcctagccaaatctcatccagagaactcccttctaaatataaacaccgtctagtttggtattgacatgttgtcaaacagcaataactcagttctatctttagtcatgtccaagttgaatatgcatgtaatattagatgcagaatggtttgttctggtaggcatctgaccgagttgcagaagtcgcgcacatcttaaaatttctttttttgtgaaccgttaaggggttcttacccccacgtgctactaattactatttgttctttttatttttccgagaaggcacacgaggcattgcagaattaggaaatttgtcgtctgaccaaaagtataaagtccttgaggcccgcattagtggttgtcttggccaagaataccaagaataatgtcatctgaaccagtcatgcaagccaagacaaagtctaaaaggttaaacgttcacaacctgttagatgagttcgaccacatagaagatccttttgaaagaagaagattagctttggaaaaaattgacaatgccaagttctctttgtaccatgttagagccattatggttggtggtattggttttctgaccgattcttacgatatctttgccattaatttagcgaccagcatgctgggctacgtttactggggaggtgcccatggaggtaccggtcggatcccctcgtccacagagtccctgatgaaagtgtctacatccgtgggtacagtattgggtcaggtggtctttggtaagctgtgtgattatgtcggacgaaaaatttggggtattgaattaatcattatgattacagctactattcttcaggtctgtgctggtgaatcccccgctgtcaactttgttgctctactgactttttaccgtattgttatgggtattggtattggagcagattactctttgtcatctactattacttctgaatattctacaaaaaatactagaggtatgataatggctgctgtttttgccaatcaaggttggggtcaattacttgccggtatcgttgctttgatctgcgtggttggttggaaatcggatttgatcgatgcaaccaatgcctcagaatgtgttggtccttgtgtactagcattggataagatgtggagagttttagttggattcggtgccgttccaggatgtattgctttgtacttcagattgaccactccagaatccccaagatataaacttcacaaggagttacaggcttatgagcaacaaatggcccgtcaaaacgataagatgcagctaattgctgctgagaacgctaacaatgaaactgctgcagctccccttacttttgctgaccgtgctgttcttgaagaggaagaagaagaacataaagtccaacctgctacctgggctgatttttggaatcactaccgtcaatggaagtacggaaagtttttgattggtactgcaggttcttggttcttgttggatgttgccttttacggtttgaatttgaactctgctgtcattctccaggcaattggctttgcctccgatgaaaatgtttatgaaaaactgtacaatgtctgtgctggtaaccttattttgatttgtgcaggtgctctacctggctattgggtatcagttgctacaattgataccttgggtagaaagttcatccagctgatgggattcattgttgttaccgctcttttctgtgccatcggatttgcatacgataaattatctgacaaggggcttttgggtctttatatcattgttcaattttttatcaactttggtccaaactgtaccacatatatttacccagtggaaattcacccaactcgtttccgttccactgcccatggaatttcatctgcatccggaaagattggagccatcattgcccaaacagtactgggtactctaatcaaccatggatgttccgcagacaagccaaattgttttcttccacacgtaatggagatatttgctctgtttatgttgttaggcgttggaacgacactgttgttaccagagacgaagaaaaagtcattagaggccattggggagatttatcacggcgagctcaacccagacgcttttgctgccgacgaggaggacctcagctccagcactggagtggatcaagaattggttaactaccaggaacaaaaacacgtctagaatgttgaatgtctagttatatatcctagacaaatgtatattagttctgcatgctgttaacttaagatttgtagtatgaaatgttgtttctatagaccgctcaagaccactgatgccattaatatgccgcccactaacattccacttttccagttggaatttggttgatggcttcttagtccactgtttgtggagtttttggaagtggtattttttaaagtgctagatgatgaaacaactgtagacaaagtgcttgaaagagaatttgagttatcagtagaagaagctgttagctctgattctggagtccaccatttcgttactgaaggtgtccaccattgtgtgacggactgactccaccagacagttgtggtcggggttgtctctggggtttgctgtgtattggtctctaatgatgcggcagtagttgcggccaatgattgagtctgctcactttcagaagctctctgggcttgagtagtagctgcagtttgctgttgagtttgagcagaattttggttggaattttggttagagtcttgagtagatccttcttcagagttctggttggattcctgattagaattttctagagaactctctgaggaagcgtctgaattgctgtctgagtttccgctttcgtcgttactcgcattagagtttctggaggaatcggtatcttgccattgatccaagcttcccaaatcaagggccaaaactgggtcaaagtaaaatgctggagctagcaatgctactgtactaattaatgataaggacatttctaactgcttgctgaactggaacgttcaccaaggaccctctgttatataggactagaatatgaaataaagaaactgcctgtttaggtaaagaataaacatacaccattaaatttccaaattgggaataacaagaacgacttttcaaagccttccttctaatctgaaatatttgtaccctatctacccacacagtcaagttaatcaagcgatgatgcaatatgattgaatactaatatacataggaaataaataaatcagcatcaatgtcttacaaaagtagtcttgatgcgattgtctttaaaaggaacacagccaacataataagtactgcgagaaccacgtagtaacccttggtggctactttgtagaggaccttttcttgcagtcttctcaagttgtgagattcaatctctttgacacatgttgcattttcttcgaaaacgagttgactttccttgattatctcctgcttttctgtctcagtcaagttattacgcgtggcaagttcgtagtcacgtttgtaaacgatacggaaggcatcttcatcctcacattcgaaacggaaaaagttagtggcctcgagagagatctcttcggtggtttttccaacgacctgagggaacagtccaacagctttagccaacttggatctaaagatacggccaccagcgaaaagagccaggtacatgacatgcatataagccagcaaaaggtatggcttctctgcagtcgactccttgatgtgacgaatgaaacgaatttgctccggcatgataggctcagcaaacttttttggatcgttgtcgtagtaaaacaacaaatctttgtaaagacgttcagatcgacgaatggtaggcttgtaaacctgtttcaaaattgaggtccagggcgtctccttggacaactcacggtcaagagactcttcaatagctgaaaaaatatgatagtacatctgtataccctgacggtagatcttaggatctctcaaagccagtgcaaactttagcgtcatcatcttatcaatcttattgtgggcattcctggtttcagcatttatacgattaccgagcgcagcaaggtccgtacgcagaggaattatctcttgttggggtattttggtgctcatatcgtgggtcaggtaaaactggtagcagctttgagtgttggaatatgggtgatataagtacctttgacctgaaggcgatatctccgtagttcaaagctttggtcgagcacacgactgttgtgaaaggaatgggcgatgacaggcagggcggattacagcacgattggtaaaatcggaggaatgggggcagggctgctagtgagaaccctgatgagaaatttcaaagtcttattatgaaagaacatgagttacttcaagggtgcattgtctttttttttctcattttttgcagagcctttccatccttatctacgataaaacctattttgggtatttcttaattattcattgacaatttgttgagtcctcctaagttatacaacaacaacttctgtggtaagcagtaccatatcagtaggcagcttgacatattttaaccctccaggatttgaatttggagtcaaatacctaaaattgtgcgtaatggtggggaaaaaagtgtctttgaagttcatcatcgtagtaggatgacatgctgtactcataaaatgtagcgatattttggcctgatagacgttcgtttgatccgagatgttttcagcatcgctgagatttagtaagatgtccactgacaatctttgaggggatggagttgacatcgcgtgggaaaatgtggacgacacagatgaagcagaagaagtgacgggtgaaaagtccgataatgacggcgttgtagaggcaagtgagacatattgggtcagagcgtaccagttctctcctcttggaatcaaacccgatccccgtaaaatatcattgattagaaacttcaagatttcaattcgactggagcgaataagctcaaggctgttatcgtctggcaatcgtttattccccccagctttgtcagtagaagctttcttcagtttttctattgtttgtagagattttccaagatctggcggtgcatcactgacatcttcgttgtatttacatatcaagtcaccagtatctgggtcttcctggtaattcattgccaaaaacaactgaagtctacgttgaatcaatggaatatttgatttagactcctcagaccactcaggattcggttcaattttttccctaactttggactttggatgggatttaagtcgggtcgatgccattacttctgaaccactggaaatgccagacctgctggcacttggttgtggactaggtccaaaaatgtattcctgatctcctcctactttcgtatctgattcagtagatccgctactagtgtggaagatcagaggcgagttgatctgttcgttgataatgggaaactgaagctccatgtccgatacaaaagcgttgttattcattcttccattacctgcgtgatacagagaattgaacattgtaggccaaataaatgtgatcagtaaacggagtcttttgtttcgtgtgggacttctacgcctcagggtcgttagcgaatcgaaatatttcaacaagtacttcattcttcctcttctggaatgacataatcggatatacttcgagagctctcggggttattcgatgccgaaaaagacgatcttggggcctgcggtgagacaattggagtgaaatacctatcgtcgtcatattgcgggtccactattgaggttactgagtctctggggcttcgtgatgatctcggggtttctgtcaactgctgcacgtctgatgttgacggtgacctccaaaacggctgtgtaggaattgctaatggattaactgttaactctgggggtactggatggctcactggtgaattgcccttgggtagtgaagtctcagttagagtagaagctgctgaatccatcgtgcttgtagaggtccgtgtagttccagaactactcggtctttggaagttctggttgacaacttcaatattggatttcggtgataaaggagaaaatcttcttggggaattgttgaacttgctaaagttgttggaaacagaacgtgcaatcttgtttcttgaactttgtgttctttcaaccaacgtagaaccttcgcttagagctgggtttacattcttcctatctccaaccaacattgccttcaattgttcactggtcaaacttaggacatatcgtttggtcttatgttctcggccttcagcatttggttctccgaaagaactgacaatcttggaccataaatctgcgaatcccaagtactcagcaattgacttgaggacattggaaattttgaaaggggtgaagattggtttttcccaaagtagcaggtagctaaccaatatgagactgagccctagccagactccaacgcaagtgccaacgataaaggcagcgctgaggaattgatacattatcttggagaattcccaaacacggccagcatgtacttggagtttttcatcctcaatcagtagaagcttaaacaatagtattgacatgggaagcctgatcaaaccatagaagagcacgtcgataacgctcattattggttgccagatcaggaaacttaaaatggctaccatcacttgggccgtgccatagactttgagaggcaaataccacaagatcgaccccagatctagagccatcgaatattatagtgattgaacttgtttacagtaatgaaataagatgaagtaaaccctcagagtatagttcgaggcagggtaacacaggtggatatttatcaagatagatttttttctctcatccttttttcaacctaacctagttcatttgaaacataagagacagagtttgttgattatgttttgaaaccagggacactccatttaagcctctggtctcttatgtttcggtgggattatgagtcctgagatggagaagattaagccagtggttgaaagtcatctttttacctcgatgcactttcatatcgctggatcgtgaaccaggcaatcaattcagttggactgttcctcttggctgattgtatggagctacaatttgtagaaaataatgagtttatttgtagatatgttttttccccccttctttaccccgtttctcttatatttgcacattttactcggcgtattctggtctaagatcggatctccttggggctaccaatggatgcaattgtgcgagataagtgaacgcccacattaaccaacacatagctaaagttaacagcactgtacttctccaaacgcttagatgttagtaaggcaatgttcctatttcttctgttcccttctctggtgtaaactgtacttacgtttggtcttgcttgggggcaacaaaccagaaccctgttccaatggcaattaccacaagcagtgttattatcacagtccatctatgaaacagttagtattcaagatgggagttcaagaaaacctttttgtgtcacgtacccactcatttttgcgtatgttctctctgttcccttggatgattgactttgcaaggttgggattctcagtcaatcgagcagccaggtgggaggagcaatacgtgcaccacacatatttcgtctatcaacctctatcgatggatcagttcagcgtatcacctttaaccattgtccatgggattgccagagtctctcctcagatggttgtttcaggtgttgaaaccacagtatcataatcctgtgctatgctatcaggatgtttcattgattctaatgaagtactcttcattgaaaccaagaacgagggtatttgccgataacaaaggacaagaccagttactgcttagtttatacggctctatcccttgcaaacatcataatgtgacatatgagatacctataacgatatggataccattggattatccaaactcccatcccaccatttatgtcactccatcaaatgagacgcatgtcctcaaccccaacaactacgttgatgcaaatgggaaggtctaccatccgtttatctcccaatggcattcggtgtacggagcagataagtacaatgatcccaaaaaggtacaagaaaaccgtttgctgaagcttgtcgaggtaataggtgatgcctttggaagagagtttccattgttcaaacgacatgcccctccaccaattccaggatatgataatccgaggcaaagtcctagactaccaacaaatgaagtaaatccgatgaacagccctagatcggaggttcttgcttcaagtcaaccacctcctttgcctacaaagcccaaggaataccaatcacctccaccggactcaagtagacctctcaacttcaatacttcttcacattcaactccatcccaacagagcctctcaagtccccagcctggagctacggttccttatgtctacaaagatatgctttcctcgaactttgatcaatcacataagggagatgagcagcattctctcttaacttcgctgcataaatctctttcagtgttgctggaacaagatctcaaattgctatacaacgaagatatacttcctcaattgcaaagaattgaaaaagagttgctagcattgaaagatttggcctcaaaagacgaccaactagtcaagtactatcaaacacagataaaaaagaataagcaaatcttagaatcgaaaatttccgaagcctcctatatgatcaaaaatctttccaatgataaaagtgttgacaaaatagacgaaattcttgttgctgagacggttgtcttcaaccaattgtacgatctcagaacggaagaggcaagcattaatgatacgatagacattatcaccaaatctcatgactctggctccatcgatacagaccttttcttgaaatacactagacaattgtccagagaaaagtttatggttattgcattgactaaaaaaataattacatccattggaattgaaaataaatagattcacccttattctgaatcttcatcttgagttagtttaatagaatccctgaagtttttcttcagagcaccctcgtcaacacgaaggttccttattgcttctcgtatttggctcagatcatcttcattggagcaattggagatgtgaccatccaccaaagcttggatttgttccaaagatttctctaaaagctgaattcttttggaaaggaacctattctcctgagaaaatagatcaacgtccttctgcagcttttcttgaataacttttttcttatgtctacatttagaggcagctatcctgtttctttccagcaacttctgtcttttccaagcactcgtcccaggaatcagggtatcatttgggttaaaaatgacttcgttgttatacaacagctggtgcttgggaagcccatcgtcatccagaactatagtggatgacttggtgtcagaaccttcagagtccagactagaaacgaactctgaattatcttccagtttaatattgtgagtgggtgttttcctggcctggtgttcagacgtcttcacaagctcctgctgatcgaagtttgcccctttttgctgttgctgttgatacatatgggtggcttgtataagctgacctatttgaccattggatattgatatccttcttttcagagtaggaaactgagggtttgaaggtacgataccatcgttgtcaaaagttgagttgaaatttagaacatcaggaactacgttcgcatataaacttgagtcatcgttgaccgtattgtagtaggaaggattcatggataaaaactgctggtcatccagaaatccaaggcctgcgtgggaaacggccgatggatattgatgggagttatgtacacctatgacatttggcgttttgattggatgggaaaagggggacggctgttgataatattgctcaaagattgggggatttgttggaggcatggtatgaacatcaaatgtgggctggttgaatagatggggaaaagtgcctccagaggattttttggacttctctgcaccctgatttattggggaactcagagtgtttgattgctgttgtatctgtccctgtgattgacgaggattcacgtcaatctgtgaaacgggagagaaaggttgttcctgtaccagctgtgggttattatgagccattggatacagatagccacacttgaaaaaagaacgaaatctccttggcgacctatttcaacttatcagggagtcagcgggtcgaacactgtttgaggagacctaatgtttcgtagatccacaaaaaaagagaaggctctttccgagagatttaggatacggtaagaaaacctttttgacggataacagggatacctctattggtagtacatgcttcaccagaaatgcactacgcagtaaaaaaaattcgaggtttggttggaggactactaatattattaatgttccacagaaaaccggcgatctagtggtaagttctagacctagatagagtgatagagtgttcacaagaaattgcaaagctttcttcggagttactgcatctttcgaagatttaacacgttgcttttttggtttctgcagctgaacgaggtattgttccgccccatctccacattatgtggcagccgtagagctgttgttggtgacgtgtgagacagacgtaatgcttcggacagatcatttattgtttctatcgatgtagagaaagttaaccgttacttcggagtaattatgctggtgaagccgtaatactttgttccgccccaactttttgccgtataagcaagtatggctagcggtgtggcctacggagacgcgccacaaagcgctgatcatcttcggcgataatcgctttcgcgcttccggtgaatcccttttggctggacatcaaaagtagaaaagacgattttgcccaaattggatatacatacaatctcgccgtctgccctgccttgcattgaccatcatttagcctctttataggatgttgcgccgttttttgaacttcaggcggccgcttcattactcggcgccaattgtcagtgaggaagtccagcatgctgtgaaaaataacatccctgtggtgtcattggagtccaccatcattacccatggcttgccctatccacaaaacttggagcttgccaatgaggtagagcatgttataagagaccagagtgccatcccggctacaattgcgttcattaatggcagtccgaaagttggcttgagcactgaggacctgagattgttggcagatccagcatcatctggacttccaaaacataaaacgtcgagaagagatattccgtatgtagtggcacgcggtttaacggggggaaccactatagccagcactatgatgctttccaaaatggcgggaataaaagtttttgcgacaggaggattgggaggtgttcatagaaatggtgaagtgaccatggatgtcagtgccgatttggaggaattgtctcgaacagatgttgcagttgtctgcagtggacccaagtcaatcttggatgttccaagaacaatggaatatttagaaaccaagggagttcctgtttgtacgtttaatgacggcaatgcccctttcggaaaacatgtccctggattttacacaagatcttccaatgttgcgtctccgtttgaattttcgtctcccaaagaagccgcatctatgatatttgcaagtctaaacatgggtttggataatggccaattgttctgtattccacctccattagaatctgcattggaccttaacttcatcaactctatcattgaggatgctttgcaagaagcgaaagtgctagaaatatctggaaagaatgtcactccatttttattggacaaaatatatcataagaccaacggtaagagcgttgaatgtaatgcccaatttgtactaaataacgccaagattgcatcacaaatagcgacagaattggctagtttgacaaagaatgaagtaagttaaagccatttttttcttcttcataatagcatttactaattttcaagtcatcaatccctaataaaaacaaagctaaatttaatccctcccttaacactccgagaatccctcaaaaggttgaggctgtgatagtggggtctattgcccacgatactatgtgctctcttcaatccggctatattgcgaatgattcaaacccaggaacacacgcacagtctataggaggcgtaggattcaatgttgcactcgctacacatctggcttcgagagatcatggctcgttcgtggaaacccgactctgctctgctgtgggaaatgacctgttaggcaggggcttgatggagactatgaaatcttgtggaatggccactgacgctgtttcaatctctgagaatttccccacaggaacgtacgtgtccatccatgatcattctggtgctttggttgtcgccagtgccgacatgaaagtggttgaaaatatttccatagagcatgccatggaatgcttgggaaaatatcaacctagatgggttcttttagactgcaatttgagtaattcgttgattgactccattgtgaagcttgaagattttgatgtggtcattgaaccagcgtctgctatcaaggcagccaaactgggaaagttaaataatctgcgaatattccctcacaattcagtgaaactgataacaccaactgtcaccgaactgaacgcaatatttaacgaattccatgataattgtctctttgatgcttatcaaaatgaatggtttcctgttgtggattcgctaggactggactacaatgtcagacacgctttggacagagaatttgaaagaaatgattatttgaggcctttacttgaacagggatttttgacaaaaacattcaggttacttccttttttcaacaatattattgttaaagatggtaagaatggaataattgttttccaaatcattacagattgtgacaaatacgacaatctaatcaaaggttcaaaaattattggcagtgtgtcgactttctctttcctgaccaagggtaaaccagtcggagttggtagaattggtgttctagtacaacattttccagtgctcgatgttgtcccttccgatgaaattattaatgtcactggcgctggtgattccttacttgggtacttattttctaagctttcggccgatagctcatggcttacgaggttggactctactagagaatcgtatttgattaattccatgaagagttctgctgcaagtctcaaaagtaatcaagccataaatatagatcaaattagacagattccttaagaaatgaaggatcagtcgaaaccaaaggaatcaaatcagaatagtcatcagcctaaggtgaaaaaatcatttgaattcatgactactactgtcacatagactaagtctcttgttttcggtcttttcaattatcggatatggcgtcgatgaaccggaatttcaactttaatatcatcacatttttactgggtcacttactgggtgttaatcaatgttaatcaataactaaagtttaatgtccagctggttgccgtggaatcaaacccctctctattcggatttttcgattgctggatctcttttttcatgctgaacggctaaaatggctactcaattgcatttcagttcagatcttggttttcctctgatctttactataatcacatatcgccgagaaaaagaaaaagatagaaaaaaaatatacctaactcctattactattaaacctacataaaatgcattcactattataacgtaaaatttagtgattctagtagaggactaattggctttctaaaaaggccgggtcctttttctcatggcgtgtcaaagctccaagggcttgaagtgaaacagcaaaggggccacataaatggtcacgtgacgtataaacgtacttctactttgagcgttgatgagccctctaagctgatttatgcaaagcggaacggttcttgataattgttcggtgttgaccttggcattgtaacggtgaaataattgagggggtcaatgtgaaaaataatgatagggtaaaaccaaacaatcctagcaaaagaaaacactccaaaagtgagacaaatcacatcaatatgcaacagcttgtagcccttttttctttgacagcagagacagcagtcttattcacagagtggagttctctactatccttattctcattgccggtggtaacttgattattttcagttatcccattttgatttttacttggctcctcggcgacaggtttagcttccctgccggagattgccgaagattgatggagtgaaggtgatagtctatggtcatcttgtgaaacctgggataaactgcgactgcgttcatcatagctctcctctctcatgagtttgaaatcttcatcgtctatgtttctatcatgtttagactctccttgcatcgaagagttctggcgtatgccgacctggctgtcgttggcactatgtggtttactatctgggatatctagtataagctctatcattctagtgaacacgtcgtcaacgtttagcctcatagatgcactagcctcgatatagtcgtcaagtttgtactgatactggaggtactcggcttccgttctagaaacttccctttcatcttccaagtccatcatgttccccaggagtaatattggaggtaaagagttcccccgtatgcggctaagatttcggagaatgtttgataaattatcaaaggagtccttggaattgatacggaaggccagtataattccttgggttgcgagaatctgctgtcttctgtgatcggattgtagatcagtctccatggtcgattgggaggagtcagcagtatcaagaatgtttatctggtactccttcccctcgatctcccagactctactgtacgtgtcttctatatcgtcatcatggtgctccggcatttgattctggacaaactgtagggtgattgaggacttcccaacacctacattgcccagcattaggatattcaactcccttctacggtccatctaataactgactagctcaacaacacagagacaatgcgatgagctattttgagtggcaaacaactgaagggtgaggaaaaaaagccaaaatcaaaaggtaaaaggaagagaaaatcgttattgtttctcgctgattgtgacattacgatacgatttcgctgcacccgaaatactgggaaaccgttgagaattataatagccagatatcatccaatctattgttacactggggactaatcctagtgattgcacaaccgagatggtcagagattgggaagcaataatagaaacaaagaaagatggagaataaaatgctgttttggtggcagtggtgtttctttgtagaaacggtgggccaaaaaagggctgacgtcggttattttcttttccctctctctacattcacaacggcataaaggatgagtaaggtactgtttagactccagcaccatagtaacctaaatcgggtcttccactcatctttgggccgagctggtgaattcaattcgttgacagatgcgccgttttagtctcccggcagaatttgtgtttgactgttcgctaatgttgtgctaccaagtaatgattagggccaatcccacctgcgttaaacggtaatcggatggcaggttaaaggctgttgccaatctcgtttcttttttatttatatctaataaagaaaaaaacaggccgtgcctgcgtaggagaggtcttccgactaagacgagtgaaggctaatcaccattggctgattttattaccctccaaacattttgtggcaccattcctgcctactgggcggagcacagggcagtaagtaacgatgcgtgcatgcatgtttgacattatgagtgaggtgtctctcctttattgtcaaccctttgttcagcctctaacaggtcccggaattaacacggctccttcaaatgcgccgggccgattcaccatttgattcagcagaggagtcaaattcttcgtagctgtcactgtctctagttagatcgatgacttccgattcctcgtcagagttttcacgtaagttttccgctaattgctcgttgtccctgttgaaaaacttgactaaattgtttggcaatacgtccaatggatcttcgtcaaaaaaggctgatcttttcacatatgttaaggtcatcgtgtttgaaatacccgagcgcgtaaactcatggattgtattctgaatctcggaaaagtccattatttttctaatgttgaaattggagaccctcttcgaatgctctctatggaaatatcgaacctgataccaacagtaatctgtttccttcgattcaaagtttttggtaaaataataaatgttggaagtatcaagaactattgaggtaagaaaatacggttcccagtctaatttttcttccttcactatccctgggatattgaacaggtccatattactgtttaatttctccacaatagcattctgttggtcagttattgacaatttttccttgattatgttatctttgatctgattgatgttttgtaaggccttgtggatttcttcatcctctgctttattttgcaagtattcgaccgttgtggacaaaaaatcattaacccttttgccttgataacttgaaatatccatgattttcttggaattgctcaacctttggttgatcaactcctgtctcagctcaattttagatctcatcaactgttcgttctcttttagataaatttgagggtaaaatatctctgaaactgaaaaactaccataaacgctttcattcaggtttcccaaaataggaatgaccatgacctcacttaaacggttgatatgtatcattcccaatctttcaaaatcattttcccacagcaacttatggaatgtctgataaatgttacacttcaaaacatctggttcaatagtaaaacattctactacctgtttttcacgttcttctccattatagatctcaattatttcactttggaataacctctgtagtttctcattatcaacgccagtagcagcgcctgagagtgatttaaaaaaggcaggaaaaaaatcttcaactccctccatatcattcaaacctgccagcagatctttactcaaatgttgaaccaggttatgaatactagcaaaaaatctttttgacggtgcattgtccaagaaggcgactactctttgtaactccataacaaacctatttcctacagatccagcgatcttgatatctttatccttccaccaatttttttcatacccataatcattgaaagactctaatttgaaaatcaggttccggaaacttggaatttcgtgtagtgtgatgataagtggagccagatagctctcaaaatactcataattgatgggaactagaataggaggaatatagctatttctttgtgttgcggaagggtcatcgtagacagtgtaatcatcggaggagtctacagagctcatatcatcatcatcctcaatgtcactgtcttcctcaattactccaggctcatcagaccgcaacgatccataagctgcaatctttgtccgaatctcttcatccagatgaatctctcgggatggtaatggtggtggtgacaatgaacttgagcttgatcctgccaattttatgtcagtattctgaacgtggtcagattctatttccaattcctgatcgttttccttgtcgctccgttggtttggtttctcctctggatgttgggtgtcctcattttcgccttgctgttgcttgggaataccgtcaccaaataaatagctcaaagcgccagtgacatcattgtttgtcataactaatgcttgcctagccacttcttcatcgaagcccatatctttcaactgggcgattgattcatcggtcatctttctgatgtagtttgatgtcaaggtaagaaggaggaaaagctcgaattattaagggcagatattcatctagcgttaaaagctggtagttgtaagaactcttgagcctaacgtatgagcagcggtctgtgatacgagagcactcttattttatatgacaataaattataattgttatacgtgaactatgtaagatttgccacaagaatataccaaaccctcgttcttatttcctttcataatatacactttttaaaacaaaaaccctttaaaacacttctggcaatctttctatctcatatttatggcctcctacgctcataatcggaataccagggacttttcttactcttctcttcagatccgcatcgtttgttgcgacgatgaaacacttatgttgtatgactcgatgaaccaagcaatcatcggcatatgttcccctatgggagcaggatagtcttttgatcctgggatccttggctagtttcaaggcaattctgtactttggacccaatttctccaattcggcaacaacacaatctgtaatcaaaggaacgcatttagcatatagtgtgtccatcatcccgcggactatatcgattttcttttgaatgctaaagttgatgaaattggtatctatgagaacctggtacggaggtttgatagcttggttatactggaaaaaaagagccgatgagacttgtggaactgatcttaccagttcaggatcatctttagggtcccttggtttctgaacgctatttttcaacctttggtcggtagacttcagagttcttttcacttgagcaaactttcttgtcttttttgcttttcccatacttgaccaatatgtgtggaaagaaaatgtgtgttctctgaatatgttcagtcttgtatagatagatagatagtctaggaccgaataattttttttctagcagaatttcaacatccaaacatcattatctacattgttggcatcccgttatggtatccacggaagtagattgaaacagtttaaattggatatcaagaggttgaagctctaacgaaattgtagcttcaaagatatgaacagctccaaaaatttggaaccaggccaattggaagatcaggagaaagccagaattttggactctaacaatcttcaccaagtctcggcaatttctctgagcttgggtgtcctttttgggctgtcattatcctttctgttcacatcagaactcttccaactgccactttacatattatgtctttccctgtttcattttctggagtattatatcacagcaaagtttaatactgacaaagttagtctggactcctttctcatcaataacggagctgaatacattctagcacattcacttgcaatatttgaagttgtattagaagctcactggttcccaactttgaagtcacatcgatatatttcattttttggcctaatttttattgttattggccaatttttacgatcaacagctatgattacagctggaagatctttttcacatatgatatctaccaccaagaagaaagaacatgtcttggttaccaacggtatgtacaagtacacaagacatcctagctatgctgggtttttctggtgggctcttggaacccagctgatgctctgcaatccaatctgtttcattgggttcctatttactttacggcgtttcttcaagcatagaatcgagtttgaagaacaatacttggtagcatttttcaaccgtgattatataaattacaaatcttgtaccgggactcttataccctttattgaatagatcaatggtcaccgtcattttcctcatcagaaagcgtaagatcaaccactgtcttggaccttttgttagcaacttccgcaatgccctccgctggtcttgcgtaactggaggaagaagtcgatttttgggtggaaggctccttcaacgagccattggaatcttgcagtggtgttttatcaaaaattgatgtgtgcatggagattcccaataaacctttagtttgagtttgttgattttgatcttggtcgttgtgcatttcagcattattgtagccatttgttggagatgaagcactaggatttccggtgctttgcaacaagctgttatttgaccacgacggtagtaccaagcttggagtctctgaagattcttgagctgggtttagtagttgaggttgaactccatttcgtgatatattctgtgactgagtttgcttgtcattacggagacttgaatgaatcgaaggtgcccctgggtataattgtggcaatgtctgagcccctacctcattaggagtttggactagaggttgaccataaaagttaaagttatactgatcttggttttgaacttgtcctgagctatttgatgctgatgggaccaaatatgatcgattaaaatttggagattgactatgttgttcctgctgtgctgatgatgctagtggggagaaattctgtgaggcttgtaagggagctgatcgcaagctttgaacgaaatcagtacttccatgaccatttggcatggtgccatcgactttctcggaaatggagttaacgtttgcatggtggttgtgggtatggtttagttgtccccgtttctttgccagaagcttcagaattctgttcttttgagcagtccgtacagtagcttgacgtattacttgatcatactgaccttcttcattgcgtaagctaggattcaaggcttccaatatttttttttgagtagcaatctggttatatatgtgatcttgcaattttaaagaggcttcaagttgttgaagagtaggattatgggtcagtaactgttcttgacgttgcaaaaatatctggatacttttggttctattaaattcagatcttctattaccatttgagggaggtacaacttccgtatttcttggaaaaccagaactgctgaacgacgaaggtctatttgctaagtttgaagaataatttgtggttaactcactgttgtacggtgtagaattgaacatctggcgaagctgagcactctgcggatctgatatacttctatgagcatccgggggcgtaaatgaaactgataaactaccttgaggattctcttgagatgttactgaagctgtcttgactgcatgactatcttcgatagttatagaactgtttgtgttatttgccgactgagcatttgatgactgcgaatgtagatgaggaggaggggcggcgggtggaggtaaaggtgatatgcttctttggcgcctattaccatcttccgttccaacatctttctcagctacatctcccaattctgagttgtgcaaagtatcattagactgagcttgagtccccgaagcgactgacatagctgcatttaaccgattttcaccagacaaggactgaataggggggcgtgaaggaggtggtaatggagaacttgaaatgcttgcggtatcctccccttcagagtctatacgtggaagcccacggcgtatatttgcagttgggagatctgaataatctaacatttcttccccatttggcagggacgcgcttgatgacgatggtccttcgttgtttgtagtattcgatacagcaacagtggttgacaacatatcctgtggcaaaacagttgaattcaaaacttctggttcgggaggattaattgcaactccatcatcttgatcctcagagtcactatccaatgatataacttcaacagaagcatctggtggtggtaaaaattcctcggtgggctcagatttcaaaccttcggtagatttttcttgaggttgagaaacatctggttcgtcttctttgccaatggtccaatttccatttggatcaatctccacagtttcgacaaggtcagaagtgtttttaaggatttcttcaacatagtcactgagggccagatccttcacatctatttttttagaacaaaggggacagctccatgttgatgcctgctcttgcagctgcaaaaacgcaagaccatcaaaacactgaacatgttcgcaataaattgacttgcagggatacttcatccgggaaaatgacaacgggcacttcaaacttagaatctgagacatttccaccacatcatcatcatcctcagtcttattgaaactatttagggtagcttccttgattatgtgtggctgggccaatactttttgtagtacatcaaatgctgaaaacgattccacgatgtaaagataaaacagataatccgtattggaaaaagcataaacaacttggaggttgttcatagtgggtggctccttcacaaatggagtcaagttagcaggccttgccgttcctggtttatttttaattcctttaacattacctttaacaggggctttgttacagtatatttctaaaggttgtgggaactcaacaaatgcattgttggtgacattacgaccatcgtagcttccgctcaagagcaagagtttgtaattgggctttccgaaaagagtcttagtttcactctcattcaagataaactggatgttacattgacctcttcttccgggagccttctcagccatcactggagttccatgcaccagccgcttcaaacgataaaatggactttcttgaaaataaacccacggtctgactttcttggaatcctcacttggtttcgtgggaaacatattaaccccttgaaacatgttagtattaccagtactcatggggagctgattgtgtgtgacggaggattgtacagctggtactacgtttgacccggccgacggaagcataaaaagatgagaatttgtctttaaagcattgtagatcgtgtcaaagttggggacttcctgaaaatttgcagccttcagcaccagagttcttgttgccagtaagagtacgttatcattattatctcttcctagctggaagaaaagttttagtcgttcggctaaatctgcttttctaccagagacaagacgaccggttgctctacagagcgctttcaactcgctgactcttagagtattgattctattaatggtgtcctggaatgttagtattcggtcaaaaacatgaactgtcgaccctaaccatagggagtaagatacggattggaacagctgccttccagtgacaaacatacctcataatcttcatcagacatcggctcttgccgatccatctttggctcttgataactgtctccagtatttgtaatgtgaaagcttgaagcaaattcgaccagggattactttacataagcatatctatgggcgaaatacttagatacattgtacattggggcgcgtatgttttgcaggcacactacttgtctactactaagaacctgctccacatcagatggtgataggaccatacaagaggcattccaccagggaacctgctgccaatgtatcgccgtgatcatatcttgaaggtagaaccaatagcccgtttgagttattaaaactccccactcggctgcttctttgaaaccctgttggttcagcctttaattgaaagtcatctttatcttggaatatcaatgctcgttggtattcatacctcgtatcaagctttatttccgatttgagcctagtcttaacttttggcaacgagaaaattggagatcctccaaattttagcaacgatggaaggacaaaaacgtaaaagcaaacagcggctgatgctggattaccaggaagtgcaaatatgtattttgtagtggatttaacggtgactgtggcaaacgtcgttggcttgccaggtttcatgttcactctcccaaagtgaatcttgccctctagttctctttcaatgaccggttttagcagatccaattcacccattgaaacgcccccagtagtgatgaggtagtcaatgtcgctgttcaaagtgtcctttagtttttgaaccaacttcgaaggatcgtcaatcacggcaccaagatctgtggtgttatagtgtagattggagcatatactgtaaagcgttagtcgatttgtgtcgtacacttgaccatacttcaatggacttgaggactcaacaacatcaacaagctccgaccctgttgacaaaataccaatcttgggtttcttcacaaccaatacctcgttcaatccaacactacctagcaaaccaacttcgcctccatttggagagataacgtgtcctttattcaggagaagacttttgtattcaacatctgatccaacttttctaatattatcgttctctttcacgtccattgctagtatttcaacttccttctcctccttcgagtccatagtagtcgattttaaaacagtctcctcaaccataacaactgccgtggcttcctcggggactggagctccagtagtaactctagatatagttcctggctttaatgtggttaagtcagaggcagacgcgtgtgaaacagatacaactggatagactcccgggccatctgtatggtgtacagcgtaaccgtccacaatacttgctctgaagtttggaaaacttgtgggtgccaaaatatcttcagcaatggttgatccaacaagaaactcatcaactatacttaaccttacatcgatatttctttttgtttccgtcaaaatcctagaaagagcagcgtccacctctatcatcggatacaatgactctcgtttccgctttgtcacaccctgggacaaatcattcgataagagttgatggtgcgccaatccacagccagcagaactttgggtggacttgccatgatggtcacaaaaagtgctagagttttcgcccggcaacttatcttcagttgttctttgcatcttatcatgaagcactcttgagttctcagagtccatttgagctaaagcatgcttcatagtgtgaataattgcactcaagttttccgaagctcctttgggagatccaggcaaagtgataaccagtgagctcttgatagttccagcaactggtcgagacatcattgcaaatgatgttatgctcaatgatttggataacatggcgtgcactatccctggtgctggtctttcaattagtggggagattgcttctggggtaatatccttagtagtgaaccctgtaccaccgcaagtcaaaatcaacctggatggcgagtctccttcagtcaattcaagcacatttttttgtatggagtatttgtgatccggtacgtacactgtaggcccaacattgaaaattggtgggttgttaaaggtgtcataaccggtaaaaactgatccaaccttgtcagccgtaagatcagcactgtgatcttttgcacaagtatctgatacaacaacaattgaaactttaaacatgaaatgacaatgtggaggggtcaaagtaattgagaggatcaagtcgtttggaatgggcttatctacagttggaaagaaaccagaccttccgcgaaatttatcaccaaaagatagataaggtgcactacacttactagtgagccaaattaaattatcctaaccactaaaccgaaatacagagaaactaaacaaaaaaggtaaggaaccttgtatataccagaatgaccttttaattgacttgaattgtctggtcaacgaaaataatcaagtttcggaacgccttcttggagcctttgtgatgggtaattaccacaagggactgctccccatccttgatttgaacattaaaatgaagtgctcttcctgtcagtctagctggtatgacacccgaaatcagcctttcattatggtcataggtcaccttgctgacagttttctctttctgtttgttattaatggtagtcttaaaaatctcccaaagcctttggctcgaaatagacgattggataacctcagtgtgattcggtttcgattccttggtggttgtcttcggctttgttagactgttaaataacttgctgaaccatgtcggtttcttaagggaatcttcattgcccgtcttagataaagatttttcgttcacttgaagtgtctctttggtgctggcctcggtagaattcttgaaaataggatccattggggacactctagcatgagagggtggacgaggagcgtccctcttgggcactatgctatggaactgattcattattcttcgtcttgttgactgagctcttccaagatcaatatcattatcactaagtgtgttggaaaactgagacgccctcttgacttggtctcctctctggactttttctggttgtgattcatactgttgtttgctttcaattggattaccctcatcatcaactacatcgaatattgttgagtactgggttggtaaagatcctctgtctttggtgctgttaactagcttctcaagattcaaatttgaagtctcatctggatcgccgtatatggatacttttgtaaaccttttttgattgaacgatggttctcccatcgataaagaatactgggagaatctggacaatcgggggttagaggatttttcagaaactcgttctctactgtcctcttcaattatctcgttgacagtgttgtcgacaaacaatgagttccgaatgtcattgaaaggttggacaatgatattcaaatttgagtcatgagtaccatcagacgcaactttgcgatgatgcttgatggatttttctgaaatagcatggtcagtattttgagcgtcattcgaagattcaacgtcggcaaatttctcttcaattgggctgtagtaagtgacatcctttgttttggcaaaagtgactggttcggccacgtgaacagagctatctgtaagatcatggtagtcaaaagaaaactcatcaatacatgcaggagtatcattgttgagaattgtttcttcatactttttagcaggctcatcaactattgctttggattgtcgataggaattttttcttgaaactgcaatctctttgacactgtccaattttttaaccttagagttgtactcttttaacgtgagtttgggagcttcggggcgtaataacgaagctaagtccctggttgaagacgaggaagaataatgcaactttccagaaaaagttaaaccagttggaagcggcaggaaactttctctttggtagctcatggcattcttcgaacccactggcttcgtaacagcctgaggttttgatgcactggtcaatgtggtactagagttggagttgagattggagttcaagctttttgtggagcttgaagatgagccattgtactccttatagatgtcgattgtgctcaaacgaacgcctagttttgtcaataccgatgatgcagtatcacttacattccttttgtttgcagaagcagctcgtgggtctaaagaaaaattcctcgagttgtcaggtattgaagtgcggtctccagttactgctaatgataagtacgattcgtctttaggtagcttcggcaaattcttagcttccttgcgtttggcagatgtaacaacatttgtggaatccttcagtacattagaattgacctttttaggagtattataaagaggcacgtcattggagacaattgtttcatcttcacagaaaagaaaatctgaactcggatccaacagaggctcctcgtcaaatcctctattggagttaaatatatgatcgcacaagaaagagaaatctttgagttccgacttgttttcattgatatttgcaaaaggaagtcgtggaggagcagctgatgattttacgctattcatcgaaacattctttttcattaggctctttcttgaagatgaagacttcaaagacacatgctttctagacgtcgatgctttaatattgttcctttgaaattttatgggatctttagccaaagattttgagcttaatgaagttggagcagccctaattatttccgtctttgactctagggtgttcccattatcgtctttgatcgtagttgtaacaatgctagtcgatctgggaagagaattagacagcctctttttcgagttccttcttgaaggaagtacatattcactgtggtcatctctgtatttcaaaagaagccgataaaaaactttctctgaagagatatttgagtttttcagcttcgaaataatatcacgtctatcaacgcccttccaaagagtttgaaggttttgtaggatatcttcatccacggtatcaattggcgactcgctgttcacaacattaactgtggactgattgtaagaatgatcaaaattcaacgtgtccgtatatttttgaatcaatggatggttgtagacatccaatatcttgattcttcttgtagggtcaacatgtagcattcttgttattaaatctttggcctcttttgagagatattctggcatcgtgaaaactccagactggaccttgattagtaggtttctaatatttggatcgtcaaatggtagacgaccagtaagaagagcaaacaggatgataccacatgaccacacatcactgggggaaccatggtaatccttacctgcaataatctcaggagaagcgtagtgaggagaaccacaggatgtctccaataagcgttcctttgtttccaaagcagccataccaaagtcagcaatctttatattggagtttttgtctagcaaaagattctctggtttcagatcacggtggcagatgctaaactgatggcagtaactgactccgtcaatgatttgcttgaagtaacggacagcttcagactctggttgccgaccgtttttgattagatagtcaaataattcaccaccttcaatatattccaacacgaggtatagttcccctttattttcccatacatcatagagtcccatgatgttggggtggtttataagtttcatgatgatgatttctctttcaataccgtatggtaagccattggagtcaattctatgggaagtagcggcgatgcccttatctttggctttttgctcaaggaagcttgacttcggcacaatcttcaccgcagctagttggccagttgtggaatgttttgcaagacgaacacggccagtagagcctcttccaagagttctgcctaacttccagggtccgacatggttctttgattttctcttggaggaattggtgtttgttgaagcctgcgataatctcttattggcactcataacactggacacaactttatcaatgggttgatcttgataatcatgttgatttcgggaagccgactgagcagcacgaagcgcaaacgatgaatcgacagtcatattacacggtactgtctagggccgttaaaaacagttatctgaatgtcgacacggaaagatgaaaatgaaaaacaccaaaacttgttcaaaagctgaagaaatattctacgctggatggggtctaagaagctagcaaaatgatgataaaatgaatgtaacagactagtagtcttgagttgggtgactggagagggaggggttggcgttaagatgaggtattgcttgcaattgagtcgtagcaaagaatagtgagatctttcggttgttttcctttcgctggggatgtgtttggaaggagctagagcgcgttggattggaagacaaaaaaaataaaacacggttggataaagcagccgcacattaaagcacatcaggggcagatgttgtatcaattgagtattctgcttaggtaatagtcagctctctgcctgaaggttgggtcactaaaaacggtccagtttcgcgcaccactggggtatcgtgaggacgacattgcagatctaattcaggataaagcgggaattgatagttgatcttcgttcttcctttaaaaacactctttattgcaaaatgatgtcatcatggaagcagaaactgaaggattcaacccaccatttctctagagcaaaaaaagattcctctcctacgagagacgatcagaccttttatagtggtgggtctccaagttcgggaagcgtggatgtcttgagtgtttccaaaccaaaacctgtcttgactagagatagtctcgagcaagctaatcagagacgaaactcttctacagagtcttcaatgtctacacaaactgcagtggagttggatagggcatctcgttccggaaacacagtcaacgtggaagaagaattgaagaacttgagcttaaaggatgacgagcaagccatttttaccaaagacttgtcaacaacggatccagtgatggtcccatcctctgactccaacagtcagctaaattcgacggagaaaacgtcggactctcaaggattcaaaccaggtctcttgacatgcaagatatatactggtaatgacatgaaactccccatcccgttgaagatttccaaagttttaatggataggttgattgagtcaggagttgatgtgaatttgtcaaagctgcaagaaacttgcaacgaacttttgtcagctgcgtctcagattactaacagtgaaaaggacaaaactggcaataagattaactccaaaaagttggaactattgatgaccaaatctattccagccctgatttctgttccctcaatgtatgacccaaccccggtaaagaagccgttgatatacttggtagtcgagttcgacaagaatacagagaccatcaattctatcggaaacactatcaattcacccaaattcaacaatgtaactacttttgatgtaagcagcaatatgcaaactttaacaatcaatgcatttgctcgcctgccatctgttttaatacctgaagattctttgaatcaactcaacgaagaggccaaaaatttgcacaacgacaaagagccttttagaccattgcctcaacatgatattttgattggttctacaagggttgacttgaacaaatcgacagacatttcaaatgcaacatcgagctcaaggctcataaaccacgaatgggtcaatatcattaacccatacaacaaagattgcatggggctcataaacctttctattgacttccatccgtactcctccaaaaaatcaatgagtattgatgactttcaacttttgaaagtcattggtaaaggttcttttggaaaagtaatgcaagttcgtaagaaggataccggtaaagtttatgctttgaaggtaatacgaaaagcgcatatagtttcaaagatggaggtcactcatactttagccgagaagtttgtattgtcaaaagttgacaatccatttatcgttcccttgaaatttgcattccaatcaccaagcaagttgtatcttgtcttatcattcatcaacggtggggagctattcttccatttgctgaaatccggtaaattttctctagcaagagcaaaattctacatttcagagctgctatcagccatagagactcttcatgacatgaacattatctatagagacttgaagccagaaaacattttacttgactatcaaggccatatcgccctctgtgattttggactttgcaagataaacatgcaactagagcaaaaaaccaacactttttgcggcactccggagtatctggctccagagttattaagcggacaagggtatacgagggtggttgatttctggactctaggaacgctactttacgagatgactgttggactgcctcccttctatgatgagaatgtcaaaatcatgtacaagaagattctgaacgatcctttaaagtttcctgccggctttgatccggacgctaagtctttgattacaggcctgttgcaaagagatccgaccaaaaggttgggattcaatggctcccatgagatcaaaaatcatcaattctttgcagatattgactggcagcgtcttctttccaagtcttatatcccccccttcaaaccaccagtgcaagactcgtttgacacgtccaactttgacgccgagttcaccagtgaaagacctttggactctgtggttgatgattatctctctgaaagtgttcagaaacagtttggaggatggacctacatcggctcttcgtcgtactacccataagctaaacacaaaatagaaaaaaaataccaaatcttattaccctatagttactagtatacaaccatttaattatgtgcattaattgtatcgataagaggctctttcctatttttgcatccctcatcgtccggatgccttttacagtattcagcaatcggctgctccacatcgcctctgcgggccttgagctgatccagctccttctcgatttccttataggacgccatctccttttcaataaggtccagcccttcttcttccatctccggggaaatctcctgcttactaaagtatttccgtatgatattattgatctggtagtatgaacacatgtattcgtattccttctgtgccaaatccacgaaatactttatgtaacccagttccttatattgtaacgacccgtcgtcctctttggaacctccgtgagatttttcaaatgctctgacctgctcgttatatctctcctgaagggtctcataaaccgatttgtaccgattgaggtccttagtgagatcattattacaagacgagagttgcagattcggatgcaccataaaaacctccaccattatgagtagtttcacttgctagttgtcaacacaatttcaaaggctattctatttcgaaagcgtaaggggaaaaaaaatctagttcaggtgactagcttatgaatgaatatttctcagggaaaatgagttgcctcttttgcaagattatctggtgattagatgcttgctccgcattctagtccctatagaggcctgaagactcaacctaaaaaaatattaggatctactgcattttgcagggggtgcggcgtggggatactttttcggttattgagtggaagcaactcactactaagctttaaatgttaagcctccacagaactgcaagtagggcggcaataattcgggcttggaacttactcttgcttttgggctactttgtctaggtggtcgctgtaggttacgggctcgtcttcccatcaaagccttggggcaatgtctctgaggctatctcaggttccgcttcttcatgctgcgaattgccgtaagttccgattttcaggaagcacgacaaaactactgcaacaacagaatatcctatagcgcagtaccaggcatttcgaaagccgtccagtaatttcactgggtcgtcgttctgttggggagttccgtaaagtggatttcgggcattaacaacggcagaagaaatagccagccctacagccccggaaagctggatgacagtgttgaagactccagccgcggagctctgtagatctttagagactgatgtcattgttaccatgttgcatacattgtatgctgtgtcagcaccaatgactgacaagctgattgcttggaacggtccagcccagtaaagccggttcttcgacactgtagcccaaattaccgcagaaccgcagaaggacaacgatgctgcgagtaataatattctgcctggaattacatgcagtgtaaatgcaataaaaatgttagttaatatccccacaatgcccattgggaggatgtatgccgttgtaagtaagggcgacctagcttgaacgttctcaaagaacaggatcgaaaagtaagtcaatgttcctgcaaagcagagccaaagcagtgacatgatagtaatgctacgggcgaaccttgagttcgaccacatctccattggcattaggggccttcgtggtacatatttttcccatacaaacagtgcgacgatcaacagcgaaccaactattagtagcgcaatgatgtagggcgttttccatccatgaactgtgacatcaacttgagttagggaaaaacagaataaggtaaatcctgtcaaagagaggaaagcacccatgtaatctaactctttcaaagtagctagtttaccttttttggacagctcagtgtcttgatctttaggcaccgttataaaggccactgttgctaaaagggcataccaaactgtattaaaaaaatggatagctctccaagtagaaaattccgctgcaataccgccaactacaagcccaaaacacatccctaggggggctccggcggcgaaacatgcgaatgctctgttctttctccttcctattggataattggccccaataatacctgccgcagctggagtcccaacggcaacaacaacaccttgtaaggccctgaagatgcatagagcgatgtagttgttcataaaccctccaataagagaaaacatactgtaaagtgtaaatgccgttaacacagagtatcttctgccaaataagtctgctatactccccattaacaacagcaagcttccatttgcaagacctacactgcttatgctccatgttagtgctccaccggcaacatgaaagtggtcagcaactttgttgatggatatttggtaggctcctgtggccatggacgctgcagctggggcaaatgtcagggtgaagatacaaaaacattccttcaaagtggatgaaaaacactctggtcttgggtccacctttgttggtctgggtattttcagcatcacgatacctgtaggctactgtaaatcttcgaactatttccccttaacgtctccctgaaaaaaaaaaacggttgattacgtcattcaagcagaataattattagcagattagagtgattcgaagcttgatagttatacatttgctccaaatgtagaggcttgccgggcatctactggccttgcccactcacttcgactattagtaactccattaaaatataaatacacgttatgtctaaatagaagtgctaaacaaccagttcgtcccataaatagggagtaaaaacaatgatggccgtgtaaagagcacacaaattctcccaaatggctaatggaaaaccaataaggcctctgtcaatatagttcagccaaaggccgtaaaaagcgacgctgaaaaagtggtgaaatagaatcataggactgggtaaaagaccactcagtagatcaacagggtcagtgacacattttccgccacgtttgaaataagcaaaacaaccccgtctaaggatcagtaaagctttagagtcgccatcgaaaagagaaaaaagggcgatcgatagaacgttaatcaccgaactgagcttcttacgttcgtaatggaattcggccaatttttcagaaacagtagcgtcatctaacagatccctaacgtcatataagacccttgccaataaggcagcatcatttatacctacggtcatgcctccacctgtcaatggatgtctcatattgagagcgtcgccaatgaaggccaggcccggaattgtgtttgtctttgcagttaaatattgatttggcatggcacggtaacagtcatccttcgataaagcttctatcaatgaaggttgcgtctcagcaggaaagctaggcaaaacaacttcatttagatatttaagaacatcattcttaggaggtagtttctcagaacggtaagcgcataaaactcgagtcttcgtctgagaaatctggtacattagaataggcgcatggtctcccatgatgacatggccataatgaagcttaggaactattgcgttctgtagttccaaaccaacaaaatatgatccaacttgcggcttcttggacaaaaataactcttttctaaacttagagtagattccgtctgtgcaaattaccaattcagccgtatagttcttacgattcttagagtcgtcctcaacttcaacaccaatacaagcatccaaatcgtttttcagtaatgatgtcacatttccttgcaacttggttatatttggttcttgagttgcaatttttctcagattcatgacaaatctaccatgatggaaagccacccctctaattctttcatctgattcccaatctttgacagaaataccagcttcagtatccttatcgtccttcaatttatcgttaccatctttgacacagcctggaactggctcttctaccaacttcaagtcctgtttgtatgaatatggaattagtacatcctcattatagttcttaaccaggtatcctgcagtataaaacgcgtcaatgtcattgatagcttcgatcattccaagctctcgcaaggctttcaacccagaaggctgcatcaattcgccgacaatcctgtttggctccgaccagtctctctccacgataagcactttccggccttgcctggcgagagccgttgctatgcaagggccaacaactccagcgcctatcacgataatattgtagtctctttcaggggacatacggtctttttaaatgaatgttatggagatggtgaagaggagaaaggatatattgtatggttttcctggtggttttaaataaacctaaatcagcttattttttttatacgaagagaacgacccatgaaaacctcactcatgtgaaaataagacgataaagagagccatctgaaatcgtctcaacacacctctacacctctattcaacttttccaagttaccaaccagtagatatccataaacaatacagtagccatggccgccgctaacagctcttacctgctttggaaaaagtcgttgatttatgggggtggaatcatcggcactggagttctgctctacaagttcacgactccaactgaggagcaacttatcgccagactttctccagagttgagacaggaatatgaacagaacaaaagtcttcgtaggaaagagcaggaagaactaatgaaaattgtcagagaaacatcaaagtctaatgatcccatatggaaaacgggacctttaactccctcatgggaatcgtctgccaccggtccaacagaccgacttccaaagggcaaagaactactggtcgccaagcaagccttcgaaaagagtcaagcagaggaaaaacagaaagaggaactaagattgctgaagaaacaggttgaagaaacgtctcagcttgaatccagcaagggaagcaaatggaaattctggtgattaggtcattcattgtgtacatatatttattttattttgctaatttattcttcaaccccatgcgttgaataacccgggagcttgtttcttaaatgcaaagagaccctttgatgctaaattacttcctgcggtgctgctttcgatttgcaggtttgccttatcgattgctgccactatcttcttgatgtttgtgtctatcaccatcccaccctggacaatttcttccaaagcagcctgcagaacctgccatccaaaaaccaaatctagctcacaaacgttggtaaagcagttgttcagtacttccacgaagacctgtattaggtccaatatacccaattcggattcttggttgtcaacaataaacacgaagtatagcgtggcgtagtgtctatagataactttgatatcgtcataatcctccaataacggcggtggggttaaaaatgaacattggtcttcggtccttgtaattaccagttggtggacttgttgcaatagcagtctctgtgtttcaatatccacggaggtataaaacttcatcaaccgaggaagcccatcattgttgactaaaagttagtaattgttggaccagacggaggaaaaacaatattacttacatatcagcacagaatggatcatgattgatggtgggacagagacggagaactaaagatatccgattatgcgcgaaaagtatcactgtttatcttcaaagggaggcttctatgacgagccaggaccagcagagatgaagctgagtagcagcgttagtggtgcagtaaggacctttacgtacttcatggctagtggttcgcattacatgttgaaggatgttgagtatatatcactttatggtgatgaaccaagtgccattgaacaggcctatgctattttcatcaatgtgctggagatggatgagaatggcaacgtcacaaatatgagtcacgctgagaaaagagccacagattatatcaggtcttattgtgacccatcatttacagtccagccgccttacgaagattgggaagttgcactctattgagaggatctctatgacaatttttcgttttggaagcttttcccccagttggtcgaaaaagaacgatgaactaaacatagtgaataagctgggctaggttgggcggttgctggagacgctagaataaactttggtctcatttccctcatttgacttaataaattctgcattttgtcctcatcactctgtcttttgcttgtggatacttctaaatgctaaacgaaccagtgatgctaaaatcttgcatattatgaaaagaagtatgccaagtattgacaccgataatgatagcaccaataaagcattttctctcaaaatttcttcattgaaaagagtaggaattgagtcatcatcctcaccaaatcttaaccattcagggcgaacgtccacctttttggatctcggtttgttgaaaataggtttgtccttatcgtcattcacagcaagaactggttctgcgtctctgtctttttgatcaaagttcatatagtgacctagattatttctttcatactctgatagtctggtgaggtcaaataaggttatatcgggaaaaataacattctctttctgaagaatctcgttcttcattgatagtggaatcatctgaggatcattaggaatttcgttcacgtttacgagttcatctggtatctttgcaaactcttgtgcagtatctgtggtatagagtaaagttatgaagggagagggcaactctctaataactttcagtaaagtcaagtcatgcttcttaagtatttcctctctctggccttcgtactcttcttcagcctttgaaggtatgcccgtgaaatccatcctaatgactcttgttttactatcgatgaacgattcaatgcttccaggatcatcatccttcaatgtaagcagctttgctctgcattgtctcataatatacgtttgaatcttgtccagatccaatcccttgtgggggtcttcctctgtgaccacagtgtgcgggaatgttagaattgtgcttgcttgaaccatgtaacttcttaaattctgaaaagaatagaaatcctgaaaatcctggacaatcacacctggctggttcaccaaaataaacacattagcctgacatttttcaaggacttggtttatcatgtaattcgtctgttgaagtgtgaaaggttcttgcggagaatgaggtagcttatcttgaattcctggtatcaatttatgcgagaacaaaaacgatgggaacgaggactcgcaggaaacgagctctactacaaatgcaataaaaaacaatccgattttccaacttgatttcatggttcaccgtctttgcagaatattatgctttgtatataaatagcccaaggctgatcttgggaaaacttgaataaaatgtattatgtaatcagagttgctgagactttcaacatccatacattagctggtacctctttgaaaccgtagcataatgtacacatgcattcttacacacacaaacaataaaaatttcagatgagtcacgtgaaataagaaatattatggctcatcatccctagagaaaattgagattagaaagtggaaagatagctactcacttagactatgaccagggataacgacattgagaaagcaggtttcaacaccaaacttgtacatggagacgactcttcagcccgagttcctgatgtcgttcaaccgattaacgtttctactactttcagatacaatgatgatcctgcttccttagtagcagctcttgatctagaaccaggaagcgggatattggataacttgatctactcccgtctctcccaccctaactcagagaaactcgagcaagtgtttgaagggattctagatggccatgtggtcatgtacagctcaggtttggctgcattcatggctatgcttactcactataaccccaaagtcatagccatcggacagggttaccacggctgtcacgggatcgccgatattttcactaggttgaacggcttgaaacaaataggtctggacgatgattatagtcagctaggaccaggagatatcgttcacttggagactcccgtgaaccctgaaggtgtttcctttgatatcaagcattatgccgagaaggcccatgctaggggtgcttatcttgttgttgattccacactagcgcctccacctttacaggagccttttaaattcggtgctgatatgattatgcattctgctaccaagttttttggaggccattcggatctattagctggttgcctggtcactaaagacctagatatcaagcataagctgattgaggatagagtttacttggggacgaacgttgccaaccttgaaagttttcttcttcttagatcactgaggactttcaaaattagactcctaactcagagtcaaagtgctcagcaactggtgcagtacttgcaaaatcacattaaggagttctctgctttatctgctgttcaccactcatctcttcaaaaagacgcctacattaaagaacagcttccgattgggcatagtccggttttctccatcgacgttgactccccagaaactgctcgtcaattaccgtaccgtttgaaatatttccatcacgctacttcacttggaggtgttgaaagtcttgtcgaatggagatcaatgactgataagagcgtcagtcaaactttagttagagtttctgttggtatcgaagatgtcgaagatttgatccaagatttccaccaggccctttccggtctcagtaaatagagaaaatagacgccatacaattgctagaaaactatatcactgttgaaggtttatcgcgcctccatcagaaacgaagacagatcctactatctaattcatactcctaattgtctaatcaatggctagaagaagccagagaatttcagagaaacccatcaaatctgaatcactggacaaagtttcttctgatttagatgtttcggtgcgaacgtcatcccgagtggagaatgatactgattcagattatataaacaccagcaccgtgtctggtgcaagtgatgaaaagggtcaacaggcaacgaagaagaacctttccaaacccaagaaacgatctaagaataaaacggaatcggacagcatacctgcttacttcgaatggcggtcttcaaatccagattacgaaaaacttgatgatgacccatatttagatgaacttcttcattttgaaaacacacttcagaaaatagactcctcctcgagggttacagcattggccctaaaagacagaatattttattgctatgggttcaattttggaatagtaaagtcggttatcgataggcgtgaagaatgggtaactaatgtctttcatccatcggtgtccactgttgcttctggtaagtataacattagggaaatcgatctagcttcatttccagaaacaaactatcagcctttggtgaaaatggatgatactctacccaaacttgataggaccatatccctaaagctggatgactctcaaactatgacgcatattcaccctagtatgctaatagaaatccccaatgaaaacgatagagttgcaaaactattaaacactggtggattcgtcttggaaaccatatggcttcccagctatgtggcagagaaagttccagcataccttctcatttcacttaaggatcatgaccctcaggacggagccttcaatccacaattttctgtgttcaaaagacaacagtatccttctgctctgcaattttacaagatcaacccgaacaatttgaactcaattttgctggtaacaatctacctaaaaactggcggtttgacaaatctgaaagttctttctgctgaagacaatgtagttcagttaattgcgctatccagtgaaaaaacaattcatttgtacaagctcattttagaagacactaaaagtgaaatttgcctgacggtagacaaaccatctctagagctatcagtcaaggatcttttaatcacatcgtttgatatgatatctcctgacagaatcattttcggaacctcttccggtacgattggggagtttgatctttcgaataaagatccgttttctcccgtttacctttatcaaacgccgttacaatccattgtacttctaaagaccaacggaagtgacctcctctacgaagattctctgaatagcgagcttgttgttataacttcaatggactacaaaagtttgatccttgaccttgcagatataataaagcttgtccgaactgctattaaacaaagatattttttaaatcagatagagtactcaccatttgcaaaagtttttattgctaccgatgatactgcatccctaacattatttgctagtagggattctactgctatcatttcgggggccagccatactaacaggatcaacaggatcggaatttcaccactacatccgatggcactatctggttctgtcgatggtgaagttcggatttctaattcctttagtagtatctttttcatggcaagaagcaaaagcagacctgtaagtctttgcctttggaagttagaacattcctcgtcagaggatgcttttcgcttggtttctcatttgaaagttggtaaagctgagcaaaaggtcactttggacgcaactatttttcccaattccatcacgtttacatctctcagttggaatgaatcgatctcaagttgtaacttgtacgcggctggttctgcatgcggcctggtcattttagaagcacttgaatcggggactacgaaaaaataaagtatataaatacgtaataatgattcaaaaactaatctagttcttctacagatattctaaaatcctcggttgtaggggagctgtccagctctcttttgagtggttcaacctcatcctccaaatcttcccgaacaaataccaaaaagtatggagtagcagtatttgactcagaaaaattgaacacttctgaaattggaacttcagtgattgtttcatcattatactttcggtaaatatttctagttgggtctctgatgtagacccaataatgaccatagctggcttcgcctctatgaatgaaaatggcaaaaatggaataaccagtgttcttaaactggtcgaattgatgctgacatttttcttccaactcagaaagtcttgagttaatagtctggagctcactatttaatatatcaatttctttctgtaaagtgataagcgttgattcggtagcttgaatatctccaggtaactccttctgagcctctaaaaattctttagtcgcaatcaaagcatttcttggagtcatagagtgagaacttggtacaagaatttcgtccttacgcctgttgagcttactgatctcatttttccactgaaaaatctccttccgtttcaaaattaactcttcgttatcggtttccaggtatctgtccatgtacaacttttcatggaagggcaagggatccaaggctttgaatggaattcccctttcacgatcaaattggactctctgaacttggatttgcaagaattttggaagctcggtgattgtaagagacctcttgacttgtccgtcatctaaatcaattaaatcttcagtaaaataagtgtctaatgcatcgtagagatccttggggtgatccccgatattgacaagtaagcttacaaatctttcaactttggttctcactgacgagtcagtaatgttctctttggtttctttatccactggctgcaaaatttgcttcgttctaccataaaacagttctttcacaagatcattctgttcttggtcatcggaatccaaggaagtaggtttagaagcactctctagttgaaatagaacattttcaatacattctgtaacatcttgctgtctacctaattcaagcgcattctccagttggtcatttccaatcagagcaacagccgtagtagctctcttaggtaaagtagtcgtcggtggctctgcgttagtaacagaaactttggtatcaatttcattcaagtcctcggtagaaggttgaggtgacagctttcgctttgttggtgaatgtataagctcactggactcgtcaggagagttcaatgctgctgattcttcatggtgagaagatgatggttcgggataagcaatagaggaactccagtccattgctactggtgaaagctcgggcacaggagcatcgctcattccagtttcagattcagttatacttggtcttggtttttgtacttctggtaaatgaaactgaacctcatcagtactcggagaaaaggctagataagctagctctttggtaggtgtaatggctatacgacgggagtgtatcaactcatcaaatagatcacgtaattggtaaacaaactgaaaagatctttcggtttccttatatccaacagtacgaccaccaattcttctcttagaatagtcttctatactattaaactcctcttcgcttgaaggtaagatatccttgaaattttgaatcgcagttcttaatggttttatcacaaaataatattgaagtaaagagttcaaataacatgtattaccaatattgttcaggccaactggtgaactctctaaaggcaagaaggaagcatcaacgacaccattttggagaaatttgccgataagtttactgcttctagatttttctatcactaccaaagaatagaaaaaaagtatcacatcaatacctggatccttaatcagtctctcctgaaatattgtgacaacttggaaatctgttgctaatggatcacagccgagatatttgtacgcatcctcaacacctgttattgtcttactagatgatgcaactataaccttgaaaagatagtccaagttatgggtgatgtatgaccacaaaaatagactttttctctgaattgctatggtaagtagagctcggtcataaagagcaactgcttgaggaaaatcatccttcttgaattggaatgcagtaataagcacgtcgtcctctatgctttgtggagtgtcaaaatgtttatatgcctggtcaatgttatgaataggttcaatacgaagatagttctgtaaagcttcgcttttgcgatagtctgcaatgctggataacgcatttcgcagtctgtcgtagcttgattctgagttagcgaggatcaactcgtatttgtagaactttaagatttcatcatcacttaatgtcggaaaatcagcagaggaagtgtcaattccaagtatttgataatttctcatagtatccctgaaactgaaaacgttcttgctagcttctttggcaacaaattcttgcactactggggcctgtctaagaagaccaatatctctcaaggcatcaaaatatttgggagtgttctgcggatcagattcgcagagtaagctatagctaccacagataagtttgttattgaaataatttgccgaaaccaaggttgttaaagccgggttgtagcgttctaaaacatcatatctcaaaccaccaaaccattcgattgccgcagtagaatcaaactccttcaagaaatgaaatattttagagccagtatcgttaaaccaatatgcttgggcaaactggttaagtcgcttcagccccggattgttggggcaaattgtacccaggtacacaacttccagtaactttcggatgtaagattcccttactagattttcgaacactccatactcggaaaataaaggcggcgtcaaatagcttccatctgcagacttgtggaaaaaaaggcatttctcaaaaatgtccatgtctaggtgtatattcagaattttgtgattcacatccagagttttaacttccaactcctcgggatcacgacttaatgggcctcgcaagaccttgaatagagtccataaacactctgattgggagggtatcttattgacgtcgttctcattagaaatattcaaagaggggtctgcagaaaccgttttgctgtatctgaactggatctcgttcaactcaaactgtttgtactcttcattggataggtccttctcaaaaatctctatccttaaaactttgtaacattttcgacaaatatagttggtggagtctagtagtttggggcatgattgaacaattgaaggcttgagatcatcttcacagtcggttaactcacctttggatatctttgcatagtctgtgaccagatcggaacgatctgatgggctgagggaatcgtcagaaaaatgaaaaaattgatgcttagaacaaagtatctcattctccaagctcttgaacagtattctgcaatgatagataggtatgtctgagattggtatgccatgaacagtgtcctgtactatgagtccgcggaaaacggtccttgttccatttggtagttgctccgtagacacagtcggagcaaagtctaattgattgttcaaaagtactaacttgaaagactcatttatctgcctgttttgatactgtaaggataattgggtggcataatcaacagctgggaggttcaatatggagaactgctctagaaacagcacactgttcttgatatcatcaattaatcgattggaagtcttgaaaattttggatttcgaaaaatcatacgcctccaattgtgcaaaaggattgttcacatttgtgctagcactgggaacctgatctggcattgtcttgcagtagtgttcggaattagtgtcactttggagagttgagatatttggagattttgggttgagggtctggtgataggagttcagttgaagggggcagtgaaatctgcgcaggaaagattttagattacacgggggcactttgcgagagacccgttggggacccgaaatcacggaggcagattagcctcaatcgagatttttcagtgcttccctaagaaatcttggacttgacctcttcctgcaactcatgaactcgttgcctgcaactgccaatagtaacacgcccgtagtttccttagagaaattgaaagaaactgatggttcgtttaaaggaatggcaagtggactgttagaggatgtcatgaaagggaacccatattttgctgctggtgggggcctcatgcttttgggtacaggactggctttattaaaaagtggaatcacccgggttagtggcttagcctacaggcaaatgctggttgatttagaaataccaagcaaagacaaatcctacctttggttcctagagtggatgtcacaatataaacacagatcttcaagacatttatcagtggaaaccaattacactcagcacaataatgggtcgatcagtaccagtttttcattggttccaggtccaggaaagcatttgattaaatatgaaggagcatggatgctcatcaacagagaaagatcaggaaaattgctagatatgaccaatggaactccgtttgaaactatcacattgactacactctaccgagacagaaataagtttccttcattattggaagaagctaagagaatggcattgaaaacacgagaaggcaaaacagtgatctacacttcatggggtcaagaatggagaccttttggtcagcctcgcatgaaaagactaattgattccgttgtgctagacaaaggcattaaagagtccataatcgacgatgttcaagacttcctgactagtggacaatggtatcacgatagagggattccgtatcgtcgtgggtacttactatatggtcctcctggaagtggaaaaactagctttattcaatctcttgctggatacttggactataatatttgcattcttaacctcagtgaaaccaatctaacagatgacagactaaactatttaatgaaccatattccagaacgaagtatattgttgttagaggacgttgatgcagcattcaacaagagatctcaaacagacgagaaaggatacagcagtggtgtgacattcagtggactgctaaatgctttagatggagtagcaagtgcagaggaaatgctgacttttatgacgtcaaatcaccctgagagattggatccagccctattaagaccaggtcgtgtggactataaggttctcattgataatgcatccatttaccagattgaacgtatgttcctccgattctatggggaaacacacagagagttgtgtgacgaatttctggagcagttcaagacgcttggtcttccgaccgtgtcagcagcacaattgcagggactgtttgtctacaacaaaagggatcctaagaaggccatcgagatggttgaagtgctcaaacaaccgaaccatgtattttgaaacacaaaatggggctttatctgtaaatagtgaacccacctaccccctgaatagtttcagagtactctcacgagcttccagcaaatgttttttcatgactgtggaggagccatccctttgggccaacctcgtagcttccttggtgagtctatccatgaactgtatgtaatgaagatgaactaatagagggacattggatgttcgtttcaatgaaaacttcccctttggattcttggactctttagaactagcaaccttagctattttcttggctaaaatcgtgtttagctttctgtccatttgcctacgcttatcaattagtgggtagataaaaaagaaaaagaataataccaggtagatcgtgatttcaacaccccccaggtagatcaatgaagcagtagtgtgatcaccgctgtagctctcatctcatcagcattgtgtttacacaggcaaccaggtttttcatgaatagtcgtgcagtcctcatatgcaatcgcgcttgtttctgctatttctagtaataggacaaaaaaaattgttctcccgtcctatcgtaccagtggagctttgcccttttcctgagactacaaaaccttctccacacaaacccgtccaatatatttgtgtgggccattttttgaaaaatgcctgaccatgtggagttacaagaaacctccagttataatgacggcaggactgaccgtccagcatctcggagtggtgccactacaatgtccacaaaaacctcatttatacacaagttatactacatgttagaggacggatcgatgaagcaccttatatggtggcttcccagtggctcatcatttgctgttgttcctaacgaggatttctctaaggctttaagtcactactttaaacatactaatattgcgtcgtttgttcggcaattgaacatgtatggattccataaagtcaatgaaaatagcagcacaaacagttccaataacggttcgacgcttccactggactcagtcacacaaactgagcaaaataggagccgtgccagcagtacttcgtctaatcccaatggtttgtctgtttgggaatttcgtcattcaagtggtttttttcaacagggaaactcggaagaccttaaattgatcaaaagaaggtctcgtcaatcaagggaaggtgctccgaaggggaaagatggtgtagatatcggaaatgagtctaacacttttacgcccgctcctgcaatcggtccgcaagctctgtcagctccgtcaggcgcagcacaggtgtcaactactctggagcatccacccgtgaccaatggtttcagtgggtctaatggttctatggcccctagttcccaaagtcttgcttccacctccaaccctatgactgggactaatccagatgtacagtcatacactcctcaacattatactttgaattctccatcgaatacagaaactaatgatgaaggacatcctatgtgccaaaatactgaccctaactccaactctttgactgataattctggtactaaacgttttggaaatgagacgacaacaaacaaatcagaattgggcgacaacgttctcgccaagtacaatgatttaaataacaaattcattgagttcagaaaggattatgatattcttcaatacaaatatgatctggcactggaggaaatgaaaaagtcgaactttgacatgattaacctcatcaatttcatgaaagagtcaattttgtctaggactgactttattaggaaccagcaatctcatccttttgacaacgagaaaaattttgaggccgaattggattcatttaaaaagtctattctggaaaagtgtaatgaaagggacttagaattgcgggacagtattaccaagatgactcctccgatgattcaacccgtagttcaacctcagagctatcaatcacatcctaatcaagttcaatatcacccttatcatgtccagatgcctcaacaaccttttcagcaaccaaatctgtctaatgcttaccatcagcagcaacagcagcagcagcaacaacaacagcaacaacagcaacaacagcaacaacagcaacaacagcaacaacagcagcaacaacaacaacaacaacaacaacaacaacaacagcagcagcaacaacaacaacaacaacaacaacaacaacaacaacagcagcagcaacagcagcatcagcaacaacaacaattgcaacagcagcagcaacaacaacaacagtacccacagttacatgcaattacccaaccaccccagctaccactacctcaagaaataagattttactccgtatcctcgtcctctaagaaatctaggaactattcggtcatggatcccctccatagaacatcagagcaaggacaacaggtaatcggtaagcctcctattgaacagccacgcgccgttacacctaattctccaccaattaaacatgtaacaccagctcattcttttagtccagttccaccacaaattgcgggatcccattcaggtcaaattcctccagttttatccgtcccagaaaacagaccacagccgtacccacagcaaaatgtggaaaattctcatgatggcgagctcaagaaatattcttcaggtagctcattacctagaggtagtttgtcctcggtatcttcacattctcttgggaacaatttcagcgctggctcggtgacaactttaatggaagagagccaaactgaaacgaaaaggccttcttactccttaattaatccacccagatctatcccggagtatgagctcccaaataacaacaataatattaatagacagagattaccgtcggcgtcatctctgactagcatcatcaatatcacatccaatcctgcatacaaggacaaatatcgagctccaaatgctcgtcataatagcgactatcagtaccaaaggcaacagtctattggctctcccagctatcctcgtttaacggatgacaataagagatcattactcacaaatgaagaggaaaatgagaccagaaaacggcagagatcaatgatggatactaaatgagcgttatgcctccataatcagtctcgtgtgaaaatacaaatctttatttctttcaaattcatactcttgttttaataaactatttacttttttcattgtttgcgtttctggcttcgttcaacgattgagctaggtcaactccaaacattaccttgatactatcaatgtataaactgtaaggtccatagatgccatctgtgattcctattcctatgctcttgattcgttccctctccatttccccgctgatttgacttaatactcttcctctattagttagcacaaaatcatctagattgatgatgattgtctcccattgaccaggtttttggaagaagagcctgtgttggaacaaatccgtttgagaagcagagtcagtttggatattaacgaaaaaagatcgaagacgggtaccatcttttgaattactcggtgtgaaacattctgtgggttctattttgcactttaaaaccatgcattgatagggggagaaatcccatctaaaattggcaaaataatcacttagataaaatagcttgtgttggtatgcgttcttatgttttgtgcgaaacatggcccatcctgagtacattacttttgggttgttagcaggagtatccaagttcaagtttccgtgaaaatgagcgcatttattgtctccatttcttgcaatatccagatttacggtagaatatccgcctaactcttggtcgcatctagtaacgactttttctaattcatggttattcttgaagtctagaagagtcaaagtgggagttatgtctctgggagcgaacgtctctttgaacacttgtttaacggtaccaaatactgtcctcaaagacatatatgttgtgatgttgacgatggaggggggatgagatggagagtaaaggcgaaagttaaaattgatagtcgagggaaaacgagatactacaagcaaaagatgatgctcaaacgactacagaccggacacaccaatacggaggagctgttgacgactatttagggaattaatctattcatgttcatttcatgcacaaaaatactgtgttcttttcaacgtttaaaactaaatatgcctctttcaataattgtagactgtttgaagtattctcaaacattttaccttcaaaaagtacaaaacccttccaaatttggtttcaccttgcatgtaattcaagtcattaaaatcgttactttgaattccctcattttttcccatcctgataagtatcttcgtaaaagccaacaatatcaaagtaaagtaaatcctgacaccattcaagaggacactggatgcaattatgacgaatagctcgcgagcttgagaagccgactggacgttttcatccatctctcttttgtatggttgaggtactgtgctgtccaatgggttaaagtctggagttggggaggcagtaaatgaggagaacgagagggttgatgttgcagcagatgcaatactttcgcttgcagtagttgcggattctccaaacgatggtttatttatagtagtatcctcacctccgtaagtaaaccactgcagagcaaagtacaaattggataacagtcctaagaacgtatccaatacgtagattgttgtgactaatgaaaacatgcctattcttggagaaaacaactccttgaacccatggaaataaagaggtagaacaataacagatgaaatataaaacatggcttggaaaaaatctattgggtggcctgtgaacagagagagtaaaccataaggtccgctcattttgtttattatggcgtagcccagaatgagttctactccaatataaagcgggaagattcccaaaaatttctagatccgatgttagcacaacaaacaagcaaaaagtaaaagtagatggaacataccttgggcaaagctgagttaagaaaccccatcaactgtaacaactaaaactatgaaaccaggttctttctttttcttaaaggaaaatctgtaaacgaattttgtcgtccctcgcgatggaaccttggagggaagcagaaaaaaaaaaatgaaataagaaaaaagaatattccgcctgcatatgagtgacaaagaatcggatagagaacaggaaacgcaaaacacaaaggccaatatcctggataagtatgccaatcgaataaagacggatgagtttgttttcaaaaaatcaaaaacgtccaaggacaaatctgacagagccaccgttgagaatgtgctggacccaaggacaattaagtttctggagaagttgtacagaaacgggactattaccaagctgaatggttgtatcagtacaggaaaagaggcaaacgtttatcatgcggtgaatgaaacgaatggcaaacaatatgcaattaaaatctacaagacctctgttctgattttcaaggatagagagagatatgtcgatggtgagttccgatttcgaaatacaaagaaccaacacaacccccgaaagatgatcaaaatttgggccgaaaaggagtttagaaacttgaagcgtttgcattcctcaggtttgattccaactccagaacctgtggctctgaagtcacatgtgttgtgtatggaatttctgacagaaaatgaagagtcaccatctcccaaacttaaagactatcagttcaaagacacagaagaagtaggacgtttctaccagcaaatgcttgtttacatgaggattatgttccaaaaatgccatcttattcatgcagatctgagtgaatacaactctattgttcataagggtcagttgtacatatttgacgtctcacaaagtgttgagccagatcatcctatgagtttggatttcctaagaatggatatcaagaatgtcaacgattatttccagagaaaaatccaggtttatcctgagaggctagtcttccagtttattgtcaacggttgggatgcaatcaaggaaaaaactgacaaaaatacagtcttggaggaagagaatgaacagactttatttcaatatcttgagtctctccccttgaagggagaagatgactctgatgctggctttgaggatgacatattccgatctatgcatttggtgcgatcattgaataacctggaggatagagatttccaagagtttgcggatggtaaaatcacaactttgaacgaactagttcaagatattaaccttgaatctgattcagacttgagttctgactctgaatctgagtcagactccgatcttgatgccgaatctgattcggcttccgactccgaaaaatcctgggaagagagggatacatctttgaaaggtaaaagattcgaagataaagacgaaaagaaagcaagaaaacaacaggcaaaagagctgaaacaggacaaaagaaaaactaaaatgaagaagcatttgaaaaagaaactaataagaaaaaccaagaaataagcgtaaaaaataataatagattatgcatacagaactaatgaaagcagttttagacactccctccggaagctccatggtttcctactagaccggccatttccagaaaagccctttcctctcctaacgtatcggcatttattctttgcctggccattgcctctttttcttcccaagcccatcttttggcttgctctaacaactctttctctgaaccgcatccccagacttccaaatcggatattacaaatcggtcttcgtaaactggaatagagtcgtcttctaggaccatgggattaaagcttcctcccttgcccaaatgtctgaatacacaaaactctaatccagaatcaatagtcagcgacacattaccaggtctaaacttagtggtgttgtttttcaaatatggttcttcattgccaaatccaatcccaccaccactagtattgaaatagcaataatcttttcgaaatgtagacgacttgaaaacggcttgccttggagacagttgaaatatagtcgttttgctgtccccgaatggctctttattggaagttttccaatgctggttcaaaaacacagcaaatgtaagtctggctgaatcatcattagcatgatcaaaatcactacccgtttcatcctcagctgctctggaacgtggaaactgttcctcaaacaataaatatctcttagttttcttagaagttatacgatgtcctgaaatgaatgtaattgttggggcattccaattgaaacatttagattcaaatgatctcatggaaaaccctgattcagagccaacgtagagcttcctgagtctactgtagcagagctcgagtggtaacactgtagataattgagctagtgagtattcgttgatcagcttggtgcttacagaaaattcaggggttacatcgctggcacccttcgattgtttcatgaacaaaagtgaatccaataatgcgtccaagggatgaagaacattaggcattttggtttcgatagtcgatatgaacgctgcgtacccaactgttttggagtgaagtgacctctcagtaattgatgaatcaaaagatctcaccagattcattccatgtgacatgaagttagaccattgtgataggtgttgtgaatagtcagacattaatggccttgagatggccagcaagaaagttaaaaaaatggcaaggttataagccgagactttcctttcctttatatttgtattgtcgaaatctttgatcactttgcattgagcccaatgtatattactgtcgccttgcaatgctagttccaacacaccagtctcatcgcatgatgaatccaaattcttttcaaccaaatccttgggttcactcaaaattgaaagcaccaagaatactaagtcctcaaatttataggagctgtcacccttgaaaagtttaaaaaacttttacttctcgatagaaccacacttcggattaacatgggtaagctgatgccttttaatggatcaacggaattaaagaatggaaaccatccaagcacacggacgaagtcatagacaacttcattacaaggacagtcttttggtaggcccagtaactgaacagtttcgtctatggatagctgtttatcgttgttgatgtcccgtacatgtaagttttcttttaaactgtaaacctcaattggggttaataaggaaaggcagttcttatcgaataaccgttgtaattgacccttggacaccttaaccgtacggtagtcttgcttcgtttcttcttctgaactcactgactggcccatagcattaaattattggttgacttgacgatgtggggaatgggatgagtttgggttccactggtacaactccgcgcttgtccacatgataatgtatgctacttacgtaatacaaaagcaagataagtttgaacgaaattattttacagaattggatctgtatataaccttgacccataagttgctctagacctaactgagaagttacactaaatttcaattccgactagaagactatgattcaagctgttttttgcatgtttaatcctagggctctgaatgttcgatgaccatctcatcatcagggtacgcgaattatacgttaattttttttttttcttttcgttaagtaggtttttcattcaaagggcacagaccaagatggcaaaaaaacagggaaaaccttctaaagagaaggatgtatttacgtctgacgaccgtttcaagtccttatataatgatccacgtttttccatgcccaaaaaggaccaatttaagatcaaattggatgatagattcacttctgatgatatcaaagattacagacattcagcaaagattgaccgatatggtagaaagcttaagggtgaggctgcgaacaatgactttgaaagatattatactaccaaagataaggaactaaaggacaacaactctaaagcagaggccaaagatctcaagaaagacgatgaacacagctccgaaagcgatgaaagtgacagtgaagaagaggcaaaagtcagtaaaaattcaacagttgacattaaagttcatattgacaaagcggatgatcagcttattgatagagctagaggtgaaggtttttatagttcctctgatgaagattcgtcagacgatacatctgaagaagtctccgaggaagagcttgaaatagaatctggaaatgtggaggagggtgaaccatccaaacgtcttgctgttgtgaacttagattgggatcaagttagatcacaggatttaatggcaacttttgcaggatttgtcccatccggtggtaagatcattagggtagatatattaccctctgagtttggaaaggaaagaatgcaaagagaagatactgaaggtcctcctaaagaggtattcaaatccagcaagaagtcaaagttatctcgtgccaattcttcggatgacgactctgagtcatctgacactgaatcagaaatcgaagatcttgcagctgctgccaaaaagctgtatgaggaagatgatgagcaagattacgattccaagagtttgagaaggtatcagttgcaaaggttaagatattattacgctgtagtgacctgtgattctatcaaaaccgcaaagaacatatacataaattgtgatggtacagagtacgagtcgacggctaatgtgtttgatttgagatacattccagatgagatggaatttgatgatcgaccaagagattcctgtagtagtgttccaaaaaattacaaaccaaataactttacaactgatgctttgcaacactctaaggtcaaactaacatgggatgagactccagttgaaagggtaaagatggctcagagagccttttctcaaaaggagattgatgagatggacttcaaagcataccttgcctccgattctgattctaattccgatcaagaaagcaataagaaaaacttgtataaaaatcttgctatagaaagttcaatgctgggatacaaatccatttttgacgacgttaaggagaacgggtcggaagatgtggatatggagattacatttactccaggtctttcagaagctgaagcattgaaacagaaagcagagtctgaaggaagagaactaagcacaattgaaaaggtccaacaaagagaaaaggaaagaaagaaacagagaaaggaaagaattaaagagctcatgaagaacaacagagaggccatcaaggaaagtcgcaggaagcctgaagagacaagagagcttgttattgagaataatacagacgacgaagatgatgatgctcatttcaatatgaaagacattgtcaaagcagaaaaacagaagaagagaaagggtaagtctaggaccaagaatattgatcaagagatgttacaggatgatttcaaaccagatttgaaagatgaacggtttaaagagatttttgaggaacatgagtttgcaattgatccaactcaagctcaatttaaagagactgcaactatgaaagagatattaaaagaaagatctaagagaagtcatgaaagcaaaataactaaatcaaagaaacaaaagaaagagaaaaaagaacctgttgagaacggtaatgacattcggaacctggttaaaaagatcaaaaataaaagcaaatagtagacaccagttattgtataattagtaaatagagctgtctttattcatgaccttaccactctggaatggaatctatctctggcgaagccactattttggctttcttagctctcaaaagctcatctaacatttgagtctcgtcacctgtcctatccctcagcgcaagactacgctgtaatgaagagatcgcctggtctaaatctttgatcagatcctgatagtcttcgcatccaatactgaatcgtagcaagtttccatgagtaatacactcttttgcagattctggtggactgacgaagttcctgcttttatgggtaaactctaccatagtttcaataccaccaccgccagtaacactgctgttgataaacttaaatcttgacaagataagttcggcatactcttttgatttgaattccatcccaaatacaggattatagtaatttctcaattgttcttttaaaaacggagacgtttgctgggatgaatggtgaattttttgcacaatagtataccttggagaatttttgattagaaacttgataattttctctgtattatagcactgctgcaaaattctcatcttaaaggttcttaaacttctcaacaataaaaaggagtcgaaattggcaatatttgttcctagagagaacctttgatcgatcagttgtcgcttgatcttcttatctttacaaacaataaaaccagcaagcaaatcagaatggccagagaagtattttgtggcactgtgtaatatgtaatctgctccatgttgaaaaggattttgcaaaggaggaggggccaatgttgagtcaaccaataaaagagcccctttttgatgaactagatttgaatacatggaaatgtcaagacagtatccttccgggttcataggggattctataatcatcacatcacctgcttccagcagcccaaaatctcccagcgtatactttcgtacgccagtcagtttattaagcagtttgataacttcatgagttccttgatacccgctgttgtttatgcatatttgtcgtgggttcaagtaagtcaataagcccataatagcagaggttccagaattgtatattgtgacaaacccttctgttatattctctaaaatagtttcgactttttcactattaggatgagctgatcttgaatatgtaaaattttctagaacgtaagacgacctagctggctgctgaagcttcaatttgttaggatcatttgaaagacttgatgcaatatcaacaactttagtagcattattaagcggtaagttgactgatggatttaatggattttgcattggatgagaatcattatgtattggaagctcggtaggctgtgcaactggtccatttaaagaatttgagcttgcaataggacctccatgctgttgtaattcattattatctagtattgaagtaaaattttgatctgagtgaattaattttgtgctgaatcccacgcctgtatcaaacagtgagtctagggaaaatagttcatcagaagcatggctggatggtaaaacaatatttgaaattgggagctctgatctctcaaagtttggtgttctttctgatggcggagtagcagatagttgcggcctatcactatttagcttgtcatctaccctttgccttagtgatttaagaatggcagaacttaaagaaggagcctcagcgccatgcaattgttcggtgtgaaactgaaatcgtttaagtattaaatcatctttaataggaatgccttgttctgctaacaacaaaatgtcagattcaactctttcagtgatttctggatacttaaatctggggaaacgtgtaaaggctctgctataaggggattctttgtagtgtttcctcaaagcatcttctttgatgacccaggtagacagagttgcttgcgaaattgcaaacttgtttaacttcttgaacttggccaagacttcagtttgggatctaatgggaggaccatgaaggtagtccaaaacttcgattttctcagcaatggtggcacgacgtaacttggcagcctctccttggttaccaagctcattatctggggattcactggacttggtgagaaatgattccatgtgaattcctcgtaaaacagtttcaaaaagaatttctgagtcaggacttatcctttcataaatcgctataagatgtttggctaacagtacagtgctccccgaagggtttcctgcatagctgagatttccccctcccactgatagctcgacctcagggccccgccgcgctcgataaatcgctgccctgaggtcgtgtgtccagattccaatccacacaccggatacaatttcaattttgttctaactgcatttgctacccatcatgtcagaaggcctacaacgacgccgtggagtcaaaagttccaacgactcttctgaggctctggatgtgaacaacaaagaaaacaatcgagtggcttttgatccgcaagacctctcgtcaaatagtcgtgaagttcaaagtccaatgttgacgttgatggaggaggtccttttgatcggacttaaagacagagaaggctatctgtcattttggaacgataatatttcctatgccctgcgtggactaatcttgcttgaattggcctttagaggtaagattcaaatggtcaatgatcctgcccgcagaaggtttgaacttcctgaccgattaatcgaggttgttgatggttccttaacaggtgagatgctgctcgatgaagctctcaaactgatgaaaagtgatcctacaaactcaagtgtgctcaattggatcgatttactcagtggtgaaacttggaatctaatgaaaatcaattaccagctgaaacaggtcagggagagattggctaagggtctagtagataaaggagtgcttagaactgaacgcaagaatttttttctctttgatatggctactcacccaatcagcgatcctcaagcaaaaagacaggtagtgaaaaggatgctcaacatgttaactaatagaaactacatcatagagaacgatcccaaatattttgctaaggaatgtgggtaccagcatcttagaagtgtggccctagtatgtggttgttatgcaggaaacgttttagagaatgttgtctttgatctcaactacgaacagagagatcgggctttcaacagagctgatgagttgctctcgcaatactcggattatccatttgaaaacaaaaaaaataccttaggtattggtattaacctacatgatgaaattgaagctgagctagatagggatggtcgcaacgagatgatgttggaagtgattgctgctgtaattaatgtattcagcaagatggattccatactttaaaggagagaaaataatgaagaaatattgaagcaaactcgtgaaaaaggaaacacgaacaaatgaagataagattaaggtcgtactaaaccagtcctttcagggtgttactttttttgtagaatgcactcttggtattattatcttggtgctgggaggatggcactttgagcagtgtttgagtaccacccagttcatccacaaagttcaaaagtagagactgttcgggattatcaaagtaaaaatctccgcaggcttcccaccacatagctcctccataaccattatttttcacaaacttagctttttctcgtacaactcttggagtatcatatgaaacaaacgttctagatatgggttcataactgtacgcagcgacagcctcagggtcgtacttttcattatccttgaaattttgaggtagcatattgtaattgtatatgccttcctcatcggaggttcctttaccaactcctttgaacttcttattgtatccatccgtgttgccgaatccacggccatagttaggtaatcccatgatcaatttattgggcggaatagcgtttctcacgtagtaagccatcgcatctttcacgctcaacatttcaccttttggcgagtaaagattagagtgatattcagtttgtggggaccaagagccagcaaagtcgtaagtcatcacgttccaaaatgaaacaaacaaatccaatcttgataaggggtagtgctgtaaggtatacagagatgctggagtagccaacgtgataagaaatgtgtctggaggcaattcgtaatgagcttccaattgggatagcttcctttttagagaggaaactaagtgcagtaagaattgcccttcttcatcatttgacgggtattcccaatctagatcaacaccatcaaacccaaactcctgcatggcagagacacatgaagacacgaactgctcaactttagattcgtctttcattaaagccttgaacccgtcggtgcgaccccatcctccaatggacattgaagtttgaagggaaggtttgatcaatttcatttgatacaattgtttgagggctccaacggttttcttactgaaatgaagctgtttcagttttttggcttctgcagtaccatcggcgtaaagggtcttgatatcgtcactacgaggtgaaaactttagtggcatctccagagatgaccacttatcaatcacaaccaccttccccgtttcacagtcgatgtcgaagaaagcataaaacacgtttgtcagttgactaattgggagatcggagggagtaaaattacgaggttcgtaaacagaccaatatgaaaaataggcacacgttctgtatgacaacggcgcgtgaggagaaccgtggattacttgctgctgttccttctgttctttatctaatgctttcattgaatctttcaagaccttttgagtttgtcgattatttgagtctaacgtggaaatgtcgccaaacagggcaattaacgtaaaaagtactacgccggtgccagagattagtacgaaatcgagatggttgcgcaaaaacaactgggcaattttcattcagtagaaagaaagatgtttatagactcaattgcaaacaacgaataaaatggtggcttgactgattgagctatggagttggcacaaaagacttgttggagaagacttctcgatctgagttttgtccattgtaaacttatctggggaagcgtttattagtcccagctgaaaaagggaaaaaacaaatttccttgatagaaagccaactgcactaaagcggctacccagtttatacttgctgcctatccttacttcatccgttccattccttcctcttagtggcctccagacactcttcgccttgaactagatatctgaacttgatagtgtaacacctttacaccaagaatctggtatcctactcgatgatgaaaaaagccaacctaagagggagagaataacaaacgacatgtcccaggaacttgagcagaacagacactctggagaagagtctcctgatccagttttagatgcgaataccagtgatgttgatgatgatgggttagacctttttggagatgacgacgacgaacaacctgaagcaaagccaggtcaattggacgattcaagcaacgacgctgaggaagatgaacaagagaaagcaggtaaacccgaagctaaagtgacttcacacacaaaatccgtatatgataatggggaaaccctagatatctctctgcctatacatcccaagagtcacataccccaagggaagcaagacagatgggtagtaaaattgccagacttcttggacatcaatgcggaaccattcgaccctaggccattcgaaatgaatgtcaaaacacacgaagataagaatcaagaattgctggacaagcttatagcggtgaatactgtgaggtggagatatgccaagtcggaaactggtggaattttcaaagaaactaactcgcaaataattcaatgggaagatggaacgtactcgttgagggtcggaagcgaaatttttgacatgttcaccactaatactgatgacaactatcttgtttcagaacataacgaggaggggattttaatgacagagtccacactatccaagtctgtcaaattggttccggcttctttccaaagtactactcatcaaaaactcgcaaaggcactttcagccaaacagaaaaaggaatcttatgccaggagcgtcgttactaaggaagatccagaggaaaggcagagaagattggaatctcaagaaaatgaacgatacagattggaacgtagaagaaaacaagctgaagaagaggaggactacgatagttatgccgtgagtacttcaagatcaaggccatcacgtgcctctcaaatgtacaacgccgccgatgaagatgacgatgacgatgatgttgccattggtagaactctagctagcaggcgaaacaatgggtacgaagacgatgggtttattatcgatgacgaagaagaagaagaagctgttgaaaatgattccgctgatgaagagtctgaaaatgaaggtgatgatgacgaagaggatgacgaagaagcagctgaaagactcaaccgacttaagagggctggagcttcgaaatatactaatgagggcgaacaagcacaatctgagccagtcaaatcggaagaggccgacaacgccagccaaagggacgatgcgccgcgcaagaaaagaagggtcatcctagacgatgatgaagaggaagaggagtaggtattgtctgtataatagtaagaactataatctcatctctacatagaaagtggtcaataagtatgtaaaataaattatacgccaaagcgccgggtaactctgtttctggattcggtttaaagacaatcacaaccttcttattgaacataacctaccagattgtcaatataccactacaaagagcccaataaaatgtcttggaatggtatgtaatgaactcatgtcaatcaatcatcagccaccacagcattggctatgagcattgtggcccttgtttcaaatgaaccatcctcttcttcctactaacacttcgctttagcttacaccgataacctcattgccaccaacaaactagatcgggctgccatctacagtgctgctggagactcgcagtgggctaccacaaatgatcttactcttctcccgaacgaaatccaagaattggttgctggtttcaaagacccttcagggctgcaagctacaggattgcacatcaagggccagaaatactttcttttgaaaaatgatgagcgttccatctatggaagacatgagactgagggtatcattgctgtcaaaactaagcaggccatcctgattgctcattaccctccaggtgtggaagctggagaggctacattgattgtagaaaagttagctgattatttgatttctgtcggttactaaacagtgttgatttcagtctttaatatatctatttaggtagatctttaccctttctgtaggcgcaaccgtaagggaatatcagaatgttgtcaacatcccagattccagattttgcgtagacatcctttttcaaaaattccaatgcttcttccttggtatctgcgactaagttgaaggcacttcctgcaaactctgagggtttgccttcaaagtctaatccatggtatatagcccccgcattagtgacaataccagattcaactgcgggtggaatgtccttgagatgtaacggtctcaattcagttctgtctgtacctggcttgtcgtacacaattgctagccactcaaccatttgcaaactgtttgttatcaacgaagagtaagtagaaggggtaacactatagccaatagttgagacactcgcttgatttaggggatcgacatagaaggggtgatcatttaaaaactgccccgcgtaattttccaaaatatcaagtaatattcagactagtcgcgcataatcttcataccagacgtaattggctgaaccttcaatctccagacagaccaactagcatcatcagaatgttgacaaggagaagcgttggtttattgcaatcaaccaggatatctcctgttctgaccaatttcagttcgtctaggttttactctgcacatcatgaatctgataaaaagcacgacgatcaccatgaagagcaccacgatgaacaccatgatgaccaccacacaccgctaggtcctgctgagaatatcttcaacaagtggaatgttacgccctttgtttggctgtttgccaccgtaggtattttccaatgggataaatcacacagagaatcccatgacggtaaaggtattctagatttcctaggggagatcaaggtaaaggaatctttagacacctacttcaaagagtaccagacaaaagtggctagtaccgctgatttgtacggcttaatttcgttcactccaaagagagatattcatcattacgttatcagagtagatgaggttccaggaaagcactttcccaccaacactacgggaaactttggaaatactgttgattttgagaacttggaacctcgaaggaagcctatcaacccatacctttagtttggagaaatgtagtttagaggggtgattacattgattacaccagtggcatatcgcaaatggcgagctttccttatatttattttatttattgtagacaatacaagaattacttgcttagaagaaaattgtttttcccaattggtgaggaggagataattaaatgttctgtagctcagtgttgatataaaagctaggaagccgcattgattcttagtttgttctggaaaatatggatactatcccgagacagaatggagtcaaaaggaaaatggccgctaagctgttcaacatcaagaagaattttgaaaagctaaatgggttggcatggctgaaacaacacagaaatctagcctctgccattgacatcgttgactttccaaactcaaataaagatatctcttctgcttcgatcatgggatctggatacatccctcttcacgatattctctatcagaaagcacatcctagtagttttatggaacaactaaaagctggggctatagaaagtgatgctagaagttggaatagcagcaccagatcaagcagaattcaagtttatcaaccggagccatcagcaatttttgctgtccatgaagtgttcgtatgttcagttcaggaagttgaattcttagaagaatatgtcacaatagtttctcagacatcttcaagttcgaacgccaacgaaattattagccagtgaacgtgcactgaaagatcatcatacagggtaaaatccaagtatgcattgacgcttgaccaaggctaggaactggatgttagatgtatatatgttataatagtatcccactggtataatttctgaagctttgtagcgcgatcttgactggtgattgaccccagatctataatgataatgaattgtctgcaatgtgaagggtaaaaaagagaagtatggtcgcattggctcccacctccatcttccattaaaccaggtgcatgaattactcttaccggcaagaagaattggactgttatttcgaattccaatgcagtaccattgttgagtcagttgatgcttatccctttcgtctggagattacaaggtccattgaaagcgtccttgacgacccccaacctgaactgactctcaataatgcagtggaaaagagttctttattgacaatgggagacattctgtttgggcgtaaaaaacagtgtttcaatggtccccctgtaaaagggacacaatggacaactaattctttgagaaagacagctgatagtaaaccaaatgaaaagcccctaaaaggattgcttgctccatctaccgactcgatctccgaaaatgtgttcacgtttaattcttcatcacattcgttggtagagcctgctaaggtggaggatcaattgcttgcaataaattcacaaaataccaattcctcaaatcctggttctgaggttaatctctattccagatcatgctccataatgtagaatacatttatatatcagtaatgtattataattgttgatgaagacaaccacgattaggcagactttatttataaaatctcgaaagcattattcatgttatctcatttatccaaaacatggataaacggcaagcaagaccaaagtcttatctttccgttcatgattcaattaagaaccaggtgtccattgtaaagaagcctctaatcatctccaaagacttgaacgaaatattgaaaactcaacatcagtatgaaccgaatcaagctaaacatctcagtccccttgcattgaatagactaatcagaagtgttaattttctacttaaagctcgttacgccagcatatttaacagacaggccattcatttggtatctttgcaatacattgagagcgagaaaaggatggaaatcgaacgattggacgagtttttgaaactttattaccttctggaacctttcaattctcaagatcacagtgcaaacaatgttcacggtttactacttgttcaaaaagaacactttatggacaaagtgcacaaactcccaccttctagcactgtggcgcatctattaaagcaaagatcagacatcaccccgcttctggccagttatgacaaagtgaaagagaacctaatctccaaagaaaataaggttgaagcgctcaaacagaaattatcacactacaatgacatcttgaaattactgactagcagtttatcagacccagaaagactccagcaaaatttagtgattagtagcaacacagagctcacagctcagattaatcagctacggattcttctcagcagactggagtataaactacgggaccccaaagtgaagctacaagtcagtaacactttgaaagcccttccctcaaaagtaaactaattcaacctgtatttgtacaaaaaaacttgacattatttaagagaatcagcttaatcgaacagaccgaagcccatgtcatcgtcggactcttccttctcctcttcagcagcctcttcagcagcttcctcagtggcaccagcagcggcaccagaagaggcgccagcagcagcagcaccgccagatggaacggaagccaacttggaagatccctcagcgattaactcagagatgtccttaccctcaagctctttcaaaagaacggacaatctggactcgtcaacctcagatccaacggtctggagcaagtcagagatttgctcagcggaaggggtttgaacaccaccttgttgcaataataagtaagcagctagatacttcattttatcctagaataatcacgtttaagcttcgatttaagcagactatcccttgaagagtactatactagtgaaaaaaaaattataggttgcagggcaacgactgggccagcgaattcaaaacatccttacaccatctttcgtgactgtgttttcatatagtttgttctaatattattacataagcatactctatcaagtggtagacccagggtccatctatctatcagttttcagtttcttttctgtatggctggcggttaaagctctctctatgaaaagttgtttttcaatgtctggtgtgtgaagaagactataccgttggcaggaacactcttcaacaatgtgattcccaatccagaataaaagcccctaaagcctctggatcgccacaaacgaagtatgatgtctgccgtcttcacttgttgatgatggctctgctcagtttggatcatggacttgatagtgtccactggataaaatgatgcattgtagacggctccagcaacaccaccagcaatgatgtattgtaaggaagttccgttagatttggcatctttggagattcccccattaaagagaatgaggacgtattcgtaagctccgaaccatagagctgttccacctgtttctcttatcattgtgcttagttgtcctttccacaagcctttcaacccttggctcttgtaaatatcagagaccaatcgggctattccaggaggtttttcagatttcatctgaagattaatcacttgcatcttacatttgacaagttcgattggggtgagaatgaacgaagttaccacacccgaaaatgcaccacaatagatcttatcgagtaatgtaatttcaggtttgtaggatttcacccagtcttgagccagctcataactgaagaacagagaagaacattcagcggcagctcccattagaggtgaactcaggcctttgtaaaatccgttaaaaaaaccttcatgcttgtaagtttgtgtgatgaccttccatgtcgaaggatgctctggagtcttcccactggagtactgtaatcgaactttgattgtatccaaaggatactcaactacctttcctaaagctccagccacagaaccaaagaccagctcgtcaatctttttttgagtgttagactttatatagctactggtatcagattcattcttcatcaactaaaatttatccagttaggagctgttacaagaaaataagagaaacaacggtggaaaaagctgcctagttaaatttcactggaatcagaatgatcgcggcggatcgattcagattacataataagaataacatgtatgaaagaaaagttagttacagatgacctaaatatccactggagagccgtcagcattgggagatggtgcagggttcaaatcaggcactacttgagcggggttattcaagaaagacttgtagtcgacctttttcaccgccttaattgccacatcactggctgataccaactcttctttgaaaaagaacaaaaaggcagctgacaagattgactgcgataacttgacagacattccactgtagaaacttgatattccttcttcttttaacattttcgtggaaaggccccaaatagtgttggtaggttgttcctgggcaatctttttctcgttgtcgccctctttgcccaagtcttcgtctgacgtggccgaaagaacagcggaattgctgactgagctctcaccggaagaattcctagcattctcagcgttttgcaaatgcattctagttctcagggtgacgtaggggtaggtgatcaccgttgaaataagttttccaaaagcacccaacagtaaagcatccaagggagtcaacgctctctttcttgtctttaccagtagtgttttcagttgctcaaaaatcgtgtaatgaatgatcgggttcaggaccaaaaacaatgccggaatgaggccactgaacagcgttttgaatccctcagtcttgaagatgtacaaaattgcctgcaatgtgtttaccctcttcagatctctctgttctctggaaagaacagtcattctggtatttgctacccagataggatttgtggcaatacgggaaatcacaccagcaatagctccagcaacaatactttggaatgcagagagaccaccaactctggaacctctctttctaccacgggacaagccttccaaagtgtttccagttagctcatagaagtagtaataaatgaagttgttgactgctatcccaaggatagcactttccagcccgttgtagagaccccgaactccctgctttttcaaaatccgttttagagtaccgtaagttgaagacttcttgggctccaattccttctcatctacagagccatctagtggtttctgggtttttgaagattgggcatgggttgatagggtcagaaggggataagtgataatcattgagagaattccccctccggcacctgcaagcccatgggcaagatcgtcaacctgagcgttttttgacattccagttcgaaataaataacgaatatggaggaagaaaaagaagagaaagaagaaaaaagcagagagtcaaactatgactcttttgttttgtcttgctgttgtagtcttcctctacccccacaaagttctaccatagcctacgattagatagttaagatttgtcgcctatttgttgtgttcggatgtcaagcctgcagagattagctcagtcaattttggccggtgcacgagtatctgattttactctcgtttgatgacttcacaccaactttaatcaaacataggttcaatgagtacatttacaggaaatggcattccatcgtttgcgaaattctggaagcagactttgtttttgagtacattagccataggcacggctttatttgttaaatccaagattcatctgagaaagaagaaccagcatttaccggacgctgtgcttggagatagagagcaagattatgacatttcaaagattcgtccaggattcccacagtccaaagatgatatgaccgcttatggaagaaagtctgagttccaaggaactgcggatagttatttgactcgtaagtccggagataagtttagtttctttccttggtttggaggatctaaataaaacacaccatgtagattcatttatataatacttgtacatattttgttgggctaattcttattttcaaagtagtcagccatttcctgatccaattcttcaactgtcttctttggctttctcaccttcttacctcccttgggaccggcttttgaaggagcaggtttggcggcagcaggtttggaagtagcctttgggccttttttcttattgatcgtctggattggttgaacattcaattttctgggtttctcaacaacggggctaaaattgttagtattttgtttgcatggatgcatgcgtttgcgggggttacttacttagcggagattctggaaatcaaaggcttcttggtaggatcaaaaatcatttccaatctgagcttgttggcaccaccgtcaattggagctccattgtactttttgacagcagttgtagcatgggtattgtctcggaacacaacagtagcaatacctttggacaaacctttctcattgtaagacagggcaatagacttgacacctcccacttgggattgaaagaattcctaattaattggttaatagttgacttcgggcacgagaaaaggaatgagaagatatacatgtgacaactacaatgatgtttctctttaatccatgagggcaataatcgcagtgtaagggagagggaagttttgtgaggcggctggctaaatctttgatccacagtggtggaactaagatgaagtacatgggactttctggtttcgtgttctatcgcaagggtgaaaagtaactcccgtgttgcatagttattgatcgcccttgaaccaagagtgtttaaaagacaaatcttgccccggaactaaatctcagcagaattgctcacaagtttacccttcgagcttagatattcatagggtgtgtttgatcaaacagagaaaccagtcatcaataatagacctggtcacgaaacctcaccgacacgtcaagccttcaactaacgcacatcccttcacttaaaaaaagcatacttgaatgaccagcatttcagtagtttttcttacccttgcctgcattcccatcttttatcatgtcatttgagttgtcacgatgcaaatcttaactaatataacttcaacatacttttacagcattctgtttgatgtcatgtggcaagttgtaaacaataaccttggtggcataagagggatcaatgtaatcagaactgccaggcgtcttgggaactgatgccttagggatattgtttcttgccacttgtttcttgctcactttggcgactttagaagccttcggagctggggctttctttgaacgcaccacaggttttttgttggaggagatgatttcatccaaggatttatctagagaggccattttcctttttattgaattcgaacagttggatgttttcttcgtagatgtgtggtgtcgggaatttcaatttcgacgtgagtggctggcaagaagcatttttccaggccgcgaacaggtacttagtggtagtgtaccatcagatatcgaaatcgtctcaattcttccccaaatcgtgcagtttactatctggatctgatctgttatagatgcgtcatgggtgaattggatagtttagcgtacatcttgacggccgaatttgataagagcaagggtattgttattacgaaccagcacccctgtgaagatgattcatggctcctatcttcacagttgcaagacatttcaaatgtactgatgccgtctcaacttcagcattcaatgaacagagaaagtatcactgtctttcctatttacagcacatacagtgatgttgaatttgaaaatgccattttatcatatgatcctaaaccccatagtttaccaagcgtgattttgtcaataagttacttcaaatcggacgactcttatagaaatgggacagccaattgcctgtctattgtgacttcgttgtcattttggtatgcatataagaatttactgattgttctactacatctttatatgaaagataatgacttctctcaattgtcggctgtttttcaaactttaaacgagattccgttgagacagttggatttatattttcagaatataccaaccattcaaaaagatctgttaaagacactaatagagaggcaagaacttaacaatgagtctgaagaagaatctttcctagctaaaattttaaaccccaacattctggatgaggatgaaactgaaatcattaggggtatgctaatgttcaaagactacttagaattctctccacagtcaaaatgtttcaaagcaaacgttctaattccatctgttggtactcattttccaattcaaattcctttactatcattattatcttcaagattcacattttttgggttaaatttggaacaggaatcaataataagaacttttcttttagactcaaaatctcttaaaattcaattctaccaggacaataaagcattcattacaaacaaggaaaaagactcaatagacaatacggcctttaaatctgttctcccttatggtgtccacaatactccatttataattgctttgatcaacgccctcttgcagcgcaagagaataatcgtttactcctatagcaggtcatgcaatgagctgttggagttcatcatggcatactttattatagtggagaatttcatgtccacggattcaccttgcacaactgatcatctctacccttacgttgacctttcacaactagagatacttgaaaaaatgccattctatgtggcaggaacagccaatattatctttcagtcgaaacccatttgggatttattcatcaatttggatgacaaatcaattcttttgaatttcgactcttttaccagcaacagtcaagttctttcaagacgaagcaacagtcataaaaagtttttgaatcttaagacaaatcctaataattttttcagaaggcaaaccagcaatattagcaactcctcttcaagtccatttagaaccaggcatagtagtcaaaccagtggaaactcgacgccttctccctcagtttcttcagtcaaaaaaagaccggatgccgactccttatacgaaatatatgccaactcttcccaacaatttgaagaaaattacaagtttctacttcccactttcaaaaataatgatgctctattctcttcttctattgcagaaactcagtttgatttcaataagcatacaagtgttggtagtagttcaagttttattgcctttgggtttcaatacgaagacacctcattggacgaaatttcattgtttgactcaagcctgtcgcaaatagacagctcgcttttaaagtcaattgaggatttactgaaaaataatgaaagagacagcgttatttgtgataccattttcaagtatttagatcacctaatcaatcgatgttttaaatcccatgaaatgatatccaatagcaagaaagttagagagttcaccgattacattcaattgaaattggatgacagtggagaatcttccttcaacaataaaaatttggtaatctccgaaattaataagtacatgcaacgaaacaagattgtacagccatttgtattgggggtagactatggcaaccagttctttagtgtaacctacccattggacactaattcattcaacaaatcaaatctcctttcatattacagttctttgaataagggttcatccagaaatttgtttttgtatgaagattatttgaaggctaattcaatggatggtataattaagacaaagttgtcaaactatctcgttggcgtgaaggaacagacttatctcttcgatattgagtatatcctacaaaactgtttttttgttgccaatgaaaagttcaaagacgttcattcactatcctttatgaagggtcagaagcaactataccagatctacaaaatgttaaacgggtacataaactcagtcgatagctttgatcccttattgtatcactgtttgaaaacggataagatcttggacttgaacaaacagaagaatgacaaatacgtgtttgacacactggaaagtacccttatgatagtactgtttttggttccagaggagtccaacatcacaggaggtcaggatgaaatacagtaccccctacaagaagaatttgagaattatttgaaaattttgtttgataagaggacgtttttcaccgagtggtttatcaaccattctaatggattcataaaaagtggactacgagactactttcattttcattatgagtgataaatgtctattttaattgcttagctcttacaccactacttactacttcaagtgtcatacttcgtatcgtttttttttttttttttaacctacgattttggctttgttcttgctggcagcagtcatataactaaatctccaaggaacatccatttgatcaagtattacttcaaaaagcttcagcttggaattgttattattggtgtacagcataacttggtccaactcctcgacagtttggatcttttttgtttcacttttagattcatatctgtctccaaatgtcttaaaaatttcggtccaattccagtttggcaaaatatcattatattccctttgaggccccttaattattctttccaccgtgtatccgctgttgtttaagagaaaaatgataggagtgatttgctggtagacatagtttccgaattcttgaatagtcatttgggcggatccgtctccctctaaaaggatgagtcttcccttactgtttccatctttcatagcaactcctactcctagggcagcaggtaaagcgtagccaatggacaagtagaaatgctgtccaaacaaacgggcaccctttggaaggactaaatccggaagtccgaacataatagatcctgtttccactacaacaaaatcatcttccttaatgaagtcttgcaatttatgcagaaggtgtgtttgagaaattggagtggaagctgaaatgtgttcgatgtggttaatctctttctttgataaagtggggctaatgcctcgggggatttgagacacatccatcatttgaagcattacgtctaggacgtgcacgaagttgacgttcctgaacaactcagttccaattttgatgtactctggatgcataaggatcaattgctcttcgtcgatgttgttgtacaaagtgtcatgtccagagttgatttcattgtagtagtttccaatatgcaatatgagatcagaagcctggaagtatccaatcacctcgttatttgactccacgccattgtaggttccgatatatcttgagtcactctcatccaggactgatttacccatgaaagtggaaaaactcttgatacatgcatttttgacaaatgctctaacatgttcagttacttggaaacgatcgcaaagtatatctcccagcacggcaggatttgaacaattgtatatcttatccagtaccttggttgcaacctctcttgttagagattgatttgtgtcgacggattgatagaattgttgagtagttctttgaattaaaaaatccccatctacattgatatcggccaaatcagaaggtaaaaacagatatcctggccttttgtacttcaagatctgtcttatcaatgtgtcaatctgtcctggtgcatcactagcatttacaacagtttcctgatgacaagaaacaggtgctaccattttttcgtacgtgaaatggtctgacggctcaaagacagacaactttgggaccaaatgatgggtatgattgttttcagcaatcttggcagagagaggagttgttccaacaatatgaagaataggcacgtactctgagaaagcacctgatattccattgattgcactcaactctccaacaccaaaagttgttatcacacatcccattttatttgaagctctagagtaaccgtctgcagcataggcagagtttagttcgttggcacaacctacccacgacatgccttccactgagtagagatgctccaataggttcagattgaaatctccgggaaccccaaacacactggatacgcctaatgattggattcttctgaaaatgtattcacccattggaatggttgaggcacttggtgccatggaccatgaatgatccaggtcgttcaaagtatggtatgctatatctggaactggggccattatggttgcttctacaagttgtttagagagattttaggtaacatgagactgtacttataggaaaatatgcctacacaccgagcaagggaatctacactagaatattcaacagtgttgtgtcttttgtagtctgcaatggttatcgttttccgagataagactggtccacaaatctacgatatttgaaatgggatcgttggaaggagccctgatccctttcgggaacgccggtgggtaggttccctctataaaagggaatttttcgtgccagaaatttccttgtaaattttcggttattcaggaaggagtatggcgactgcttgtgggaaaaagtgtgcgaaaatattgtggcagactccgaataaccgaatatatccgcacttgtggcacttcaaaaatgccacaccaatccatggttaaccgaaaggacggaaagagacggtaatataaaaaaatgccaggttaaaagataccttcttacattgattgaaattagatagataatgctatgaaaatgttctaggccatcactcttcgtcctcgccatcatcctccaagagatcagcgtagtcttctatcgaggcgaacatcggtaaacccttaaggctcttggactttttagaaacatcatccgacgtgtcggttctggctctcttcttcttaggtttttcatcttcactgctcaattcgtcttcagagtctggtccaaagatcttggcctcttcatcagatgagaatttattgtcattatcgttgtcactgtcctcagggtagggttcttgggcagctatagcagccaaatgggatggtatctgaactggaacattatcgtcctttttcttttcttcctcgtcactatctgagtaatcaaagtccgcagggtcaaagtcgctcatgttgtctaagtcgttgttcagagcttcaacttccggattactttgaaccaatgcagaccacacctcatcctcatcaaagtcactggcatcgccttcggaaatttctccttctacggcactgtctatatcgctgtcactgtcactagcagcctcttcatcgctgtcatcggtatgcttcttctttttcttcttattgactagggatcctgttcttttctttttgatcgtgaagtattggtggaaaaagatgtcttcgggattgatctcgctgacttttctgctcaaccactcctcagtgttactaggatcaatggaactggaaacattcgcagaatgaaccaggacatggccggtacttggagtgttcagtgattgcataatggagccgcttggggttgcactattctttttggcagtcttgtacacgaacttgtccaagaaatgagataaagtataaagtcctagatcaggcttagtgaccttctcatcacttccatccagaagtgatcgtgcatacaaacgcaccgtagggtggaaatggtccacaaaggtgtttaattcccatagtgatgacttttcagctccagcaaacctcggatctctctgtcttggatcgtacgatgtggggagtttctcagaatctgtggtgggttctttcttactatccttctgatcgtcctcctggacttttacaggatagtcaatgggactattgaagactaaatttctcaaagtgggtatactatgctctaattgaatcagtaagtataacattccacttacagtcccaatgctgatccagttgtgacaaatttgtataatacgtttgacaaatgccatcactctctcgatgttgctatcatgcttcaatgatttgaatagcaaattaagatagataccttgtttcgaagatgtgattaatctaggatctaatagtgattcgtaaagggttctgtaataacgatcagcactttctttagagacattttgttccacagtaatgcgatggatcaagatcaatgcctgaacagatgtgttgaagttcgttgagtgggttattctgaatagagtatccagatgcttggtgaatatgtcgtcgggtagttttgaataaggaagagcacgattcaaacctgtcaaaatagcagaaaataacttggaatttctttcatccatcagttcatcctgcgtcaattcaactttcttcacagaaatcccacctttcttacctctcttgatgctcttcttttgtttacctggagtgacttcttttgctttgagttgcaaattgtttgttttatcgttacttaacaaggtcttctcgaagagactaaaataggtcttgaccagttggttggctatttctacttcccttaccgagagaacagtctggttcaaagtaagaactgagtagtactgggtatgatattccttactcttgaagcaaacgtcgataattgcatccagaatgacttttaccatcgctggatgctgttcttctaactttagaagtaaataactggtcttggagttaattttgttatctgaatcaccgagtttgttaactcccaatctcaaaaggttagcttcttgttctggtttggatgctagtagattgaaaatgtgtctcagaacagtaactcggatatgcgaaataggatcacttaatagatgctccaggacgccaataaattggaagtattgctttttcaaatgatcctcaaagacataaatggcaagttgctcatcggacagttgcatgttcagtggctgtctgtgaaaataatgcaacttcctatctggaagaataccgttgacaagcatatcggtcacagcttcaatactttgaagggcagctgttcttgatttcttctcacacatgagcagcaaagcatctaccgacttcacgttatgtaaaggagcttcctggatcagcaaggttaaagctgaaatcttatcactaagtgtaccactggtcaaaatgtcattcaagaactttttctgagacgaggctttggagaactcacgcatgtaaatttcattctctctatccaaaaattcctggccacgtttcatcaaagcagctaacgattcagccgacaatttgtcagcggtgactgcggtatccatagggacattgtaccaatctttctgcgccggtatactcaatttatcagtaataacattcgaaaaatctgtcaccatgttcgatttcttcatgctcaattcctttacagttacctttgatctttcttgttcctttggaacctttgtgtttttgattggctccacactcttctctttggcgacctctttattattctttgactcctgtttctttgatgccttctttttctgcttagtaggtgtactcaatggcttgccagtaaggccaatatttttcataacggaacttaaatctttctgaatatcgcctgtgttgagaatgtcactagtatcattctgagtagatggattacctgacatcgacccttgatcttggcttcttcccttggtattgccaccactctttttgttcttcacctccttctccttcgttggcttaaaccccatgagtttactggaaactttatctcccaaagaagataagtccaacttgatgccactcataatctagaaactttactctgtagcttatgaaaaaaaaaaagtttttctcactattttgagctgggtaatctcatcacctagattatctaagcaatatcaattacgtaatctttggccaggatgcgggatgttaaattagtactgcacggctcgcttcaaaaaggggggaataaagggatagttaaacttcacgctgacaggaaaagttaaaaaaaaaaaaacgaaaaaaaaaaaactataaaaagacacctttgacgtaaactcttctctcgacttgggacacctgtcgacaaacactcaaagatggtaatggatactgccatactggtccctcctcccaaacactctggtggtcatgtttttttatcgtaatctctgaccctaaattctgaactgcaccagctgcataatcacggttagacaatctaagtacaaaaactattatgtcatttcccctgaacaaatgggctcctttaattaatatcctattggatttattgtcatgggactaccttttattgtgcaaaaaggcttgttgcatggaggtacagctcgaaagttgtttcttttggaatcttccctcgattcccgttcctatacctctccggtaaacaaagcaagcatctccccctattcttaccatcgaacccaattaaacattttggtaataaccgactaattccttttgggcaactcgtcctcttaactatttttagctacagtcattccttttagtcccagctactattgtacaagagtatcccccatgtcaggccaacaaggttccaaacttcccatgatcgtggatgtttctatcgacgaacaagggaagcaggtgtaccaagttcacagcacgaaaaagcgtgtaagggatgacatgcccgtctccaactttaagtcgtcgaaggtgaaaacggaatcgagtgttccattagcagcctccgagtccggttcgtcgtcttcgtccgcgtcgaacgtgaaagaagaagaacaagatctcaagatccctgggtctgttgaggataccgacgtcaacccaatctggcctgctgatgtagagttggcctttagagaagctctgactattatccccaagaaaggactgaacaagatcaaaattagtggcaagtgtagcggacggaacgaactgatttcagactatattttttcaaagacaggtcaagtgcgtacaaggaaacaagtctcgtctcacatccaggtggttaaaaatatgaacaaggaccatgaactaatcaagctcatattggagggcccagaggattccaatctggttgaaccttttgattccgtgtttaccaagatcgtcctcgccaaaactactggtggtaaagaaaacaattcgccagaaaacttatccgacagtgagaatgacaacatcaacattactccacctgcgactgctttaaggacgcgtgcatcagtacctcatctgcaactgaatgatgccaccatgtcaggccaccaagatactccggttagagcaacttccgcaagattacctactcctagctccgataaccgtgatagtgtctcgttggatcgacctttgtatgtccaagcagagattcaaaactttcagttctgtttggagaatgccgtaatgggtatgaggttttatctgtcgaatctacaagagccaggcttcatgtatcctcctttgcgtctgaaagaaaatgcgaatatcaagtctagatttccctatttggactcctttgtgtctaccttgaacacgagaggtgtgccaatactccacggcatgactaaaattggtaacatcaattatgaacagatttcctcgatggacgcttttcgatccaatagctatattactctgcaacttgataacctgtccgttgaaaatgccagctggtctgttgtgacggcagtttactcgtttggcaaagagaaggctctatttgtcgacccagttgaggtgaaatctgacccaagttttggggaaacaagaatgtacaccttgaaagttgattttgccaacaggttttggaatgcgtatacaaagggaatttgggatctctaccttaatccaaatatcgataatgcagttattgcacgaaaagagaaatattccatcaagggtaccactatcaagcaagtcctagtctccgggaatctttcaccacgttccattacaagatttgaagacatcaattcctctcttgtgagatgtattctactatgggagttctataaagtggaacatcctgaacctaacacaacaactataagaagactgcatctcactaacgacgatgcgatgtatgtcatgaaccaaccgccgttcgagctgactcctcagtctagttccaaaataagcagtgaagcaggactagaactccccttccaaaatttacagagagccccatccgttccatatctagacgattccgcacaccagatgccggtacaacaaatacccttaacttcaggagtaggtgtaccgttggctggaccagctccattcttggacgacatgctcatgggaaacgaagaaagcgcccatgtgaatcaattccaaggtgaagccattgacggcgatcctaaagtgatcatgtctacaagtaatatacctttaaactaaataaagttggtagagttgtgaatttttttagactatacaaagtgaaattacaagatctaagcttcctcgttcaggaaagcctctctcttctcagcctgtctctgttgtcttctctcacgttgagcacggttcttggctcttctagcctcagactcgtccttcagaaccttctcacgggcagcctcggccttagcctggatgatgtgctcgatcaaagcacgcttgtgcttgaaagcgttacccttagactctctgtacaaagtgtggtacaaggttttgtcgatcttaccgttgtcacggtacttgaccaataaacgtctaagaactctcaatcttctcatccacaaggtttgagtggacatacgggcgttagcggtaccctttctcttaccataaccggtgtgtctaccagcacgcttagcctcggcaaaagctctagctctagctctggagtgtcccacaggaggcttcttgacgatcaaaccgtctttgtacagctttctgatagcctctctggagttggcctgtgcaatttgctcagtctcgtttgggtctaaccagaccttcttcttaccagcaccaataatgctggctgcaagtctcttttgagtacgcaaattagccctggatttgttagtaacatgatggatcttggatgaaggggaggccatagggaaaatacctggaggatcatgaacaatcaacaaaaagacaacagattgagcgagttgaaactgattgtactggtcttaccaatggaactactccatgacctcttccgcttgggaatcaaacttacattttgaaattagtaattgggcaaactaaaaaggtgaagaggaaattgaaacaggtaaatttttccctcttggaaaggtagcgaaagaggtagtcacgagctaaatctcccttttctgggcccaatcgcgggcaaattgtaagagggtccgtcgtgtggaacagtgattcgcttccaataatcacattctcaaaaggtggtcacgttatcaaagttagggtttacccacgatgtgtaaaggataagatcatgttacgtaataacggtttgcttcttagataagcaatactttgataggggccaagactttttgagagttgcaggaaaataaattttctgagaggtaaaataacatctcttctaggaagatcccaatttgcattcacagatatcccacagtaatggctaaatcctctagatcaaagtccaagcttcaagcaaaagctgtgaagaggtcattggaattccagaaatacgaagatgaaaggaggaagagactgtttgagaagtcccaagcagccctggtaaaacagaaggaagaggcaagcgaagacaaagactctaaacctgccaaggtctccactgtggaagttgacatagatatagactctgtccctttgaaaaagcctgagaagaggacgaccaagaagaactttaagaagagatcaagaagacaaaagtggaatcatcgtttgggctttgaacagttcacccccgaaaagccatggtaatcttctattagtttagtgttgtgctatatgagggttgctgtagcgtgtatattaagcatattataaaagttgtacagtaatagcaggtattggtcttttttttcaaactagtttgctgagctaatcaaaagaacgtcgtagcggcataaagatcgtcaacattgagagtatcaactccaagagtgatcaactgcttccacacttcgtttctagttctgattggccaagaaggtgtttcccaaacccggactttgatgtcgttattgtgtgcaatgtcgatgtaagaagatatcgtttcaacctgagactcgctcaggcctgacacgcctccaagagccctacgagactctgttagctcatatagtgaggctgaagaggccaaagaaatagaactgtggttatacttggctaattcttcatcatccttaaacttgaaaagtggggcatcaataaagaagaatctcttagtcttggagacgatgaaatcgtacgggtagtttcctgtaatgatgactgttataggaccttccacaaactcatcggtttctgagtcgtaataggaaagatactcattattgataaagtgactcaacttgtcttccaaggcggccatggtcttctcaccattagatttgatgtctaagtagaaatacagggtttggtgcaagttgttgtaaaagattccgttcctgcgtgtagaaacgttttcatcttcgaatctcttggcaatgttgttctgtcctatcagggagaaaagaggattcaggtacatatcatcaagattccacttggacgacaaaaacactttgttgtgcccaacaaatatagtctcaggatcagagtcaaaataccaaatgtctgcctcgacgctctgtgcaccaactttcaaagcgtcatataatggaagacgtctccattcatcattgtgggagtggatagggataatgtcaatatctttggttaactctgcacttttgaccctattcaacgttgtgatgagaagctgatttttgaactccgacagactcaaatacagctgagcaacacttgtgaaagtcagaataaacacaagcacgcaaaagaacttccatcttctacggctgcttttgcattctctgagcagttcgaggtcgtagatggccgtgggagctattttctcctcttcatccagtagtctctcttcttgttgagcttgtgtctctgtcagcatgccaaacatggttgagcttggaagaaaagaggaagaaggggggaaataggcagtctttgtatcacaacgtggttaaatttaatggctcaccttgaaatcgtggagtcagaagcttccctgcatgccttagtaattgtatgacggatttgctcgattggatggaaaatagcgaaagacgggattcgtggaccccccatgtgtgagccatgtgtttgtgcagcaaatgacaacagactggacgcgagaaaagagcgcacgcgctcgcaccaaaggcttcaattactcttgtaaattacttgaaacgtggcatgcatgctcacaatcaatagcaagatcggggagtggctattatgtatgcggcctattaaactggatgaaaagtgggcttagaaagctgttaatttgcagtttatccagcaccaataggaatcgtcttggttaaccctatgtgtgatgacgtctcaggattaagccggacgacaaattagctcagagccgacattttgactgttccgtgtactaaattttgtccggctcaggtgttaactgcattactctcacctactggtcttgccgttcgttggaaataattaatccgaacttcaaatgctttttctgaaatctgagccgcattggatctaacattggtaagcccgtaagccatggcatctaccaaacaattaataatacgcttcacgcaaatcaccgcagtggtacagtccgtcatggtagggatgtaatgtatccgccgtcttcaaagctcgtctgtcgtaaaagacctctttctccggtcaatcatactcgccgggcataaagaataataacgcaaaggcaggtatcaacggcgaaatagcttcttgggaaaatcatgctgggcacttattctactcaagcaccaggcactttatattttcaaaggcagccttggcggtgtggcaatagactgagtgctgtttagattatgatatgacttaggtgttcgaacgggaggaatgattgaaagtagtaggcctgatgaattgctaaacctcagaggtcaatattttaaactctacaattgcaaaatcttgacccctgattgtaataagcattttaagaatgctagatcctattctgtttttgttagaacttatcaacaggtaaactagccttagtttcagtttgatttttttattatctttttttactttaaacgacaaaatgcagctccagttgactatgcccttcttactgttttgatttcactcccggttgtagttgaatggacaaattctcatggtaagctggatgtgtttgtcaaatagctgcacttttaaaggtccactacaagttccttacgactaatttcaaatgtgcctcttttttatgcctcatactctaactagaaagaccaggactgcactgagcataagatgaaattcaagctgtcaggcctgaccttcattttcaagtgaattccaacgggaatgattacgaataatcttgtagtaactatacacaaagtaaggaaaaattcatctagcataggaagagccaatttctctaacaaaagtataatacgatggatactgtaaaccccattttcaaacctacatacctctgaggaagaagtagatgtcaaatctgccataacgaccctgaaaaatagcagaacaattaataagacgctttcgctcaaaatggttattctatagccagttacttccctattggacaccaagcgctagccattccgcgttacaacacgaaaattgtagttggctcgattatttttaaattcacaacataagatcatccatctctttgatctgttgttccagttggcacggtttgaaaccaaatgaacaactataatcccgatggaagtcccgtccatggtgattacgtgcagtcaaactttaggaacaagcatgatctggaaaaatattcccctcccaagtccaatgacccacatgacagattacctacactatatgaggtattgaacaggaagacacagacaccggttgatctttggtctttctacgtttatatgaaagacagccaatcagcaattgactaccttgacttttggctggacgtgatccagcacctgaacttgtgtaagagctacgtcaaagggttgaaaactacgttaacagccaactacagacagagaaatgcaaccaacgtggccagcgctattccaaggaaaactccacctaataatgggtcctttgtttcaccttttggtgctaatgatattggcaacaatagtagagagtcagtagggtcacagaaacacaaatcgataagttcctccgtgttgttagatatgatcatgactgagaatcttcttgaagatgaggataataatagactctcctcatttttgaaaggtgaagcaacacttagaaccagtgatcctaacgtaaaccaaaggatagaagaattaaagcgacattcccaatccattggcctgaatatgggcgcatccaattcaaatctttctgtatttgaaacacaacctgaaaacagagaaataaatcgaatatctaccatcaagccagaaatgttggaaacattcataaaagaagaaatggatagtgcgcagttgaaaaatgatagtccccgaccagagaatttgttcgttacaagagctgatctaagatcgtcttccagaaaaattctatacacatatttcatggaagctgcagagaaaagactatttattcctgaatacatcatcaagaatataaggcataatttagaaacagaaggaagggatgatcctgaagtatttgaagaagcaaaagagtatgtgtttaaagctatggaaaatgaagcttttccaggtttcttgctttcaaatgcgattagcaacattacagtgacatctcacttggttcgtctgatctttggattctttttcctctttgtcggattttgggtaggttacaccttaattttccttaattggaaccccaaaccagttagagctgttgtggtgattccatttttcattgggacctacttgctaataacttccatctataatattgaccctgtgctttcgatatttggttatggtgaaagcaaagcgacgcacagtgggttaatcaaactgaaggaaccttttgtcagaagacttctactaaagagggggctctgggtactcttactaacatctgtgattgccgcagtattgtccatcatatttgcactcgtgcctggtaaaaggctctaatgaatttactacttacttagccaacctccatctactggaagcgatactcctgtcaaatatgcagcagcttcagagcagagaaatacagttgggcccttaaaatcatctgcctcaccccaccgaccaatgggaattctagaaacaatttcattgctcttcttctcgttaccataagaatcggctgtcatgtttgacttaacgaaccctggaacaagggaattcacggtaataccttttggagcaagttcaaccgatagagccttcattaatgagttgattgcacctttggtggtcgcatataccgattgattcgggtaggtcacttcgaaactgtacagggaggcagtaaagatgatcctacccttaatctggttcttaataaagtgtttagtgactagctgtgtcaatctaaatggaaaatcgacatttaccttttggatagccgcgtaatctttctccgtaaaacttgtaaactcagatttaatggcaatggcagcgttgttgattaaaatgtcaatctttccagtggaactcttctccaccgcaggactcgttacggtctcttccagctttgcaagatcggcatccactagatccaactcaattgtatgtatggaggcaccatcggcatttgacattctcacctcttcaatgaaagccgttgggtctgtagaaggtctatggataagaataagttctgcacctgcttcataaagtcctcgaactattccttggcctaatccgctggtaccaccggtgatcaaggcgaccttaccattcaaagaaaacaaatcagcggacattagcgacttgaatagggaatgggttagacaaatgaaagccgacgagccagcactttatagtaagtgcaggtgagtcaataagaataaatgtatggcttgctgtccctatcgcgtaagaagcttactaagatcgcctaaattgaaaagttgaacaaatcagttctagctggcctccatcagcatttcgttctcctctgatcatctttgccaatcgctagcatgccctcagcgtgcaaggaaaagcacgcttctttcttatcgacgtattttcaactatggcagagccaggttagcaagtcaaagccgtatactcggtagtgtgctcgccaaaaataaatttgacttgactcttcactagcctatgcaaataaggttaccttttccaagaatcgtagaaacgattaaaaaacttccaaactctcatggattctcaggtaataggtattctaggaggaggccagctaggccgaatgattgttgaggccgctagcaggctcaatatcaagaccgtgattcttgatgatggtttttcacctgctaagcacattaatgctgcgcaagaccacatcgacggatcattcaaagatgaggaggctatcgccaagttagctgccaaatgtgatgttctcactgtagagattgagcatgtcaacacagatgctctaaagagagttcaagacagaactggaatcaagatatatcctttaccagagacaatcgaactaatcaaggataagtacttgcaaaaggaacatttgatcaagcacaacatttcggtgacaaagtctcagggtatagaatctaatgaaaaggcgctgcttttgtttggagaagagaatggatttccatatctgttgaagtcccggactatggcttatgatggaagaggcaattttgtagtggagtctaaagaggacatcagtaaggcattagaattcttgaaagatcgtccattgtatgccgagaagtttgctccttttgttaaagaattagcggtaatggttgtgagatcactggaaggcgaagtattctcctacccaaccgtagaaactgtgcacaaggacaatatctgtcatattgtgtatgctccggccagagttaatgacaccatccaaaagaaagctcaaatattagctgaaaacactgtgaagactttcccaggcgctggaatcttcggagttgagatgttcctattgtctgatggagaacttcttgtaaatgagattgctccaaggccccacaattctggtcactatacaatcgatgcatgtgtaacatctcagttcgaagcacatgtaagagccataactggtctgccaatgccactagatttcaccaaactatctacttccaacaccaacgctattatgctcaatgttttgggtgctgaaaaatctcacggggaattagagttttgtagaagagccttagaaacacccggtgcttctgtatatctgtacggaaagaccacccgattggctcgtaagatgggtcatatcaacataataggatcttccatgttggaagcagaacaaaagttagagtacattctagaagaatcaacccacttaccatccagtactgtatcagctgacactaaaccgttggttggagttatcatgggttcagactctgatctacctgtgatttcgaaaggttgcgatattttaaaacagtttggtgttccattcgaagttactattgtctctgctcatagaacaccacagagaatgaccagatatgcctttgaagccgctagtagaggtatcaaggctatcattgcaggtgctggtggtgctgctcatcttccaggaatggttgctgccatgactccgttgccagtcattggtgttcctgtcaagggctctacgttggatggtgtagactcgctacactcgattgtccaaatgcctagaggtgttcctgtggctacggttgctatcaacaacgccaccaatgccgctctgttggccatcaggattttaggtacaattgaccacaaatggcaaaaggaaatgtccaagtatatgaatgcaatggagaccgaagtgttggggaaggcatccaacttggaatctgaagggtatgaatcctatttgaagaatcgtctttgaatttagtattgttttttaatagatgtatatataatagtacacgtaacttatctattccattcataattttattttaaaggttcggtagaaatttgtcctccaaaaagttggttagagcctggcagttttgataggcattattatagattgggtaatatttaccctgcacctggaggaactttgcaaagagcctcatgtgctctaaaaggatgtcagaattccaacatttcaaaattatatctgcatgcgtctgtaatactggaactgttatttttctggtcaggatttcaccgctcttgtcgtcatgtttctcgtcgtctgaaagtaaactgactttcctctttccataaacacaaaaatcgattgcaacttggttattcttgagattgaaatttgctgtgtcttcagtgcttagctgaatatcaacaaacttacttagtactaataacgaagcactatggtaagtggcataacatagtggtattgaagcgaacagtggatattgaacccaagcattggcaacatctggctctgttgatactgatccggatcgtttggcaccaattcctgaaacggcgtagtgccaccaaggtttcgatttgagaacaggttcatcatcagagtcaaccaccccaatgtcaatggcaggctccaacgaagtaggtccaacaacaacaggaagtatttgaccttgaagatctgttcctttatgatccaccacaccttgccccaattccaataactttaccagtcccgatgcagacatgataactggtactaatgatctccattgattttcgtcggcactacgtaaagcctccaaaaatgaattcagaatatcttctgaaactagattctgcttctgtgattcaagcattgctttatgtagacatctcttgaataaaagcaattctccacatattggtgtgtgtaagatagatctggaaagatgtatctggaatagtccagtcaacgttgtgcaattgattagcattaccttactgtgaacatctctatctacaacaacagactcaattcgatagacgttccgggaaagtttttcaagcgcattcagtttgctgttgaacaaagtgactttgctttccaatgtgcaaatacccctgtatatcaagtccatcacatcactcaagaccttggtggaaaagaatgaaacagctggagcataattttcgaatgaattaggtaaggtcacttcatccttatctgttgtaatgctataatcaatagcggaactaacatcttcccatgtaacaggtttcttgatctctgaatctgaatctttatttgaaaaagaattgaaaaaagactcatcactcattgggaattcaaggtcattagggtattccattgttagttctggtctaggtttaaagggatcaccttcgttaagacgatggaaaatagctaatctgtacaataaccagatacttctaacgaagctctctctatccatcagttgacgtgttgaggatatctgaactagctctttccactgcgaatcaggcatgctcgtatagctggcaagcatgttattcagctttaccaagttagaagccctttggaaaccatctatagattcccgaaaaaacttatacccactgagggtttcactgagcatagtcagtgacatcaaagagcatttcaaatccatctcaggccagtatttctcggtaaggttataccaatgttttggatttctgaaggtatggcttctaacaattttcgggtcagcatgagtgcaacatgtcaaaattaaagaatgaagcaacgaagcatgcattgggaacgaaatacttttcaaaaattcagccttggatggcatcaatgaccttgcaggatgaatgtacttgtagtacaagtctatgaaatatgaagttatctcccaagatgggaattcgtaaagctccaattcagaatcagatgtcataacaagtgtagaatttcttggttttacagcggcactgtgtgaacttaaggacttgcgtggctttaaaaagctatcgtctattggagaatttgatccatagtgagattgagttctcaaccaggaagaggtttgatcgtaatagcggcttgaagaaagtgaacttggtgttcgttgaaaatgaggggtatgatctctatatgacatagttgtcacactgtctgttgaatctataggatcttctcttgaaggatgagggccaacgaatggagggtggaatccaacatattgttgggcactgtacttcaaaggaacggatttcaggggcagtgctcctgtgctggaagacactctcattgggggagctgtgtagacattgcctggtcgtccactttggggtaacggaaggttaaaattgggatactgccctggatgagcaatggtcggatagtcctgtggatgatgggaagtatttggggagagctgggaatgagttgaggagatacgatcataagagctccgtcttgcgtcctgattgtgccccaatgattctgggtataatcgttgcattttcaaagattctggggaatgcaatgaataattatacggaaaagcctccgtgtcgacatcataattgtgaactgaaccttcctgaggaagacctctcgtcgttttcttgaagtcagagttagctaccttggatacgccctttttccgccttcctcctctattactgggtatgaagatacacttggtatggcacagtgcacaattcgtacaagggtagattatgtcggcttctttgccagctctcatgggttcaccatcacacttgatctttttctctctacaagccaagcaggcccttttggccacaattttcttgccagacttagactctggagtcacggagagcattcaggcaacgcttacaaaaaaaaataaggattaaagtttgatggccaggcatgaaaaaaatgaacggtggccgggcccagtaggaggatctatttacttatgatgctgaattgacatgcatcggaagggacgccacagccacacatccgggagttaaactaaccccccgcaggtaaaagccattattatgtaaggcttcggcatatgaaaaactgaacagcaagcacgtcgcttatgtaattggtttgtggccttctccgttaacatccttgcaccagtgagcttgaacacggttctcttctggcaggcgacacgagatgaagaaagagacacactaaaccaaataacctctccatgctcaatcagaagcaatggatcgttaagcaattgaaacgatccaaaagtttgtccgaagaagagaaaggcgaggtttggaaccaaattcaggcagttctggtagaggccattagaaaaaagaaagaagatgtcaatgattgggagaggcaaggacttcctttttttgataagtgtgatcttcaattgtgttgcgaaaaggacaatgatgaaccagttttgcaaggcaataatgtggacccgataattgacacaacccagagagttgccgtaagtactgactctccaggtgatctgcccatggatgacgaagaggacagtgaagataattttgaaaaggaggaggtagaacaaatagaccggaatcatgaagctaatgaaaatgcagaacctcaaaatgatggaacgattgtaactttagggaacgaagaagaaatggtagatgagcaatctaaagatgaactttcggacaaatcaatcgaagatttaaataaaacacccatcgaagaatcagacattgagccagctgtagagttaagaagaaatccatctgagatgtcaatagacatagaaagtttttctccagtatcgagtgaagtttcaactgataaagttgctgagaagaaatctgaggtgcaatatgttgataatattaagaaagatgttattgaatctgagcaggccagctctactgaagagcaacataagtccgctgaagaaatttttgaggtcccagagagtcaaactgttctggtagatcaaatagaacaaaccgaaaagagtcaattagaagatcttcaagagagtcaacacagaatattagaaactaaggacacgaactctgacaacaaaattgcaacaacaggagactatgatgaaagaagtgctgagcaagaagataaacaatctcacgccactaaccaatctgcaactgaaaataaaggtgcattgggtgccaccaatgattctatacatgatcaagatcatgagatggttgatcgggatccaacttcacgaatagaggtgattaaatttcgagcttttcccagaaaaggatacttagatagagtgactggcagttcaggtggtgtagccatctcaattcagaatcagactgaagtgtccacgtttttcaatggccagcccaatttgaatcctgatgcacagtttcttaacccctccgaaactcaatctgaaccgcaagtcactaatcaattatcagaggatccccatgattttccacataagacttccatgaaatcttctcagcactctccagcgaggtcaccaattaattcaccttccaaacctattagttcagctactaattcgcctaaaaagtccccaaacagaacccgaacagaatccccaatcattgtcccacctggtaaaccggattccaagttttcccctgccaacgctgccacaacccattcaaacaaatcttttgtcaactcatccctcaattcctcgtcaaattccctcacagaattaagctcgaagtctcctgcaagatccccaggttcccacaatttccagacgtctcaagctccaagtcagtcaaatttgcccacttttactcctgccgtcgtgacttcacagtcgccagtcttgagccattctcagtctgctgactatgacgacgtctcaacacatggtattgactctaaaacaaaagatggctctccaacatcaccaaaaggttcaccgactgcatcacttccatcatcaggtccaaacttgaatcctgataattccttattcggacgagaaagtgctccgaattcgcaacagctttctaacacagtgactaatgaagtagacaaattaaatttgaagaagcaagttgagctgctacgaaggcatttcgttaatatttcaagccgctcagatgatctagccatgcaacaagagatagagagtatatttgaaaaaactgctgctatcaaagatttggagaaaagggttgtcttcaaaacagtttgcagtcaagttttggttaaactgttccttaaacgatcatatttttcaactgaagttctaccatatctacaatttattgccgaaaatagaagtacatttgatctttatcaagaacaggattcttatgaatatcacctctgtctattaacgtgttactatatttaccatcgcatggaaccggaactggataaatttgcgcaatgtatcgttgatcgcattgaagcattggattctaaacttgatagtcaagcgaaccagccactgccaatgttgctgtgcaagattggtttgtctattctttatgcctttcttgatcggaactaccacgacctttttaaaagttgtttcgaattggtgacgattatcgatacggaggaccatgctgctggaaagcaatttcgtcttcagtccatccggttttctctagcaacttttctagacagggagcgtgaaaaggcgatcacagtaattcaacagaaattcacggaaatcccattgcgggtacttatttttgagctcagattttactcagaagatgaatgtcttgggttcctagactctctaaatctcctaaataagcttaaagaacctcagaatgaatcagatgaccttattcttaggttctgaaaagtaaaatactagttctcaattgtaagtttgactcattaccttaatacatagattaatatccaatttagatagcaacagatttgtggaagttcttaccagcgtagatggccttgtcaccaagttcttcctcaattctcagaatttggttcaacttggccaatctctcagatctggctggagcaccagtcttgatctggccggctctcagaccaacagcaatgtcagcgatggtggtatcttcagtctcaccagatctgtgggagaccattacaccccagccagcagcataagagtcagtagcagccttgatagattcggtcaaagtaccaatttggtttaccttcaacaacaaagcattggcagacttctcctcaatagctctcttgattctgatagggttggtaacagtcaagtcatcaccaacgatttggatgtcgacagtagagaaaaagtgagaccaggcagcccagtcatcttcagcaaatggatcttcaatggatacaattgggtactgggaaatcaattccttgtacagggcagccaactcctggccactcaaccacttagatgggtcagagttagggttcttgaagtccaagtcgtacttgccgtctttgtagaactcggaagaggcaacgtccaaagcgataccaatctttccggtgtagccagccttctcaatggcggcagagatcaggtccaaagcctcctttggagtagaaatgtcaggagcaacaccaccttcgtcaccgacgttaccagcagattgtccgtaagtcttcttagccaaagactttaagttgtggtagacctcggtaccaattctcagagcctcagaaaaggttggagcatcggttggaacaatcatgaactcttggaaagctagagcaccaccagcgtgagaaccaccgttcaagacattctggaatggaactggcaagacgtatggctttggagtaccggacaggtcggcaatgtgttggtaaagaggaacgttcttctcagcggcaccggccttagcggcagccaaagagacaccaaggacagcattggcacccaacttacccttgtttggagttccgtccaatttgttcaagaaagcgtcaatggcctcttggtccttaacgtcaatgtttgccttaacgatagctggagcaatgatgtcattgacattggcaacagccttcaagacacccttaccgagccactttgacttgtcaccgtctctcaattccagagcctcgtggacaccggtagaagcaccggaaggaacaattgctctgaaaagtcccttttcagtgtagaggtcaacctcaacggttgggtttcctctggagtcgtagacgtaacgggcaaatacttttgaaatagccatttttagatgtagattgttataattgtgtgtttcaaccaagaagacaaaagcctgctagatgtgctgtatttatatcttttcaggaccagggtggatcgtggtttgcagcatatttcaagtggttctatattcgcgacggaagccatcgaagcgtatagacgtcacatgagatggctcatcgattaggagcacaaacgccattatcagacgtctagattgagactgtacgaagctcgttaattgaacaagattacatatgaattacatgtttcaatctagccaatggctttgtcaattcaccataacagtactgtgaggggggtgcgagagatcagtcttcataccttaactatttcttgcgcagagacactaccaggggacggagcggaggaacctgttccatcggttaaggttggtcctatgcatggggtcaagaagaggagggtagctatgcgccgactcaattgctgtcgtgatggcttgaagttaaccatccgtggttagggccaattgcaaggcaaatttacggtgatcctctcttctgttcaacgtccctcactgtttccaatgatacccggggacaacagaggttattgaagataccgcccggaggtaagtttaaacgggtgagaggaaaattaccattgaacggcccctaaagaatgttttaccggggcgtaaatttgttagcttctcttgctggttgtgagtcctgtccggtgcggacttgtgtcatgactaggaatctggggttgggactagaactgttttagagttgatgaggtaaagtaggtgagatacatgcagtatgtatgattatgtaacgtataacatctctcctatgatgaattcactgttccttagaaaaattgacagataactgccaagaaagatcacatttataacggttgccttttgccatcgtttgttctttaaatctcatttagcatggtttggaattgtgtgattttgcccaggtactttcctctcactctttcattcccctgattacatcagactcacgatcttcgagaaacactcccgcccatagcattatggaaaagagagctaatgaaacgtcctcatatactggtgaactaaagaagcagaagaaagctctttcaatacctgtaagtgattggcctgaatatttccaaaccttagagaaaattcatttcaggattaacacttacttcacatttctatgttcaagaaagcacctcgttactacctgggaactaatcaagactgcccccgaatccgctttaaaacgacaagtcaccttagaagaaggtgctcagattgccgccctattacctgacaatgtgaattttgagtacatcgacgagaatcagattcataccgaaaagaaacagtttacctataaccgggggtgggaacaaaaagagacagatatctttcagctgaaggactcggattcagacttgaatatgagcaaacagattttgatatttgagtttgtggatggaaaaatacgaaaagaacgggatggaatatcaaggtatagtagtgctaatgctcttactactcccacattctctcaggattctatgaaaaagctcattagtaaaagaaatactaattttgagatcaaggtttctcaattccttcataagtgttacgacaatagcttggaccctcaagatgaactgaatcacattgccaaagcttatattcctaccacagctacttaccaagatcctattgaagaaatggtatcgaattcaacgaaaaccccttctcaaccttccaatgagacgagagatcctattcctgttatcattgatcatctcaaacaaactcccttttatcgagatcagatatccgacaaaggtctcttccacttacagccaaaggaacctgtctatgaggaacttgactttgacttgtcccccgagatttggacaggtattactcacacgaaaaaaattaataagttgtattcacatcaggcagaagctttgaacagcatctgtgttcataagaaacacgttatcatttccacctcaacttcatcaggaaaatctttgatttatcagattccattactaaaagcacttcaagagacaaacgggttggcaactgcactctatgtgtttcctacaaaagcgttggctcaggatcaaaagcgatcattgagtgaattggtaaaatcaattccatctctattcaacacagtcttagacacttatgatggtgacactgagaaatcagctagattgtccatcagagaacatgccagtgtgatatttacaaatcctgatatgctacattcctcaattcttcctagtcataagcaatgggtcccttttcttagaaacttacaatatgttgtcattgacgaattgcatatgtacaaaggtctttttggtgcccatgttgccctgatcatgagaaggctacgaagattatgttcaatatatggcaatgactcagttcaatttatttcatgctcggctaccctgaagtatccaatggcccatatgcacaatatatttggtatagacgagtcggattgccagcttattgttaaagatggatctccttcaggtgggaaatacgtagtgacatggaatcctccgaacttgatgagccgaactttaagtcaacaagatggaaatagtactagagaatcattcattgtgcaaacagccaaggttctcgttcaactggtactgaaaaatgtcaggacaatttgtttctgcgtagttcgacgagtttgtgaactcttaatgaaggaagtccgaagtcaactgaaatctatggacaaattggatctcgtcactaaagtaatgagttatagaggtggatactcgacctcagacaggagaaagattgaaagggaaatgttcaacggaaacttgaaatgtatcatttcgacaaacgctttagaattgggaattgatatcggtacacttgattgcgtggtgatgtgtggttttcccctctctattgctaattttcagcaacaaagtggtcgagccggaagaagaaataaggattctcttaccattgttgttggcagcgatgatcctgtcaacagacattacatgaacaatcctcaagagctgatctcaatggagtaccaagacctaattttagatttctcaaatacagcagtgcttgaatctcatcttcaatgcgctgcgttcgaaaaaccgattgatgatctggattgggaagccaaatggtttagtgattacaatcaagaccagattgaagagattctggcgaatagactagattttctggaaacttccccagactatccagagcctgcatatcatgtatcttcaagatacctaccatggcctccaagtcacgtttctatacgggcaattgaagaggagaactatgcagttgttgatattactaataacaggaatgttgtcattgaagaagttgaagcatcaaggaccagttttacactttacgatggtgggatattcattcaccaaggtctgccgtatattgttcgagatttcaactcggatgacaaatatgccaaagttgagcgggtcaatgttgattggattacttcacaaagagactttacagatgttgatcctgttgaagtagaaaagataagatctttaagaaatggatccgatgttccaatatatttcggaaagatatataccactattgtggtatttggattcttcaaaaagaataaaattggagaaatcattgacgccgtggaagtcaataatccacctatagtcatcaaatcaaagggtatatggatagacattccctcgagtgccttagatttcattagaatgaagcaccttaatatcgcaggcggtatacatgctgctcaacatgccataatgaacattctacccctgttcatcttgagtggagttgatgagattcagaccgagtgcaaggcaccagagaaagagtttgccacaagacagaccaaaagggttagaccagcaagacttatcttttacgatgcaaaaggaggtcaatgtggttccggactctccaccaaagcatttgagtatattgatgatattttggaaaaggcattaaacactgtgttaaattgtcccagtgaatgtgaatggggatgtcctaactgtgtagcagcgcccttttgcaaagaaaattctctggttttatcgaaacctgctgcgatcatcatcctagccaccattttgaagaaaacgattgacctaaattcaataccctcagggccagaaccctttatgccagatatacaaatcgaaacgataggtgaatccacagaaacagtcaagctttcaaaagatattgaaattattgatgttcgaaaagcttctactccattagaggaagtaccaaaggatgaagagattgttttcctcggaaaaagagcgatacacaatactcccagcaccattaaaacagaagaaaatccgtgaaaaattttcttgcaactacttaagttcaaaaaaaggtcttatctactgatcgtcaactttcttcccaatttactcattcgcctggtaagacctagagagtttttttgcttgcgacttccagaaatatccaaggacccgaccatggtgtctgagtcagtgtcatcagctttgctactggagtatcgttgacctgcttgttgacgattaaacttgaactcagcctcaattggagtaagtgatgaagcagacttatttcggtaggtcaaactactggagcttctaagtcttagagtttttgaagaatggtttttttgtgccgcaaaaactgaggagtgctctcttttcaaagccgaagtgtgttgtagctccttaaccttgttcagtctgaaaacatgagatacaggcttcaggtatattgatgcgagagttcctatgttcatttctaattcctccagaactctagtgtccaaattatcgggatcagaagagatcactgggagcttggcgttgactatttcctcaatagcattaggaaagtctcttctgttagaaagtaacctccagtagtaaaaccctctttctctaacatcaatattcccgatatcttctgtagctgtcctgaaagtttcaactacgaggtcttcacacattttatcagccgaaaagtttaaatagactttaattaatgctgttaaaaatgccaactgaacttcagaattgtcctctctgaaattttgcccaatttttttgagtaaagatacggcattcttttccattgctgtattgtactcgccaattaaccatacaatagccaatttggaccctggttcttcaatcatatcaatgttttccatcagattgttcaacattttgctgtgaaggtagggataccttcgaacaattctcttgaaaactacaacaacttcttgtagaatatgtggcactttcgactcaatcagatcagacagaacaagaacggcgtcagttgctatatcttctaattttatggccaagtttccaattgctctgattgctttacgtgacatttgaacgtctgaatctctggcatactcttccaactcttctaaaataatatgcaaattctcctcattggctagaagataaatgatctcaagtttggtatcctttatgtatatcgggtcgttataacgacagaaaaaggaggtcacatttaagctaactagattgaacttgcttagaagtaacaaaatggtgtttcgaagtaacaaaaactgaatttctggtccagaattcaacacactaaccaacgctgatccaattctcttgggcaactggggaatcaaatcctcggggtgcattatgtaattcgacatgtaaattatcactttcaaggcattcaaaactacttcgttgttggactgttgtaaataaggcaaaactttatctatgatctcacaagcagtggcttgagaatcgggagcaaagtatagaatagaagacagactgctggcttgtgcccactcgttgatggtaggaaggatatccaagagctcaaatgcatggtcctctgaaatactaaattcaaactcctccactttctctgtaatatctgagagcgctacaagagcactagagacaaccgaaggatttccatcgtctaatttatcgtttaaatggtcaatcaagtgtgcgtcattgccaatctgaaggtcaaactcatatattcttgctacgcaaaagcaaccggtttttctcacgtgtggatcttgatcatgtaatgatttcttgacagcgggaatagatgcttggatgaaatgttcatttgggatggaagtgagggtttgtaaagccaggccctttatatgagcaggaattgatttactgtagtaatcacgcaataacaactcgatcacctgttccctatcctcactacggtaatgatttgtggaccgcaaacaatgataaatcataactcgtagttcttgatctagactactttgttgagcttctttgtatagtttgattacctcagtaaatacatcaatgatatctgtactttccactgtaatattggctagaaacttcttcaaaacattcttctttttcaaaagagtattcttctccttcttggagttggtagcttcccgaaactccgctaaaagctcggatcctctgcactgaaaacggttaacactctattactggtcaattaaactatttcatactcactttcacaaaatatttggaatcattgaccattttgcatgttgttcgaaagatggtactggtactgtactgatctggaaacctggtagaatatgaaaacatggacgatagcgcagagctccaaacaccattgagatagttgacattcaatcggttgttgtacttacattatccgctcagaaggtaaaatcaagctgaggtttaaggagcaccttgataagaatgtgtaatataaaattcaagcaattgcggtttgaacgttttggagaaagttttaggggataattactacttaagccttgattgaaaaggataaccgttgcggccatatctagcagaaagcaccgtttttcttcagacgaggccataaatccaaaagcttaaggcacagaaatagacaagaatcacaatgttcagtcaggcccagcttggttgcagcaaacaagggtgacatagctccatatagttgagattgtctttcctatacatatgccagaaaaggtgttagcgctctcaaaccgccaaagcttgagctcattgtgaaatctaactagctactgagtatgtaacggtagttcaggatatacctgtagcctgaattacagatagagaactaaaaaactctggatcaaggataacgtaatgcatacaatgaacatgatgaaaaatcgaattgagcaagtcaaaggagtactgctgcaagaagagtaccaactacactcaatagagtgcttatttgaacacttaaccaaggcgctccattagacggcgaaaattggtaaacagtggcagatgagtcggaatgtaccacgacagaagaagctgttttttgactgttaatagtgggagagatattagaggcatgataattacttgaactgccagccacagtgcgaatagcactaagtgaaccaataatgatagtcgtatctgcgttcagattcgtagttgtgtcgtcctctgtattcacatcaatgttcactgttatttcgtagctatagctaccaaaaactgggatactatcttcatcgaatctactaaatgcagacgtactgttcgctttgaacgaagttggggtattgctttgagatgtgctttggggttgcgagataataatagtcacagtatcaattggattctcaggagtaactgtaatcgtttcaggtttactacaaacagcgcaggaactaaactgtgtgacagtatcaattttggtccacggtctgctgaatgctgaaacggaagtgtttaagtatacaattggagtctcaatcgcaatggttcctggctcgacgccacttgatagaactgtatcagttgtgtcgtaggtactggtcgatatttgggtgctgttcacatagcttactggtatttcaacgataacagttcctggctcactgccagtcggtgtaattgtgtacgtggtttcgtaagtaccagtccatggttgggtggtggtcacatacaattctggagtttcaataatcacggtacctggctcggttccacttggtggtacggtgtacgtagtttcgtaagtaccagtccatggttgggtggtggtcacatacgattctggagtttcaataatcacggtacctggctcactgccagtcggtgtaattgtgtatgtggtttcgtaggttccagtccatggttgggtggtggttacatacgattctggagtttcaataatcacggtacctggctcactgccagtcggtgtaattgtgtacgtggtttcgtaagtaccagtccatggttgggtggtggtcacatacaattctggagtttcaataatcacggtacctggctcactgccagtcggtgtaattgtgtacgtggtttcgtaagtaccagtccatggttgggtggtggttacataaacctcgcaacttaaatctcctagacagcagacagcgtcacactgacaaagttctcgtttttcaatcgatcccaggagcttaggcctgccatgatacggctgagtggaaccaaaatttatctctctcctttttctagcgtcatcataaaggtagaaatatataataacagttccaggttcagtaccacttggtggaattgtggaagtgctccaatatggggaacccggagggacgtcagggatccaagacaaagaccatggtcggttgatagttacataagactcaggtagctcagtcgcagtactttctggctcggtgatggagggtgatgacgtcgcatccccacagcaaaatgctacgcaatcaataatctctctgttggcaagtctagggttaaattcgtcatatctcgcaatcttttgctcatagggagtctcccctgttacagtccttattgcctcaggtgtaccagtccacggtgaggtatgagtgatccatttcgttgcttcatggacttctacgacaatagggtgagccaaaggttgaccgtttgcacttccatcaacttctattgcaagaatagaatagaattttagcaaaaccaaaagcaatatcgtaaacttcgtcatggcaaacaaaaagagttacaccatcgataaaagtaaaaaatcaaaatcgggattctggatgttgaaatccaagtttaacaaccgggtcatttcaaatgcagggcagccccacttctcaccggtaaaatcagctacaaagacactaaaaaatcttttcttcttgcctttcgttttcgaagtagatataccgttacgaccgattctatttcagggctccaagagctgcgaagtattctaacacaatgtgaagaatgataccagtgaaatgaatccaatcgtaggggttgccattcatcctcttatatttggatcttgattcaattcggctactgtacctttgaggtgcatgatgcaggtgacgttcgcctctagttggttgcaaaattagcacttgaaaatgacttcatcaacagatcgcaccaatacataaccaggatgatgttgttaacgcctccttagtttgcttcatagggattagatcgagaaagggggataatcgagggagaactcattaatttttcgacggtacaagaagaagatacatcgccgtgctcttattgatgcttcgaaacaatagatgcgttctcatccccaatcttaaaagatgagcaggaaactctttcttttttcccccatcatatgtgcacaactgactaccagttctggctgagttgatctcggttgcttatatgctttaaaaccaagattcaactaggctagacgaccaagtacgctacaatgatcctcatggtgtgttctgaaattggtttgattgcttcgcatttacttttctcatgtaatgaagcttgtgcccagcattgactgggccaaacgcaaaactatctttctgttgttttcttcgtggtcatttgtcttctgattgtggtttatgtgatttgtctaacaacaacaggacatacatcaattgtggagttatcagtcagcctaagttactcaggaaaaaactgcatacacgctttgagaatgtgcatcacaaaactaggatactgcgcactgtaagcggagttctgtgcccaaacttagggtgtatcgctggatgccgctcctttcagctaaacgcaagaacgcactatgtggataatgatctttttctgtcttactgcgacccttgggattcaaatgctactgaacgttgatctatgtgtggctcctcaaatcatggaactcacacttagtcagatattggaagcctaggtcgagctggctgaacttataatatcaagtgacgacacttacaaaggataaaggaaaattggatggttgggataaatgtaggaacgggataagttgcacacatagctctcagcaatttcactgatttcagagcagagccagcagagtgtagcggatcaaattcaaaagtaagcaatcgataagagttattgggacatgcaatacatcgaccaataaaaacattcaatcccagagacttcaaatcatcgaataaattcgtcttagtttactgctagattatcggtctggcaatctcaatataatctcaaagtattatgtcagttcatttagttcacaacagtcaaaacttgttaattgtacatcgcagactctgtctccattctgtttgtacgcatgagctgtgcggaatagtattgcatctcaagtctcacgaacggagaaatgaaatgtctttcagacgcgtcatctctcagttatgaaccttcatcaaaatgatcaacccatcgataatcatacacagtagcaccatcttgctccatctcaaagcacttgcgcaaactataaacccgaaaacaatcagcaaagaatcttgaaaagcccatttcggtaaacatggaccttctgtggaacagtaggaggaagttcagatccccaggagcggaattcctaactcactgaatagagtcttgtattctttttcgcatctagcacaggtgctcatcttgactcattactctcctagtattggacggagccatcacctcaagtagtacgcaaaaatgaaccgacttaaattccagattagagctagataacgtagtctaaagtgcctcaaatcaacccttcgaaccgtcgaaaccaagaatctaagtggagggtctcagtgagaaggtgtacgcttatcgtatctaaaaaaactgtttctagtccgattaaattgctaggagcctaactaaatgaatgccatccatgaaactcagacttgcaatctgctttattttcagtgctaacctaaatagccaaactctatgacggaatagcatatccactagcataactcactgaactatcatacggatcaagaacatgactactttgtgtgtatcctagccactcaaaagtatcagctttccccataagtttcagtaagactgtcagaggataagctccgcaaattgtgttctccgtggcctgaagatattgtcgccatagggagacatctcccttcgaaatcagctccattcccttcttgtccacagcctcaatcgactcataaatcttcagcgagttgctctttccattgaacgcaacagttatatcgtccatagactctaaatctccattgggggtataactagtatacccaaatcgatcgccccaatgacagaagtcagtgcttacaaaaaaggcgttctctttgtcttcaaaatacggctgcagtgtgctggttaatgaatctgccaattgaccagggaaaccactaattaagatgggaatgatcgggggtggagtgcttaatcccttatccaagcaagctttatagtacagtggcatgtgtaattcaaaactgtgctcattttcgtcaacagacgagctcatgtagtcgatgtggcgggcatttgacacaagatcttttatggtatcggtatcaaccggtacattaccaaggggtgtagcgtaggcaccatacctggtagttctaacctcatccttgaaataaatgtgatgagatggtcccaatatgaacactcttttaatccccgtaggatcgaacgaattgtacgtttgggcaagagtcttgcccgcaaatgaatatcctgcatggggccccacaagaactcgggctcctttaactgaagtctttcctgaggacttggctagtgataaataatgactgagttgagagttaagctcattgggattgccagaataccatgagcctgcatgagtagctgggcggactttgaccatcttagatgtcggtttatatcactcttgctttgtaaagtaaagtttaagtaaggaaggctctcatccttgataagggggaggaaaattcgagaagtattagtacatcagtacacatttatatctacatcatcacctggttcctaaatatagagtctgcacatagagccccagaaagggcccaactaatcctcctcatctaaatccgaatcttcgtcagaaaccttgtcttcgttctcctttctttccatgagagcttgcaactcggcatcttcagtagctgtaacagctttgggtgccatggtgacgttacaggatccgccctgtttggtgatggagtcttcgatgattttgattgcacgttctaagatttcaatgccttgcgtcttgtctaaggattgggttgtaatgacgtacaatggagcggctactagcttgaccttgacttgattagcctcggtggagatatcctcagcagcttttagtgaactcttgatggcttcaattccctcatagctgaagcatgagacctcaacgtcagcacgacatttaatggcctgcggcgttagcctccgggagatgtaaactttcagttcttctaagacctcttgtgatgggggttggaccttgtcaaaaacagtgctgtcagtgattgatatcttgaaggcatcgtaggcgtggccaaattccttgcttaatggccatcctatagtacggtacagctcctccagaggcatgttaaacttttcagcacaatgcctcaagatagaatggacagacttggactttgtgtatctctcctcacattttgctatatcctccgacgagactcgtctcttggacaggtcaatgtatcctttttccttatcaactctcagtaccaccactacttcattcttacccactctgataagcttctggatagatctgatacgtcttctggataactcagagagtaacaccattccttcaatattgtcatactccaatagtttcacataggcacccatctcggcgatctgttgtacattcaccatgacaacatcatccacctcaggatatttgttttcgtagaaccggcaagttgatgtgctcattattagtagattcggtagggttctttagtatgtttgcctagtctaagattttgagtcagttggatcctgagattcttctgccagtcaaaaatttcccaactggaaacattttcagcgaagacactactggtgttgaaacaataacttacataatcaaacaatttaaagaatggaatacatgaaatattacgtaaacgttgaagcaagaacgaaccgatcaaacaggaggcaggacgttgtcttcgaagtagccggcagaaacaatatttccacgaggtgcgtattcgcagatgatgtagtatctgtcggtactgcactccttgtatccacagcccagctgtgtagttgatttccagacaacttgggtgaagtgaccggtaccagcagaataacctgggttagagaaatcgtagtcgctgatctcgttgtaccatgcttctacactgccagcaggagagtatccagaggccaaattttcaccgtatggtccacctgtgtgttctaatgaagagccacaagtgtatgaatcggcgtaaccttgggcgtagtcagcgagttcggtagaccaagtaaggtctgggacgccgtgcaaagcacgcttatcattgtgagtatccagaagtgtctggctgatagcgtcgatagaaccggttggagtcgaagtagcagaagagctagtgctggaactagtggttcctgtgcctgtagtaccagtaccagtaccagtgctagtgctagtgctagtaccggtaccagtgctagtggctgaagttccactgcttgttgtacttgcagaggaggtagaagaggtaactgaagttgcgctagttggtaaccctactgagccactagtcgaagtggtgtcgtcagttggagcaccagaggtagctcctggagcaccagagtgagtggtactacccttaccctttttagtacttttaccaccgtggcttggagagtcagttgggatactttcgcccggtttcaaagttcggtagacagtaacaacctcagtgaaagtgtgagtcttggttgtgtcggtgtagtaagcacgcttgtgcaagtggtttgctgcctcttcggctggagcaactggagcagctgagacaacggcggaagctgctgcaatagctagaatcaaattggtggagagcttcattggaatagtgaacgtgttttaaaggagtgacagatagttgggatttgaagaaaacggctcaagagtatcttcttttgttttttgaaaaagacttgatgtatcaaaaagaatcacaaacaacacgatttcagggaaccacaggagtcttataacttctctaacaaaccctgagtgccagggttccaaaaagggggagacgtaaataacgcgtttcttaatattagacaagaagactgattttaagtgtatgaaaatgcatctgcacgacctattgtttcgagtgaaatttggaataacgtgatgagtcaaaaaaaatcatcacaaaaaaggccttttcaaacagagaaacaacaggtgtaaataggctagcttatcttaactttgatcattcaactcgctttaccagagaaattgtcctacttttttgtcttctttgttgcgatctactgagtggaattctcagattagaatgcacatgcatcaaatgcatcagcatgcagattgtcataatcacaggggctaactcaattccaaatgtaaacaactttccaccaggtttcattctgtatccccatcgttcgagccaatgagagtgatctacagggttctaggcatagttggtgtgcgacaaacgtgttctagacaaaaggataggggtaacaataacaaacgtgggtattatatttgaagcatgacatttgcctaaataggagggtactatgtattcaccgatacatacgaatcactgttgataccatttactggggtcattttcacggaattattggagatatcttgggataagactctctggtgtttgctagtttttccgttgccagtgatcccttgcttaaagttctgttcttcttcctcagcatcataaaactccagatcctcagcatattcaaaccttttcaggtcagcaagttcctttgaatagagcaacccatcgcggaatgtatcaacgagagatccagaacctttgatgccttgagatatgcgatacgaacacatctcctggaagacctgagtccagtcaaacaacgcccattcttctttgatactgttttctagattcaggtccaccagttggtatgagctttcagagtccagatactgagtgtgcggtaactgaggtaatccgaagagaagtgactgtttgttatctctcgaggatagaaacttctgaggacggccatacaacttgaaaacgttgaaaattggtatgagtagtcgaatcatggtttcagaatctggcactccatgatgggtctctggaatgatgtatacgaaattcgtcctgcacactttactgttcgctggtaagcagatactactaccattggactctacagagttaacagaagatgatcttagtctgctatgacccatgcttgtcaacgaattacttcggaatgggttcttgaaagatgacaacgatcctgtcgatgaccttttgtttagctttgtttgagacgacgatcggctaagcagaccgtctagatcctggttcaagagtttatctagtaaggtctcattgacaaggacctcgccctctattcgaatcagtgagttactgtcaataaattctggtacttctggataaatggaaaaacatgatctcccattgaaaatcgttgcaagaagatttttcttaccctttctagaagaaatataaatttctatcttaccaggtttatccttgttgaccttttctttatccttgaattttaatgacggaaatgatacgctttcaccgggtatcacagaaatgtaacagcgcaaccactttgcattcaaccaagggaaacgtatagtcgtccattcctctttaacgaacttgttttcgggtgccaaaagcaccttgatgtctgaaaaattgacggcttttgcactcaacaatgctccagtgaaagctttttgcatttgctgatactcaaactgagccaagagtaaagaagagtaaaacagtttcaaatcgttgatattggcacatctcagctgcagctccctttgaagactcagcgtgattttgatgattaacctggaaacgtccagggagaacgcagcatctacaatgtttgcgtatatcggtttgaacaacccaacctcgtcatcctcagggtcattggtggttgctaaggaaccatcctgattcataccccagaaggaaagctctgttccactcagtttggagctcacaattctccagctatcaggcagatctagtaaactgtcgttagatatactcagatctggattatctggaaccttgactagtccttcaacgtagattctcgcctgctgagcgtgaatcaaggtcactataggcagcatctctcttgggagtttatcaatgctgggcaaatctgagccattcggaaaatatgaattcaaattgggcgaaacagaatgtctcaaagttgctgttggcaatacataggctgctcgagcactggtagatgatgatcttctgtgagagaccttatcagataaccttttattcacgtcagaggaggcagacttcgatgtagtttcacttgagttaagggaagtccgcaagatttgctctttatctttatatgtcaccgcctcgttctgcgagtgctggcctgtagggacatcactcggatgcaactggttggcttgggtctgtggagacttgcgagtttgctccttcttctttgactgcttcttccgattactacggaacagctgctggattatagacatccctgggaggaagattcaaaggaatttttttttctgagttacaatcgcaacataaaatcctgatatggattatttctgattatattaggcattgtgagcgcttatttacgtaatgggaaaaaattatctaggggatatttttttatcgtttcctaattaggatcttggaattagaaggttaatgccaagagaggctttttaccaataatcatagagaataacccttggggccaagagcaagtgtagattgattgcggttgctggtcatggcttctgactaattaaacattcctgacttattggatggtggcacattgctactatctatttttagtgccgtctttttagtaatagtaatttccaacggagaaggtaaaccggtctgatgaggcacacgatccgtctattccggaagcgagagattgtagagtgacagccaacttccaattctgtagtcggaaaaaaaaatgattcggccgagaattgaactcggagccttctccgtgtaaaggagacgtgataaccattacaccaccaaacctttctgttgaaaattgtaatcataaatgctatgttaatagtatctcttagttgagccgtaaggactatttgactctgctggaaccattcagggtacgataagcaatagcaataacaataccactgagacacgacaacattgatcgaaaggcgttactcgttaaataattcttttgattaacaactctatttttctaaacgattaaacaattacttctatgaataaacttcacattataatacaatttttctcaccgtaaacagcttcaaacctctcctttgcaatttccctctctgtttcgttctgcttgatttttacttcttttggaaaatacttctgcaggtattccatatgttccacgtccaaattactgttatctgcgttcaagacgacttccccacggcataggggacatctgtcttcgccagatctttgcagctttacgagacatctcacacaaaagatgtgtccacagtctagtttgataggcttaaacgcaactgagcagcatataggacaagtatagtcatccagttgaggaattatcgataaaaggttggtagaaatcttgtagcataattgctgggcaaacgactcttcgataaaggtattgtgtgccaatagttttggaaaaatcagtctggtgtgcaacgaagtctgcttatcaaactttttcagaatttttgtcatggccattttgttaagatattgaaactgtgaaactttcaatagtctttcgtttaaaccgataaacgatttaaaagctgacctgcttcccttttgatgaaacgccttgtggaattttttgttattaacgtggttccaaaatgctgctagattagcctttgcttgttggacactgcgttctccagcggtgcttgtggatgacttgaaaaagatttcagagtcaatgtacaacttgaaaagctccctccatgtatagagatccgacctgcgctttacaaatgaagttgactcactaacggacttactgatcatgtcaacctggtccactaaatatcgcttttgggcctccttgaaattgttgagaccttccaactcgagagatagttccctaaaaaaaactgaagtcctcatggaaatgaaataccaaacaggtcgcttcctcttcctctttaacttcgacaactttgaacaactcatcgtcttttaaatattccctgttgttgacaaattcccatagcctcgaggaagtctccgacttgggtaaaccttgcttgtcgtgggggaccctgatgattagtttgggagtaataattttactatctttttcaagcacataatctgccagcctatggtcaccttcaaggagcacctcaatgaggtccttctccaaacacgcagattccagttctttgactactcgattaatgcatttttttaaagacttgtattggatgcgagagccaatccagtcttctggaatctcttctgacttgagcatttcatcatatagcttagcaaacttcattttatgtcatgtccaaaaccaaggtcatcaagttgtctgtcaaaaaaaaggctgcgaattaacgtgggaaaaaaaattaaggttgcgaagacgatgcgaacaatctctatggtctcacacgtgtgggcggaagaacaatagctgcagttcagtcaatcaattaaccggcacagaaatggctgtcgataattcaaggtgcgctgtctacagttgatataggtttcaagagtgtcaggcttcttacaaactggaggagatccatgtgctctttgcagagattctaacgaggaaggaagcaactacctcaatgaaggtgctgggaggttggatcgtcctgattgtcctttgccgccaaattaaaccagtgtatacagtaatgacgagctcacaagttgcatctagactagcgagtggtagagcttaattattgttatttacactttggttgtgagcaaagcggctgtcgttttcagccgtttcagtcgcaagccaagactgttggggtacatcctgtttttctctagattctctttcccgctcgcctccgcccacaggcggactgcacttttctccatactaaccccgaattattgcaactccctttaaatagaggtttgcgttcaacccaatgtcagaaaaatatgacaggcaacttcgtctctgggctcaacgtggccagtctctactgagacactctaatgtttgcctactgggtgccaccactactgggactgaagctctcaagaacctagtcttaccgggttgtggcaagttcaccatagttgactcgtccaaagtgactacctctgatctggaaacaaactttttcctcacacaacaggaccttggttccaataaagcagctgccgtagttcgaaacctcaacgaattgaacccagacgtcgaaggcactgctcttgatatctcattgaccaacaacttagttgaggatagtcatttttggtcgcagttttcgttgattatcatagcttccagttggcatctacagaaagtcttgacgttggctgatacattatgggatatgaaaattccgctcatccatgtttcgacaattggattttacggttacatgagaatttacatcaaagaacataccataacagaatctcaccctgaatctttcagtgacttccgtattgatcgaccctggaaagaattaaaagaaatgagtgactcagtcgacttggaagccgatgataaagagcacattccgtacctactgatactgataaaggccttagataggtggaaatccatccatggaaaacaaccatccactccaaaggaaaaagctcagttcaaacagtcctgttccgaactgcaatctgacctaagtctgcaaaattttgaagaagctgtcacattttcttggagagcttcccaagtttcgactcaagtacccgaaaatgtcaaaactatcataaacgatccgatacttgataatctatccagatcaacgccattattctggatttacgtaaaagcactaaaactgtttatcgaaaagaacgggcagttacctcccctaccgggtgtgctgcctgatttacattccagtacagaagcatacatcaagctccaacacatttacaaggcaaaagctgaggaagatattattgagttcaccggcttggtgagccaaattttgtcatctataggccgagatgctgaccacctagatcatgactcaatcaggatattctgcaagaattcaagatatctatttctacagaggggatccaaaacattgattgaccccagattgattcgtgagctcggaaacactccattgttgtcattatttattgcattcattgctactcataagtttatggacacccattcgggaatcattcctcaagagtcagattataacgaactaatttctatagttcagcttatcttgaagtcggaaaaagtgcctgactttcttagcgacattgtgaaggaaattctacgatccaagggaactcaactgcataatatctgttcattcatgggaggaatcgtcggccaagaggctgtgaagcttattactggccaatatatcccacttgaaaactcattagtgtttgatggcatcaatagctgtactgaaaaatggaaaatttgagggattatagatgtctttgtttgatagagctttgtcttcgaaatttttgggtgttatccaatatattagtcaagtagccttcagaaatttcacgatccttcaataactctaaccgctcctgattccatcccgataatagctcgattaattgtgaattaaaacctttcatttctttcagtatatcttccaactcttgttccgacaaatggccgtcagtgtaatattgttcggattgtaagcgtctttcaatgttctgcacaatactatcactttcctcggtcaattgtttggccctttctgggctaacctctacgaatggtatgtcggtggctaatttgtccgtgctgtcagaaaatgagtctttaccgtaggatttacttatacccaacttcctttctcttggatatagctcatccagatcaaagggaatgcttaaattgagaaatagctgtctccttataatactttgtttccaattcaactgttgaagattatttggctcacttgatagttggtttaacaatgccctagccctttcatcaagaaacggtcgattttcctctatagcgttgtttaggtcctctggttgcactcctagtataccattcacaatcttgacaactttttcatcactcttactatccgattgttctaagtcttcaattgagagagtactgaacgatctcgttggttcatctagctctggcgcagcctcaaattcctcaaaagaggcatcagaaaacgagccaaactcttcatcttctttggctttatttacaacaggaacttggctctgttcttcatccgacattggtagagatgggtttctctgaatgcaagattgataccagcaggaacgctcctctaggtccactctggcgagaaaacctcattacataatcattagaagactaaacaactaatctagtgaaagataactattattaacagagaaacagtaaacggaggcaaaaagagacctgattcaatcatgcctactatcatgaattctgtctcggattctgtctttcagttgcgagtcatcattttcattttctccatcgctcgattggtaatctgacgataattcagatgaaatagacgaaacatcggtggttggagcagaactagtaccaccataaagatcgttactgaaaattgggacgttggatatattgattcccgttgacttgttgtcgaatctgtttgagggagcttctgtagtcgatgccgcctgcttcctggcggctcttctccttctcacatcttgagttttgagttcttcctcctcatcagatgaatctaatcccattgatgagacttcaaaagccttctttctgtacttctcactcctcttcttctttcttttactttctactttcttctgataatccagtagattaaagtcggagaatagttgagggccaaattcattcactacctccgtgatctccaaactcagttcctgtctctccttcttcaaattagatagagtttcgctgtctgtaagaaatagccacaatggctttaatctcttgaatgaatccatgccaatatctccaacaattagagccgaatacgtgatagtagcagagagaatataaaatccgaagaaagtgaaggcagtctttccaaatccaggttcgatatagtaccttgagcgaatgatgtatgttccaaccgtagagtagaaaatatataacagtggagcaaatccaagactcaccaaaattttccaagtggcgacgacatcaattgccttgattttgaccgtagaggctgccagggcttctttagcctttttggcactgattttgcgggtggctacaaacactgggaaaaatagcagtgcaccaggtaacgccaaaagtcccaatagagcaaattggaacaaattccccaacaactcagcaaaagtctgcaatcttttttctggtcgataatcgttcaccttgtgatcagggataccggaaagtcttaggacttcgtgatatgctagtatcttttccttcaattcttgaattctgggctcgttctgaaaatgttcatatcctttgactagtcttctattcatttccagtatcgattctagagacaaacgagaagagaagttgttggagtataaccttctcgctgtttgaatacagactagtgtctcataatcaggacacgtaactgtaaccgattttaatccttttgtgatgattctcaggacctccttaattgcatctttggtggtctctttattctcatacatggaaacgagttcatcagaaatttcaatgggcctaccgaactccaccatagctcttgatctgaatttatgaggatggaagtagttcattccacaaggaacaatctttactttgcagctcttgtcactgctcatggctccaagagccatgatggccacaccagctttcaaaggtaacagatctgttctatcatgagagcctccctcagggaaaattccaatggaattgccatgtgctaaatgctgaaatactttcttatagacaatgctctggtcaattttaggagctagcttgtaggaagttccttccgcaaggattctattagctttctcctctgcttcagtgctaggatgtctgaactctttcttcagtattaattcggtatcagatactacttctcctatttcagaagttcccagtgagtttggaagggccaacatgcgttgattggcacaatcctgggtgaaatacgtatcttcacctacaattctaagtggattctcagagtctcttcgaatttttccccttccacctttcaagttatcctgagccctgcttacgggaatcgccatttgtgacctagatataaggccaatgaactttcttctgtgagacttttctgccactagaaagctaattcttcttccggctcgttgttgaacctgtcccatcaaaatgatagggtcaacaaattggttagcatgaggtgctccaacaaatatagttggcccagagcggggcaaattgaaggacccacgggacctgatttctctgaagaaacagtcaaacacaacgcagaaactccaaaggacaatgtcgtagatcagctttcgaatccaagacacctcaacgtagacctcttctgattcggaatccgcggtggcggatgatacttcaggccacggtttatccgattgagtggaatctggctgcgatccggcctctgccattgtactacgggttgcaaatgaggaagaatttatcaaaatattaggtttattctcactcggtcatcagatctcactgagctgcatagttgaaaaagacatctagcatctcggaattacagggtctgtattaaatttttaaaacactgtatctacttattcaacgggctataaaagttaccaatttgctgactcgtatgcttatcttcagactccgtattcttttctgtatctaaatccgagattccgcctgggcctgtttgatttatattgatggagctttggttcaatggggatgcagggtaggtattaatgggcacggtctgcaatggcttggaaactgactcaaccggagtaagaacaggaacagttaccggagttgggctgtagccatatgagtgaacagcagtctcatcaaccagcaagtttttgaattggggtggtggaatgaaggtgttcactggttggatggaactattgattgatgttggaatagttgaagccgactgatggtttggctcttgcttaggctgctctggaactgcttctactggatgagacttggcctgctgctcaggagcttgcgcaaatgaagtgtttccagaactttcgttatcagaagctgcagccgattcagtcttgaaagatgaatacttgttttcatctggagtaacgggcaccggagaagaagttcctgacagccctgcttccagtgcccgtctttgttgcaatctatcagctctagataaagctgtatttgtaggaggtgcagattcttccttttgggtttgtttcattatcaggcgtctgctagacctcaaggccgtaccttcattgatttgccttatacgttcatcatgctcttttctcctttcttcttctctttggcgctcctttgcctccaatcttgaagatcgttttctattggctagcagtgattgcaactgaagttccttctttctgtgaagtgcttcctttctcttttttaaatctgttccatatatctgctccacaaaaggctccagtgctttcagtaatttgccctccttacttgatgttttcttgccagttttgagttttaaattgttgaggtattcgtcaaactcatatatgcccacagttaagcattcccatctggttatcttgggttccagatccccaaacgggttttcatattcgtccagtaacttcagatattcctttcgttgagcaggaaccttgatcttggggaagctccattctctgtaatacattctgtcatccattaaaatgaggtactctttcagtaccgaatttttgacatcatcttctgcaaacactggtagcagcttcattgtgtcccaggggctatcgtataattccaccgtttttcgaacggtagcttctttgcgaaccatcaacaaccgtaacagctcgtagaaaatatctagctttacctcaatggatgcatcgttaaaatcgaacgcgcttaaggcttcatctgaatcgtaatgctctaaaaaccagttaggaagaatgctttggatctgctcattgaaaagctcaggatgatttgctatgttgtcgatcctgaatccattcaaggcgtagattaagttcgacttgaattttaataagaacagttcgccgttgattccaattaattcctcttcaaatgagataacatcaaagtgcacctcgtacagcttgattactcctcgtaatagataaagccattgaactatgaaagcaaacttttcattgtttcgaatttccttcaacctgtcctgatagactggttgctcgatggtcaaacgaggtggagtttttgccagctggattcgaaattcttccggaacaaaatctgaaagccgctcggctggatgacctgtagaggttggaacaggcgaggatactggcattcttccaaataggcaagatagtacttgaatgaacagtgagttaagtcgaacgcgttaagaaaagcagttcgcgccctcaagtgatcaccgaaagaattacgattatgattgaaatataaactgaactaccttgaagacccatagagggcaattaatgaattgaaagattctccaagcaaaaaaaaaaaaagatacaacgaagggatacctcagagttaaaaggggtaatgatatctcttaggtttttcttcctttggaagatccactgcgatgtgggttaaacttgtaatttgggtagcagagtttgtgaagacgcttctcaacttgactgaacttaccaaactgttctttgacttggctcgattctgtaacccacaacatggaaatggcttgccccagtacttggtgattggttttcacgacagtgggaatcagtttcaggatttgactaaccagagaaggatcattgtcatggagctttctcaacactgaagggttattcaggtcaattgaattctcaatgctcttaacaacatttagcacgattcctagcttcagcaaaatacctctgtatagcatgaaactgttcaagggcctcttgatatgccctgcctttgtcctaagattggaactaagtggagacgaagccaaggtgctcaaagaagacgtgagacagtaagtcgatgaagacgtttccggtgacgatggcgtatgtagcaaactcgaattggaaggatttccggagcatgcgtcaattagaatttgcaagctatcgtccttatcatcaccgcatgatgttctaacattgacctcgtattgttcagcgttcttgtcttttacaagaatagggtgtggatgatctctaatcccgtttcttcggttaattaataggtttccaatgatatccactttggcttgaatattgtctatggtaaaaacgcttaatgacttctggatatccttgaatttgagctttctcgaagttgcaagggtataaattctttgaactctttcatcagtaagttttgaaattccaatccacttactgattttcttaacatgggtctttggggcgcttggataattgacagacttaggcgtaatgcaaacaggctttactttgaatttgaaggtagaagatgactgcgttggattaggagtttggagtcctgattccaacttagtttcctcattggaagtgctagaaattgaacagtgtggtttggcaccggcggataccttggactttttgctttttccgaggagatttatatgggcttctgaaaagggacgtttgacggcaaatatgttctttctgtcagtttgctcaatttgggaagaagtagcagtacaaggaaagaaagctatttcagagttatcgagaggcggtgtgaacagttgttcatcgtcatcacttgtatctggctcactgaaagacccagtcattctatcgtctatcataagcccagagttcatgctaaaattatgaaacgaaaattggctcatcaatgggttgtttaatctgtattgatgaatatcttcgtccgtgttgtcagaaatattgaagatgtcccttactgagacaacgccgttgctgacagatttcggaatgttaccagacatttcattcagggaagaactacccgcattagcagctggtcggcgcaaaagatcataagtataaagaatttctgattcattttgttgcctgatagtgatcaattcattgttgacaattggggttggcaagttgtggctcagatctgaaagcgaataattggaagctaagagatccggagttgaaacatatcgcaatggagtttgaaagttcttgtttggcgaagacattaacggtactggtgtgttttcctcgttcagcgacgccatcaaagagggaatgggtgtgcttggtttgctataggagacatgggataccgctacctcttccgcatgatcattgtccatgattaattctaagctggacatgggtaagaaaaagagttgtaatttcgaaataggtcagcacacggcagttttacgctgataggacaactagtaaatagtgggttgacaaaagaaacaaccggaaccagaatccaaagaaacttcggagtacagtgaagaagagaagaggagcaaaacgtgcctgcttatttatacctcgccgccaagtagttggggtcttctaaagatcatatcaaacaaaaatagccaaagagttattcgtgtaacttttgatgttatcggtgggaaaattgataggtgacagatgtatacaataaaatcgctgcaagcaaagcatagtgatgcatctatcacgcgttaccctaacgattacgcgcaaggtactttcaatttggttcggagtatagacagaatggccccccactccactaaaatgcttaaaaagaacgtgccataattgaatagttacaacctgtggtactatcagtcaattgaacaggtgaggagaagatgtggagaaaagagtggagtataactgagagcacatgaatacataagtagaaatgacattttctacaatcatctcgtgcagttgtatcaaaagctatcactcttcgaggttaaacatcaccgttgaggcacaaattgcctcatcaggcccttatatgatcaagctttgcgatggtttcctgcctttcggcgataggcacgtgtgaaaatgatgatctatcaccagaaggggcgacaacaaacaagctactgcaatgcctacggatgataatagcaattaatgtatgtgaagccttatgcatgtcgcaataagggtgtatggactcacatttaattgggatcaacctcagctcgaagtgataacagctgatagtaaggctgacaataaagcttatgcactcgcaagtttgccaattatacgtcacttttgatgaagatacacaaatagttgttctggcgatgattaggtgcctgtagcaattggtatgttgagagaaactgagaccaaaagatatggggacggttgcttgtacattttgtaacctattctcaagttcctgactggatggttgtcgcaattagtcaaaactggagccacagatcatcttgtttgaaataggggaaagcctactgggttaaatactgaacactggaacaaacaaggtgttagtttcctaccgaggtctgccatcagtttccttgcagaaaaaaagcaataaaaaataccctgagagtgcaccacacaaattgatttattagcatgtgatgacagtaaaaaaacaccctttgttgagcctccttggtacgtactacttactatccgccccttcaaaaatttattttggttttatataagaagatccatctcaggcaaatttttttttggcagatggcagcaaccacagcacgtcctcagagaataggtcgctcgagagtgtcgaaattagaagaaagaatatcaacgtcttcctcctattcatctctctcgtcgcttgatgctagtgatgataccgtgttatccaccgagtcaacaagcccagtcttagataaggctaaaaatacatccacctcgtatttgttgttacaaagccacaagaggttcaataagttgattcataagcatgagttacccaggaaactattccatatgtccatcgggttcttcacattatacctgtacacaaagaatgtgcagaaagagcaaatccagttacccctggttgtgggatttgtagtggtgtttgcacttgatttaataaggttcagatggcctcaagttaacaaactttattgttccactgtggggttcctcatgagggagagagaggtggacgagtattataacggtgttaactggtacctgctcgggttggctgtagttttcttgtttttcaagaaggatattgcagtcatggcagtgctgttactaagtttatccgataccgctgcctccacggtcgggagagcttggggccagtatacacccaagatcaccagccacaaatctttagctggttcgttggccgcttgtgtcgttggaatattgtcatgctacctcttttatggatatttcgttccgaactatcccgaatgcaatgacattccaaaccagttcgaatgggtttccgaaaaaagtggcctcaacattcattcattggccctcctttctggattggtcgctagtgtaagtgaaggaattgatctcttcaactgggatgacaacttcaccattccagttctatcagctgtgtttttacgactggttatcaaactgacaaatacagactaaacagggaacagcaagatcacccactgaaacacaattaaacccagccatgttataatcaccatgtatatgtatttattacctattatacttagaaaattgactcatttacaccctcgtaactttatgtagtaccggattccttttctttttggatcatctcatacagcccaaaggtctcagagataaaagtcaaccactcattaatggatgagcataacagccatagattataggtgacgctcttccgggattctgcaagtgcatcatcgactctgaaggtaacgtacttcaagacgattgtctgaaacacgtcaaacatcatcaaaaagctttgaagccgaagtgattggttaccaagggcttctctgatcttggaaaataaattgacaatcagtggaactaagcctgttagtagttgaatatccacctcattcgtatttgtcaatgtaataagaaaatccggaatctctctgttgaaaaattcgattaggatattggctatgtttgtggactcggagataccaaaggtctggagacatttctttgattcagaatcaaatactaggttattaaattcttcccaagttccaaaagaacctgctgcaacagagctaagctcgtccaccagtgaatcttttatcagagcatcagcaatcactctttcaaactcttcattcaacttgagacctttaagaaacttggaaaggatatttatgaatgaatgcaaggccctgactctttcagagtcaagggaagttgtgcctgcatccaaaaaacccatgaactggttggctaccaaaagtagattttcactatagactagctgcttcaccaccctggcgtcactcaatagcaacacgctcacgtcaaagtaaacttggaggtcatctagaagagaagaattttcagtttctattattttgagcaaggtatctgagcttcctagcatcaagttttggtgaaatgatggtgaagttggagactccatgtgcggggataccgcaatcaactgtaaggcctggtttgatgggatttcagtataattgttaatgtatgaatggaaaggggattcgatatgttcggtcacatctagattctgtttcaattcaaacagatgatgctgacttttttgttttttgcgtgtgattgctctctcagggatgcttctatagctctattagagaacttacccttagcatcgatatcagagactgtgctcagttttagatactctggtttaatgtctatgcccatataatgatattttgattggcctctagtcccaagacgttttgtctgaatgcctgaaaatgtgattctgagaagtttacctaaagaagaggatccaaaaggctctacatgacagctttctgtcaaacggtggtatgtggcataaacatgaacacgggggacagaggcaataagactcgtggatctatttggcgaatgcgagtgttgattactttctctctgccgttgccggatttccctttctgagggaatatagagaaattgaagtagacaccttattgtaaacacttgacgaagtctttccttttcatggaactctttactatctacatctttggaaactgatttcatatcctcgtaagtgattcgatactgcttggccaagtccttcagggagatttccatccgaagagactccaaggcctgttgaagtttggaatcctccttcatcatcggcgcaagctgttcagactgcgaggttccaaatggctgaatcgatggggaaggctgcaaatacatgcctggatcaacttgaggttgagattgtgggttcacatatgtgcccatatctgcatgttccatgtgaaaagaccccaaagctgttgaaatacttggttgatttcgtctatgtcctaaaggccaggccgcggggcttgttgtgccaaattgagtttgcagttgagacggtgcttggggctgactagggaaatcaaaaagggcattatgtgtatccagttgagccatggagctgccagaagtttgtctttggtgctggggagtgaaaaactggggttgttggtagatgatttgttgaggagcggtatactgttgttgatgtgaggggggaacggtcacataggactgtctagggacttgctgttgctgaagctgttgctgctgctgctgctgctgttgctgttgttgctgttgttgttgctgttgtttctgtggatcacgttgggatccggtaatatcaccgtacggattatcattttgcatagctagaattcatataaccaaacttccgctttttgaatagactctctctttatggtataagaggtaaccacagatgatttgaaaggactggaattaaggatcactgggagcctttgatgggtgtgattggtttatcggatgggacgaatgcttgctctggtttgcatcagaagagatcaagccgcggcgtatatttatttttaagttgaaaaatacacaaaaagaataggcaaaaggtatcggaacaataggagaaaagaatcaaatattccaggttgaggtgcttaaatcacattgcataatctccagggatgaataataggcggaatcaatagcaatggaggcgcttagaactaggacgtaactagtggagattactacaatcaataccatcagaagtctagacgcatcgagcggcacgggagctgcacagggggggaactagtaagagtaggcggagttttagacggataaattgtcggaaacctataaaatgggcttctagaaggtcatcatcttgcctgagcacttcatctggggttacatagtgcgtataggcgagctttcttgagctatcacgaatccataaatagtatggaatgaccaaacgttacctaaggaataactcctcgacatccgaaatcttgatggatgtccagagggacttgcggagtgagggagatggtggatgtcatgcactttcgcccaagatccgttccacccagtgttctcaaaatttacgcggttataccaccaagaaaagttgttctgaaggaaattcctgctaccccgtcacgacgaaccaattgaggcaatcagcagtgatttatggcagatatcctccacccgtgaaccgaactcgtaactctgtcaatccgtagagttttctgcgatttccccaatgaccgcgatagccagcttcctcttctcagatttctcgccatctccccgaaccttgatcatgttttttcacatgcctaaacactatataacatgctcccccttcggtaacttcttgtagacctcagtttggaccgtataaatataacttccccatctcgtcagttttcttttttcacgatgtcggcaccattgttgttcaaacgttcattttcaatgtctctcagaagacaagctggtcaactatacaagtaccaggactcattaccaaacttgcctgtgcctgagctatctcaaactgtggagctctataaacgatcattgattcctctgtatcctgagggagagaccgatccaaactttctgcgctactccaaagtgattgatgattttttcaagactgacggccccaaattgcaggagcgtcttcaaactctggccaagtccgagcgaaactggttagcaaaatattgggataacgttgcctacttagattatagagacccagtttctccctttgtctcgtattttttcaaccacaaagatcaccgcaacatcccgttcagaggagaccaattgaagaaggcggctgctcttaccagagaagtcgttcttttcgcacaggctgtccatgaagaatcactggctccagaagttatcaaaccaagagttggagccgctaatcaaacccctactgctttttgcatggagtcgttccgttggatgttcaacaatggcagagtgcctggagcaccaagcgacaccaatattcagtatgatccttccaagaatagctatgtgactgttatttctcatggaaacttctatgttttgaaccaccacgattcgcaaggtaacccgctatctgaagccgatttataccaacagttgactgaaattaagaaacactctttggtcaacaaacaaggtgagattgccccagttggtgttttaacctcgtctaatagagacgtctggtacaataactactctgagcttatccagtcccctctcaataagaacaatattgagttgatcaatgcttctacttttgtccttgcattagactccgactctcctgttaccattgaagaaaagtctcgtcgctcgtggcatggaaacggcgccaaccgctggttcgacaagcctgttcaaatgttcgtcgctgagaatggctcttctggatttttgggtgaacactcaaaaatggatggtactccaactttgggactgaacgattatgtgaacaagaaactcaagtctgaaacatattcatttgagaccgcttccacttcagacaagcaatggaaattcctgaactgggacattactcctgccactcaaactgccatcaagcaagaattggctacatttgaccagaccgtcaactctctcgatattcgtgtttggcagtatcctggattaggaaagtcgttgatcaagaagttcaagctttcccctgatgctttcattcagatgttgatccagttggcttattacaagatgaccggtatcagcagacctacttatgagagcgcatctacgagaaagtttttcagaggtagaactgaaacttgccgttctgtttcaaaggaatctttagaatatgtgaaaaaatggcaagacgccaacgtcagcgacgctgaaaaggtagctgctttccgaaatgccgtttcttcccatcttaattacattaccaaggcttccaatggtcaaggttgtgacagacatttgtttgggttgaagcaacaatatcaatctggggagactgtccatgagcttttcaccgatcctatttgtgcttactctcaacactggtttctttccacatcccagctgtcgagtgaagaattcaacggctacggttggtccccagttgtgccagatggttacggtctagcttacatggtcaacaacgaatggctgcatgtcaacgttactgttgcaaaggacaatggacttggtttgcgtgccgatgttatgcattactatctgactgaggcagctaatgagatcaaagagcttttgaccaacgaattgaaccaaaaccaattgaaggccaaactataactacatatctaggttttttttctatcattcaacatagtttacctacaatccctcttaaagcagtattattgtagttctccttgtgtagaaactagcgagatctccactagcgcgccgcctaaaagtttcctcctctccctcgaagtctcgaaagaaacaaaacatcagcttgaacttcactattatccatggctccaaagagaaaattgacctccgagataggaagtagtaacaaacaacagaagcggaagggttctaccaccaccaagccgtccaaactggtggatcttgacgtcaaacaagagtcgaacctgaagggcctcacgttgagacaattcttcacacacgtcttggatcaactggaaacgttaaccgccatagaggaagagacaggggccgaatacagaagaatcgacccatacgttaagttaccatccaagaaattttttcctgattatttccaacttatccaggtccccatttcattggaagaaattgaaaagaaggtcaaagccaacaaatataaagatgctaatcagttcttggaggattttgagctaatgaagaataatgcaaacttctacaacgatgcagagtcaacgattgctaaggactctgtgatcatttgggaattcgtaaaagaccttgtggaaagttatgagtcaggatccactccagatgaggaagattactctgaaaagataggaggggtcattgatgaactgttaagtatgaagaaaccaaaaatcggcaagctggcacttccttttattgaaagtgttgatcgagacgagtatcctgagtattacgaagttatcaaggaaccgataacgtttcaaatgattcaagaattcttgaaggagggaaagtataagggaggaaaaaagggtgtagaaaaatttcaaaacgatctaacactgctgtttaataatgcccgtacctttaatgattccaaaagtcttatctatcgaaatgctgagcttttggagaagaaggctgaatcagaaatacctttgatatataaggaacctgagcactcatcgataaagctcaagataaagcctatcaagacagaaactgaagagagcctatcggcgaaaaaaagaggtagaaagcctaaaaaggccaaagctgttacttttactgagaaggaatctaagaaagtagttgaaaaatcagataatgaggatttggaagaaatcaacgaagatttggatctggacaatgaaccctcgttataccaagacgatttttcagatgaagaagagcaggtagacgagacgaagctcattgacaagaattctatcgtgaacccccttgaaccttcagaatcataccgattcaagtataagagcagtgacaaaaacgacactgcggaatatccatacgaggaacccagcattaaagaagtatcgtttagtacgttcagagctcgcctgattaactctgctttcaatgttcacagtacggacaaacaaatgtatgagtataaatttcctattaaagagttgattccaaacgaggagtcgccaaacaaacgagaggcacatttctcactaagtctgccctccattacagaatcattccatttcgacaccaaactaaaccctgatttgagaacagatgccaaatttgaaaccaaattgacagtgaataatgaaaagatgaacccaataccttcagtgagctacgaggatatattgagttccaaatacgagatgaaattagcgattgggctaaacctggtagaattccattgcacagtgtactccaagccagggaagaatgatgttgactctatcaccagattgccctcaagacatgcaagtgattctaagggtgccaacaatgtggtacacgagaagattctgatatggatccacattgcccagcaatagattttgtaattttgtaacattaatgtgtttctttctatattatcctcccgctcactctaagttcaatactagcggtagacttttcagggattcgtcaatggcaaagtcttccctgattttcgcctccaattcgctcaaatccttctcactgtgcagtgtcgagttcagagaattagctcccttctctgagggctgcacctcctgattagtatccaggtggaaattggtaacgtcaatcaggttttcattcgtgttgttaactatgtcttcgagttcgttatttctggcctcgtaaaaatgagagttgacagcattgtcctcatcgttcaacaaaggcgtgttttctgaatagtcattattgaggtcgttgtcgtcatagttgggtctcagacacgagaggcagattcccattgtggttgacaggatggagactatagcgcggacatgatcaagacgagggaagatttcgcggagtagacggagtgaatctcagaacgattacttgagctttctcgcagggtaccccggcccaaaataagtggacacttgtggcggcgcgtgagatggcaaattccttcgcgataatggtgaattatgtccacaaagtcatttagcaattttccccactacaaatttgtcaccgcttctctgcattgacaactaccacgcacacgttttacattgtgtggcaccgccacacaatgcaattctacaattagcctcttgacagtagtaaacaccggtgttgaactaacttacttgataatatacaataacgcctccttccctaacttttaaatgtgttgaacttttaatcgccattgaccgacatgtcgttttcaatgggctttttttgaatgctctcgtcttaaacagagatggccttgggttccgttctgagaacatgagtggggcagtggtaaccatcagcattcttgatgaggtattcttggtggtaatcttcagcatcccagtagctagtcaatttttcaacttgagtgacgatctcgtgatgagggaaccacttcttctgtgtttccgccaaagattgctctgcaatctctttctcctcttcatccaggtagaaaacagcagatctgtattgagtaccaatgtcaggtccttggccgtcatcttgcgttggatcgtgaactaggaaaaaaaagtcaatcagctccttgtatgaaataacttctggattgtaggcgatctgcaatacctcagcgtggtaagtcagaccctgacaaacctccttgtaagttggattggccagatttccgttggcaaagcctacttgcgtgtcaacgattctgtccttaaaatgcattttgtaaatgtactccaatccccagaaacaccctccagcgacagtaactactttgtcctgaggtgacttcttgatgttggacgaaatgagggagctaacgacaggcatctgaaaaaaactacgtttggaaaaacgtgggaaggaacttatgaaacgcaaactcgttggtcttttctgggatttggcggaagctaaggtatttatatattttcatttccgttctacggtatttgaaatttagtaaccgttctgacgtgctattagttgatgtcacgtgtaatggtgaaatttttcatgttttttcttcctacaaagcgtttctttttgcagagctcatcacaaaaacagcaattgccgagatccgacccccaaaagccagagccttgaatcgcgacattattcccgagtcttaggtaataatgtgggttgagacatgtcgttttttaaactttctcaaatcctgggcttagaagtggagttgacagaaatcacggcgcaactgcactaaaaatgtcacgaacaattgttacatcaccttcgtatgccgcacttgcctttgacacgctgatagcagctctttacgaacgcgatccagctccagttgttttcctcctgaaggatcaattgcgcagtgccaattcctcatccggttttaagccgcctcaggagctgactaagtttagccttgccgattacaaaagagccacacgaaccgggacgtcaagcgcacccgagcctgacactccgctgtttgtcacttggaatttacgccacaatgataaagcaacattacccacaactgaggaagacagcaaggaactgagaggctgtatcggtaacttttcctccttacctttggaggaaggtatcagggaatacgctttaattgcggcttttgaagaccccagatttccccccataacttcaagcgaactttcccggctggaatgtagtatcactttgctgaaggactttgaactcattgatgatccactgaattgggaaattggcaagcatggactcaggatctcaatccagtcccccttctcatcacgacgactatcatcgacgtttctgcctgatgtcgctcctgagcaaggatggactaaagatgacacattggaacatcttcttctgaaggctggagtccctgctggcagtggctcttgggaagacttccacaattccaacaaacttcaagttacgagatacaaaggagtcaagtcaaagatatctttacctgactacctgactttacgtggtcagttggaagattcaattagcagcgcttaattaacaactatttcccaatatggagttgatcaagcatttcgctctcaattgggaaacctcgattttacttagcaaattttttttttctttctttctcttctcatcacctacaaactctagcattttctactactcaaaagaccaagaggttactagatcctaatatggctgtaactcaaaaaagaaagtggaaggatacagagccaaaggatgacatgtcccctgtgtctgcagccgcaaggagctccatcctcaaccctagcgaagtcgtctttccaagaggtggaggctcagtactgacgccgttggagagaaaggagatctctaacagagtcactgctgatgtactattcgaaaaggagactgccaaggaatcttctttcaagtctacagatgcaaccaagaaacgtaagaccacagcaaccacagtaattaacccagctcctactgtttcgggaactatctatgaccaaaaggatgattcaaacaccaccactaccagcatgacacttaaaaacctaattccgggaagtgtggtgttaggtcaagtcatctcgatccaaaaactaggtatgcaattaggtttacccggaaacatcagaggttacgttcccataacttctgtgagcaaacagattacccaacagttagaggccctagaacaagattctgacgatgaagatgccagcagttcaccacaattatctgaaaaggtctttcccgagttgagcaagattttccagttaggacaatggttgagagctgtggttctagaagaatcttcagttccatctgaacacaagcataagattcaacttagtgttgaaccagagaaagttaatgctcacttagaggatgacgatttggttccaggaggtgtgctccaggttgcagtcaattctgtccaagaccatggatgtatcgtcgacacaggaaagaaaattcccggattcatcttcagtaaatcattcaagaacagtggtattgacatggaaactgatttaaaacctggatttgtgctcttggctacaatttcaaagtcaaacaacaagaacaccatcacactgacactcccctcaatgaacaacaaagacaatggatctactttatcaactgctacatctgtcgatgcggttttgccaggtgtgatggtcaatgcacatattttagacattacagaagaaggcattttttgtagagttcttggattgttacccggaagaataccattggctcatttaaagcttttcaatgttccagaaattagagagacatataagatcggttccactataaagtctagagttgttggtgttctggaatatgaaggttcaaaatctttaactttatcaactataccatccatattagaattggattctacttatgatgaatctccccttgaatcgttcccttttggcttcactttcgagtcggttaaaatagttggtaaagattctaataacgtttatcttgagctcaacgaagacacatatggacaagtacacctttccaaactgaataaggaagttagcattgattcattttataaggtcggttccactcaccacaaagctcgagtgattggctactcaccagttgacaaggtatttgtcctgaccatggacccacgccagttggaagcaaagttcttgaatattcaagatattcctattggtgaaatcgtgactggagtagtcaccaaggttcatagtcacgggcttaatatcaagatatttgatcagtttgaagcacaggttccgtacggacatatgagcgatgtcatgcttacttatccggagatgaaatttaagataggtaccaaagtcaaaggtagagtcttaaagttttacagaggaaatctttgtgtcactttaaagaaatctctccttagatcagaaagagacgaacttattttcacatacgaagacgttgtacctaacaaacgtacctttgccaccgttgagaagtttttcccaaccggtgttctcatgtcatttttcaacaatatttctggtttccttccgaagactgaaatcagcgaggcttacgttaacaggccggaggatcacctaaagcttttccaaacaatatctgtcagaattgatagtattgatcctgctacaaacaagttcagggtttcttgtttgctctctaaagatctgtcagaggaacaggagaaaaagatttcaactttcatccccgggtcttctattttggaggtatacatcgtcgaaaaaatgaaagatgctatgattgtcgaggtgaaagattcaaatgttcgtggtgttatccaagaaggtcaactctctgatggagatcaaaaccaaaacaagaccctgctcagaaccgctgttgttggttccagtttggaagctcttttcttgcacagagatcctaaaagtcgtactattaatttcactgctaaagactctttgattagagcttccaaatcaggtcagcttcctgcctcgttcgaagagcttcctgctgtgggagaaattgtttacggatatgtccataccattactaatgcgggcttgtttattgagtttgctgatggtttgagtgggtttgctcgcaccaaggacattactgacgaaccttctgataagcttccttcattgtatttcaagaaccaatccgtaagggctaggatactgaagttagatgatgagttccgtaaattccgcctcacattgaaagatatcgatcatcagattgttgctgctactaacccagttgacaagtctattactaatttgaatgaatttgttccaggaaaaatcacgaaggcaaaaattaagtctgtaacaccaactcaactcactgtagaactggcggaaaaccagttgggtcgaattgatgttagtcaggtgtttgacagtttgttagaaataaaggacaccaagaagcccctttcgtcattcaaggaaggtgcagaattaaaagtgaaggtgattgggtaccaaaataaagattccagtttcacatctgttgccttccgtgattggggcgacattttagttgaattgtccattaagaaatctgagttagaagaggaaggaaaggttaatgttctttccttgacgcaaatcacaccaggtacgaaatggctgggatttgtcactagatatgctagaggattttggtgggtcagtgtttccccaaagttcagaacaaagttgtcattaatggatctttccaaatctggttctgttgaagagttagagaaggcttacccattaggttctgctattgaagtgactgccaaacagattattggaaacaaagcagtggaagtgttttctaaagagaacagaattgaaactataaacgatgttaaagttggcgacaagcttccatgtcgtattatttctctttctcatgactatgtcacagtcgaactcagtgacaaagtcaaagctaagtctttcatcactgaagccttagatgactattctgagagtctagagtctactttttctaccaacgatatttgtacagccactgtgctatccgttgatgatactacgaggcagatttttgtatctcttcgatccgaaaatgccaaggacaagctgattgaaagtttcgaagatgtaaagcgaggggatattgttcgtggtttcataacacgtatcagcaattttggtgtttacgtttccttaggaaggactgtttttgcattggttagagttactgacatctctgatttgttcctaactgactggaaaaaacacgtcaagcttaaccaatttgttacaggcaagattgtggatgctggtgaagagcgccgtattttaatgacattgaaagaaagtcaagtgggtcaaggaactggtgccttgcatcaatttgatgatttgaaagtcggtgacgtctatgagggtacaatcaagaagataatggactttggtgtctttattactttagatggtgttcatagcgtcgacggtttatgtcaccgctcgcagatttccgatagcaagattgagaactttgagtctctttttaaccaaggcgatagagttaaagttaaaattctggatattaaccgcaataaaaaacagttgtctttgggtatgaaggcgtcttactttgctaatagagacgatgaagaagaggccgatcagttaagagctgaaacggatgactcagttgactctgatagtgacgaccaaatgatggaaaatatattcgaaacaagacaacaggacagcgatgacgagccagatgtagacatcgacaccgaatctcctaagaagattgccagtggactttctacaaacgggtttgactggacagcttctattctggatcaagccgaagatgacgagtcatcatcttcagatgaagaagactttactaagaaaaaggataagaagaataggaaaacaaaggcttcaattgccgaggacaagagcgctactctcaatacacgaactcctcagtccgtttcagattttgagagattgcttatcggtaaccctgactcttccatcctgtggatgaactacatgtcatttcaattacaattgagcgaaatcgaaaaagctcgtgaaattgcagagcgggccctaaagatcataaattaccgtgaagaacaggaaaagatgaatatctggattgcattattgaatttggaaaacacatttggaactgatgacaccttggaagaagtgtttaaacgtgcttgtcaatacatggattcatacgtgatgcaccagaagctggttggcatctttgcactttctgaaaaatgggaaaagtgcgaagagatctataccgtgatgaccaagaagtttggtagaaatgttacaacttgggtgtcatacggtgctttcttattagagcgtggtaaccctgacgaggctcgtcaagtacttgggcgtgctctaaaagtccttcccaaggccgaccacatcgaggtggttagaaagttcgctcaactagagtttgcccatggtgatgcagagcaaggccgttcattgtttgagggattgttagctgatgttcccaagagaatcgacctatggaacgtttacatagatcaagaaatcaagattaacgagaagaagaaggttgaagatctatttgagcgtgttatcaccaagaaactgactcgtaaacaagccagattcttcttcggtaaatggctagaatttgaggaaaagcaaaaggacgtcaaagcagccgactatgtcaaggcacaggcttctgattacgtgcaaaagcaccaaaaatagagacatcattaataacctttgtacatttaggaatgttgtgtatttactaacatttgttcactcaagaattacaacatcgaatattgttgtggccgatgagatgagatgcatgattagaaccacaaagaagttcaatttctgccctcaaccccaaaccctactattctgtgtatccttttaaccaatatctgcgtatgtttattgagggtcttgatagaaaaataaatcttatgatgaaaacaaacacttttttcagaaaattgggaaggaagttcaagtctttcttggctattggtgtcgagttgaatccttttgttgtcttaatcttaggactgttggcggcagccactctaggaatgtctaccattgaaagaaagtcttttagaactggaccaatgagatttcaattatcgtcttctcccactttcgaaaaaatcctgcaatgctccgaaattgaaagtgctagcgtctgttttgacaaacatcgtaaaaacttactgaaggaaagtggaccctttttgtctccttttggagaaccccaattgcaaacttgtttaagtattgcatctaagaatcccaacgacatttcgttattattgaacttgcagacatgttaccatcaggtggacataattgagagagcaacagaattcagttacgccttgccgaaaaccagttggtggacaacaataggtatttttttgagcatctctatgcagttatttgtagctattcactcttttgtcgtgtttgtgatgagaaaaagagaattcagtattatacacgatagcattcatcgtttaactcaagacaactatctgcgtttggagaaagagagggaattgaactcctatcttagcagtgtttccatcaacaccaattctgaactggcgaaactgaaaagtaaagtatccgaatctgaaaatgtccccttggaagttagaaagttggaagaaaaccttgcgtcattgaaaaaacaagtttattactcaaacacaaggatgttggaggctatgtccaaacaagagagagagtttgtactacagaaaaaacacggttacaataccacaagatattacgatccttccccgttaactcaaaattctaaattagacaaagataaacagaatgataagaaaaaagagaaagaggaggaaaacagtaataaaaccatagaaaaggaaaaaaagagagaagagcattcatttgatctaacaaccgaatctgggagagaggcctggaaatcttatatccagaaaagccttgcattcaaacccaagggacctctcttggacaaagaaaataaatccacacaagccacaccagtgagacttaccacaaaccaatctagtgaccagctcaagtccattaagaacatctcctcctgggaaaactctcctcaaaagaccaagaataccattactagtggtagcgcactgaaattggcagcacaatccctaaaggatgacaatatacttggtgcttcggtcaagaccctgattgcaaatacaaattcagatgaacagagtgaaggcaagcacttaggtgtcacctccagtccacttgaggtatcagttaatgatatccaacaaattgataaaaatggaagacctttccgcaggatattcgtcccaggaaggggatggttagctgcaaaaacgtttagaagtgaggtagattctggtgccattaagttggtcactgaaacagaaacaagaatcaccaccaactaattttctatatacgatgatctacatcccccagctagagattaatctttaatttagtactaacaacccccaacaatcccttttagtagacagtccttcgcgaatttacttacatccgatgggcttactaccaaaagtattacacttctatctcagatgatatgtacaatattgtcattgaccttgattcacccaaagagttacttttaaaggccagggatcaatcagaaattacaagcttacgcaatctgaaagctctactagctggtaatcagattttcggagaagacggcttggacttggactattggagcaccacagtactaaaacaccataatatttttgtcaagagtaatacaaagcaagcacagccccatcttgctctcaatttcaaaaagagatcaaacatagttgaggaaattaggaacactttaagtaaggtgcaaaatactcgcataggcgttcccgattatagatatacccggatcgaattgatagcgttcgacaaaatgcatgacactaactatgagaagacagactaccttagagcttcctttcttggctatggcgttataagattgttcagagaggaaataaacgaaaagactacagaagatgctgaacttggtcccgaacctacctctcgaagcaaaatagctgctattttagctgttccaacctacatgtcaatctcagccatactaaaactcgtcggagagaactttgttaaggatgttgttcatttccgaatattcaagacccaacaatataaacgatacatgtgcatcctaaagtttcagagcgaggatcaatgtgccgctttccagcgagctctaaatggaaaaccctttaactcaatagaacgagaaagatgtcaggtggtccaagttaacaaaataattatcaattcccctcacgacaaggctaataaaagcgaggaactcaattttacctatggtattatagaacttccaacttgcccagtttgtctagaacgaatggacactaacatgacaggattattgactattccatgccaacacacttttcattgtcaatgtttggccaaatggagagatgatacctgtcccgtttgtaggtactctcaaaaagagagaacatccaaagatgtaacaagtgaagccagccaatgttccgtttgtggagacacagcaaacctatggatatgtcttatatgcggtaacgtgggatgcgatcgatataactcagcacatgctgtaaaccatttcaaagaaacatcgcactgctttgcaatgcaaatagaaacacagagaatatgggactatgctggcgatcagtatgttcataggttgattcaaaatcagacagatggaaaattagtggagttgtctctcaataacgagaaagctggatcttcttctgattctaatggaaagaactattcagctgacaaggttgataccatggagctggaatactctaaactgatgattgcacaactagaggagtatgaaaagaacatgaccaagataatggaggaagaaaagatacgatttgcaaatttgcagacagctatgggccgattgggcacagactccaaagtgagtgaaagaacaaaggaattggaaacgaagcttgatcaaatgatgcaaaaatacgatgaagaaaaaaccttagccttggtattgactgaaaaacttgaattttttgataagcaaaccagtcagctcaagaaggagaacgaggatctcaaagaggaaatcaacgacctactaatgcattttcaaacgatggagaagtacaaagatgcagatgaatctgtaaaggaagggaaattggtgctgaagccgtctagaaagtccagcaggaagggctccagaaagtaaacatatatcccttccccaggtttttataatcattttctgtgctgataataaataatttccgtcgaaccggcggttttcgcctgtcttacctaatcacagaatattgtgatcactttttcctcgttttttttttttagcttcttagttctttcttacttgagtatcattcattagatccaactgaagtcataattggttattcaagtcagaagactcttttgatagccttaaccatcctctgatttactttttggcctgaccacattcacattttgcctgaagattgacagaactaccccgcgttcttaaatatatcaatggctacaaattctatcaaacttcttgccagtgacacccactatgcattggcagagttggtctccaagagattaggcacaccacttacgaatgttgccattaaaagagattccaacaaggaagtctccttctcaataggtgaatctatcagagacgaggatattttcatcataatgcaaattggttctggtattgtcaatgataaggtcatcgaattattgattatgattaacgcctgtaaaacagcttcagcaagaagaatcacggcgatattgccaaactttccttatgccaggcaggataggaaagacaaatcacgagctcctattaccgctaaactgatggctgatatgttgactacggcagggtgtgaccatgtggtgaccatggatctccatgcctctcaaatccaagggttctttgatattcctgttgataacctttatgctgagccaagtgtggtgaagtatattcgtgaaactgtcaatatcgatgaagccattataatttctcctgacgctggaggagcaaaaagagctgcaggcttagctgatcgattggacttgaactttgccctgatacacaaagaaagagcccgcgccaatgaagtttcacgaatggtattggttggtgatgtcacggataaagtttgcatcattgtagatgatatggccgatacttgtggaactttagctaaagctgctgaggttctactagacaatggagctaagaaggttattgctattgtcacgcatgggattctatctggaaatgccatcaagaatattaacaactctaacctagacagagtggtttgtacgaacacagttccctttgaagagaaattaccacagtgccccagattggataccattgatatcagcggagttttagctgagagtatcagaaggttgcacaacggagagagtatttcctacttgtttagaaatgctactttgtaagagaagaaaaaattagaaatccatacatatttatattatgattactccctaggaaccaagcatggtcttgtcgaaagcttctaaagacttcaggattattccatgttcgttattttctcctattatttctttctctttgcccgcaagaacttttagtgccctttcatctggaacccagatcacgtatgcaccagaagccttccctgcttcgacacccggaacaccgtcctcaaagactaaacactctgtaatatctattgtatcttggccatgctgttttcgttctttattcaagctttctaatgctgcaaaccagatatcaggaaaaggtttgcctttaccaggagggattctagaatcatcccctgtgacaatatgatgtcgaaacagatcaaatccgtgttgtaaatgcccagttttcctatcgtagttcagtttatgcgatgaagttgctaaagcaaaaggtattttcttcgtgtcaagatactgcaataactccaaagcaccaggtagaaatttgacagtgggccaaaggtccatctgtacagcagtggtttttgcaaacaattcctccggagtcagaggcagatcataatgttcgattaccagcttggaagcagagggacctggtcttccttgaagcttgatcttaagatcccaagtaagagggggtttgccataagtttccagtacttttgtaagggatatggtgtagatatcctcactgttgatgagcagaccatccatgtcaaaaagacatgcctttatggtcctagatgatgccattgctgactgaaataaaatgtatgagtcaaaatgtaaatgagcgagatttgagatatactctcgcattgttgttttctgaacgtacacactattaaagattattctcttaccaatgaccaaattagactattattagtatgtaaatagctattttagattaagcagtacattcatagtgggggtaaaggatttctgcaaacagggcattgaagtttgtattgcatccatgattcaagacactcggagtggaataaatgcctacatggtgtaaccatgtatactcttctggataaaattcctggaatatttgaatgctcggtggattcttcatttcctagaccctttctagatacaacagggactttaagctcactcatgcagatagcacaatctacaacacaatggccatcctcatgtgtgacatgatgtccctcctcttcagatgcgccaaacccattttcaagatcagattcagtcagaacaggatgataatcataggcagcaggtagcatcttatctggaacaaagaatcttggtcccaggaattcttgcaactggagaacgaggatttgtaaacccaaccatgatacaatgacaatgaaaaagattggatcatagtgatgataaaacacattatgcttgtaaagacacacataaccaacaggaagaactcttaggatagatgttccaataacaaagccccaattaaatgattttctggtccctctataaacattcctgtaaacttggggtacccaaaacgaactcaaagcaaaaactgtaatatactcaaagatcagcctggattttcttggccaaagaatggcgttaagaatcaaaaatgtaaatgcgatcaagaaaaagaaaaacctagtgtaaatttgaccactgacagtttgctcatcttctaggatagtaggcctaaggttttgttgctgtggggtcgttgttggtgcctgggtcgtgggtagaattgtctcattgttgtcaactagtggttgagtttcgttgatgttatcaaccggtgttccttgtaacgctgttctcatgctaacatttctttcgttcatttgagatagataaatcgatatcatatacctcatttcaaagacacttgccagggtaaacgagagaaacgcactcactgtaatcggtaggtataatctttcataaaccacagaacagagtgcgtataatatgcttaatgatccatcaatgagattcaaaatagcaagtgtggagaaagagattctcgatatggtagatggtgtcgttgtggcactcatttgttgaacggaaaagaagatttggacaaagagaatcactataccggatagaatgacatttcgcaatctttgttcttgtacttcctttcttggcccaacaatttcatcaaaatttatagatataccacaatcaggagaatacaacaaaccagatgttaccttcactgggggtattttcttatgaggtcttccaattggggtaaataattcatcgtcaatttgacgtagttcatctttagagagaccagtactctcaaaatgcaaatacatgacatgctcacagttatccgaggtttctctgaaataatccatagttgatatttctaaatcttctaagtgggttttatttgtcctttgaatcattgcattcttactctgattgaacaattcttgataaagagtgaggtggggtaatgcatgcactccatcaaactttccagtacgagtggtagcgaccaaatttccagaattctggtggtaaagaccaatcagattcagtttatgctgatgcaattcgtcaaaatcatttgcctcgacctctagtgacataactgtagtatccttgcaatactcattaattgaagtgtactcatctaacgagcctattcttatcatcagatcgccctcaaagtcggtgatatttccatttatgtcagactctttttcctctattggtgtaggggttggatcatcgaattctgttgttggttgtaccatcacttgtaaagggtggctatagttgtaaaatggaggtaacaccatgggtatacgagtgaatgatttgttggaattatggaattggcctcgtagcgtaccagagacatttagcggaaaagagcccgaccgaattttttttgtgccctcttccgcactccagatatccatggcaagttcactgatctcgttaggtagaatagaatacttttgatcttctgtaaaattatcgttgatgggagacgaacgattcaaaccgtccaatgcatcttgataagatactgaaaatcctgctagatctccgtaaccctcttcccatgtgctattgcgaagtacctcgttcgaatgctgaatatcttccttaaattgcttgaaagaaataactttattcctgttctcattggataaatcattacccccatttggacctagtaataggaagaagaggatcagaaaaaatattatctgagccctgtcaacattcatctgatgttgaagatggagaagctaggtggctaaacgtacgaaacaagtagatctctccagggtcgtgtgagagtccaatatcaaaatcgctaaaggtatgattctctcaaacggtgtagctggtatacacaggtttctcttttcaccgctcgtacataaagtgaaaaaatgtccaccgcaagagttgacccatccgagttcttgtccaggataacaggcgagaaggtggttgtcaaaatgagagatggtacggagtgtcatggcgctctacagtccatcgacggtttcatgaacgttgccttggaaaatacagtagggaaatacaagggtgaaacaacgaaaacttatggagatgtattcattagaggcaccaatggtaagtactctcttctatcctccatcttattagaacgactactaactctatagttctatatatcgcaagggcctagatagttataataccaaaaataacgaactttgttgaggtcgtacacccaccaatattacataatcattggttttcccttctcccctagtagtgtcttgatcactcctccgtcgctctcgcccaatcgaatctaattcacccttgaaaaccaacaatacggaacagctccttcattcattgaacatgtcctttgtcattagaagaaaactatccactttgatccctccaaagatcgcttccgcaaaggtaagttaacgtctatggctcttccgctttgatatactaactttcaattagaacctgggatccaaccctcacgctaagaagatccaggaggtcgtcaagttctacaaggctcttcctcaaggccaagcctctttccctaaagcttcttcgccaattggaaaatacggagagaagtacttcaacgacggaaacgcttcagctaagccattgttgcacttggctttaggtgttattcttttcggttactccttagaatactactaccacttgcgccatcacaaaggtgaacattagagaaaatttatgctatgtattagaatgcagaaaggtctattttatgtcatttgatgagttccaacacttgatcaattgtggtgagtttttctctggtcttgcccagtgaggttcccgcttcggactcgtgttgctgtattttttcccagtcttgccatgttactactggcttattctgcttgcttatgtagtggcccaatccatgtttttcagttgaagagttgtccaagtcacttaacactgtctccgccacgaaaaatgcatccatcatagtagatgcaatggctccagtagcaccccttctgatccatcctgatgcataaattcccggcgataccctaccatctttgtttggaatatatccctttttctcgttgaagggaattcccgcctcaatcaagccttggatggcagatcctttgtaacccgtagagtatattaataggtctgcgggtagctcagtgaattcacccgtcggctctattgacaccggaacatctatatcaggctgaactaatacgttgtgttcaaacactactttggatagaagttggtcatctttggcaataatctctttgggagaaagtagatactgtaactcccattccttggtacatgcagttttggtgctattcttgactttttgaaagtacttagtaagaagatccaaccttctcttttgtactctccccagattttttgcaagtggggcaaaaggagcaatatgatcttcagagacacctttaaaccctactccaattgaatgcatatctatcaactccttcagttctttattggtgaaggcactttgtagcaaccctcttcttccgacgatagttacatgttccacttttgactcttttaacttggaaattgctttagccgttatatctgtggatttccatagtggatccacaggacctaaaagtactcgtgtaagatcgagtgcgacgtttccattgcctataatcacaacacgacgcgccttctctaacggaggattaagatcttgcaaatcaaagacaccgttgtaccagccaacaaattgacgagaacttatgacacctttatgatcggcacctttgatattaagcttattgtcctcgctgcacccataggcaaaaatgacagcattgtagttatcctttagtatctcaattgagacatctttgccaatatcgacgttaccataaaagttgaaacgcttgtcgtgagctacctcttcgaatcttgtttggcattcctttacctctggatggtccggagccaccccgaatcgggacaagccgtaaggaacaggcagcttttcaaagatgtctacatttattttttgagatggatccttcaataatcgcaaagcagtgtagaatcctgcaggaccagagccaacaatggccactttttgcgaataaaacctgacaaactgtctgatcatggtcaactggtgaagtaagagaggtgactgaataaaatccgcgaatgaatgagagacagatattctaacacacagtccataataatcaaccaactatagaaatagatacaatgtacagagtatctgaaataccaagaggttctgaccctgattcatatttttcttcaatatacaaacctgcctctggtacgtcaaggaccaccgctggtccctcaagtgggacgaagaggagttcccgtgtaaattataatttccaatcactggaagcacaagctcatggaaacacagtgccaaccacgcaagccgaggaaaaggcctcaaataagcgatttgaagaactgaatagagagaattacaatgaacaagccaagatagagatccccaagagtggtctagaagcatttactaagcatagacgattgaagccaggcgaaacagcatccactaaaagaattctggccagtcgaaaaacattggtgaattacgttgaggaagttgatccccaattaatgaaaattttcaaagcaactacagttcccagtaacagaagacatttgaaaaagctgtgttccatttgcggtaacaatgctcccgctacatgtgtcaaatgtggagccagattttgcagcgtaagttgcggaagaactcatgaggaaacgagatgtacgtggtaaaagtattgatcgcatagaattaataaataatatatacaggtaaagggttttagtcattaatttttcatttcttctcttttgattgaagctctcctttttcttcaaatggagcatcctttgcagtctcatccaccataggtttgattccttttttaatcaaataggcctgttgaatgttagcagtccgttaactaaaatttaaaatattcgacacttacttccagacattccctgtagtcatcccataatccctcacattcgttctggaggctctttccttgcaagaatttatccgtgtaccaactgttaaagcaggaatcgtatttgtttttcagttctgtacactctggtgctacactttgtgacattgcgttgcccatactacagcagaagacgattactgaattgtcaatcagtgatggagagaggttacaaatttagtcgtgtacctgtttcaatatcggagagtgtgatctcaatacagggaaacgcgtaatcacgcagtccattgattcaggcagatatctccatacaccagggaaatgagtaaggagaaaagtacacggcggtcaatatttataccgcctagttattctgatcaaaatgaaacgcagcagaaaactatggagcttgaaaacttggagcaagagcttactctgactcttcaacaaatagacagtgacttaacaaaaactaatagaataatcaacgactccataatacctgtgatgcgtcggtacggcgcagcttctcagggcgtttggcagggtgttaaggtttggaagtctttttttgaggccagtgctaatgtgcagttatccggttatgatgaagcaatggaatcctatgatgattccactctgcacaacaagaattccgtaaatacaggaaaggattccgcaaaggagttcaatgacgatggaaatacgggtgctgtttcaaatcacactactgacgacatacaaaaaaggtatagagaatcccatcggatatttgaacagaaacgtggtcccgatgatgatacaatgacggagtcattcccaacgagaatcaagaattctactcctaacaaaacagggagaagcttccaatttgacgataatactgcttctgtgtctttagatccaccttctcctacatatcaccatctcaaagcaccaaaggaactgagctcagaaaaagatacgagcccgaataaacaaacacaaaacccagatcaaccaacaacaagctccatttttgactcttcaaaactacagcaagctcaggaagaacagcgaaacaagttgatgttcatgcatcgtgccttggataatgtttggcaggtacaaatgactcccaagaagcgagagaatacaccaatagtgaatagcagaacaccaaagaggcggagcgaacataaagtaaggaaagcacctcaatatgattcgtcaccctttaatgctcctgaacctccccagcttcaatcagacttgagactttcaatgcctagctcaccattgcgacaagtagatgatgatcaagacgagtccttcatggtagctcctcagatatcagtagaaacgaagaagatgtcggaatctactcagaaagagcagttgttcgacgaaattgagcttccagaatctacagagatagaagacacaacgttgaagaagataccaggaaaatacgcagattctaaataaattttacatagcaagcaacttttagacaggcaaatagtttcaatttgattatatactatcagacttgtgattctcttttgtcgttcttatcttaattctccttcccaactaaagcaccttttaaccacttagtagaaagtggatggacgcttagaagcataaagtgcctgagtcttaggaactctgtgtggcaatgggaatttcagatccttctccaagaattgtctgacgtattgacgcttgatgtcgtcgtcgttagtcaactcaacaaccttcagaatgtggatagatctaaatctagctctgtgtctggaagccaagtcctgatacattccttggacagcaccaactctggtaacatcacggtattccttgtacatgttgtgagtaccggatctagagtcgtatctaatccagataccgaaagtcttaacctcagttggacgctcctcaaggacttccttgatggcgacgatctcaccagaagctctcttgaccttgtgcagcttctgcaagaagtaccagtaacgagacttagcaatagtttcgttcttagcaaagatggtcatacggtacaactttggctctggaacggtctcagtgggcagacgacggccaataacttcgaattctttgtattgagacactggaggaactgtgttagtactggacatctgattcatttgctgtgttctctggcagagttgcctgcgttgtgttacttactgttgtcttagttgatgtgtacagagattccctggtataattgaaattttttttgacctggagcttgtgaggattgagagggaacattcgcgaaggcactcaaagcttttgctttagtgcacgacctagttttctgaacgacaagactacgaaaagaaaattataagacaggactgttgtggtgttgggtgggaaaagccctaaaagcgcgcacgtggtaatagaatgagggctcaccgcgaaaagaactaactatgacgacaagcactcacgggactaagaggtgacttaagagagggtacgctctgaaatagcgtcggtgaaaccaccttcaattaggcccatttattaacgttcattcacggattttttcaaggctgaaactgcattacgtattatcaggagtaagtaactcgattgtccgaaatctgaatagcatgaacgatccaagattttccacctaaaaattacgagtcaaactcagtagtcattgaccgtacctagtgcattttcgatggtatgaaacttgtcaattatttttcgcttcctactaagcaatttttagcaaccaggcaaggctgcctagctagtcttgccttttctatgtcatcgcgttatctgtcgtttacataatgttcgctacaccttacccaagatgaagcaaaaatgactgtaatccttatacggctgattactagcgttgccctgtctatcaatgaactgatcttatcttcatcatcagttttaaaacacatgattaaatgtacactcgttagctgtttttctcttatatgccagtttcaatgtggtgtcagaaaactcgcgtcttctgcccttctagatgccagtttgcctcctcccatctcatgagagtcgtacaaatcgtaaggttttactctgtgtcagctcagccttcttcccttgcagaaaaatcaagctcgggatctggtgtcactaaaaaaagatccctaccgactggccagacgatgtgccatccctatcggtccatcagttcgtttatctcgtattcctcgtttaagaattatttttagtcttcatacctctaatcacaccacgcacgatacgagatacgaccaaaaaaataaaacggtgaggcccgtataaaacctttacagctccctaaactcaggttcaataggtggatcaacatctctcttccagacacaggattccgatgacagaaatcttcaactccacctacttggactctataagaggccctactttcagtgacattaccaagaatatctttgccactcagcctcacttaacgttcttagagaaaatatgggctgcttactacacgtatatgagcaatgacacccttgccacgggtctattatttttcatggtccacgagctcatgtatttcggaagatgtcttccttggttcatcattgaccagattccttacttccgtaaatggaagattcagccaaagcaaattccctccaacaaggagcagtgggaatgtttgaaaagtgttttgaaatcccattttttggttgaggccttaccaatttggactttccaccctctctgtaaaactttgggtatatcagttgccgttcccttcccttcttggaagacgttagcattgcaattttccgttttctttgttttggaggatttgtggcactattggtttcataggttattccactatggtgcattctacaagtacattcacaagcagcatcatagatatgccgctccttttggactggctgcagagtatgcccaccctgttgaagtgatggctcttggttttggtactgttggattccctctcctgtgggcttatttcacccgagacttacacttgttcaccattacttgttggatcactcttagattattccaagctgttgacgcccattctggttacgacttcccttggtcattgcataactttgtaccgttctgggctggcgcagagcaccatgatctgcaccaccactacttcattggaaattatgcttccagtttcagatggtgggattacaccctggacacggaagctggtcctgaggccaagaaggaacgtgaagaacgtatgaagctaaaggccgaaagaaaggctgctgctttggctcagaagaacaagaaaattgcatagtaaagttacacccctttttttaaagtcattttttataattatcatacctcgcctagaatatgattcaaatctatattaaccaccaaatgatcggtgttttggacgtagaaaccattgcttccaacgttgtagttgctggagcttatgttaccagtcattgaacttgcatagttggcaacatcgtatttcaaacctttggtgtgcattataaacggattgttcaagggcaacagccccaaataacataaaggatcatccacatgctgtttctctaggacaatgaaattagtgcccttgggtacaagaaagataatctctaagtattctgtgttgaaaaacctcatttggagtaggttatctgatgcatgtttgtagagttcacctatcgaatggatggtctggtcaaaccttccacctatagcacccaaaaagatcatgtccaagggcacggtaaattctttggtgtccaaggaattcttcaaagttgtgagtccattattatcgtcaagattcaaggtatcaaaatcattgaaaaagtttggatagttgaagtgaagaaagcacaccgtgatggctttatcaaaatctgtagcatattgacttgattgagttttcacaatcacttttccggtacttagatagtaatttttggtctcttctgttagggagtccatgtctccaacaatatactttggaagatacttttgctcatctaaaccattctctcgcacaaatgacagcaattggttggccccaccgtctgcacatacccgtaaatatgtgttatcccaaagtttttcaaacaccctcgggaagaggtttattttctgattcagtatcaccaagcatgtcttaccgggcactttgttatcgtcaatctggtatcgaattatgggatgcagtggccgtatcacatttatagaaggatcagtaggaactggtatatcaactaaatcagcattctccgccacaaaatttggttccgttgtttttatgaataccattcttttgacaggattatcgcaatcttctaatttttcctaccgctaggggaggctatatggttcggggaacggaccatcaaatgatgcgcggatttgatttcccctaacagcatatctaccattctggtcgcgctctccaacatctaacttgaactagttcttccttcaagacaagattatttcatgttgtatgtccattgcctgaaatgactgacgccaaagacaaggatcacaagtacaggtatcgtatggagatacaacagatgatgtttgtgtctggagaaacaaatgatccccccgtggagacaacatcactgattgaagacattgtcaggtcacaggtggtggaaattgtactccattcctcgcagactgccctctctcgaggtaccaaatctatagttcccgaggatgtcatttttctaattagacacgataaggccaaggtgaatcgtttgagaacctaccttagttggaaagatgttcgtaagaatgccaaagatcaacaaagtggagatttggcagatattggaggtgatgatctgctggacaattctacatcccaggtggccgcatcgggggctcctggggctcctggctcctcttcaagcacatccatggacagcaagatgctcagcaagtacaagaaatcgaagatacggcttccctgggagttgcaattcgtattcacagaacaaccactggacaccaatgaggatgacgcagaggatgaggacgaaagggcagcaacattagcttcattaaagagacttaaaactaatgatgaaagaacaaagaatatgactaaagaagaatatgtccattggtctgagtgtaggcaggccagttttaccttcagaaaggcgaaacggttcagagaatggtgtggtctatcacatttggcagaaagtagacccagtgatgatgtgattgatatattgggattcttgacctttgaaatggtctgctctatcaccgaggaggcgttgattgtcaaaatgctagaagaacagaatggtgatctagcctcatccaccaccactatccaaaaattacaagaaagccacaggaagaggaaacatttatttgatgggccagataaagacgtgcgtccgatcacttccggccatgtattagaagcatggaggaggctgcagaagagaaatgtggaaaagaaggccattaggaacttccaagggggaaagctacgatctagagtacaattaatatgataaagtgttgtaatgctatttttctttaatataaacctttccactagatttcgccctcatgttgtcttcttcttcccataacttcgctttccaagcgctcagttgattgtgcatcttcaccaatttagtaagctgcttgtgttcccagcttttgtcgtggttgggatcacaatttggttttgataacgatttgtagagcttttcgtattcgggatattttgccttgaagtttattgccaattgcaaaagttccggatccaccgtcttgggaacaggtgttgtggtagttttggtagttttggtcttcttgacatcatcttcggaacttgtgattggcgacacgttgtccgcctttctcttctttaaaccatctgaagaggcagatgaagaaggtgacggtgaattgttctcagccttgctagttgacgctataggcgatgctactggtttgggcgactgaattttcttcttcttaaagaacttaaagtctggcagtgcatgcaaaattttcagcttcaaggggtgattctctggatagccaatctgatccaacttgcaactcaaatactggcgaatggtatgtctctgcatggctcctaggaggtgacagttgacttgaaggaggtaaaaatcccgcagcacgtagtttacatcgtgaaccttggatatcattcgacgaagagcagcctttggaactttggattttgatatcaaagctccgacttcttccttggtcaatgagttgcctttcaacaaaaattgctgaattagatgctgtacgtctgagtgaagagaactggaaaatgatgacgaagatggcgatggtgatggtggtgctgatgacgatgttaacaagaaagggtgagatctttgatgggataatgcggaagttttgagtaaggacttatgtggctgctgaggacatctggcaatatttgacttggccatattgatcttatagtccagagtccccatattgataaatctctcatcttcagacgaactatacagttctgttttcagattatccctcagaacggttgcctctaacagcttgcccttaattcgaaatgagagcttgccattcttcacaatcaacttcggaacgtcctgctccaacgtcgtttcctgaattgctgaaaccaaatcctcattgagtctcagaagaaaattgacattcttgtaccgatccacaccagtgctgggtatatgaggcagtagtatgctaggggtcacattcaaactcataccgggcctgcgatattatgatagaaaggaggtagtaccctctgtaggagattttgtgggactagaaagtatttatcgcaagttacccaatggggaaatcgcaaaaataaccgaaagtgatgtgatgatatcaggagatgaggggtcaattcctgaaatatatttcgatctggacagggggggaaaaaagggttggatacgatatttttcagtgagaatggaaagttttcctgggcacaatttataaaatggctcacgccaattaatcaacccacaaaactgtttgaggttcagataggagagtcatttaagatgcctatttatcgtatcatccaaatttgccaataccaagtccgataaggatagttgcatctagaataatttccggtcgtgtatctatcatttctgtttttctagaaggaattagatttacacgggtgcctgccaattctagatagtcgaatatgactgtcgccggattcccttgttgaaggaaaacagacggcaacggaagtgtataccacagactgccatcgtaatgtcccctacatcactgaacttgataaccttcctaatgtccatcatacgtctatggcagggcatctcctacgaggctatgcgcgactaagatccaaaggctgagctcagccttaagtaacacacagactactcagaaaccttaagaacaaacatcatggatccatttaatgatgtttacaaagatgccgtctcccaggttaatcagctggatggcatcataaataatctcacacccaagaacatcaaccaaagtaatattgacgatattgagaataataaacaggaactaaatgaaacaatccaggatctcagggacactgttagaatcatacgagagaacaacgacaattataatatctctgaaaaagaactcgacgagaggatagcaaaagtcgataagatctctgctacctttcaacagctgaatttacattggaatgataaactggccaagagacctaaggaagttaccacaatggcaaatagaatatcacaggattacggtaacgagaacccatttaataatgacactgctttccaggaattccaacagcaggaggtgttgagagagcaggaccagcatcttgatagcgtctacaacaccatgcaaaacattcatcttcaagcctccactatgggtacagagctggaggaccaaggtatcctattggatgatctggatacagactttgatcgggttggaggcaagttgacctctggcgttaagagaatcgagtggttcatagaaaagaataaggaaagagctagcgactgttgtatcatattgctgattattgcgttgatatttctgttagtgttactatttattgcttagaatgtaaacaaacacttataattgaatgcacgatcattgaagatgttccattcctctttgttgatccacatttcattgacaatcttgagtcgggcgtaaacagatcctcctttccagcacatttcagctggatctatatctctcgaagatgataatatttcgatcggcacagcagaggtcccctctaggagacctctaagatgttccaaatgctcttctgttatcttgaactcctttacatctccttccgttttgctatccttgttggctttttcaaattcctctttcttgagcgtaatgtactttatagcttggtccaaactggtactatatagaactggtgatctggcgatatggattcgatctactaaaattagatctagcccatcaatcttcgaagatcccccaacgatcagaatattttcataaagctttttcagcttgttcatatcttggaatcctgcatacgatatgctttcaataacagctaattccaaaggtgtaagattcaaacctttaccttctttcttcagttctaagaaattcttaatttgctttttcaatttagtctcctcaatttccatgtaatctgagctatcctcagaacctgcagttgctgcacctgtgttccctaagttgttgttaccacttgaagtgttactattgtttcccatgttgtaattcgatcctaaaccacaagattcagaaagcaaccgattgacaatctcttccaaatcctccatattcgccaaaaactttccttcaacttggtccaattgggatctacttaagggagaatcatatcttcctgaaaagtaatccctgtgtacgtcaaaaaaatttccctttctgttgatggggcttcctcgtgcaccgaatacttcaggataaaaaaaacccatgggagaaatcataacttcgtcaaacactttgaagtcgtacttttttgtcagctgatgtggattcctaactgaaaagttgtataattgaatggctatatcagcatcttcaaacgttaagtacttttcttttagttgactgatcaaattccagtctgtgatacgagaaagatctagttctttgtagggaaactggtttcgtttcaacattttggcaaaagtcttggttacatcatccccaccataatcaagttcaatctgagaattaggaattatcatgccttcatcaacacagcaaactttcgtataatgggatcctatgtcaatgacgcaaccattagaaatacctgatccaaacgttgcactcacaccctcttgcaagactccaatgttagcaaaagacatattgatcaacaagtttgtcatctcggcgacataagtcttatcatacaagttgggaatgatgagtataatattcaaatctgcgtacttcgcaggttcaatacccaaatttttggaaagtccttctttgatgacaagctcaatatcacccagtatttcttgatttgatctgtaaattgacttgtcttcattgaaatttcccttgtagaaaggagatcgcaatatccaatcagaataatcatccaaacggagggcgtcgtctccaaccaaatatttgacttctgggtcattcaataatttttttgagtccaagaaatcaactttatgaatatcgttatggtcttcaacaacttgaggttcctgacgtttattgaagttagcaaccgtttcgttggaatttggtaatattcttctcttatagtatctcattctttctctgaagctagacacaatcgaaggaaggtgcgtctcaaactctttggcctcatgctcagatcccttacgggactcaaaaatataacccttagtactctcttgtccaggccgtcttggaaaggcaatcacgttcttaataattttaggatcaatatcggtagcaagtccgattcgtatatttgtggttccaggatgcatgacaatagtgttggagccgactcgctcgtcgacatctccatcattatcatcctcgtcctcgccatctacgtctggagtattggtagaagtaccggcactcgactttgacaatttatccttcttctttttctctgccaggagacgattcatttctttcacgttcttgatactcagattctgctcatctcgtttcaaataacctgtaaaatagttcttttgattgattaatgaaattgagggaacagtagaggcaggtaaagcatttttctgatcaactctcttgataccaagcttatccagtttcgactgcaacgtggctagtgcctttattctcccctctcgtcgtctctgaagaatctcggccgacactttttgacctgaagccgctgatcctcttttctgtttcttcggagcagatccattggtagattcagaactttcctgctttggagtcttctttgggactgcttgctcttcaacctcaactttaacttcagaatcactcaactcagacatcgccactgacacaatggaaaacgaaacaaagttgagagggaaaaaacagagagaggcacacgcacgccgttgctttactgattctcaactactcgggactgattcgagggaagtgaatacttactcctcatagagatgagtgtgactactaagtcattgaaactatctgaatatctatctagaatgcaaaccaagtagtatcttggtagggttatgcaaaaatcgcctgattccatccattattacgtccattctggcaaataatcggattatcggcgccaattctgtaaaaagtgcggtattggtaatggagagtctttgaaatacggagaatggatacttgatcagatacgtcttactattcttgtaaagaggtctccatttccgtgaaccagccctaattgcttttgaagcataaaattcaagatattcctcacgtagactatcgaagtttggtattgtgggtagcatcacatcatcctgtaacgaatcatagtaccgctctagttgttgtatattggactcagccacaactttttcaaatgtattaggagtaacttgttttacttggataatttttccctccggtggtttgcagttgcatatggcttgcaattgcattaatgaccttctaatgtcctgtaggcgggccaattcgttgagtatgggtcggtcaatagtgaacctcattaaacatccaataatgaatagataatcagacaacagtttttcatctggcctgtctatttggatcactgttgaaagctcgatcaggtcgggtggaatttttgtggagtcagtgcaggttagaacgatagggcgatgcgaatattccaataggtttttgatagtaatgaaaagatctttatcatcttccaaatctacatcacagtcatcaaataagatgacacctttctggttgctaatattctcaaaatcctcaactgaaatgtccagcatgtccgcataccctttagtcatccttttgaccaacttggtcgtagctatctgctccaaatggaatcctatatccttcctagctcgagattcacctgtgttgatttcaaaaacaaaacctttcatctgtctctccacgatggtgaatatgctactactttttcctgaacccgctggtccttcaattattaatagtggcgcaaagagctctacttcaatcgtttcaatatcatcatatacaataaagtcatcgagattgtcgtctctttttggcttcttcgaagcatgagctggctttctcttggttctatccatgttttgtagcttttcaaacgcactctgtatccaatcattgatgccagttgatacgtccgaagagaataaaagttctttgtattctgttggtttgaacagatctatccattgacttgaattgtgggcaattttgcgttgaaaatcaatatcatgaaaaagccctatcaagcattccaaaccatagtgccgtttcacatcaggaacctgctcttgcacaagcctagtaaggtcatggtattggaagtcagatgtagtgtagtgatatttcgtggctctcaaaggatctggattagttttttctgtcttcaaatcccccagggcttggggaaagtctataacggcgtggttacgagtattggctcttgatggaaggctcagcgtccgtctggggcagttgtaaacctcatcagtgacattttgtgtcaaaaaatcacccaccttcaaaggtggggggagcatcccttttgagctgagacagtcactccctgattcattatgtttattctctaaagctctctgagcccttaattgaatttcatttaaaaatgaaaatgcaggtttcagtggatctcgatttgatattgcaactcctggcgtatgcaactcttgtctgtcgatttttttttggatatctttcaaggctgatgagcttattttcagggtgaccaatagctttgtatcctcaataggtttagttggtttatctctgactccctttccatctaataaagacagcaaagaaaccctatttttctttggtggtggattttgttgttcttgatccagatctataatttcgtgatttctgatatctcgtactggatctagatttctcatggtctcttcaattgtttctgatgcctcagtaacttcctttctgtgtttgatcatatttcctgtcagcagatcattaattttcacgacttttcgcctgtcgttgacacctctatcagtagtttcatttgaagaggtagaactaactccagttgaactaaccctggactcagacgctcccagtcttaggtcgacaacatctgtattgaaagaagaataaaagctcaaaatggaatgctgcttgtccatttgccatcagttattgctcagttaggaacaattcatccgatgatgcagaagtaacactgacatattatattcagaacgcgtaccaaatcttgctgaatcttacgtaatctatggaaacaataacttggtggactgccgtgtctatgaggttctttatatatagtacaactattaggtcagttctcctgttctgtaaaattttttgttgaagacaatcttatgggggatttggaaggtgtggcgctgttactattgaggcatcgattggatagtatcttggatggggagctgacaattctttttttgggcgagagtttctccatgaagatgggactcataatagaaccgttggaaatgttaccaacttcttcgtgatgtacttcgatatgctttttgggagaatttttcgattcctgaagttggtcaactccttcagttgacggtcgtttcagagggattatgaacgagcggtcactttttaaggtttcttggagggtgagcagattagactttatatcttctgttctatcactccatagttggaaaacttcttgttggtttttgatacgggcacatgaagagatcaaagttcttgttagcactgacttttctcttttcatctcttcgatgcttgcctgaagctgagacgattctaagcctttggcctttaaagtggaaagctcctcttggatcgcagtattttgcatattggaatcattcaatagctgtcgcaagcttagaatttcattacttttggcttccaattcgtttgtgtgtttttcgtttgaatattgcaatttcctgtgaagatcatgaatctctagtttcaatacatcgataatttcgtcctttccaactattttttgttccaactctttctccttcaattcctgtcgagattctagttttgtgttgtttgttgttagttcctgcactaacttgtcaaacttttcctccaatcttgaatctttcaaatcattgctctcttgaagtctttccattctctcagaaaaatctgtgagcttcaattcaattccttgtatatccgacttcttggtcaaactggaaactgttgctttcagagatttaagttcctccgtttcatggtcaacaatattacctaatttgctatccaattcagaaagtaaggagctattgaccttactgtccaataaagtcttcatcttctcgtgaatatccgttgactgctgttcaactgttttacagacttgactcaacctatctgaaatttgctcatcgaaatggcctctaaggtcatctaatgacgatttgttcgtcttggatctatctatcatattgaagatcatgtccctgatttccacaagcatttcattatctggtgtactctcctcctgtatcaaggtgttgagaagagctttattggactttgatctgtcaaccatgcttatcaacaattctttaatatcggataattcagcattgggcgtcgtcttagcaacattctgttcttctagtgtatccttaatttctgctagcaagtggacaatctgcgaaccgtcacctttgggctcaaacaaagatttaatatcgccaatcttggttctcctaacaggctttaaaccatcaatcatattgggcgctattggaagtggttggggcttcattccggtgagatctatctttgaaggactgctggcagctgttgaaccctcttggtccttctggttggtgtccatcgtgtagttagttgaaatgctgtcagtatcacccatataatcggttggcgtcttgtatatgtgcacaatcacgaaaaaggtaaacagatatgacataagcagagtaaatacaacgatagggaataggaaggagggcgtgcagcggatcaaagattagcgaacccttataccacaacttattccctagctctttttttccaaaggggaagtctatctacctagtaccaactaccaagaacagcccaacgataacccgaactgttaaattctacattggaattcaataagtttctgtttttgggaatccgttttttgtgtttaagattcattggaacttgactgccatcttcaagtcttttttgtatcgttctattgtacttttctggatcagtcaattacgtcctaagtttcttttcctctcttagtggcaacacacagcaacaatggaagactctcaattgattgatgaaaccatcgtccggccagaagtaaaaattcccgatcacacaaagaactacatcaaatacttatcggaatgttcattgtctgagttagaaagtgagcttggtaaagtcacttgctggaactccagcaagaccgatctatactattgggtccctctacttaaccgaatggattctattttgaaagagaaagttaccaagtacaatttagaagaagagtttgcaaaacccgttgagattcaacctgccgatgagtctctactggcggcaatacttactttttctagtttgttgtttgctaactgttacaataactccatatacgcatcaactaaacacgtctacaatcttattaattgttgttcggtacccgttttattggctgcgttacgtctgtgcgtggctctgggtgatgctacaattcaaaccggtaccatgaaatacaaagagtcaaaagtaatagacaagtttgtaaacatgtccattggtttccttcctccgacgccgccggtactttcgaacaaaccagtaagcttgaatgcgggatcacctacagatcctggttctgagggacagtttaatcttgctgattgttgtaagcttactagccgtaaggttccaacaaaatggaaaatgctcgactttgagtactacaattcggacgaaaaacgtactaatgagatcggccctaaacgaaaaaagtctaagttaacaccaacaaatacacagtcatcatccggcaatgatgcctcctcctccaagcagaaatccgtcaacttcagtagggagggagtgcaacatttaataatctcagaagaaaatatgcgaaaattcagtcttcaacagatctttgataaattttacgacaaattacccaaagaatgcttttttgattttgcattggcagtacagatagcaaaggcctttaacactgacacattcgaaagcttgaaattgagacaacagttagtctctattaagtgcatggctatcagctacttgtcttgtatgcaatcagcaacggactttcttgatagcgtactttcatctgactctactctcatcaacgacttgtgtgaattaatagatccctctttagagacaccagatatcatttacgagtctgcaggaaaggctttggagtgcatctcctatagaaaagtgttctctttggaaatattgaaagcactcaatggacatgtcagttatggctctctgttccgttacatcaaacaatacatcaagatgatgaaagatgattctgtggtaatcccggagaatcgtatccttttgtttaatttgctacggaacttgttggctacgaaacacgttgctcaatccttatccaatacagacatattaactctcttgatagacctattatctatcagatcttcgcatagatttcatttatctgcgggaataactgttttgtgtcaatatattgaagtcattccacgaagtttagacaagtttattttgaacaatggcttccaactgttattgaaagcaatcgatgatgaaatccattattccctacaaaatcctggaattccccccgccgatataattgtgtcgtataatatctcatttcatcaaatgctttacctgagagaactgatgatatttgttctttccttgattcaaactgattctggagatagaatgagaaacctttttgattctatactgctggagcatttcaacttggtattggacaatccaaaaacctttggttcacctattgttatatgtgttgtgtcgagtgtatccgccattttacatacagagccaactgctttttctattttgaatgagtctggaactattgaccgattgttgaagagctatccacagctcttcgactcttccaatgacttaattcaatcattgtttgatgtttttggcgcactttctttaaacaaggatggtttaaataaagtcgttgagtcaaagtctattgacatattttttgaaattttcagaaacgataactattcttacgaacttgtggaagcagcaccacagctggctaactctttagaccagctgaccagacattttccagagctgaagcctattgttatggacaatattatccgtttgattgaagatatacccaacattgtgtcaaaaacttttcctccgacagaattctttcaacaccctaatggttctttttacaagtccaaagatgatgtcgtagttgagaaggaagaaggtgttgaaaagctaaagcctttagaagcaacccgaggtggtttaatgtatgaaaatgttacttacttgataactgttcttttggaacacaactccaggtggaaagatatcactaagaaaataacgtttcagaagcttctcaagttcatcatcattgataatgcaccatatgatttcattgtttctgactctttgtacagtttcatgggtgttctcaagtattacgatgatgaagataggaactacggttttgtccccctattggactgtattgacgagtacacttggaaactgcatgaatttacccattatgaaaaggatgacgtctcatttttctctcaatatgaaaaaatggagaacgggaatattataggtggaaaagtcattgataacatgaagactttgaacgcattattttttcttttaacagactcatatttttctcctggtagccttttttcggaacggatgggccaagcatccagttattttacatcacagaagggggctaaactcttgaaggagttagtattatactttaggaggcttattttagaggaagttattatccagaggttcactccagattctgtttgtgaggataccacattttttgcgaaggtggattttgctcccgttcaaatgactcttggtaagcagtcagatgtaaaaaagaagatagattctgctcctaacactaaaagtaagaatattgcccagcttaggttgcaaataaacagagcccacacttggcttggattcacgtttggctcaatttgccgtataacaatgcacaaaacgcaagataggccagcgtcccttgggttcaagaatgctgtccacattttatccgatttcaccatctacatcactgaattatatggtaacatatcaactcaagacatattgattgaacgagcatatcatggtattgttaccagtctgttgtataggttgcttgtcaccagatccagaactttggatctagctatttttgcgtttgctatcgttcttcttcaatcggacactttccaaatattgaaaaaacttcttatttcttgctctacccagttaaccacttttgatcccgagaaactaaaagaagaatcaaagaattttaagacagtttctatgaatattgaaagcttaaccctccatactattaggtatattctgtccatttttgcgatagttggaaataagtcaaatttgactttgattcctgccgcaagagtatactacgagggtgatataagcggctttggaacgcttcataatgaattggtcccatcattccttactcaattcagactgtttagcttgggtatgcttcttgaagtactgagccccctggatgatggcattgacctgctttcttttgacaaggtggttcggagttttccgcccgtaattgttgaactattcatcacgattagtaaaaatgcttattcgcatctaggtgaaaactcgtcgacggttccgaatgggttactctatccattggtttggcaaaatgttcatcctacaaactctcgagttgattatttggtcagcttgggccttgatagaagcgatgccttagaatttttgaaatccacaggcaactctctggcaccaattttgaaagatgaggtccctttttatcaaggtgatctctcgcaagaccgtattgaagaactagcggctgaggctaagaatcgaccgtacattgtccccaagctagaacctttgaagccacagtactccaatttttccacgcatgatgagctagtgtttttgcgcaaagctaacgaatctgcttttgttgaaaggtggttcatttttgctgaattgtttcctgattgtgtggaaaaactttcggatctactgattcatgtctttttgaagaacccaggcacaaccagtaattttgagcgaactatccttagtactcttcttgctattattttatctcttgatacgtcaagctcagaagacgaggacaagcttgctggaactatagggttattcgctaatctaatcaaggactctgaggtgtatgatctcggaacagaatctttggaagggtttctctcattttgtgcagattcgatttctgctgagtttgttaattgcagctggtttcctaaattgctgtttgcatttgagcatattctcgtgttcacttcttttcctgaacctgagaaattagaagttggcatagccgatatagtagaggctcaaataccgaagttcgccgatagttaccgggctccgtcagctcccttggatgaaatttttgacacaatcattcattgtaagaatctgaagactatggaggtcacaatcgcactttcaagggtactttcgatatttgcaaaagatgacctcaaagcacgaaaaatatttgatagtggcatcctgaatgaactgattcgtgcatcctctttgtttactgacgactcaaactttcctaagctgcagaactatctgctattactgatgcgaacttgtatggagactggccctatattagaaacgctgatggatcactatctccagaagaagttatcagattctagaactttgagtacgcttttgaaagcaaatggagtattagctgctagaaacccccagattttggcagaatgcattggttcttctgttaggctttctaagtgtgtcgatcctttagagagcttgtcaattgtacctctaaagaagggtaacgaaatcgaagattcaataatgactgatgccacaaccggtaagtccacagacgaactaagtgaagaacccgattatagacagaatactggactagttcatacactaatcttagagctaatgtctgtttgcaagaatgatatatttagctctcctgaaagttctgagcccatttccccggataatattcgaaaatcaaagcaaaaacttttgaaactgtttgagaataagcattttggttatgccgtatttttgcttcatgcgactgccgagttggtttctagttataagcaaagcaaacttgaatttttgacattctcaagaaagaagactattcaatcctgtcaaagacctcggccaacggctttgaattttatccttcatactttattgggcacagaaaattctggtgattttgatgaatcagagacacagagaagagttattgtttcaaatcttattaaaatgatagtatttgggtttgtttccacaccaatctctaagtttgatcctaatctacctacgaaagttgaccctgacatgacttatgtcaggcagttcaccactgacgttttatccaaagtgttaactgatactcatagctctgtcgagtcacccagtacaaggtacagaaagctgtcagtctttacagaattgcttcaaaaactgatctctgaaaaaagggatttgtgtggacatggtttggatatcttgttcactaaatacgatgcatatcagatgactaaagtattggtggaaaagaattttgcctcacttttaacgagtcttgtttcttcatttgatttaaacttccctaatgctaatggtgtgatgaagcctttgttggggtgcattagtagtcttggccgtatcaaacacacttacagtgacttactaaaggatgggcaagatggtgaggacactcacagtacagacagtgaagaggaggaggacaatgatgaagatatggataatagagatgacactccaaatcttctcagaaattcgactcttggaatgtatgatgttgccgatgttgacaacgaagattactcctctgaggggggttatgaaggtggttacgaagatcttagtgaggacaatgagcacggccccatagagattatattcagcgatgacgaggatgacgatattgaagatgatgaaaatgacacttatcaaggctcatctgatatggtcatagaggacttagattctgcagaaattatagaggatgattccaattccgagggacccactgatgaagagtatgaaattgttaacaatggaaatttcttgatcaacggaagagagtatgaaaatgttgaatatgatgaatccgacgctcaaaacgatgcctcttttgatgaagaagtaccttttgattcggagaacccttcatttgatgatgatgctggtgatgataccgattacgacggctggttaaatatactaggcgctgaagatggagatgaagacgaagaagatgaagatgaagataatgaacatgaagagctaaacagacaccatatcggatctcgtagaggtaggcagattgttgaaatcgatcgacttggcgaggaagatccagatttatttgcttctggaaacatggaaagtagtagacttcgatcaatgatcgagcatttgttcgaagcagatgatcaaattgccggtgcatttgaacgtgatggcgttcgagttagtgtggttgataataatggcttgattggattagttgatcgtccttcaaagtttatgaagccccccagcttagaaatgaaatcctcctacgaaaggtggagtgttgctaacgatatctacggtaaggtagagtatgatgctctcaggttgctacctggtctcatcaatatgttgtttcctccaagttatgaaatttataaggaaaagaaagaaagagaagagcaaaaaaggcttgaacgagaaagagagatcaagagacaacaagaagagcgtgagaaagagcttcttgaacgtgagagatctcgccaactggaaacagagcagcaacaatctcaggtcgacacagccgacgcagaatcagatgaagaagactctgaacctatcattattaatattggcggtgaagatgttgacataaggggaaccggcatagatcctagctttcttcttgcgttacctgatgatatgcgggaggaagtcttcactcagcacatcagagagcgaagagcacaatcatcgggtgacaatgcttccatggatgatataccttctgagtttttggaagccctacctgattcaataagaagggaagtacaaactgaagaatccaatttccgtaacttccttcttcgaggtaatgatgaagatgattctgatcagtttgatttatccgaagaaacagactcagcttcacagtcgaccaagaaaaaatttgtgttgaaaaaacacaaatactaccgtacaccgttggtagacaaatttgggatctgtgccctgatcaggttcttgttcctccctcagaacaaatatgatattgactctctaaaacaggcttttttacagctatctcataacaagcaaactagatctgaaataatgcagatgttgctgctagtactgcatgaagcaactcaagatcaaaaggccattgaaagaatattttatcaattaacaagtcgcagcaactctgctgcccaaaaaattcttttgaaagaggaaccaatttccgatggtggcattgactctaaggagttagcattgcaacaatttcctataagttgcactcccctgatactctcaactcaagcactcgaaattatcaactacctgttaaacgctgatgtggaattcaggtactattttttgactcttcatgatcatcagcagttgttgaagaaattcaacaagaaacaaaaactaaaagaaaaagattcttaccaaaagggtccaaactatccaatcaacagcctgttgtccctcttggatcggaatatcttcctgggggatagctttgtattgaaacaactttgctatgctgtacatattgcaaccaaacctttgggaaaattcaaaaagcttcaagaaaaaaaattgaaggatggggaaacagttaaaccggacgttcaatttccgtttgtatctgacgaaaatctgaagaaacttgtatccattttggttacagatgactgtacttcttctgtatttaggaaagtggttggaggtttacaaaatttatctattctcgaagaaaaaagatcgattcttgcacaagagatttcggagaatgctaccaatctaggaaagcagttggttgtcgatttagaacaactttcttcaagaatcaagaatgcggatgaaaatgttgatgaactttcttctgaaacattggagaaattcactacggccagctccaaacaagcaaaacttttgcgtgtattgacagcgcttgattatctattttataccaaaaaatcggccgatgctagtgaatctgaaattgaagcactaacaaacctttacaaaagtttggctttgggaccattatggggtggattaagcgagtgcttggtaactcttcgtgataagaaaaccctgcaatatattgctacaatcttatctccattgattgaatctttgatggttgtatgtaagcacagcaaggtaaaggaactacctatacgagaagttttgaagtatgaacagaaaaagaatgattttgttaacgagccgatcgaaagtttgtttttcactttcactgacgaacataaaaagatattaaaccaaatggtacgtgtcaatcccaaactaatgagtgggcccttttctatgttggtaagaaatcctcgggtattggagtttgactgtaagaaaaactactttgatcaacggttgcacgagggaaatgaaaagagaccaaaactctctatttctgttagccgtgagcaagtgtttttggattcatacagagcactattcttcaaaaaagttgatgaaattaaaaactcaaaactggagatttctttcaaaggtgaagctggtgtagatgctggtggtgtgactcgtgaatggtatcaggttttatccaggcaaatgtttaatccagattacgcacttttcataccggttgcgtctgacaaaaccacattccaccccaaccgaacatcttacatcaatccggagcatttgtcattcttcaagttcatcggacgtataattgggaaggccgtctatgataattgttttttggattgccattttagcagagctgtctacaaaagaattttgggtagacaggtcacgctgaaggacatggagacacttgatttggactactacaaatctcttgtctggatcttagaaaatgacatcacggatatcatagatgagacattttctgtggaatcagatgattacggcgtgcacacaatagttgatttgaaaccgaatggcagaaatattcttgtaacagaagaaaacaaacaagagtatgttcgcttgattacagaatacaggctgcagacttcagtcaaggaacaaatgaacaacttcctgataggattccatgaaatcatccccaaagacttggtggcaatattcggtgatcaggagctggagctactcattagtggacttcctgacattgacgtcgatgattggaaggctaacgcagtgtacgagaattattctccatcctctattcagattcaatggttctggagagctgttaggtcttttgacgtcgaggaaagggccaagttgctacagtttgctacaggtacaagtaaggttccgttaggaggattcaaagaacttactggtgttgatggcgtttcgaagttcagtattcatagagattacgggtccacagaccggttaccatcgtcccacacctgctttaaccagatagatttaccagagtatgagtcttatgaaacacttcgtggctccttgttgttggcagtaactgaaggtcatgaagggtttggactggtgtgataccgtttattgtgtatttataatttagtctaactcaaccaaactaattacttaaacagatcttgcaatgcgcaggagcgaaattatcgttacatcagaaattgtaatgtggtagttaattgtctgtctcacaatgaagcgtaagacggatgaccatagtggtaacccccggaaaagcaagttgccacccagtctgcgagataaagtggaggctgcaaaacaaaaactaaacggaactcccacaggtaagacagttgaaaaaactgctctcaatgtggaattacacccgctgttaaagcaaaatgttaccagctcaatcatccctaaagattataatcccgtgctacacacaaaggtcagacctggtttttctgcttctcagctaaatccttatttagatcaaacgacgttaagcaaaccaacaagaccctatagaccattgaaatttgtggagaaaggaacttatgtgaaaaaagctgaggaacaacgagaaagacttaaaaagcaacaagaagagcagcaattgagatccgaaaaagaatcgcttggtcttgaaccagatgaagcactcggtgaacaatactataaacccatcctacctccttcgattgaaccttgggataagccactgttgaaaggaaactcatatgataacttagatgacgttacattccttgactcagaggacgaagataatccaatcaccatatatattcaacatccagttccaataccgtgcccatgggaaaagaatgaaccggccccgccttccttatacttgacaaaggaggaacaaaaacgtcttcgacgtaacgaacgagcaatcaagcacaaagaaatacaggatcggatcaaactagggctagatccagctcctcctccgaaagtcaaacttaagaatttgatgaacgtgcttacgaatgatgcaatcaaagatcctaccgctctagaagcaaaggtacgagcagaggtggaggaaagaaagttgaaacacgaaatgactaatgaagagcgcaagttgactccggaacaaaaagctgtaaagagggaattgaagaagatgaaggaattagaccggggtatatattgtgctgttttcaagatcgacagattagtcaacccaaagcatatctataaagttgacattaatgcgaaacagaactcgctggtggggtcgattgtaagtgttaaagatacattttcgttaattgtggttgaaggaggtgaaaaaagtattagaaaatacaagaatttgctattgaataggatcaattggactgagaacgaacacaagaaaaagccagagggcgaagagaaaacggatcaagaagaaccaattttggaggacctttcaagcaatcaatgttttctactttgggaagggccaattgctgattttcgtttccgaggctggtccaacaagcaatttgaagacgagctggaagctctaaactttttgggctttcatcaagctgaaatgtattggagagaagccaaagttaccttctcccaataaacaagacaatagtgatgattaggtaagcgaattcggctgataccccttagattctcgacgtagaactaaacttccttacccaatcaaccaacctcaaatataaattgtatactatgggagccaattacgttatttttggaaagactgtccgtccacacgttgtaagttttgatttttgagatctgcaaacccactgaacatacattaactgtcgatagttagcattggctacacttggaagcgtagctgcaggtattgctattcccaagtttcttcctaaagacgagccaattcaacaggcaaatactccaatccagagtgctgttgaaactgtgaaggatggagctgctaaagctgctgagactgtcaaggcaggctccgataaggttaccagcgtggtgactggcaattcggatgacattgatgttgaaaaattgatcaatgattttgttacttctgttgacgacagaaagcagtagatatagattattgtttagagattgaatgagaaaatgcaatgtactagtaccctatgagccttgacggagcgtgctaaaggatgaagaaggaggtgccggagaccagctgaaaggaggagatttgcgaagtcgtagaccaattgtctacttagtgaacgggctcaaaatgcggcagcattcggcctatttaacgccatttgtagccgtcagtattgccatagttttacattatggaggccctgttattacatgtcgcgctgactcctactggaattcttaccaactaataatgttattgctagccattggagactttcacattcctgatcgtgcctcaagtattccggcaaagtttacgaaactgctggcaccgggtgacaagattcagcaggttctttgtttgggaaatgtttgcgagtcaccaagcacattagaattcctgaagggcatatcaccagactttcagatggtcaaaggagaatttgatagagatctaagtttacccaccagtttagtattcaattatgacaaactgaagatagggctcatcaacggtttcaacgtgattcccaacgcggatcctctaagtttactgactcaagcaagattgatgaatgttgacgtattagtgagtggagggacgcataagattgaggcttataccttagatggcaaattcttcatcaatccaggcagcgcaaccggtgcatttacaacaaaggctccctcaaaagcggacttggaagctttaaatgtcgataagaatttggctgaagacaaagaagaggataatgacggcaaggaagataaagataacaaggagagagaacatcaaaaacaggcaaatgaaaagacgtcagagaaaccttcacctcaaactttcaagggtgaaacatccaaccaggtaactccggacgaagatgatcttgataatataaatacagactccctggagcagctggacccaattccaagtttctgtctgcttgatattcaaggaaatgtttgtacattgtatttgtacacatgcattgatggagacgtcaaggtagacaaggtgagctatcgtaaagaagactagagaatgaatatttgtatgacacttgaggagtttggtcctctctatctgggagagccctagaattgatgagtttggggacgctagtgtccgggttacccccacatcgattctctataagagcgcactcaaaaacttttcatcccatcaccatcagctagttaataagtaagttagacaactgaattctcaatgataatggattacaatgatgactagagtgcatttggctcgagacgtttctgtcgatgtggaaaaactcacgctaccttaaatttaacctctgaattttctcttatcaaaaggaacaatttttttttttatgtgggttgtactaacaacgattaaagtatttgaatattgataactccttgtatagtagttaataggtaaatctactttgtgatacactctttcttcgtccgttgatgagaaaatgtaagaccgcttgccgggtaaatcttagttgaaagccgttgcatgagggatgctgttctttctcagggaaatcggcatctgttcatgctgtcagtccagccggaaaaagataagttgagtctgccggctttgtagactagcacggtacaagcaaagcgatggctgttcaggtcgagtatttatccttcttaataccccaaaaaccaacattctcctccagcccatttgataacaaagcgcttcggatcttctggtctcaaagaactccgaagaactcggaatacaacaagctgacctggtcgatattaatcctaccttgaatatcagctcgatctagcaattggcccaaccatctgcgaacagttagcagcgcgttcaagctgtacaaacgatgcctgcgcattccctgtctacgaacgctacaaagcctcatctctcgacttgctcaaataaaaagctatcaattcgcccatcagctcaatggttaggtctaatttcctgctactagctcccatctgccagctttctagtgagtcctcacaagacacgctaaccgactggatgtttaagcaaatgggacatttttgagttgtacacgttactggccctcccatgtgcatttcaagcacactccgagccctcggtgctaccaaaagcctaccccactcccttcagaaatgggccgcttcggctatctctgttctctaaccatcaccaaaaatacctagcatccctctccttctactgtttttctttgtattcaacaacgatgcccaataggctcataccattggcaaatccagctaatagggtccttcaactcgatgctaagttgctagacaacgaaatatcggatatgctctaccggcagctatctggagcttttaacagcaacagacttccgagttggcttgggagaatccattccaactatgcctctgagttaaagctcttactggaactacttatctttaaagtaaccgtatggaacaagcactcaagctatggcctcactcttcagaatctggtaatgtacgatggtggtgttcataataaaaaattcaggtcgaaacaacagtccgaactcagggttacaaagaaaatacttttactgtcatccgtgttgcttgggtattttgtcaaaaagattcaatcgtatgtgtactctttcgaagattatgatctagagactgatggagaagacttgagcaccttagagagaattagattaaagactatcaaactgttaaaatcccagatctccacactggagaaagcacattccgttctctcattggtaaattttgttacatttctggtatctggaagttttcctgacctaactactcgaatccttaacattagattcaaaccattggttactacgcaagtggccttcgcttcaaacccagaaacgatatcctatgaatttcaaaatagacaactagtgtggaacacattgacagaatttattgtgtttattttgccagcattatcagtacctaagtttaccaagtcactggtaagctcgataacaggaacttcacccaagtctagccaagtgactgacgaggacctaaaagttttttcttctcttccggaaagagtatgtgctatatgtttccagaattcacaaaattctgactcgggagctcaaaatgatatttccctcaacgatactttagtcaccaatccatacgaaactacctgtggacatatttactgctatgtgtgcattctttcaaaattgcaaatcttcaaggaggaaggcaagaatctcccaaagtcagatccgaacaaatactggcattgcttgagatgtaatgagccagcttcttggtgtcgagtctatactggagatgtggaagacgcgttgagacagaaggctgttgaagaagtcacagaggatgaagatgcttcaagtgaagacgaggaaaaaagggatcaagattcagaaggtgctaaaactgtttcccaaagtttccatcacgttaatggatcagactatcaaacagcatcattcatagagcaggctgagctgaatgaaaatgaatacacagacggttcggaagtggaaatatatgatgctgaagatgaatacactgatgaagaagtagatgacgactctccaggttttttcgttggtgcgttatagagttacggttaacaagatggtattagaatttgttaagtaatcataatcatgtaatgtgtcacgtgactgtttgtatcattccttacctggataacaatctatctatctcatcgccattcctctagcgtaaatgggcgcagaactatcactgttggctcctacggctcaaccaattgctctatcagcctatgtggatttcctcagcaacattcaatacaataaaccactggggacctctcgtttcctaaaaacagtgaagggcctcaacgatcaagggagcattgttgtcaaagtcctcgttaaacctaatagcggcttggatcttagtgaatgggtagaaaagttggaattcttacgactgaagctgcttgatgtaccaaacgtgataccatataacttggtcatcgatagcgtaagggcaggatacctcattcgaccatttcagcagagaactttatatgaaagagttagcattcagccatacttggaacccattgaaaagaaatggatagctttccaattaatacatgcagtaatggaatgtcatgaaagggggcaatatcacggagatatcaaaagtgagaatgtgttacttacttcttgggacatggtgtttttgacagattttgctccgttcaaacccatttatctccctggaaataatccgagtcaattctctttttactttgatacaagtagaaggaacgtttgctatgtggctcccgagaggtttttgggtgaagggactccaacacagtatcaagaagttgacaaattaacaagttcgatggatatattcagcctggggtgtactgttgccgaactttttctggaaggttcggtcctgtttacattgcctcagttgttcaagtacaaaaaaggtgaatatactccaagcttgagtgggattgtcgataatgacttacgcaacatgattcaagaaatgatagatttggatccaagaaagagaattagtgcacacgattgtttgagaaaacataggggaaaagtcttccctgagtacttctattccttcctatatgattacatgctagaattgagtactccatccgatcactctgtgggaaactggcgatttgacgaatgtgaccgtcgaatcgaacgcatctacaacgatatgggtatgatatgtgacaaactggatgtcaaccttgacctaaacatagtacattctttcacagaagagccctctcagaatgtgattccaatgacgcttcggcttccaggagttgaaccacatatcccacagtcttcaaaaactccttatgattctgctttaatcatactaaatatcctgcttcattcaatgagaaacacaacacactcttcttatagaatcaagtcatgtgatttgattttgatgatatctgagatgttgtctgatgaacagaaactagatcgttgcttaccgtatttggttcacttactaaatgatccttccattgatgtacaagcggccgcattgaagtacatgacacaattactgttgttggtggactatttgacaccggttaatgtgttgatcttccccgagtacattcttcccaaactagcttcttttctctccactactaaaggctcatacatgagaatgatttttgctacaattttaccccatttagcaaagactgccctcaagttttatgaaatggccatcctattggggagtcatgttgaaaagtttgagctcttaaagaattttgagaacctcacaatccagttgctgatcgatcccgattcatcagccaagatctctttgcttaagaatatattgcctttggcctctgtttttggtaaagataaaacaaacgacatcatacttagccatatgattacctacctcaacgaccctgatgaaaacctgagggtggctttcatagagagtatcctagggctttcaatatttgttggaataactagtctggaaaactacattcttccactacttgttcagaccctaaccgataacagtgaaattgtggttgttaatgttctccgttcatttgcagagctgaataacttgggactaatcaaaaaaagatataagtttgacctaataaaagtctcttcaaaacttttattacatccaaattcttggattcgcttaggtactttgagattgctgattagtgtagtcaaggatttgtccttgactgatttctactgcctgctttatccccttgttcgtccgttttttgagtatgaggtcaccaactttgactgggccacgttgtatccctgcatcattaaacctattccaaggtcaatatacactctctccattacttgggctctaaaagctgaaaagactctcttttggcagcaagtgaagttggccaaacctgacccttttgggagtcggaatagcacattcttactaaacagaaactcaaagattggggaatcgggagtagtctctaacaatcagataccaacttctccagaagatatcggctggttggggaagctgaaggcatcggggtttgatgaaaaggatttatggaagattgccaccctacgagattacattttccgtgtggcaagatcaagatccaatatcccgactcaggaaaacaacgaagtcaccatgcagcagatgggaatttatccacgtattgtattttttgaaaagggatccatgtatgaaactgaagggtttgtaactggatcctcaatgatggcaaactatcgaattctagttaattcagagtattctccagaaagcttgacgaaacgaaagacggtaggtggagttaacactaatcatacttatagcggtgcaaatccttacattctaaaatttttggaatgtattaagttcaggcacgttctggatgattccgaagaatttgggcccagtataccgtcggcaactgtagaggaaggccattggaagtttgaaggagtgcttgttagccatctcacagaacatacgggaagcattacttcgttggcgctttcaccggatcaacagtattttcttacaggtgatagcaaaggtataattagattatgggatgttcttcagttagaaagaaatgggtatgcaacttcccacgtcactgtctccatgagttcctcggtgaaggatataaagttcatagaaaaccgaaatagtttctgtgctgtcactgcagatggagaaatcaaaattttcagggttgaaattaatagcacatcgagctcagtgagatcaaatggtagccctcatagacatgaatcgataagtttattgcgagaacatagcctcgagggggagcatataagtgacatgaaatttattggtccaaacttagcagttactactttgtcttgcaaactcatactctttgatttgagagatatgcaaattgctgaagagattcaaaatccagtctcacacggattcattacatcttttgacttagactcctcgcagagttggctactgattggtacatccaaaggtattttggacttctatgatctgagatttgaacttttggtcaaatcatggaagcttaaatcaaccagctatcccataaagcacatcactgttcctccggctgggtttacttgtaatagaaaatcagagcgatttgctttgataaacggaggaactaatgattcagttactattgtttttgatgtttccaaaggacaatgttcagaactctattttactgaaactgtgaatttaaacactgccattgacaactatgaggtattggaagttgataatggtgaggaacgaacccgaacttctgtgctggctacagaagttgaggaccgctcaataaccagtttgacaatgctaggctcaaaccaatttttgacggcaacttttgataaaagagtcattctctgggacactggtaacaaagcgaattcttccgctctcatttccaagttagatgatttcacttccagtttttcatctgtacaggtcagacctcatcttatggctataaacgaaaaaatagtggaaaaagatccccaaaatattggagggccaaaacgtaatatggccagtgctaattcctctacctttgatctacactcagacatcatcactggaatcgctgtcattcaaaagcctctcaagatgctcatactggtagacagggctggagtaataaatatttataagtagtgtcagtaatgcatgtttgagcttattgttttactgtgcaccttacaacaaacgcatgttgtatttgtacatatatgccataacatccagacacaaaacccaacaactttaatacattcatgttcatcttgacctcttctctgttcatatgatatcttctcaaaagccgattggtaacaagaaagccgatattgaggtcgctgttaagaaagaatattcagtttactctaaagcaaacttttacctcaactcaaggtatcaagtccagcaagttttgggtaaaggttcttatggcgttgtatgttcagtgctagatttgaagtccgagaacccggttccattagcagtcaagaaagtcagcaatatcttcactagagaagttctgcttcgcagagccatccgagagttaaaattgatgaagttttttagaggtcaccgaaatataatcaatctggtaaatcttgacattgtatacatcaagccctatgacggcctgtactgcttccaagagttggtggattatgatctggctcgtgtaattcattctaatgtgcagttcagcgagtttcacattcaaagttttctctatcagattctctgcggagtcaagtacatccactccgctgatgtaattcatagagacttaaaacctggaaacatcctggtaactgtattagggaacttgaaaatatgcgatttcggtcttgcgagaggtataaatcatcaattcatgcaaggatcatcgaggcccagggataacgctatcaccaactatgtggctactaggtggtaccgtgcgccggaattaatattctccagaaaagagtacgggaaagctgtagatatgtgggctgtagggtgtatttttggcgaattgtatggtagaaaacctcttttcattggagactcgcagatgagccaaattgcggagattgtcaaggttttaggaagtccttccaaagaggtgatcatggcatacggatcacatctggcatgggattattttcaacctcccaagccacaatacaggccactgaagtgggctcatgtttatccatacgcaagtggttcagcactagatcttctctcctcactcgtttgctgggaagctaagcgtagacttgatgtggaagcagcactatctcacgagttcttaagtgccgtcagaaataaaagtcaagaaccaaagtgtaaatctatttttgactttcgatgggaaaaggagaacacaagtctagaagatctgaagatcttgctgcacgaagaagtcactcaattcaagaatgaaagggaaaataactcccaacctaattagattctatttaatttctttaaaaaccgtctgaaatatcggtctgatggtctagaggtatgattctttcttagggaggaagaggtcccgggttcgattcccggtcagacccataacttttttatctcgttatcttgcaccgttctcaccccctaccaagacgggggtgaacgactggtaataaatctcgcacgacactattgttgttgtatctatgttgtccgtttagggaaatttctgcctatgtccagttggaggggcggggtggaagaaatgtcaacttcgttttttccaatacctgatacttgattctctattctttctggccttcaaaataatattatgtcagaccccaaaccattgccctttgtgtaccaatttctatctggggccattgctggagtcagtgagattctagtgatgtaccctttagatgtggtgaagactcgtattcaattgcaagtgggaagtggagcaaacgctgagtacactggaattgttgactgcgtcaccaagatcgtcaagaatgaaggattctcacgtctttatagaggtatctctgctccaattcttatggaggcacctaagagagccacaaagttcgcagccaatgacgaatggggaaagttttacagaaatgcctttggcgttcaaagcatgacccagtcgttagctgtactgactggtgccaccgctggtgccactgaatcgtttgttgttgtgccttttgagcttgtgaaaattagattgcaagacaaatcgtctaaatattccggaatgggagatgtggttaaacagatcgtcaagaaggaaggagtattgtccttgtacaatggtctcgaggctactttgtggcgtcatatctggtggaatgccggatactttggtgtgattttccaagttagaagtctgttgcctaagactgagagcagcacccaaaagactgccaacgatctgttgtctggtgccattggtggtactgtcggtaccatactgaatactccatttgacgtggtcaagtctcgtatccaaaacactgtcaaggttcctggtgtggttccgaagtataactggactttaccatcgttgctgctggttaccaaagaggaaggtttctcagctctttataaaggattcctacctaaagtgttacgtctaggaccaggaggaggtatcttactggtggtatttaccacttgtatggactttttccgaaccttacagtagagaaatagttagacttgattatctatatttattgcagtgtttatacaagtttttctttcgtctagtttttcaaaatgtcgaccacagccttggaaatagcatctcctacttcagtggtagagttggagcctcctaaatctccagtcatgatcccagagtccaaaacttgaccgacggctttctctaaagcatcagcttcttctgtaagattcagggatagacgaagcatcatagctgcagacaagattgtagctacagggttgaccttacctttgtccaaatctggagctgagccatggcaaggctcgtacagtccaaaggcttcgttagaatctggcagagaagctagagaagccgatggcaacagtcctaaagagcctggaatcatggatgcttcatcggaaatgatatctccgaacatgttattagtcaaaacaataccattcagcttggaaggagatttcactaaaatcatggccgcagagtcgatcaattgatggttcaaagtcaattggggaaactccttctccaaagtttcagtaacggtttttctccacaaacgggaggaagccaagacatttgccttgtccaaagaccatattggcaaaggaggatcgctttgcagagccagaaatgcacccatacgggtaatacgttgcacttcagggacagagtatttctcagtatcccaggcaactcctgagccatcatcttcagttctttctccaaagtagataccgcctacaagctcacgaacaacagtgaagttggttccacgaacgatatcctctttcaatggggagagctttagaagagagtcactggcaaagttacaaggacgcaagttagcatacaagttgagttcttttctaattttcagtagaccttgttctggtctgacatcacctgtaccccatttaggcccaccaacagcccccaaaaggacagcattagcgcctctagcagcttccaaggtttcatctggtagtggagaaccggtggcatcaatagcagctcctccgattagttgagtttggaactcaaaatcagcatttggagaaacgctgctaatggctttcaggactttgacggcctcgtcaataatttcagcaccaacgtggtcacctggaagaagaacgatcttcttgggaatcacagacttgggtttcttggtaattggttcggacatcaggggagatattatgttggtgaaaagtccctgagtatacggaatgattcatcacatcgtcgcgacattgtggagcggatgttagatggaaagtatacactaaagcaaatcatctttcagttgaattattgggcaagagtggctattggaaggcaatatggcccaaagagctatacacttggcagaggtaaactacaatcaaaaatacaaataaaaaatgctttaacatctagttctgctcctcaatatacttatcaatgtcgacatactcgagttcagcccttccggaattggagaccttggacttggactcttcagcaactaactttctaagcttgctctcaggaccccatccgctctcagggggactcagttgaaatgggttcaaaaacttgttaacgactttgaaattctcctctaaagaaaatatctcatgaataatatcctccatacaaacaataccatagtctcccagcttatcctcaataacattgttatcgtttaactcaacggatcgtggaccattttctccttcaattgtaatcttagctcttttctgcaccagcgatcgcactgtgtataaagatggttcaccgataactacatgagcacggataaccttcaatagtggaataacagaggatgtctcccgaacaaacactccagtgttcatttccgttaatcttaaaagttttagaattaggtccacttgttgtggtagatgtgctctttttggaccttgaactcgcactacaaacaccagtttgccttgatcttgctcttgctgtgtcttgtcagaagaaatggccttctgtttcaattctttctccactttcagcactctgtcaattctgtgctgttctctttcggaggccaaatgcctaagtgctaaatattctgggggaacaaaggtattctgtttctttcttttctgaatttgtctttcttcttctgcttggcgaagagattcagccttttccatacgagctacctcgtcattttttctctttttcaagagcacttctgtctctgtttgcgttgaagacatcgattgattaggagggataattttttctttttctctaagaaaatttaaaaagaaaatttcatcaggcgcgatgagttggagcatccttggaggccactcagcagcttatctaaggtgctccagggggacaaagaatcccttggagcttggatggcaatcatcttgatctagctgaataatacaaatcaaaaattccttcaactacttgctacttgcaccctattaacatatatacatcactcctaataatagtattaattctgaagagttaccattgtgtttcgctctagtgtccagaccattcaatgctgttcagatcaataccttcttgaaccatttcccacagtggagacaactctcgcaaaaactgcactctttggttgatagcatcaataacatagtctatctcctgttctgtggtaaatcttccgattccaaatcggatagacgaatgtgctagggcatcatcagcaccaagggcatgtaacacatatgaaggctccagagaggctgaggtacaagctgatccggaggacaaagcaatgtccttcaaagccattaataaagactcaccttcaacataggcaaaagaaatgttcagacatcctggatagcgtgatgttttggagccattcagctgtgtgtgctccatagacagaataccattcatcaacttctgagaaagacgagaaatgtatttggtgtcatactcatattcctgcacagctagtcgggccgcttccccaaaccctgctactaatggagtggcaagagtaccagatctgagacctctttcctgtccaccaccgctgataataggatccaatcgtacccttggtcttctccttacgtagcaagcacccataccttttggaccgtatatcttatgcgaggaaatagacatcaagtcgatattaagtttgttgacatctaaaggtattttaccgaatgcctgagcggcatcggtgtggaaaaagactttgtggtttcgacaaatgcgaccaatttcctccaatggttgaataacaccaatttcattgttcacggccatgacacttactaagcaagtatccttgcgaatggacttctccagttgttcaaggttaaccagaccgtcctcattgaccggaagataggtaatatcaaagccgtcatcttgtaacctacgagcagattcaagtaaacacttatgctcagtttgggttgtgataatgtgcttcttggttttcttgtaaaatcttgcaactccctttaccgacatgttattagattctgtggcaccactggtaaacacaatctcctttggatcagcacctataacatcagcaatgtactttcttgctttctctatctctttctctgtttcccaaccatagctgtgtgtactggaatgaggattcccatacaatcctgtatagaactctaacattttgtccaaaacacgaggatcagttggcgtagtggcttgcatatctaagtagatgggccttgttccatacaatgagtcatctcttttgctgttgcccaacgaaacagcagatcccttaggtggcactgcatcattaagggatgcattactaaccgaagtaggcattggcgtcctggcagatgatgcgccggaaatattcctaacgacttttccaaaagccgatgctttattgcaagaccttcgtactccgaacattgttataacgatctacttctgaaatccgctagtgaggagaaaagagaatttgtacgaattcatgacatgtattctatcattgagtggcggacgaccatttatcttcccaagccggtgttaggatggtcttataacttgctttaacactgttttaggttgaatcaggatgtgcttggatgttgtgggaaactttcccacgtatttcatatgtctttatctttgaggtttatagttacgtactatgaactgtaggcgtccctggttgaatcttagttcgaatcgggaaattttcagggaatcatcgtgttcgctaactttgataaagtctcaagctacgtacttttccccttctctagtcaaagtcaactttttaggtccaaaatagttgctggagccgatatgaatgaatttctagtatcactaatagtaagtctattttgattgcgaattgcaacgtccactaacgagtctagagtggtggttgtgctggaacagctacagacttagctttcttcccaatagacacattgaaaacacgattgcaggcgaagggcggtttttttcagaatgggggctggaagggcgtatacagaggattgggatcagctttaatagcctcagccccatctgcatcattgttctttgtaacatacgatgggtgcaagaagtttttcaaggctgaactgatgccgctactgaaaaatgagaacttgacccttaatgtctctcatatggcggctgcatcccttggtgagattgctgcttgtcttgttagagtaccggccgaggttatcaaacaaagaactcaaacaagcaagttttcaagttctttagaatcattaaagtacattctgagaaatgagaatggagaaggggtgattagagggttgtatagaggttggacctcgactatcgtgagagagattcccttcacaacaatccagtatccattatatgaatatatgaagctgagatgggccgcacatcaacagatagagaaggttagtcctttgcaaggagctttatgcgggtctgtggccggtgggtttgcagcagctgtgactactccattggatgtcttgaagactcggataatgctaagttctcataaaatatctctaggtcaggtagcttctcaactgtacaaagaggaaggatttgctgtgttttggtctggggtcggacctagaacaatgtggattagtgctggaggagcaattttcctaggggtatatgagacagtcagctcgtttctcacagctgaagagaaaaccaagctcggataatggagttttttagtttgcatgatgtagcatagtatagaaatagaatagatccgaacattgactgccctgtcaatgttacaccattagttcatattttgttcgccatatttagtcgtcctctgaaaatccgaaggaaaatccgttttgtgacaccaattgattccaggttttggattctctgacttttgccggtcggtttttcttttctattgttgttaagacatcgactacattattcaaatcaatgctgttgaattgctcgctttgttccaacaattccaagaacatatcatatataggcatcggaacgaatgctatttctccacaatcttcgttatcatctttcgcttcccggatatagtcttgaaatctttggtatctttctgtgttctggttcattctcttgcaaatattgattaatgatttcttgacatccaaggaatgaaaacctgagatttgattgtttttattcttgacgaagtctagtacatggggcaacttaggttcgggaataaagtttcccgtcatcgctattgaattgtccaagttaataacactatgccaccatcctgctgggacgtgcatacattctcctggataagttatacctaccaaacattgatcagatttcgtcaaattcagcgcatcctgcatgaatccagatagggtccactctgcaattcctacaggagctgtcacctcactttctgttttatcagtcccaataccgggtggctttatgtccggaggtaacattatccaaagctttcttcccgatatagctgtgttccaagcagaggtgaaattagggtccttgtgaaacgttgaaccgctattcttgggccccattatcaaccaagtgtgatctggccggcataagatatcattctcatcaaacactgtgaacaaatctttcttgaagcaatctggtaccgtaagttcattgaccagctctttcatggcatcactgttgcagtcaaaaagatacaaaggagattcgtcacaattatctagggaatactcgcagtaaaacgacagtggccacctaacgctttcttggcgaaactgtacgtttgaaaaacgctccaaaagtgattccatggaccaactaggccacctagaacgattaagattagtgatgatgaatggtagatcagtgaagttggtttcaaagttttccaaagtcatcttttcttctggaattcgtaccacatggcctttcagagagttgtgcttggcgtaagcttccggatgatcgtggtaaactcgttcatcttcaataatttccctacagatctcagaataatcaatttgagagcattgataaggacgatagagaagatcggaacatatctgattctcctttacttggatgagagcttcttggtctctttctatccccaaaagtgttcgcctccaagaacccttccactctttaattccgagtggataatgtgattcaactgatttggcagccttgtgcatatacaactgtctccatagttcttcattccatgtataggcatacatcatcctggaggtgtgtccaagtttcatcaaatccaaaggggaatctatgaaatgaagaattctcgtcatgagttgttcgtttgaggccattaaggtccagaaaccccttctttgagacttgtctggatagtttgagtcatgtgatgccaatagacgatttccagagggtttcacgcccagaggatgacggggaaccacagacgacgtatgcactcttttaggaagccatttgacatgtgcagcttttgaatggtcaggtagagcagttttacgcttctttggctctggttctgactgtgtcattgagtgaaaagacgatatcaggacaaaaatatttctacgacagatgagatggattttcgttcgcgaacaataagctgtgaaagtaaaagcaatgtgtagttgcactcctgccaactagtatgtaagttgcgacatcaaaaggatcgttgtgggtgattatcgattatcatgccttatcaagcagtttagatctaagaatctatcagcctatatacttcagaaaggttttctcatacttctaggttgtgggaagagatactttatgaaacatgctgaggtggttattggctaaatggtactcaactgcaacaactaataatagcgtttaccttaggggcttgtcatcctagctgagttctttatcgcacatcgtttgagagcaaaacacaacaacaaggaggtgcaagcgctgccgatataagttctgacaaggcctacgtgcgagttttcctagagccaacacgatgactccgttcttttgtcttttgaaaaccgaacaactcagtgagattctagatattgtagtttcctctttaaagaggctaatcaacattgccaggaggctgttattctataagttgagcgaactcaagagtatagttgtttgttgtggacgtgctgcgattcatctgaagaagtgctaactgctcacatttctaacatagcaaatcgtagccttgatagttaatctcactccaatacgataatccagatccaaatatcttgttcactgcgttttcgtgcctgattctggcgcgtcacttgcatgcgcataggaaatagggagggggtgagtaatagattgaaccaaggccttaacggtttaactggtcatagcagttggtgccttccaaaaacgatcagtagttggggaacaataggtcactggtacttctggagttttgtgcatttactttcacttaagaagcttgcagtgatgaatctgctctgtttcatttgttcactaacgttgacaggcaattattagctaacacgtccattggcaagtgattttttccaagtcaatagattttttgcagtgtgagagtatagagctcgggatttgagggtataacgctatatttttacgtctatcgagtcactggctagagtctctgaacttcttttcattttttatgttgttggcgccttacgcaagatctaagttatcgttttagcaactcaagggtaattgttaaagaagctaccacttggaaattgtgtccagaacaaagcactcgtttagtctgtgaggctgtattttgattctatagtatgggtcacatcaatactaaccaacgcctcgttactatatctcctaactgcagtagagtaataaattttttgcgaacccaggtttcaagatgggagatggttactgtcacttttatcagcttctttaggcaaataagcagatacttagtttggtatatatactaatgaacctacaaaagaagaagagaaatggcccagataatataaagtttcggcaagcgttcaaacctagagttcacgcaatttcagttcctagcctagcacaaatgtctaagtaggtcaaagtaggtcaaatactgtgagaatgataaaattccacggctgaccgggttgatttagcttaactatcaggctgacattacgtgacttacgacaatcatgtgttgagtgggcaacatggaaacacgtgcagaatggacgagcatgaacgtcccaaggagaagacacgatcacgtttgcatgtttgcatgtttgttgggctctgcaaggaaagtagtaaccttacactatccaaggctggaaataatccattcagctgaccaagtagatgctgggactgggcactttgtaaataatggaccttaacgacttatttaaaaaaaagaggacccagaacccaaatctggcttcatgaataattactcgaggtaatagaatgcaaaaaacgatccgttcttggcaattcccgtttttcaacttatcgaaaagatcactaatcaagggtgcactgatgcaattttgtttgcatctggaagttaacaatagaagaatagcgcgtttatggtcgaaagcgtactgacctttgatttatttgactcaccatcactggaaatatcgtatccaacgcacacactattgttttttttttcattaatcgtctacgtcgcccctgtttggtacttttactcagccttaatttcggattcatcgctagtcagggcgcgcgtaagctgttgttctctatgtaaggatacgcgttgcgcatgcagtacaacgttctcgtcttatttttcagcaaatcagatagagatatagttcaaaatgtaaactacgcaggggtaaaagaaacaggttagtgatagtacagctatgatcctaacggattttactggttccattatctttagggccgagatctcatataaataccctgctaagaatcatgattgaccactttccgaaccgctttccaactttgttcttatactagatccgtcattcgttttaagactaaggtaatgttttcgacaaagtacattgctgttctattgtcagcatttgctgcggtagaggcaatcgctttgccttcttacgaacaagccttagaccacgccgccagaggtttggttcctcaggcttttgctgatgcccttaacccagctcttgaaaagagggccgatttcatgtgtcacgctgcttgtggtctggccatttatggtgcttgggaatgtggaccagaagcaggtccatttgacgaagagtgcttatgcgctgcagactcctcgttttcaacccagatcgacgcttgtctcgactgtggatggtgtatctacatgtcctactttggtaacctggcaggtccactggatgcttgtggactgccagttaccccaactggtacaacatgtattgagactgcttctacgctgactccaacccttggcccttttactgactacactccaactcatccaaacaatgttccaacttctaccgaggagccaaccgaggagcctagtgaagatgtaacatccaccgaagatgcaacatctactgaagactcaaccgaagaaccttcttccgaaccaacacccgattactcggatctaactcttggagaggctatcactgacattaaagttgtaagtgagaggacatcaaccgaatccggctactataacgactggtttgttgtttacatcacttttgacactactggacgtgacattgtccttccaccttacgctgttgttcaagttgccctaccagaagagattatcttcattgaacatcctcagtttagtgcttttagtgatccatccttgattaacttctacaccactggtggttctggagtgatgagctctaaagttgattggaatactaacgttttgaatttcactttttctaaccgtgctcaggtgattactgaagtgaagggtaccatttcagttaccatgagacttaaggataactttgtttccacgctgagtcctggagagtatgacttcaagttctacactggagtttcagaaattgtttcaaccttcgatttcttaccactagacagaactgcgccacagaaattgattctaggaggtgctgatgctgttaattgggttgttgatattccaggtgctccttaccctgaaatcaccaacatcaacgttggatctgttatcattgaaaacggatggagatacaagtacatttatgattgcgaaaaccttaagtatattattgccagtgactttgatgagtggaataacgtcacaactcctgttggagactatcttccgctaagcagtgccgattcatcaatagctgacctagaatgtggtcttggaggtgtatctttcagcttcactgaatcactaggtgaaaacgaagttctaagaatttttgttccatccgaagcaatggtgagcggtacgctatacatggagaatattttcactgttgatattaccaccggatccgattccgtcgaaataacaaaaagagaagagttttcgtacacatttgatgaaacttattatggtgataccagagctgaaactaatgttttcgaagtatttgctctggatgatcctcctgctagttctgagcccaccgaagaaccaacctctgaggagccaacttctgaagagccaacttccgaggagccaactgaagaatcaactgaagaaccaactgaagagccaacttccgaggagccaactgaagaatcaactgaagaaccaactgaagaaccaactgaagagccaacctctgaggagccaactgaagagccaacttccgaagagccaactgaagagccaacttccgaagagcccactgaggagccaacatctgaggagcctactgaggatgcaacctctactactgatgatgatgaaacctctaccgaaacctctactgaagaaccaagtgttgaacctactggttcttacaccgatctgacactcggtgaagcaattactaaagttgaagtcaccagtgagaggacaaatgaggcttccggatacacttctgactggttaattgtgtccttcaccttcagtactactggcagagatattatcttaccacctaactctgttgtacaggttgctattccagatgcacttcaatttattgctcatccacaatatgctgcattccttgagccatcgttgaaaaacttctacaccaagaatgaaaatttgatcatgcgtagtagattcaactatgataccaatgtcattgacttcacgtttgacaatcgaggccaagtcattaccagactagagggtgttgtttatttcaccatgaagttagaacaagatttcattgctacgttgagcccaggtgaatatgatttcgagttccacacttctgttgacacccacacttcaaccttcaacttcctcccattagttagatccgagccaattaaattgatagcaggtgcagcagatgaagtcgaatggtttattgatattccaggtgcctacaacgatttggcaaccatagatatcagttctgatatcgatactaatgctgattggcaaaattacttctatgattgctccaagctcaagtacaccattggaaaagagtttgatcaatggggaaactttacagctggatcagatggtaatcaatacagtaacaccaccaatggttacgttccaattactgattctactggctcaccggttgctgaagttcaatgtttgttggaaagcatctcgttaagtttcacaaaccctttggctgaagatgaggtcctgagagttgttcttcactcttccgcatttagaagtggttcattgtacatggccaacacggttaacgttgacatcacaactggtgcattagtgaaaagagaacttttctcttatgcgttggacgagacctactacgctgaaactagatctgaaagattggcattcgacgtatttgaacttgctgatcctgttgaggaaacttcagaggagccaacctctgaaccaacctctgagcctaccgaagagccaacttccgaaccaactgaggagcccaccgaagagccaacttccgaagagccaactgaagagccaactgaagagccaactgaagaaccaacttccgaagagccaactgaagagccaactgaagaaccaacttccgaagagcccactgaggagccaacatctgaggagccaacgtccgaaccaactgaggagcccaccgaagaaccaacctctgaggagccaacttccgaaccaactgaggagcccaccgaagaaccaacctctgaggagccaacttctgaagagccaacttccgaaccaacttctgaaccaactgaggagcccaccgaagagccaacttctgacgacttgtcaattaacccaactggtgtgccaactgaggaacctactgaagagccaacctccgagactaccgaggagccaacttctgatgacttgtcaattaacccaactggtgtcccaactgaggaacctactgaagagccaacctccgagactaccgaggagccaacttctgatgactcgacaatcgacccaactggtcagccaactgaggaaccaaccaccgatgatccatcaattgcacctactgctgtgccaacttccgaatcatcttcgggacaatcggtggttactcaaatcactacagccactcagactaccatcacttcagtctgtaacgtttgtgctgagacccctgtaacaatcacatacacagcaccagtcgtgactgacccagtttcttacactactgtcacttcagtttgccatgtatgtgcagagacaccaatcacagttaccttgactttgccatgtgaaactgaagaagttaaaaagacagacggtcctaagactgtcacttacaccgaagtgtgcaattcatgtgctgacaagcccatcacttatacctacactgcaccagagtccactgaaggcgttgagtgtaccacagttacttctgtttgcaatgtctgtgcagaaactccagtgactgttacttacacagctccaaaggatacttctgctcctaagacagtcacttatactgaagtttgcaactcatgtgctgacaagcctatcacttacacctacactgcaccagagtccactgaaggtgctaagagtactacagtcacatctgtttgccatgactgtgcagaaaccccagtaactgttacgtacaccgttccaaaggcttccacagtaccagtagagaatactaccgtgccttctaaacctaccaatcctggccagcaggacactacgataacaactcatgttactcaaaccacgtctttggtgacagcctccagtagttccactgcacctcctgcaattagcagcgcaggaccagagaatttggctgtgcgtttctctgctgctggattgtttgcaatgcttccaatgattttattggcattgtaaagtgataccatttctagcgcttttcttttaagtattgcatctactatgattgtagatagataatgcgatataacttttgtgaaattagtttaatatggagtcgaacaagatgtgagcttcagaaataattatactgaactaactcatctaaaattgagaagagagccgatttagtcacaatagtggcaataaatctgtaacttaaatgaggccggtttccctattcaggtctctgtaaatcttttgcctggtctccttgagcttttctgatgttagggtttttattgtatcgcgctcatctggatgtgagatgttttcatgaaccgaatatattcgaacaataccacagtatttggaatagatgttggaggtaccaatttaccctaacgttgatcaagtgtcatgctagttctagaatttgcaactttgtttcaaattttattacttggctttgccattaattagcaaaaccataaatattatcagacctttagtgttgaggtaccgtgccaatctgttacgttttagctatcacaacgccctaacaatagaacaaagtgagacaacttaaattatttcaaacagaacaggatagcggactggattatgttttacttgaagaattctttgcaggggaaacgataccgatcttcttggaacttccaactagtactagaaatcggaatttaccgaagtcttccataactaggtctggttaatcttgctcagaaagctaattagtctcataatggcaccaagtacaggactaactgcccttaaaaccctactttgtttagtggatcttgagcttattttcgctattcatgtacagtgtcacaagctttatgcgatataatgcagtgcgtaacatactgcatcacgtcaaactaattatatcagaaacaataaccactagttaccaccgtttattatcgatcacaaggtttagagtctgaatctgaatatgaaggtaaaaaaaagcctgaataaccatgcattacctaggagtaggaacaaaacgaagtgaaataaatggatagaagctgtttgcaaaagagattaatttgcctctggagtgatcactattaggttacagatccctccagagtgcagaagcttgtatgcggaaagggcactcataggctgttatctgaattgcaggaagaaccaaaaaacattcactgtacacgtttcttttgctccaatggcaggtttttttttccagctgagagggtgtacaatgcgagccaaattagccccagccattggagagttctttcttgacgagtactagctggccgatgttttcaatacgactcttaccaccataaccaataataaaaaagagattgcagcacctgagtttcgcgtatggtctcccactacactactcggtcaggctcttagcagcttaactacggttgatcggacgggaaacggtgctttctgctagatatggccgcaaccagcagaatataactgatattgtacataccgaaaataaacagcaaccgtaccaaactttcaatgttgaaacccatggccttttttttcttgctctgtagagaaacgtacaaacttagtattataaggtaaagtttcaacttgacaaatacactcgcctgtcattctcacatattagaacatgttggtccttttttttattttaactttcgtcaactcgtgacttaacactcattaagaaggaatatatatatattggctcaaagataatgatatattagtaagtaatggttttatctttttcaactacaatagcacagtaaaatactatattgagttcacctttttggggtccatttgttctacaccctgtcatatctctcgtgagtcctaagttgaaattgatgggcagctttttgtgaccatagagataaaatttgcttaaaatcatgcgcttgtgtctctgagtcatgacctagcccatctgtcgattgcaactttgtaccgtgaaagaatacgggcgtagtccaacttagtcagttgtcatatcctaaagttaacttagctgtcaagaattcagagcctgacatttctcagtccagcaactcctcacacgagtagtcgaaaaataaatgcaggggaagaatgtaccccaatctttttaactaaacacaggttcatccaccccgcaaaagtgaaatatagtaagaatattcacaaatcaccagataatcagccaatcccttgatatcgtagggcttttacgcaattcagtagaactgaatctgaaaacatgccattttttatgtttagagagaactaatgcccagataaacttgctagtctcaagtttcattgatccactttttgtctagacctagaaaaggtagcacaaagttgacccaatcaggtaaagaaagacatggccaaggtgacatcatggcgttatgtttgcttttttctttccttttagtgcgttaacgctttagccctacacgaagaattataacttctaatgcaatgacccttgtttccttagcttttcccaaatatggatttgcaaaacatgttctagttgctactagcttttttcaaccgatcagttgagtccatagctaggtctcagcacctactaaagaccccccgcagtgccctggaatgcgtgtctaacaaaatccattttgggacacatgttggcatctaaaaatgcaatgccgcataaatcaacaaccacgatgtcgcactgcagaaatgggtactaatgtggcctattatttttgattgctgcctgaaaacagactttttttgtaccagaagcggtgtattgatgcgcagatactcagcttgcttgatcacttggagaaattgaaaaatgtttcgccgacccgcaatgacagggagttttcacgtgttctacggatcttagctcgggcttgatgatcagaactttttgactagggctataagttgcaattctaagttaccatatattgttgcggtggcgatttgacgttgccgggtagattccgtacaatcttgatatctcaagccgtgttgagacatagaaacgcggtaggtcaataagctgcacaagcacgacgtaaacaggttttaaggtacactacagatgagacgtatttgggtattaagttaggttaacaatacaaattataaatgcgactgagaatagtgtccaaaaggggatcgctcactgaaataataatcaaatgcggtatcccatatcttgcagaatctccagtcctctcatgtattcctgcatctagccaactctaaccttaaggtttggtgacggcatgcaccgcgtctaagttttatcacgtattcagccactcctaaaattttttccagccacctaatccacctaatccaccattcatcgtgttaaagttgaaaagggtctattctgaaaaaaactcagaacaatatactgatctctttaagctaatgggcagctgccacatattgttgaatcgtatcactaagaacacgttactatagtagtactttattcacgctgcaaattcacgttcacgttctcctggtaccttggcataagaatttcagtttccctccacgtgcatcaagacttgcataaagaataatagctggtacagcaaagcttaggaattacgtcccaaactgtggattcaaacctaaacagagtgatgaaaagcagggccagaatgtaaacaaatgcagataagggtgtcgttctcatttggactataagaatagtggtttttcctgaagatttcttaaattttcaccaacagtcactcactcacttgatcatgaagttcgcaatttcaacacttcttattatcctacaggctgccgctgtttttgctgccttccctatatctgatatcacagttgtcagtgaaagaactgacgcatcgactgcctatctgtcggactggtttgttgtttcattcgtttttagcactgctggcagtgacgaaacaatcgctggtgacgctactattgaagtctctattcctaatgagctagagtttgttcaataccctgattccgttgacccatccgtttccgaattctttacaaccgctggtgttcaagttttgagtaccgcatttgattatgacagccatgttttgactttcactttctctgacccaggtcaagttattactgaccttgaaggagttgttttctttacactcaaactcagtgagcagttcaccgagtctgcttcccctggccaacacaccttcgacttcgaaacctctgatcagacctacagtccttctgtcgacttggtcgcacttgacagatctcagccaatcaagctgagcaacgctgtgaccggtggtgttgaatggtttgttgatattccaggtgcatttggagacatcaccaacattgacatcagcactgttcagaccccaggtacctttgactgttcggaggttaagtatgctgtcggaagcagcctgaacgaatttggtgactttaccccacaggatagaacaactttcttcagcaattcgtccagtggagaatggattccaattactcctgcttcaggtcttccagttgaaagctttgagtgtggtgatggtaccatctctttgagctttgccggtgaattagctgacgatgaagttcttagagtttctttcctatcaaacctggctgatgatgttcttgaagttcagaacgttgtgaatgttgacctcaccactgcagactcgcgtaagagagcattgacttcgttcgtccttgatgagccattttaccgtgctagcagaaccgacacagctgccttcgaagcttttgcagccgtaccagctgacggagatattacttctacttcaactgccattaccagtgttactgcaacagttacccacaccactgttacatccgtctgttacgtttgtgctgaaactcctgttaccgttacctacaccgctccagtcattactaacccaatttactataccactaaggttcacgtttgtaacgtctgtgctgaaacaccaattacctacactgttaccattccttgtgaaactgatgaatacgctccagctaagccaactggcactgagggtgagaagatcgtcaccgttattacaaaagaaggtggtgacaagtacaccaagacatacgaagaagtcacttacaccaagacttatcccaagggtggtcatgaggaccatattgtcactgtcaaaactaaagaaggtggtgaaaaggtcactaagacttacgaggaagtcacctataccaagggtcctgaaattgttactgttgttaccaaggagggtggggagaaagttaccactacttaccacgatgttcctgaggttgttactgttatcaccaaggaaggtggagagaaagttactactacttacccagctacttacccagctacctacacagaaggccacagtgctggagttccaacaagtgctagcacccctcctcaagctacttacactgtgagtgaggctcaagtcaacttgggttccaaatctgctgttggtctgttagcaatcgtcccaatgctcttcttggctatctaagcttcttttttgttcgttcttctaattattgcttcgtgtacactgaatgtattattttgattttatcatgactcgtaatcgatgggatgagtagcgtaattgccaggaattgtcagggactccggaatgtgcgcattttcaaatcgcattgtgaaatcaccagtctccaaaactaaatcaaaccagccaaattgccacaggcacgtaatccacataacactgtctattaccaagcgcatgagcgcgttgtcgtcccgcatggtgcagcttagagactggaatctgtaagatggaattccaattctttacccaaaatgaacaaagcaaagttttgtctatgcctttggtatattcttctactatggttcagtgcgtggtttttttgatccttctttggtatgtgagccacaatttagcacttggttcttatttttctaggaacataattgaggtattaattcccaaaacacgcgctcgaaattcgtttttcacaggagtgttgtacattgttaaactgcaggcatgctgtttcaaaaccagccaatcattaccatggttttagctgtaggtcctgcatgtattatgtatgtgatctcttggcccctgagtttgagcaggtgaatgaaatagtaaccctaaaccaacaagaactggctctttttggaaaacatacaagcactttgggctgtacattaagctgttctcttgaaacctcaaccaaattggagccacctagactaactcagatgtgcagggcaataaaattgctcagccaatccagattattgacctacgtaagctcatatctgtaacactataccgtcttaactctgcgaccgcaatgttttggaatgctcccatcacttgagaaagtaatcaattaaacacgctacataaagatgctagtctttatttgcaagccaagcaaaatagtgctgaaatttggccttggtgtctactcgtttttcctcaacttgttcctcagatacaactacatctgatgaagccaaaaagcggtgttggtcgttgtaagcttcaacgactaacttactgtgagtttctccctctattttaaacttcgtttcgaacccttgacgagggactttgcccaacaactgacgttccgaaactttatcgattgaatagaatttccagtaggaggtctcagtatccccattccaactcacataagcgatggtatctccctcaggagatatatcggagtgtaaggcaattgcttccgctggatatccatgccagtcaaacttgaaagctctgtagttttcaacatgtttacccaattcgccagtaccaaaataggcatggaaaaccggagttccatcggccgtgtattcggtaacggcaccttcagaaccccaattgacaagcacattaccatttgaaagaacttgagttgatccttgagacttggacagtagattgtgtcccctaggcggatcgtactgtgccagtaatgttgcctcgttagtttctgtgttaacttcaacaatttttccactggattggtcagagtaatgaacctcatgacctcgatgatcctcagttccgtgagcggaattgtcataaaaggagaacacttgcttggatccatcatccgaagtagacaagaagcgggcatggtgctggaaagaaaaggttagtggttttcctttcaccttgaaatttgaagatgtttttccaggtagtcccccaagcttccagatgatagatccgtcggttccattgatcttgtagatggctgcagcatttctagcagatattaggtagtctccattttcatccttatcaactgaattgatgtggaagtaatcccaggcatcacttgaattgtatccacttcctgcttgccatgggttgataggaagcaccgaatcgtgaggtgatacatggtccaaagaagaccactcaaaaagaacctttctggttctcaggtccagttcttgaaacttggcatcgacgatccattgttgatctgctgaagcaccgtagtcagagagatcctttggaactgggtggtatatttgaatcaagccggtcttctcatccttgacgtgaaattcatgtttgtcactgatcctatggttaccagcacgcaattctttaatagtctcatacctgttgttcaggatagtaatgtgaccatggccgtggccataacctgggttgtgtgtgccttcaaaagcgaagagcacgttttcgccgttgattcgggaggcctgaaagttagcctgccaattggcaaaataagaaaaccctgaccagactagttctcctttgtctgtgaatatataagcaccaggttgtctaggtccatgggtgttatcttggtcgtagccagaaaatggggctgcgaaaagaaaacctggggaaaccttatcatctgtcgcggggatggtaatgttcaactcaattggtgacaaatcgggtctggttctatattgccagtcggcatacgaggtagcaattgtggaagctactgaaataagagtaaggaacttcatgattgatgttcagattccaagtcagttagtctccttttatggtaagggaagccacacccattagctatttgtcgggtcggatgacagattgtgggacccgaaggttacgtaataattagcgccatacttttccgagaaagtatcgtcatcttgcaggagtgcttatcgtgaactaaacttttatagaccgttgatctcagccgatggcacaaccgtcggctaaggctttatgaaggatatcatcgggaagatcatgaggtttgaaactgctaacaacagtctacttaaacatgtacgatgcaggagaaaagattagtattgaacaagaatggcttcaaagactgaaaaaatccgctacagcgttaacaataacagcgtggattctgcctcttccattgaagagcccaatgacaacccttttgctgaccctcaaatagctgcttattggaggaaaatctatgaagatgtcggatacgaaaacttacatcgatttgatcctgattttacctggaataaggaagaagagaagaaacttgtccgaagactcgatctgaaagtgttttcatggacgtttgtgatgttttgtgctttagacctggttcgtcgtaatattaacagagcagtgtcagacaaccttgtgtccggtgatattcccggtttagacacaaatggatacaatttaggccagactatatacctgatctcatttttgtgcgccgagcttccattgaatcttctctctaagaagtttggaccaaatgtggtagtcagtgctgagtgcttagtgtggtcgattatctgtatttcccaaagtgcaatgagaactcgtgcacagtttcttgctctccgagctttgttggggtttgcccaaggaggattcatccccgatcaaattctttacctttcttattattatacaaatacagagcttccattgagattggctattttctggactgctattccactcttccagattttgggatctcttctggcctcaggattgttggaaatgagaggaattcatggcaaaactgggtggcaatggctattcattatagagggtcttatgagtcttggtgttgccattcctagtttctacgtgatgagaagcgggcctactcagacgaagaacattctattcaaaagtaggcccgcttggtttaatgaacatgaagagaagatcctcgtgaatcgactgctaagagatgaccccgcaaaaggcgatatgaataacagacaggctcttaatattcgccaaatattgcggactgtcctttcagaatatgatttttggccactgtatattcaagggctcatggcctttatacctttccaaccagtcacagcttacatgtccttgatattgagatccatgggttactctgtgttcctgtccaatgtattagctattccgggtcagttttggtttttaataaaccttcctttggtggtgtacttcagtcacaaagtgaaggagaaatcaatctgtgtgggaatagctaattattttatctttccgttcgttgtggctttggttgcctacccagcaacgggaagtgattgggttaaatattttctcttaactggtattgttgcccttccgtacacacacgccatattggccagttgggtttcccatatatccaacaatgtggcttccagaagtgtggctactcctctgtacaacatgatgtatcaagtcggttctatcgctgcctccaacatatacagagaaagtgataaaccttactacatcagaggaaacaagatcattcttggtatcactgttttcaattgtgtatttccttttttcaccaaggcgtattatatcatgaggaacaagcaaaaggagaagaagtggaatagtatgaccaaggaagagcaaatcgagtacactaccaacaccaccgactctggtgtgaagagacttgatttcagatttgttcactgatttgattagttaatttcgtgtatgttagtatgttttatttatggttgcttggttaccattctgactgtaattgcaaatcggggcccacatcgaatagctctcgccatcccaaaacaatattgttgatatctggagttagaacattatcttccgttgaaaccaaattttggaaatgctgagctgattgattatcttgctcggagagtgatgatgtagtagacggattatcatttgcctcctctgccactattgtggtgccgtagtcaatcatcaaattcctaaacattattccttgctcatcggtagaaaaagactttaatgaggtttgaagatctaaggtccataaaaaccatgaggatgttataggccaaacagaactccacttcttgagtaactcaatgtttgttttcacatatgttttcacttcgcttttcaaagactgataggctgtcttattttgaacttcgtagttcttttttaaaagactgagaggagaggtgagaaagtagaggctagttgcagcattagtaaacagctcaaatcctgtaaacggtgctatgaccatcatattaatggactcagccgccgaaatcagtttggtgctacgctccacactttggaggaactttctggtagcgttgtaccattgatttgccggaagtgtttctggattaatgaagaaatactctcgatgtaggaatatccggctaagatataacagtgcatgcatatagacaaacgacatcagagtaccttcagaagcctgattctggaaattgaccgtgttattatagagatgcacgggtattgtggactccaagacatctagcttcttatcggtttcggagaatttggagctggatcctgaacccgtggtcggcaaattgttggagcgtggaccgctctcaccaacccatctcgctaaactagcccacacttcgaataaaaaaatggtgaaacaatatgtgctaacattggtcaaacgattttccacgcctgttggagatgaaccatgtgactcgaataaaattgattgaaattcctcaaaggtcagccttggggaactgagttttcctaggacaaactcagcttcaagagctggcatttcgatatggatatcttcaatctttatacagcttgacctgtttcggccacttgaaatgcaacgatcctgcaaataaacagcccataaggtccttcttttaacctccgagataagagggtttgtttcattatagcacaaagaagttgaatcattgaggcccaaaacgaatgccatacgacatgctaatcccacatagataaaagctctggcaacgttgcgctcaccccaatcatgactactgagcatggttagtgcttgaattctctgaatactgggccggtcaaacaatggttgtagaagttttcttgcatggtatgcaaagtactctgaagcatgtacgggagatcggaaaacaccagaaccgttgctggaggacggagtaaacaggtctgggtcctgagatagatcaaatgcaccataagaagaaaccatgctcggatggaatcgagcacttagtgcaaatattgacaacaaaaccaccggatcaggtcgatgtagtagatgatagggagccggagactccgagttgtagtaatcattgatgtaagttgaagggttaaattctgacgatttgatgaatgccaacagggatggtcgatgcagaaacagaaagacaccctgatattgatgactgaaaaaaagctctataacttccaggaccacatccttttctggaatcacgacttcatgcgaaggaacaattggcttcgaaactttataatcactctgtttggcccaattgtccttattgacatgtttccgtagatgagattgcgttggggtgtaactacattcgtgacttagtcgactacacctgtggcatggctctttggtagacccgttgttgatacacttaagtttcttgcttcgacatatatcgcaagccaaaaaggtacgtttcagctttttttcagttttcattagatgtttgcataatataataagtccgacggttcagctgatatacgttagaagtgtggctttgcggctctttttaaaacgtaatcatttcttggtgcaatttaggtcagtccccgacaaagtatgtaccgtaatgggaaattaaaatcgccgataccagatcgaagatgcaggcagttaacaggccagccaacgcctctatgatattgcgacttgtacagtgaagactatgatgctgactgtagtttcgagtatcttgtaccgattcacgtgattctgttttcttcctctttcgccttgatatcgagtggagagcagctttagaagcgatagcgccaatagttgcgccaagcgtaatgaataggttggcttttaatacggcaaaacatatctaacaaactggatggttgcaaattagtgttgtgcagttcccatctagtcttacgtaatataataatatacgtaagaaagaagaatcccttgattaagacatttgctctgatttcagttcatacaaggattggcagaatcaaagtatgattaacttgacctaataagctcaaaagttctataattagacgtatgtagtcatttcaaccgaattcttaacagtttcagctatgagaaaatgctgacagtttagttggagctcccttttctcgaagtgcaggcatcatcgcccgccctcatgtacttgcaaggtggaattgagttctattcaaacgtcccaccttgactcaacgctcaaactgctttgggccatttttcttttttcctggtttcgaacttaaatgacctctcgaagcaagtatttttactccatattttaagcttacaaccttctgaaaaggtattggtcttcatctctcctcagggctcaactttcgctggtctgttatgcatggagaggataaaaccgcattcaaaaatgcgacaaaagtatatattaagtccccatttccagtttacttttcttccctgtgctatggcgttcgaatttgaaggtgaaggtatcgcagcatctattttcctggcactgtatgtcatttatacgctgttcacaatcggaatcatatggcataaagggacactcagaaccatttactctggattattgtttttcggtttgattcgaatgggagcacagttatgtggaatagcttttgcttcattgggatatgaacattggcaatggctagttgcatatctggttttaggagctgaagggtactttgttctgattctcaccagcttctacatggtgtctcatgcacatatagctgccagaaaggaatcatggctgaaaagtagactagttgacacttcaaattgggggtttctcaaaaaactcaatattaacgggatgaggatcttctattatttggcgattgttgccaatgttctagtcatcgttggaggcactatgttgaccggtctggatgctgacgagtatgacgataatgtatcaagaattaatacgagcaaaggcctccgaggcacgggacaagcattgttcttgatattcacactagttgttgcgggtctggctgcttacaccgtaattcatgacaatatccggtcgtatttgttgacttctgttttcatggctaccccatttttgtttgtgagaggtatttatgggttgttatcctgtttcatccaacagatgaactatttttccatggcaaattataccgcaacaggtatgtcggttcactttgtggccactgaatacgtactggccaccacaatggagttcattgctgcatgtattttcatgtccacgtactacgtggtgtatataccaaagaaagctttaaatgaggatgaaaccagtttgatagaagttggtggaaagcatgaagacaaacctaatgaataggactgacactctaaatttgagccgcacttgcatatttaattcttctttacaggtaatttaatctttcaaaaagtcaagtgtttatctttgatcaggcatactgacattactcgttcttcatcaacttttttcgtctcagtatggcttttgataattaaatagctgaaatggaaaaagttttagtattctgtctcctacctgatcgaatggtgactcactggaagcgctagcgagtagtagagactcaccatttggaggactaatccttttgacgtgattcaaggtgcagcgataacttagaaagctgaatgctgtttcaagcaagaatatactactgtatctaactctgttgtcttttgtcgactgttgaaaaaaaaggattaaccttctcttagcggtcaacgccgtgccataattgatgtaccatcggggcatcttgttttgtgtagcactttatgattgtgaaaaatcgaattctttgagataataaagaaaagtagtcaccctgattctctgtaaggacagtgagaaataaactggttagcagtaaagactcggcagtggctggcctcctttccatcatggtatgcaaagacagctaagtagcataatcataaaatgcctagcaaatccacataaaaaactctagaaaagcaaacgcaaatttgttgttagcaaagaacgatttcaaatatctcaaatgtttcaaatacacttgtcataactaaaatgtcaaacgcagctattttgaatcagccttccatatgaaatgctggatgagtgcctctgatcgaagatcaagccattacatcgtgaataaatgggtaatcaaaatactaatacagaggatgaaacttctattccatatatggcgtagcaaaacattaccgaaagcctgtcactacccattcgccggaaattttggtatacacatcgttggtagctaccttctttttggttgtttgaaaagccgaaaaaggcgacctcccgtgacgttaaagctgatgtggcggagacgtgcggtgcagaaagttacacatcttgtcccgctaaagttatcaagctatcagatgaaaccatctgagcttattttttatgccatccaaactgatcaaaagagccttggttgcaaatcaaatcagatttctggagaattgactatctaagatctctataaagtgtagcagactttggggacctagaatgtttctgcacggaaaaggggaacgcacacatcaagctatcctaaatccagccgctcactccttattgtatggctcagaattgacacagtgagcacgaacgcacactgtctgaattaaaaaaaggaacgatgtaactgtggcggctgttgcggtgtctgccacaaaacgtttttcaaaggttaataagcgtttattatggaactacaataggaattatcaatcaccgcacttcagcaatatgcacctccgggttgccgactgatctagaaacctcagttggtgtatcatgactgagtaggctcgtaaataatgactaaatgaagttgattaaaaccagaaaaagaagagttgaagttcagacaatacctggacatgcagcccactgttaacattcagtctgtgcctctgttgtataagcttcgcatttatccgttaacttggcattttgctcgataagatctttttcatcacctgtcgagataatttattggtgccttgaacaaaaacttcataggagactcacgaatctactgtggagaatattcgtcaatatgcatcattttactatcttcgtagggctgtgttagcctttaataagctaggggttaaattctgcaaatcctgattgcttgtttggagatgccatatcttgaaatcccacgacactttgaaaaaggcccggcctcagagtccatccctaccataatccacaagtgtggcatcacttttgtacaatgacatattgcaagtagttttcttttcatacattcgcacggccactatgcaattccaaacgccacgactccgatcatcgagtctaatcgtgcagattcgtccatgacgaataggtaattgaaaatttgcagcaatgtcacttgatcgctcccaaaagatgctggtagtcaacagccccatgactccttccgtattgtataaatatgggagcccttgggccaagacttcaccaaccataaaatgagtgacgctgaaactacggtgcatcttcttggcaaatctgtcggatatggggtgctgattggggttggagctgcatttgctctagcagtggttatagccacccgattgatagcccgctatctcaatgaaaacaataattctactgaaactttcatggtttcaaatagaaccgttggtattggtttgactacttctgccattttctcctcgtggttttgggccaccgaactgttatggaccgtcaccatgacccaattctatggtgtatctgttggattttattactactggggactgatagtgccagtttccattatgggtgttctgggtatcgaagccaaacgaaaagtacctaaaggtcacacatgtctggaagtagttgagctcagatacggcaaagctgcccacatcttgtacatgtgtttttgcctagctaacaacttgttgtcatgcgctgctatgattctgggtgccgcaggtgctatatccattatcgcagataatctgagcattgtggcaagctccttgctaattccatttggtgtcctatgttataccttcagtggaggtctgagagcaactttccttggagattggggtcacagtgttatagctattattgtgctactctatgttaacactgctgctttggttaagattggctcaatagataagctttacgagctaattttcactggacccaacgagggaactattgaaggtaattatgatggctccttaatgaccttcagatcccaaggtgcagttttctttggaatcattcacttattaggtgatatgggtcttactgttttagattcttcgttttatcagaaagcattcagtgccaacttaaagtctggagttccttcgtacatgatcgggggagtctgtattatggctattacctggccattaggtaccatcattggtatggcaacaaccttcttggaaaatgatccatcgttccctacatatccaagaaaaatgactacatttgagatagaaagtggctttggacttccatacactttgaaggctttgcttggcgatggagcatgtggagcaatattgttggtaatttatctggcatgcacatcgacagtcagcgctcagatgatttcggtgagcagtattttgtcctttgatgtttacaagacctacatcaatcctcaagcaaaaaacaagcagatgattagagcttcacacataaccgttgtgtttttctccttctttgcagctggttttgccattatgttgcactatgttggagccaatatgacatgggttgggtacttttatccaatcctgatctgcaatcctgtttgtccaatgatcttgttattcacttgggacagacagacaaagtttgcctttatcgcttctccaatcattggaattggagcttccgttggtgtatggctaggaactgcctaccattattatggagaaatcactatggaaaccacatcccgacagcttccctgtctttgggctggtttaactgccctcttcctgccattggtattgacagtcactttcagtctgtttcagaaagaacattttgactggaatgttttcaagaaggctgaacttattgagatggaaggcagtgaagcttcatctccctcagaagtcgatgttgtatatgaaagtggatctgtctcatctccaactgaagactcagaaaagagatccgtggacaagtctgagaatgttcaacttcaagaaactgagcttggagtgtcaagtggtgacgagtacgacgaagaagagcaaaaattgatcaagcgttacatcaagatagcatacgcttggtgtatacttgtggttctcgttacttcggtgttgttcccaatgtcactgtaccgtaactggatcatatctttgagtttctttagaggatatactggattgtccatgttctggttatacggagtcttcttagttatcgcagtctatcctctttatgatgggcgacattcgctaggccgaattggtcagggtttgtggaaagacttcaaaaggatcttcaaatctaaacgatgatttaaggctacaagagtgtaacagtcaaatatgtatttagtatgccagtaatatgacattagcttttgtaccgagagcaacaatgctctgaaatttgttcttgaatagattaaactgatagaatagcactgttaccactaacctctatatatgaacgttcttgtatctgtgctcccgattcattagatatgaacgctttgaaacacgctttttggagtagctttaggataaacctaattgtgactcccaaagcaattcgcatagataaccccagttcgagaaaataaattgcggagaaacttttcttctttctgcagtttcaatgtgagatttagtgatgacctaggcgattaactttaatttgcttttgcttgcgctcttgatatagtacgaaagcttggctctggcggggtcaaaaggtgaacatgactgacccatttgcaatgataaaagagatacctttcactgtagcttcttggggagaataactacgatatgtcgctactaggtagagcaagatcgttgaactaccaagggaaactatatgacaagtttccaacgatttacaacattcatgtcatagcaataacagcaactgtttctggtctcatgtttggttttgatatctcttcggtatcttcttttgtgagccaggagcattacagaaactactttaatcggccagacagtttgacacaaggtggaataactgctagtatggccggtggatcttttgtaggttcgttagtttcttccgattttcaggacatatttggtagaagggtcgctctccatgtgtgcagtgcattatggatcaccggagctattattcaaagtgcttcgcaaaatcaaggtatgttgattgcaggaagatttatttctggtcttggtatcggattcgggtcagcttctgctccagtatactgttctgaagtttcacctgcaaaaattaggggcttgattggaggcctttttcaactttcggtcaccgtgggtatcatggtaatgttctacattggatatggatgtcacttcatcgacggtgttgcatcattcagactggcttggggtctgcagatgattccaggttttattctactggtgggcgtcttctttattccagaatcaccaagatggctagcgaaccatgaacgctgggatgacgcggttgaaattattgccaatgtcgtggctgacggtgatagggaagaccctgatgtccatttgcaattggatgaacttcaggaacaagtgttgatcgataaagatgcagccaattttggctatgcagatctattcaaaaaagattgtagaaaacgtaccttcattggtgtatctgcccaaatatggcaacagctttgtggtatgaatgtgatgatgtattatattgtgtacatctttgagatggctggatattcaggaaacgtgaatctggtctcgtcttctattcaatatgttttgaatgttgttatgaccataccggctttatttttgatggaccgtgttggtagaagacctctgctcataggtggtggaattttcatgtttatttggttgtttggagttgcaggcttattggctacttactctgagccaattgaaaattttggtggtgacgacactgttcgaatacttatccctgacgaacacaaggcggcagctaggggggtcattgcttgttcgtacctatttgtttgctcgtttgcgccaacatggggtatctgtatttgggtttatgtatcagagattttcaataacagacagagagctaagggagctgcactggctacttcggcaaattggattttcaactttgctctagctatgttcgtaccaagtgcttttcggaatattacctggagaacgtacattatcttcggcgtgttttcggtttgcttgactgtccatgtcattgtgcaatttccagaaaccagagggaagaccttggaagagattgataagatgttcaaagacaatattcctgcatggagaacaagttcctatgtccctgaaatgccgatcgttcacaaagaaaagattggatcgacagagcatatagaaaatgcttccaacttgtctgagaagccgattatggttcacgaggaggagtctgtttgagagcaacgtaacgcagggtcgctttgcgcaacctctttcgtctgatgaataatgtttattgagtattattggaggaaatgtagcctttatgagctgttatttaacgggaagctagagcaggccaagttcttctttctttgcaatactttcgtaaaagtttttgctatgccatatttcttgctagccaaaatctatgtgcatgtaatgtactcttgtttcttgaacaaagtcaacatgcgaaataaaagttgcattcttgtaggaatgtcttgatgcacttcgagagaactcacggaagaaaagtgtgtttcatactttttgaaatggtaaaagcataattaagcttttcaaatagctatgcggctgatcgaatctgtactgtttactgtttgaattatccgaatactgcacgcatcacatgatttgttaacccaccgcctttttgttgtaacctttccctacttcggtcttcaacggctctgttgaatattgctactcccagcccctacacaggcacttttttaccctccctggtttgaaagatctagtagatatttcaagaggaagtagcatctacaagtgtaatccctaatataagttcgatacattcagtccatatctcgaggtttgttgtagccatacatttccaagaattttgtttctaagagcactcactatgcattaaaaaccagaatatgtgtgaaccagatgatttagcaacagctccttacgaattaaattagcaagcgaccaacttaacgtgaccaaggaatgcaatcttgattccctctcagctcctttttaaaggagtccacaagagcggtgagtttcccgagtaatctcaacagaacctgacgcagaaacaaagaacagtttgctcccccaggtgtctccgaggtaaaagttttagttagctccgtcctaataatcatatctattgtcatagctactttcattttgaaatactgatctcattcatcaattgattatacgacttaatagattaggacacaaacaatcaacaattccgtgaatcatatggtgaagccttcctgaagttacaccttcttttcctcatcgtaatactctatcggttcttccaccacttcccaaacttccccactcgcagctcctccagtgacatcaaagttctccacttcagcatactcttcataccagcctttcttgaacaaatccttcttgatctcatacggtacaccaggaagtgggtgtatatagcataacaaaacatagatgaaaaccgatactccaaatcctgcaaaaaagttgaaatcgtaaacatacatggcaccttggggcacggagcctgctccggtagcaccaacaaatccgacaatgttcggaagaataccgcagatgtaagcaacgaaagctctatagttaataccatgccaataagtataagcggaagtcttttcggcgttatacaaatcattcaagactaaccatcctcttctcacaatatagtagtcagcaaaaagcacgccgaatatagcggacaaaaacactgaataagcagagaggtatgttgtaaatttgttcgaggaagaaagcaattcccatggacatatacatagaccaactgcagcacaaatatatccaccacgacgaatggtgatgtacctgggaagcaaagcagtagcgtccgtaccagcactcaaagaattggcggaaatattggttcccaattgcgccaaagcaaaagcaaatgaaatgaagaatacaccagctctgttacctgaggtgtagttgtccaaaaatcttcccaaaacatcaataggtgaccaataggtctcaccgtaaatgatagttgaagcagatgaaaccaagatgccgatcagtgaagtaatggaaaaacaaagggggatggaaaacaactgggcccatttagcagatgctttggttttggaaaacctggaaaaatctggtgcattaacaatcaatgtagcaaaattagcaagagagttcattactgaacgaataaatgcccacccaaactctgaccccgagatagtcgacggctgcttaacaacaggtccaataccatcagctttcttaatggaccagatcaaaaaggcaataccagccactggaacgacataagacttaactgtaaacaaatgacgtactgtgtgaggggccaaccaaataaatggaagagagaataaccaaaacagaaagaaggacaaaaattcaaacgttgtaacgtttggtgaagaaatcccatcagggattcgtgtattcaagtcattaccaaatatggagcgcagcattaaagccattgtggttccgccaatataaccttgcacaccgtaccaaacacaggccattactaccctgttaaagacgggccaaatggatccgaaaacaccaaaagaactcctacagcttacaggaaaggagatatgatagtaaataccaacacgagcactgacggtgacaaatataccagtgagtgagtaccccagccagacagataaccaacatgtccaccaactcaaacctgcctgaataccggtggctgcaatctgccatgtgttgatattgaaagagtcagaaatccaaaagaacacataattgaaccaactccatagtcttctgcgacgctccaccggtctcaagtcaaaattgaagaggaatgattgcgatgcagatagttctttttcttcttgaacaaccagtttgtctagaagctttccaattggtgatctgcctgaagtgttctgctcggccgacaatgatccaaggggacttgagctgttcaagctcccaggagccgaaacagtgttagtaacagcaccaggagatttggaccgttgtgtgagtttgtctctgagagccatcttcgatcgcaaataaaaatgaaaagaagtctggtaaaagtagaaatacgactcttcttatgtactgtgaaattttgagcttatctatcagccgtttttgaaaagtagtacctttaccaataatatttatcggattaagtggcatttgatagtgtgatgattgataactgataatgcttgtgacagtggagtgggattctatcaccacttaagggaggcgtaggcgctgaactttcaataaaactctttgacggatttcaaaaggacagggacatcagaagtctgattattgtccttagcttctcgttcgaagtaaattgcagaagagtgaaaatagctgcatacaattaagaaagtaactagcccaccaacctgtcataaactctgtcagaagagttgctttgttattgtcattagcagggtatcaagagttaatcaagctcaattcttccactttctccacgcgatcccacaattattatatttcgccgattgataccgacggtaaacaatcgagcatcaaatttcgagaaatgccaatgtagagagattgtagattagaaagtcatcacttgcttggggaataagtttctgttgatacgttcattgtcccgccttttttcgtctctttgacaatgtttagcatttaatgcgatgatactgagggtttcaactcgttctccgagtgaaatatgagcaattctagacacactgacaataatcataatacactttcgtgtcccccagtttcaagtagaaattcgtgagtctagttagtatggtgtcttccttaaagtcgtccatccatatgcttcagggtaacatagattggctgaaagatataaagatggacttatagtgcacatctttaacaaaacgtttgtgttgcacatcagaacaattttttcggagtttaataaagcatgtcggtgaactcaaagactatcacaaacagtgtgctcaaatggcagctatctggcaattcggacacttttcacactacaaaggttaatgattaaccttatcagatatgtttgtagatcaaatctcttgaaccggttgtactagtctttggctgcaccaggtgttctgaaaattgtatgccagatgcagagaagttggacttgataggatcaccaaattaccacttctgttcatcacatttttttcggtgctctttcaatgcattcaaaactctcatcagaaagtcatctcctgaagttattctcatctacagatactcagtaccccactacaattatcagatggagattgtagataattttcaaaaaaaataaagccatttaagaatggtgtgaagcagtaaaacaccacaagatgcgccgttcagaacctcgtaaataacgcttagaaaattgaaggattctccaaccgtattactggattcaaggagtggaagagctccaatcagcatcagtttcttgaatgctcttgaaacaactacgtcatgcaaagtatgattccattgacgtcattatctttttacctttggatgtttagcaggtcatttgaatagttgaagagtaaatgttgtgatttcaatggccatcatcttagataaataactttccttccaatgaactgatagttgcccaaaaaaaccaatttgaggagaactgagtgagtttcttgcagtctcaaatcaaacttcatttgagaggaaaacaagtggcttgaaaaatggctagactgtaaccagaccaaacctcattggttcttgatcttctttcgtttcaagtatgtgtatacacactccgcaagtagggctgcgtataccacatgggaggcttgcagacggttaaagtggtctgtatgtttcttttctaaaatagttcattatttgcgatacctctatcaaaattctccagatgtggttaaaaagaacctatctttcgactttttttaaaagaaaaggcactcttgatcaccaatcttaagtaaggctgcactttgccctgtcaaactaacctcgaataatgctcgccccgaaagtagtgtttcgcaaaaaaaagtgcgaccatatataagcttttccttaaccactcgcttgttgatgttgagcatccttgccaatttactgttgtggtcaatattgggatgcttgggaagaatcgctttgatagagctcaccaattatccacactcatacattaacacaggaatcaatataggcacctgcctctgggtcaattttgcagcttgcttgattataagcgctattaaccgcaatagaataccgaacaagaatgacaatagcaaaggccctttgtatatcggtttaactgtggggttttgtggcactctgagtaccttttcaagcctcatcatggaagcaagccttaaggccttcgatatatccgatggcacacatgatatgagatataagaatagcgcatatggaataatggaatggttaagtgttattttggtccaatttggagtgtcttcgttaggcttcctgataggccaaactataaatattcaggaatatttgggatatgttacaaagtacaggacacctgaaaatgatcgttatttcaggtatgcagtgattattgggagcatactgcttctcttgttgattctcttcttagcaattttcctcccagattccaactttttcaggcactgggcaacatcaatttgttttgcgccggtcggttgcttcctaaggtatttcttaagccagcagttgaatggcaccttaaagcgtacgggtatatttctgggaacactcatatgcaacctagtggcagtactggtcgaatccatatgttttttgctacttagaatctctcttatcacaaggaaaactgatataactgtacttaatagtattattgttggtttttgtgggacattgagtaccacatcaacacttatggtggaattggcatctctcacacctgttcatagatacaagtatttcactgcttctgtttttctcagttttttattcccggtactaataataggagtttacaattggacgagagggttgtcaccagattgaatagaaaaagcaggttgttgctgaaaactttcgacttttaatggacgtttcccgcaatttactgacctgttgcggtcaacgctcgcttcggtgttcaaattcatcaagccttgataacggaggcaactaagattacaaggaaatgtcgcagaagtatatccattaccggggcaatccgaaaagacaaacaggctagctttttgcactagtagttcactacgtgttagtcttttttcagctgtgtcgtcattcggtttgtcactttcagagtttctgctatcgttatgctaaggaagaatttttcttgcgatggaaaatgtcgaaagtcttatgagctatacttagtggagaaagacaattgataaggctggtaggaattcctggcacgacccccgatattcctggttacaatttgagcggatcatttgttcagctacatagttggcgtcaacattacatattgactcatattatggtatgttgggcctcgttagtatcggtcactcccatagcaaggtgtcaagacagtccattaaataccaatttaacataatgtgggcacctagcaatttttgaaaatcgttagcttacttttactattgagttggaggaatctaccctagtattggaatttacccagtaggaacttcgcagatccgaatagatgttctacattgaacaaaaaaatgataggctctagagtcagttttgtttttatccggcttacacaaattgattatacgaccaaaaagttgaggcagctttaaactttgcagatagaactattaactgtataggttgtctaattagctgaaagcagaacaggtgtattatgaattggttttggaaaagatttggatgggtttaaaattataatttctttttctgttgagtcgatttaccatcaatgtcgtgttcaatgaattatccactgcttagaacaaaattcaaaatgaaatggcgtactctactttctgccatgatacagtatttgtaagccaacctgcattcactttattggttatgttcttctcagttggccaaaacgttttactgatgatttttttcctggccttcaacgacggttgggtagtgcaatttctcttagcaatctaagtaccccttttcccacaactgtgaacaaaatgaagctctccaaagtaacctaattctcagcattaattaattttgccgctttattcagtttcagaactttggtgaaatttaatatatggtacgcacggatcaattcatgcacaaaatcatggtacatgcagtttaatgcataagacgcgcaaagtttatttcatgtttgacaaaattttggttctcatacttgcataacgcttctattgttctttacgcgatgcgtgatcgcgtcctatcgagatctaatttctattaatccgcccagtttgttaactagtatctctcaaccagcaaatgatactagtagtgtgatatacaaagggtttatgatatgtcaaccagttgaagtttgtgtaactccccaaaataaaggacgggaatctaaaggactcaggcaaattatctcggtcaaaattaacgtgtcaacagaagcagaagcgtcgaagcgatttgtaacaaataccacaagttcttacgagaaaattcatgttgttatacgtcgactgaaggactgctaatatatgcaagagtcgaaatactgaacaattgagaacccatgcaccttgagccaaggacggagagcgttccttcaatgcaagcatatttttggcgcatactttacaatcttaatggactatccattattggagctgctactctatgaaataaataattgaagacttagggacaaaaataacattattggccactacattgacttaagggtaccttgagttttatttgagagttattatgaatggccgcagtagtcttattgtatgtcgatacttgaatagcgatttttctgatgctaactaccataggcgatacgtccgatttgataaatgtgttccgacgtcacattctattgaatttctttgaatgactataagaatggaacgtgaaagactaacggtggtagattgtggctgctgcagcagttattgtatcattttgcctttttggatcacacggcagagttttggactatgatccatactgccgactgaaagggcttgacccagtgaaggctccttttaataaactagtgccttatttcaagtcctaaagctactcctttcattgtatatagtatgagaacttgtggaccgagggttggaaagttacatccgtacgatacgaggcaagaaattttgcattttgggactcggagttagtattcgtgcaatgtcatcttaccggttacctatgttacgcaattagattcttctctgcattccatgtggcatgtttagtacaagaaaagcgtttacaagcgcagcttttcatagtcacagcttaaagtgcagattatgtaaccatgaaagtgagtggaatgagtatttttcttttgcgagctttaacaggtaaactttcaggccttgaccacccgataatacgaaaatcattcgatcatgtagtagaactacaagtcagaacagcgcttgcaagaacgaaagagttagcaagatttttgaattattgccagagaaaaacgactcgacgtcattgcccaattttgtggcgtcttctcatttttagtgtggctgttcaatttgttagcatgcataaaactgttgtaccacaaccgaggtagtttctgggtccatgatttcaatggacttctagagggaataatagctgaagttatccagatagaccggctacgtatcctcatctcatatctattcttaaatgtgtgccaaatcagtagcgattataggtggtggtcccagtgggatagctgcagctaaggcgctttctgaagaaaatgcgtttgatagaatagttatttttgaacagcaggaacagcttggtggagtatggaaccactcaagtaaaaagccaggtgcagcttttgtgccttctgacagcccagctcgtactcgggaatggaacaggaaccaatctacctatttttcagccatgtatgagaaattggaaactaatattgtgaaggatctgatgccttataacaactacccatttcctgaagtttccgatacgctccccccgaggcaggatgtactcgagtatctcttgaactatgcaaaaggcttgaacccttctgtaattgttcgtttgaacactgtcgttactcatctcgaaaaagttggaacacaatggagaatttcgtacaggcaatcatcgcaggctgaaagggaagatacgtatcagtatattgtcattgcgtctggtcattacaattttccgtatattcctactgtgcctgggcttgaagaatgggttaaggtcgatgctgattcaatttcgcactccatgtactatatcaacaatgaaaagttcagaggtaagaaagttcttgtgattggcaatgcaatcagtggagtggatatatcacttcagttgacagaggtgacatggcctgtctacagatcaaagaggcatgagccacttttgaagccagttgagatcgaagacataattgaagtatctgagatagctaaatacgacgtttcgacacggtctgccactactattgatggcaaaatcatagatggaatagatcacatattgttttgcacaggctatctatatgactttccattcctgaaaacatacatgagcggcgaagatgcaattataaccgacggcagaattactcgacgattgtatcgccagatattttatattccagatccaacactatcgttttctggagtcgtgaagaatgtagttcccttcccactagcagaaagtcaagctgcagttattgcgagggtgttttctggcagactttctttaccaaacgaagccgaaatgagagaaagcgagatagcggatgtgaaggcaaggggttctgaatacaaatttcacgtctacgaggcgccagccgacgtggagtacatcaatactcttcagcaatgggtaaatcaagcggagccaacggagctggggtttaaggcggaggtttggaccgaagagaaaaaacaaagacgcgtggactgcatcaatgtcaagaacgctcatcacctaaaatactacgcacatatcaagaaacttagggacgaaactagaaaagattaaacagagcttgaaccgtttcttattgatttctggttcggtgggtgacttgtaggtactggtgtgggttgtatgcctatcgtataccccacataagtacataagtattggaagacagaaaacttatctgaatagttccttcagtaacagcatgggcgctaagagctataatttgttttattgggcgttcttgttaaatgtcgtagaacaatacctctcactccagttgtgagccacagcacagtaccattaccagaataggttctaatactgtggtttaacttttttttcaattaatacccgcgaagcttcatgcatggcggcttttattaactgcggcaacgcaataaatagtgatctttgcatcgttcgatgtcaaaattaccgacagccggatttgtcacctcaagtttccttcgctgcagactgtttccccagtttttcttagtttcaatcttttcgttattgttcatctaatcgtgccgtcactctgtggtttacttcaaaaaggaagttcaaatagacagtagaatcgttttataaacaaaagcctgctctaagtacatcagcttctttcccgaatgaagttggctcaaaaaaagttcatgcacctacagaaaaataagcccgtttccttttttttttttttttttttttagaagtgaagatagtggctttctatatggcgtatgaattgagcagccaaatatttaaaaagctgaattctctctttcttttcatctaaactccaaacgcatcatggcttttctaactctgcccaagaatgtttttactagtacaaagtcagaacactccacagaagagtttcaagaaaacgtggagaaaagtagcagcttagagaaagaaactgtcggggaacagactatcgaacttgataccggagacagaagaattggattggtgactgccgcattcttaatcaccaacagaattttaggtgctggtatttttgctactccaagtacaattctgcttatgtctggatcggttggaactgcgctcatgttatgggttcttggaatgcttatcgccctcagtgggctatttgtatacgcggagttcggatcttacccatcccgtctactgcagagaaacggtggagagaaaaactacctagagtatgcctactcacgtccaaagtacctggttacttgcatgtatgctctgtatatcttactcaccggtgggtctgcaggtatctgtgttgtgtttggtgagtacattttgagagctgcgcaagtggagccaaccgagtgggcagctagaggccttggaattgcaagcgtttgtttcgcattcttggtaaacacattaaatgtgaaggttggtatattcgttttgaatgttttaggtactttcaagatcgtcattgtacttcttatcgcagtaactgggtgggttgcattaggcggaggaataaaaaacgaggagttcacacctacacatgccttctccaatgctttccaaggaacgtcgccgacagcttatggtgtagtgatatcgctgtacaatgttatctggtcgttcatggggtactcaaacgtcaactacaacttgtctgaagtcaagaaccctatcaaggcattgaaatactctgctccaatagcagttgtatcactgggtattatttacattcttgtaaacattgcctactttgcggtcgtgccctttgatgtgatgacgaactccggaagaatcttagcggcagacttcttcagaattgcatttggaacgagagcagaaagggcatgctccgtattcattgctttaagtgcacttggtaatgtaattgctgccacgttctctcaaggtcgaattgtacagcagtttggaagggagggtattctaccatactctgccttctgggcttcccaaaaaccattcaactcccccttcacgggattgctggaacactgtatcattattatcatcactattgttgcgcctcctgcaggtgatgcttacgactttgtgctgaacctgatctcatacccaatgaacataatcaatttttttgttgctggtgctttattgtggttgcgttatgaggcccgcaaaggccgcagagaatggataccgaatattaaaacaccggtaccagttattgtgtttttcctgctctcttcgttatacctgatcattgctccgtacattccaccggcaaaaggacagagttcagtgtacaatcacatgccttactggattcactgtgtagcagcctggggtatctttgcgctgggagttctgtactggataatatggggacgagtcattcctaaggttggaaagtatcgccttatttcacgagatgtacacgatactgatggctactggagaaacaaattcttcaagattccgtactcataccagcaatcagatgaggagtttattgcacaagagctccagaagcaggcggacaaagaaacgttttctgagaagccaatctaaatttagtgtatgcagcgttgttctttctaattatgcttttcattgacgaatttcaattccagtagttgggccagaagtaaacacagaaccccaaaagatgggtgctgattctatttacctttttggaaactcgtgacttttgatatgccaccagtagacgttgtgtaagattcttgtgttctcatgaaattgcgcatacgttatgcctccatgtgttggtacgttatctcagaacggtttccatttttttgagttagagggcgtatctgacagttttgtaggtacagccgtgtgaggaattagtgagcacctctcctttgatatcatcggttatgcgggagattgtgcgcagctataatcaagtcacctgacctacatttcagggtccgattcctcgctccgttcacaagtaggtgtaaataatcaccaaatgaagattggaatcattggcacaggggatattggggcaactcttgcccgtaaatttgcctccaggcgccacagagtaaaggtggcaaattcacgaggtcctcaatctatttccgaacttgctcatgagattggagcagacgccgtaaccaaggaggaggctgttcaagacgtcgaagtgatcatcatatcgattccttttgctaagaatcctgatttggcccatcttatccgctctgttccatctgatgtcgtggtcatcgacacatccaactatataccacaacgtgatggtcagatagcagaaattgataatggtaaagcggaaagtgtgtggctttcagagatgttgggacattcgatcgttaaagcctggaatgctgttggagcgacaactttatccgactatggtaggcaagcaggagcacttgaccgaattgcgataccagtggcgggagatgatgaaaatgcaaagtcggttgcgatggagcttgtggagcaaacaggatttgatgccgttgattctggaagtcttgctgagtcgtggcgacagcaggccggtactcctgtattttgcacagaagccaaagccgaaggtatgaagaaattactagagctcgcagatcggaaacgtgcgtctcgtaatcttgaactgatcctgaaagaattgggggaaagagggggcaaacgttctcacgaagagtctgtacggtttactcgctctatcaatattcccgatggtcaatttgagttttgatccgatgctgtcttatgatttgatacagggagtgtatgtatatataagcctacggtaaatactttttgccatccttacagttggtatcagtctacgaacacgataaaagggacatcatgagactcgacagttcaatgaatcatataaatatttatgatacttgaaaatagtagcgatctcagagccaatcaaaatatctgaacacaatatattaccaacagtttaaataaagatgtttttaaagtatctgtttatatgacctttggatttagtcccaataattttgatggatgtgagccagctcagatcagacttctgtaagatggaagaagcttttcccgttcattttgtgtgctgtacaagagttaagctgccagaaaactacattggtcgccaagtagaatactggagaaagtatgtcattcaaggtagtgaaacagctataatactgtaaacgtgtttcagagaaaatgcaaacacaatttattaaccactaaacgctgaagaaatcttcagtaaactgaacataagtagaaagccacccaagttaagcgggcttgtagccatacgatgagagtagctgtattaaaaatcaaactttcagagatgagacacgaaaagatgagcgcattttagacaattatgcctaatagctacgaaagcgtagggcaaaatcattccgtagacgatgaaaattttgaatgactaattttggttgatgctagcttggcatgcagctgactatcagccacgtcttttggtgcacaatttaatctttctacaattgtttcgcagctatctatcgaaaacaagcttgctaaaacgtaactattcacgctttctagaatcagtgctctacaaaaatgagtgtctgagatactggttgaaaaaaaaaaaaactggggaagaaaataaccagtaagtagagagatcggacgcggtctgcagctcaaatctagttgaaagtcgtcacttttatacgaactgcagaaatcatggaatcgctgtttccatgtttatctgtccgactttacaattttaacaaagccattgatatgaaccacttagtgattttctgtctagctgagtctctcggtgggtttaagaacccggggatagaaagcggatatgttttgtgcgaatgacagaccccacgataagcttacatacatttctgtgctggacactacacgcatttgttcatctgcatcggtatccctccgtttctttcatatggcttgtaaattcactttgtcaaaatgacccctatgccacagtcacatatatgtcctaactggccacttgcgactttgtagtaagttttataagcgtcattattaacctgatggaaaccaggcaacttcacaatggaaagtcctattgactcaagctacctccttctctagattgaaaggttaacagccaaaactcctgtttgtgatctctttctctatattcttagtaaaaaatgcaatcccaccatgaggtccgacttgacgtccgttcccaaagttctattgaaaattaacaagatagttgagaactttatgaggtgaaaaacgatactaccaaaaatggaacaaaatcatatagttatatctgttgctagcatatcctatgaatcgactgactcaactagttccgtttcgtatttacttcataggaatttgggagaactcagaattcggaagatttcattccggttaaagccggaaaaaagaaagagccccatagcgataaaacctaatcgtggatgcataatatctgcatctatatgtactgcattaagcgaaacttgcttcctttttatcccctcctgcgtttacttggcacttactaataattagtatctctttttggcactaatttttatactgttgtgttcatccagtttcctgattagttaatcctttgttctttttttttcacactacttatacaacaaaaagactaaattggcagtcattttcttgctgcgtgcgtacgattggtctcccactatcttccacggtgctatttagtgttcactgattaataacttcgatagatactttataaacggctatattaaagtatgcctgcatgctgaaccagataataataccaggtttttgtccagtactttggggttttataattatgtcaagtttcagtcatttatatgtgagaaccttgtggagtgggcaatccaaactataatcatccggatcttatccccgcctgtgaggtacttcaaaacaaagcttgtggtcctattcaagaggtgtatggcctgcaatttttatcgcacgcacataagtttgtggtaggccatttatatctctcgtattgcttggcttttgctatctactctttagctcaaataggccctgcatatgtcaaattgagtttgcacgtttagtaccaaattcaaattcagcccataaccaatgatgacgatatcctaggctttactggttttcagttcgatgggttcctttttagggtgtggtgcctccacagatttgaaactagtccaagagtgacattcttgctaacccagtaacctacagaaagacggaacgatacaccagtcgtgtcgtagcccaaattccccccactaaaatgctgtcatgcagaaagcgcaggggttgcgacttatggaaacagattcagatggccgcataaggcatacaagagtagtgattaccttcctctttcagtcgagaatgaactttcaagttttgctttcggtattgttggttcacaacctcaaaacaaattgatagcggacctgaacaggcttcaacactgactttacgtcaactttattcaagaacatgaaacgttttgaaacgatttttagcgagatgcagaataaaacagagttgataaataatcaacaattttagtgaaaagtaagtacaccaatatagttcttggaaagtgcataaaggattcccgatatggttattcagccaaatctggactttcatcgcttgtagtgtttcgcgatgatctgcatcattcgcagacttctcttggcgttgtgcagcttcccctagtcgcaaatttcaggtgtgcagagtggtcgtgctgagacaaataatacccacataaatttgtcaatagagtgatcttgtataattagctgcaacggtgaggccatgcgcagcttagtgtttgcgtttctattttatctggcaaccatttcagtcattagcaataaacacacctgcaattcaaactgcataacaggatggctgactagtgtgcacctagctgaacccagaggaaagtataagtagagtctagattctatatctccctgttcaaaagaaaatcaaaaacaaaaacatgaacctctttacaatcttagcttggggtttcctttatgttccccttgtactgggagagggatactattccttgaacttcgatgcacgagttccgattgctctgggaatactgggaagttcatatcagaaatatacaattatggcagatagaagtctcttaggaggaagcaatatcgacttggacgtcacattcagtggtattatcgagttgctcaccaacagagtacacattgttgttagtctgcctgatgccgatggaagggtatcagtctacgacatgtattcgggaacatctttggggtacctgtcattcgtgtgtagtcttactacttgcgaggttcatgctgtatcctccagcagtggtgcgacaacctggacgcttgatggtaatcaattaataccgaccagcccctcgaccgtatacgcctgttatcgttcgttagtgggcttacttgcgcagtatactcttaatgatagaacaagtatcaccgctcaatgcgagcagactaatttatatgtcgagctggccatacctgccttccctgagacaacggctgtatggacaggcacttataccacatggactacagatgaatctgggtcggtgatagaacaaatgcccacaccatcagctgacacaacaacaacttggactggcacctacactacttggacaaccgatgcagatggatctgtgattgaacaaatacccaccccaccagccgataccacatcagtctggactggcacctataccaccaggaccactgatgcagatggatcagtcattgaacagattccaaccccatcagctgacaccacttcgatttggactggcacttataccacatggacaactgacgcagacggatccgtgattgaacagattccaactccatcagctgatacaacttcggtatggactggtacctataccacctggacaactgacgcagacggatccgtgattgaacagattccaacccgtcagctgatacaacttcggtaatggacctggcacttataccacctggaccactgatgcagacggatctgttatcgagcaaattccaaccccatcagctgatacaacttcggtatggactggcacttataccacctggaccactgatgcagacggatctgttatcgaacagattccaaccccgtcaactgacaccactttggctccatcggcagatactacctcaatctggactggtacctataccacctggaccactgatgcagacggatctgttatcgagcagattccaactccgtcagctgatacaacttcgatttggactggtacttataccacctggaccactgatgcagatggatctgttatcgagcagattccaactccgtcagctgatacaacttcggtatggactggtacctataccacctggaccactgatgcagacggatccgtgattgaacagattccaaccccgtcagctgatacaacttcggtatggactggcacttataccacctggaccactgatgcagacggatctgttatcgagcagattccaaccccgtcagctgatacaacttcggtatggactggtacctataccacctggaccactgatgcagacggatctgttatcgagcaaattccaacccatcagctgatacaacttcggtatggactggcacttataccacctggaccactgatgcagacggatctgttatcgaacagat

SEQ ID NO: 108 - DNA, 23933 bp, Pichia pastoris
ccatggaccggtacttacgagaccacttataccgtcccatccaccggcactgagccaggtaccgtcattattgagactccagagagttacgtgactaccacccagccatggaccggtacttacgagaccactttaccgtccacccaccggcactgagccaggtactgttgtgatcgagactccagagagttatgtgactaccacccagccatggacgggtacttacgagaccacttacagtgtcccaccaagtggcactgagccaggtactgttgtgatcgagactccagagagttatgtgactaccacccagccatggacgggtacttacgagaccacttacagtgtcccaccaagtggcactgagccaggcaccgttgtcattgagactcctgaggcgtccactgcccgcacaaagtttaccacggttacatcttcttggactggggtattcacaactaccaagactctaccagcttctggtaccgagccagcgaccatagtaattcagaccccaactggatacttcaatacttcaagcttagtatccacgagaacaaaaactaatgtggacactgttacgcgtgttatcccatgtcctatttgtacggcacctaaaacaattacagttgttcctgaagaaccaaacgaaagtgtgagtgtcattatttcacaacctcaaagttcctcaaccgatacaactttatccaagcctgatagtgtgagagtcatttcccagcccgaaactgcttctcaaatggatacttctttatccaagacagacagtgcagtaatttctaccgagacagccggaaataatattattcctcttgcaggtagtcatagctacaacacgattgtgactacagttactgactcacctcaagttgctcagagcactactgctacaagcagctctaatgttcatcttactattagcacccaaacaacaacgcccagtttggtgtattccagctcactttcaactgttcaccaagtctcaccttcaaatggagggttccggtcaagtataacagtgcaccctctattgagtgtgattggtgccatctttggtgccctgttcatgtaaacttcctcaccttttaagctattctcttacgtgcattatatgcattactttagggctcaaaattgcttctttccaagtatgtatacttcaggctagtctttcaagtgatcttgttacttgactagccctgccacttgtatttattaatagactcagttgtttactgcaatcgccacggattttgttttttgcccatgtagcaaggactttcaaccatactggctagtattttcatactcaaagggatctcaacgttggcggtataattctacgtttctcgtttttaatatgagcgacaggtggagtgccgctggtgattttttgatttttcgagccgtctaatactgtcgcaaaggcattcaaaggtgtgaaagttgtgaaagactggtagttcgaagtacttactttatccggctcaccgcggataaagtttaactacatcttgattatccactcacaccatgtagctgaactacaggaaaaatatacaatagaagatactacttaaaataagatacggaaagctgaaaatatggaatccaattgggggctgctttcatatccaagcagtgataacatggacaaaaatttgagtttataacgttcctctcagttgaatcgaaatactgattatctgtagcggctatcatatcggtcgagattcaacattgtcaaaaagaaagcttgtgagtaaaaaaagtcacaatcagtaatagatttagacgtacacatgtgggaaaagtattgcaacacttataagaacgtaacgtcacagttggacacagcgcaccttagccgagagtaccgtggctagcggaaattttgcgggatcgtttcatcactttactgagtcgtgcggaacgaatccggacacttcagaggtgagcatcggcatccacaatactcaaagttggggccccaatgaattactaatctgggtttcaaagacatgccacaaggtgtgcgaggtaatcattatctccgctgacgctgaagaaggccgctgcaattaaacaactgtgagacatgcatatatatacacgtattaacctacccttgccatttgaattcaagattgaaaagaaatgacgagagcagaatactcaaataactccaaacctctaaagattgcaacattaggagcaggactagtgggcgcagtggcaggcattgccctttccaagctttcaaatgtcaatgttacaatctacgaactgtctgagaaagctcgagaagttgatcgtggattggtttgaccgaatcaagtcttcaagttctttgcgagcaagtagatactgacgaaatccaaagaatactttataggggcgatcaggatggaggatacgtaaaacgccattggaagacgggtgaaatacttgctgtcaacctttcgtcgacaactactgacaggagactgaaacaggccagaactcatatagtcctcttacaccactttttctttcttatgctctcgaaggaattgtcaaatacgtggccactcggcaaaaaatgtgaatgtcacaaaagacggagttgatgtaagttttgacgaaaaggatccaatacataccataccaacttgctggttgctgctgatggtatttattccagaacaaggcggcagttcaaaggagacatcgtccaatacaaaggagcggttgcttatagaaatgtgttccctatggagctgatcatggatattcctaacctcccaaacgatacgtctgcatgggtcaaggacggagacattatgttcttttctcctttggggttgactcagtatggagtcgtcgcactacgtcgcacgcagtttttgatcccgagggtgtggcaaacaaattttgttggaatgaaaatactggagaatgggccgtgagcatcttagaaagtaatttgcgggttgggatcctattatcgataaggtactaaaggtgatgacggatatcacttcttttctcttggagaccgcgccctagttgaaggatctgacaattggagatcgcctagcgtttgtcggagatgcagcgcatccaaatcaggagcgtttggtgctggagcacagtttggatttggagatgtttgggctctctaccgacctcttcaggagacagtcagtgacgcctacgtagatactggccttcttgcagattacgacttacatcgggctctcttcttgttcaatgagacaaggcgtcattttttggctagagtagaaaaacagttaggctatgatgctgatacttataagagctattttagtactgcaagaaatgacaaggaatggcgggccagattccgtcaggtggaatcccctttagagtggatgagagaaaataatgtggaagcagatttttaaagggttgttgatgagcaaggtccatttttgagaacaatatacattgactagaaggaaactgttttaatctatttattgccgacatcggaaaaccaaattgatgacaattttgtagcggtaatagcattcaagtccagtttgtccataaacaaaaaagaatcacattttttatgcaattttgaaagtcgtcatccaataagggagaatgaagcgcaaaacgttgcaaatttaattctacggaatccacatttctttggattgtagacatctcttttttagagcttccggtctgcagatagtttctccgatcaaaaagaacatccaccatcaatcagctgattgcaaagtgttggggtgaggtcgctgggactcagttgggaagctgcttcgattagccttacacttgagactacaagtctctcattttagctctcatcaaatgttgcatacagtttgtagatagtgaccaacgttaagtagtattgtactctaagtaagagtaattcaagcgggcaagaagactccacaaggccatcttcccattgatagccaatggacagattttgcctccatcgaagaatatcggactctaaacgtaaacatatggtttccaaaagtgtccatcaaaaacactgttgacgtcctccattactaaggtcgtcttatcacggatatttgacaacatataatggagctcatataacaaaacgcataactttcattgctatcaaatgggaacttgggtttacaacctgtaggcaaagctaaccattgttgtagtgaggacaactctgacttcggaattgaagccatatttgccatatttcgttccaagtctaagcatacccaaaaaatgcgcctcaaagtatcgacataaagctgattatatgagcctatagacggactttgtttaagccgaaataattgtttgttgagcttggtgcaggcttcttgtaagtaatcacaatgtgacacgatgtctcctaatttcaaaaaatataatgagcagagtaatgggatcattacaagactcaaattatcagtggatgaactcactaaacgagatttcattcccaaaaccaaccaaaaataagaccaccctggttgtgggtctacctggcgatgagccacctggtaattgggattattccaaaaattctctttggaaatactatcattttcctcagccaaactgatcgcacccaaagccaacaccagcaaaaggatgaaagtttcgaaatctgcttgtaatcccttttgagagacatcttgcgataattctgaaagtttctgttcacatagcaatggaaacactggatatatatgtcgcaaataggcatctttgagctttttaattaaagcactattaaaattatactcgactgaataataggttgattttgaaacctacctttaagtgagtactgctcttccaaatagattattctatttctttcgtctggggttgtcgatcctttaatttcgttcaaatctacctccacctcatcgaattcgtatcctccaatcatataaggttctgtttcttcaagatgatgcgaagcacgcttgacttgtctcctactgagcaattgagtggtttcttatttgccgtttcctggttgaacagagactctagtttagaattttcgttttctatcctttgaaataacagcgataacgtcctctccagctttgttggaacggagtctttgtatgtgcattgtaagtttcgagttttgcactgactacagctaggtctggcttcgtcacatttcgtcttcttcaagcgacaatgttcacaagcgctgtgagctctggttctcttcatcgccacttcatgtcccaaaattgagtattaacatatattgtatagcttacttacgccgtatcaccacccaaaaagcctcagtttggtcaaagtgattgcgaggacaaattacgaattcatgctttagcacttgcgggccagtcaaggttgaatgcagtgtccgggtcgaaaaacgcgaaaaccgacttttcaatctccacctttggatcactatcgtgaatccatttaaaactagttttgtagatagacagagccttctcagataacctaagacgatccagaacataccccattcttctggaggtaagagccacctgttctgcatgtatctttctagcactctcgtaaacctcgagccagattggaaagttttcttttatcttgggatccactctataagcggcaccgatagtgagagcctatgcataggcattttctactccttgagatccaccttgtccctgatggggtagcatggcatgtgctgcatcaccagcaagtgctactcgattctgataccacttgctcaaaggctctttttcatacagtccgtacaccttaatctggtcaagtgacgaaaagatcttattaacaccggatgaaaatcatcaagaatctgcacaatcgtatcaattgatccgttctaaagccatgattcctcccagccttcatcatggtcaattcttataattgcagctaccgccaaaagcgtacccttcttcagtggaaataggacaacatgtttgtctccaggcgcaggaatgatagtactgtttagtagctctggatcaagatcagttaccttggaaagatttaaaacatctctgtacatcacttgatggctaaaaacaggagtgctttctccaaaaagggtactccgaacttaagagttgataccatcggcgccaataactaaatccgctgcgtatgaagacccgtctttgaaacggatggtaaccaatttgtggtgctgttgcaaagattcaaactttttacctaaatgcagttggtcttttggcaaaagacctgcaacttctcgaacgaattccgctcgcaggcacatcactttcccagatgtattactgtaatccaaaaacaacttcagcttgttggtgtcgtgagttcgataagtcgaagtttttgacctataggagattctgtcaataacatcccctaaccccagagactcaaagaccttggcagcattaatatcgaaagagattccagctccaacatcggtaatagagtcacttcgctcgaagacatcaactctgtacccatccctcaacgctgccaaaccaaggatcagccctgtaaccccaccgcctataacggcaatcctgatgctgtcccttaaattagaagtcactttgctattgcatcatcgccggagggtttttaggtttttacttatgcaagtgggggtgaaccacacatgaaaatgatgtgagatcaatctaaggcgatgagataacgcaacaaattatcgcgtattcggaaaagtttccgtgcggatgctagccgggcacaacaaggagagaaggctaaagctgaaaacgttttgttttccaggctgagatttccaaaactctttaattgtggcattagactattatttgactcgctctaatcatgaggaaagatagtatataaacatggctgattttcatttggcccttagattcattacatcaacatgtccaactctagttttaagagtgacgaaaaaggtggattgaaagggtcagttcaagcacaaggaatacctgtacttttagaaaatgacggggttcagaatatacttgaaacacgattccttctagaggtttttaaacgccccatgtttgcagcgttcctggtcggagtcacagcttttgcatgccctggaatgttctcggcactaaatggattgggagctggaggtacggccgagccaaccatcagtaatatttccaatgctgttacgtttggtactattgctgtagggggatttttgacgggaactatcacgaaccagactggtgtaaaagaatccctcctgatcggcgcgggattttattctccatatgcagcggctctgtatatttcgacacagggaaatagtaactataaatggttcatgccagtatcaggttttatcttgggtgtttcggctgctttcttttggattgcgtcgtccggaattcttctgggttatgggttatccaactgtcaaagataaaggaaaagctatgtccatgaaaaaaaaaaatttcccttcaacatgttggaggattggtgggaggcgctatatctttgggactcaatcacacgaaaccctcaagtagaagtgtcacaggtggcactttactggctctaacttttgtgatgctgattggtatcccagctgccctgctactgccaacccctagacaaatcaaccgaggagatggttttaaagttgacgtttttaaacaaccttcaatttggcatgagtttgcacttctgaaacagataattttgaggaaagacgttcttcttttgatacctctttttacttacaatcaatggtatctgtcgtatcaatggaacttcaactacagctatttctcgtttagaggtagagctctaaacatttttctgttctatttgtttggaacaatcggtgcttggattttaggcttatttttggatttacagcgtgtcagaacgattacgagagcaagatctggattcacagtattttcgattattgcaggagcttcatggatacttggacttgtggttgaaatccagtggaaaaatactacccgtctgtatgattggggtgatagggaatttggtctagggtgttttcttttttgcctttggggttttatggacgcaatgtacaacgcatttgtctattgggttgttggaactttatctaaaaagttaatgaattgtctttgctggtggtatcgtaaatggtatcggttctctaggttctgctttggcgtttgccgtttttaccaaaaaagcctcaggcattgctcaatgtgcgatcaataccgggctattttttttctccctcacattcttctccgttgttgtttggagaatcaaagaagacatcagtgaaaaacatccagaagaagaatttccccagacaggtattgtctcttttgaagatagactgtaggtgatctagagatagctagttttgtttaatgtttacctgttgaaattgactaaatcacttctaggtagtttatgagactctactatggtttcatcttttaaatacaaaaggtgttaaccctagtctcactatattaagttgtttgttgagacaattcataatcagtgcaaagccgtcttgtttctaatgtttttgaaacatacagatcatcagcttcagaacaaaattcaagttatatttcaaatcacaaaaactcaaaacaaatcttgtgttttgtcttctttaataatttgtttttctttcaattcattatgtgcagttttatcatttaacaaatgtatgtacagttctgctttaaaacctggtacttgaaaaagctaaagtgtctgaaaaatagataaggtgccaggactactcaggatttttcaagttacagcacagcaacgattgcattgtaccttcgattcactagtcaaaaaggttctcagtaacatatcttgatcttctctatagacgtacagtcttatcggtggcagcggcgccaatactgatctccgactttgcactcccaatgcataaaggctttctaggtggacttgcattcacctgtttccaggatgcagccttgactgcttctggggtcacctacggtacccgcaatataacaaccaattgggcctagggaatttcttcgattatttagtgtgttccggtagttgttctttggtggctttgatcttcattcccgaatcgcctggttgagctagctccatcatgaagagaagcaaagtcagtactctacggatgcttaagtttctttcagtcgagtttatgaaagaaaacaagccgctgtattatttgaaagagcagttgtttggtgataccagctgttttcaaattagatctcttagacttgttaggcaaaatgcgggcgccctcgggataataaaaataatgacttcgaataaaaataaaaggagccaaagaacaaactgaaaaaaacaatcaggggtgacagttcaatcaatgtaataaaaagagtgatttcaaagaagcaaatatttttaaataaaaatcaatgtctagaagggagcaaaaaacgctttcattcattttttattttttggaggcagctcataaaaattttaatgatatttttctttttgttcatttaaaaggactagtaggtatattcataattgaattccccgattttcgtccgtaagggcgtcctatcagattaagaaataaactattgggaccaaggtcatttttggttaccagtatgcacaaaaatagaattaatatgcagcgtgtgcatgggatctcttttcagctaccgtgcagttactgtgcatgcatattgtatgcgagattttaaagtgcagtgcataggacacaacagtcttcagcccgcagcttattgtctcgaagaataaatcaagttagacttgaataagcctgaccctcatttgctgtctgtaacttctcaactaccaaattcaccgaatgtaatcatggcaccttgaattctagcaagaagttgacgaaaatattttctagtcttgaggttcatcacctcattcaaatttaagaattgggaatattcttcctttgtgcatttggttttttgattgtagagtttttctcagtattttactcaaatctagttatctgaagattcattcggatcgtatcattatgcgcaagaagaatatgtagcgactacagaattgaaaaaccttgtttgcagataacaaaagaactgtttattcatttgatcacttcttttaacgctttggcttcatcttcaccactacgcttgattgacccatataaatgattcttatgggccacaaagtatcttacaccgcagctgatgccaccatgcttacagcacagtcaaagctattagtcttatgattttaatgatcattacagtcatgtcaagtctccataaatgtagcagctgatgaaactattccacaaataacaacgacccctttggaccctatccgagcagcgttaagctcaggtacgtccaaagcataatgctgataggtacaactccaaagctccaatgctctaagtgcttcaaggtgttgccactaggagcaccttacaaatctggagaacatcatttagtactaaaagaatgttacaagaacaagaagagtagtatgacacaataattaaaaaccagtcgtttcatgcaacgactttcttacatcgccttcaaatttttcgatggactttcttgaaaagaatattcaggctgttttatagcttttttgagtcaaaaaaagagatgcacttgaacaaaggatccgatatgtacgaaattgctggcgtatcccttggaattgaggcgaaataagctgctttggtggctcgttccgaataactttatatgcagttggtattccatgcatcaacgaactaaatctggtaaatgacaaaaaactggacgtctataagctagtcgctttctctgtccactatttctctgtcatgaatgctatagctaaggtctacttctgtgcacatatacagcatactaagagcgatcagtattctgaaagttgagacgtaaaataccgttccaacgaacccaagccctgcagaatcgacatactagtaactaaatgtgacagcagctcgtaacaatcttgctcgccgacaatggaagtttttttataactctaggcttgttgtcatctataattacgtaagagtattatcgttgatgaatcttaacatgttcatgaaatcagaaatacagttcctctatcttttattgcgttactttgaacgatgagaaatctcgggatcagaaaaagttggctataaataaaagtagtccagtgttagttatatgatcacatcgtttctgtaagatgcaaaagcgagcacacttatagttagtactaatgttcactactcctcaattcatttcaaatgattaccaacctcgatccatggcctcaaaaatatttagttttcaaaattgacgccttgtttgcggaaaacactcctatgagctgtttcatattcagttccacttcacagtttacgtttcacaggctctaaattcaattgaacgagttccatgaacaagcatcttgaaaacctccgcgaaacgtcaattaccttaaatttcagggtttccgcaattcgcagccagcgaatttaactctatcgtatgctcaggcaaataataacggatcgtatgctcatgcaaataataacctttaagtaaacgtggaaggagctgcattatattgatagcaactacttaatatctgtgctcgcaggttcaaaaaaagttcaagagaccttgagaaactctcaattaagtagccctgcggaaacattggtccagaaggtattgcttcgcgtcaattttcctgcttccactatcaaatgatgttcgcaatattcatatacgtgttactggttgcagccttctgtagtgcctgaaacgttggatcgctagcgatcagcgtcattatatggactgctcctgacctcaacgacgttgggatatggtacaaaggagctttttttgacttgtggagtagctgcatcggcagctacagcgttagagacctggcgtgattgccgcattcaagaacatgaacaggttaatagtttcgcctgcgctgcaagtgctctgcggtgagcggggtcagctacggtgatcgggtgttccatagctcacaagatgcacccaacgggatggatcaagctttgtgaagattatgctgcgaatgtactcgaggaggtgtctcaaaggctacacagcaatggtgtgttttcatacgcatggtgaccatcaatttgtagaaacatgatgctgccaaagaattgtcagccgattctgattagcaaattgacgctgtaccaacgttgagatacaatcaaatcacaccaagcgagaataaacaataagggctttttataacacaagtgaaagctttgatgcacgattctcacatcggactaaagaagcggaccacttttaatgttacggcagtgataatactgacatttatgtgaccaggtagtgaccctttgacatacaggaaccatgcgattaaccggattacaacctatgcatcagcatcacttgctcgcgatgtaccctaaatgcaagtgacgaatatgctttcattagagttactagcggaaggatgtttgttgtgcaaagatttgttgaagggtggtacggctgcaactaacttccccgaataggctatgaccaattttgaggtgcgttgggattggttctgaatttcagttaacagctacttgacgaaatttatagtttgaggcagagctggcgttcaagagattttaacaaagcaataaaacatttgaaatacctcctaattaacaatgagaaattattgaaaagcggacaaatgtaagagagtttttttggaggaacaaacttaataaccagtcaagattcaatccattgctaatttgtagcctggtgttacttgaaagtagtgttaacagttgttttattttcaattttaagaatccgtcggatctgaattttttgctccgtggttggtacaaagattcaattcaaagttactagactctcttcgtgtatagcataagtggcagttttgacaatttttcagataatagcgcttgcacaagaattagtaatcaactcccagagtgtctactatcattgctgatagcgcgagaaaatcagcagtacttaaactgctcgatgagtatcaattccttcgcaaatagaaattcatatcatcaaaactttgaacagcagaatcaaaatgaccacagttttcgcttacgcagctccctctgccagtggtgagctaggacccttttcatatgagcctagaaatctcagaaatgacgatgtggaaataaagattctgtattgcggagtttgtcacacagacctgcacaagtgccggaatcactggggaggttcacagtacccacttgttccaggacacgaaatcgtggggaaggtagcccgagtcgggacatcggtgaccaaatacaagctgggagatgttgcggcggtgggatgtcttgtggattcatgtgggaactgccgatcgtgtaaagacggactggagaactattgtgagaacgcgccaactctgacttatgacgctgatgaccgcaaagatggcaagcgtctttatggaggatattctgagtcgattaccgtcagagaaagttttgtgttgcgagtgcccagcgggttggacgtgaagtctgcggcaccacttctttgcgctggaatcactatgtggtcgccgttgcggaattggaaagtgaacagcaagtccaaggttgcagtggccgggcttggaggattgggccatatgggtatcaagcttgctaaaggcctgggggcacacgttacactactttctcgttcgccaggaaaggccacagacgggcgacgactgggggcagacgatgtgctaattaccacagacgaagcagcggtcgcacgggcaagcaaccggttcgacatcatactcgatacagtaccgtacgaccacgacgtgaacccgtacctgagcctacttcgacgagacgggaatctcgttctgcttgggttaattggcaacatccaggcgacgccactgaacactgggccaatgctatctgcgcggcgctcggtatcaggctcaggaattggagggatacaagagacgcaagagctgcttgacttctgtgcggccaaaaagattttgccggacgttgaaatgattgcgatccaagagatcaacgatgcatacgagcggcttatcaaaggggatgtgaagtataggtttgtgattgacattgagagtctaagtaaagtcagggggtagcgttttcgtaggaggtaggtagataggagttcaataaatttttgctaacagttcaagcacgatctagcaaaattccattgagtctagtgtgagagaccaaaatacaaaggagtggattctcgctcgaggtgccttcaaagctcaccccaatatttgtattcaatggccccaaacaacagtgctccatcgtcgacattgaatacaccaccgtagcaatgaccctgtgacctttcagcaaatatggaagactggcgtaccgtagttcattagcctctgtcaatagttgtacgaatcccagaatcggttgcgtactgttgcccgactgtattaatccaagttgcacctgtctaaggtacactttctcagcccctcagatctccgatttgtctgttgcgacccctcgtaattgaacgcttatactgcttgcggaagccctagtcgttatcgcagaactccttgcgcagtgttgaaaatccgaagacttgatatcgacaataagatcaattatcctgtccattgccacctagactggtatcaaggggtgagaattttcattttatctctccagttccaaaagattacacatcttgctctcttgctctgctgcagcaattactatcagatgaactgcaaactgcagcagaaatgcatgcttctttataagtgtgggttactgcttgtggaactactagcgttctagtgttccaagagaaaagaccgtgattctgtggagaaagagtgcatcacttgagttccgcacatagactgctactgtagtactaggtccggctgtaaaaagttcagcatattggacggtaggcgggactcttttgctagacatggcatcaaaaagaatttagtcataggaatgcgaactttgcattggtatgtgttttacggtcaagttcgactttggtttcctcatcaatcctggattttttggtgacagcacgtcctcatgggatgcagtttggcgcgatgagatggattgttaccccagcttaatcgttgacgtgtcttgacctgtcgtgtcggagtccaaattgtggtgttgaggtgccacgaattgggtcatgaaagcagtgagatttttagcagcttagtttcctgaaatacatatcagttcctacatggtttgtgggcaatcaagcgcgcagccgcttactaacctgttagtatctccctgtagagtgtatctggtgcatgcttatctgtatacactgtgggcagctttgtacttatgaagaaagtacttgcaagaagaagtactagtcaagttcacctaaactgagattcttaagagagaattatctcaataagccgtgttctacaccatgtacatatgcggcatcttgttatcactgattcctggatactgccaactttctggcgtcctttcaaagaaagttggaacgttaaaaattgaagcaaaacgaaccattttttgttactctcttccgctcaagaatttggcccttcgtaccgacagttatggtcaaacttagctgctatttgttgctgcagttttattgctggaattatctaatcggaccatgtaatagctttggatagcccgctgcaaagctggcccaagtttggaccattccagaatcttaacgctcttgtcaaattttcgaggttttctcacgtcatatgtgttaatacgatgttccagctccgaaagataatcatcgttgcatgttggcacggaacggcgcttcatagtgtccttggaggaagacactaggtgtttggaccagaactgcaccaagttcgatctcatacggcctctttcttttctcctttgcacagggtctgaggttgaatagcttccaatcagtagttctattatcttgatgacttcaacactggttatatagtacctgcatccaattgaattcccagccgttttagggttatggccattcggttctttgttcaagcctgacgttagcggttctgttaaggcatgttgtgctcgtgcttcatctgaggtatattcactgacaaatcgctcctcctcagattcattgtcgttgataaaacatcttagacacgaaacttctaaaactttcacgtctaattcagatgaaggtttagtctccgggtgatctatggccgatccaactatgaaaaaagatgctacaatttcattggactggtaacttctctcaatacgaatgattcttcttgagtcgctaagttcccgctcgctccagtggggaaaacacatatcttcacttgtactgttctccagtcttagacgggcagtaacgtaccgcgtcccaggaattaatggcgtcttgggaggtctgctatttcctccaaagctacgcccacgcaccagcggtatgcatgaatggtcaaggaacattgatgctgagaaatttagtttgcaggaaaaactgagatcttcgatcttggattgctgtttaagcccaatcatttgttttttggagttggcggcttcctcaaataacgttgtggttgcttccaaagtggataccagatcgagagtcgctgaggagcatgctgtggatggaggtgctgtttccgcagagtttgaacggtaaaagtatggctcttgaactgactgctcaaacaatacatcaactgttgagtctgcagagaatgaatctttacttagggaggagtcagtggcaagcaaagaagcatcaacatctacgaacgactgaaccgaacttgtttgtgggatcttggtgcatatgaacacaggcgactctgaattgaaaatattcttggtaagcttatctggcagcaaatacagttcttgctgtttggccatttcaactttgtgtttctggcagcaaccaaagagatttgtgtgtttttgttgctcccattctgtatcttgctgttgctcagtctcagcagctcttggaggggataacaaggagcagagcattgcgtcatcaatcggatgatcaaaaaagtcagtttccaagagttccgcaaaaagcgtatcatttccatgccagtcataactgaaaccgttgccattgttgttgttggcactgctatgatcctcgttaccagcaatggctggtaatgtgccggtgaacggaattcctagagttgctaaaaacaattgcattccagtttggtgatacgagctggaaatacgtgtttttggaaaatgaacttcagaaaacaaactgactgatggtcaattaggtcagtttttgtggttcaatattgaatgccagcaaaggcgtgtatgcaaatttaaagacgacacaggactaagaaggagtttcaattttgaaccactgaaaatagtatgggaacacagtacataaagggttctcggccttgctgcaaggttggtcttatattccaactgggcattatgcagtatgcataaccaaattctagtctttcccctcagcgagcactcgcatgttaataccatcttaccacacacatggtgatctgtatctcttcttaatacttaaagttttgcacactgaaggagttcctttctttcatggtttgcctgggctttttttttaacccgattaaatcatcattcacctgctcacaaacaaaaactttcaaatacgaactcactctttctagcttcattcagtgtatatcttcgaagcaactgagcagcagcaaagttgattggtgttgtcttagtatctcctaatttctatgatcacatgtaactggcaaccacatctggattgaggtgccgccaagagaaagttatttttcagcacacgtgacactttattatatgaactgcagcttcagttacagctttcattgagtatagtcctgaaaagctacgctgagaagataatcatttcttggcgccaaaaaattcattcttaaggtctaattcagagacaaattctattacctgcacgctgcatgcaaagaatcgtttaaagtgatcatattgcgcacttttcctattgcggatgctcgcctgatcttcgtagtggagaaatcaagatgaagaattaggtctcaggctcagctcaagcgcgctccaattgtagtatctgcgtgttcaatgtgaatcagcgccacctgaggttgcgtagatggttaaatggtttctctttttacaacatgcatgaaaccacgtgtggaattcaagagatttcggtaatatcctattttgtttttgctcttattatggaatctgctgatttacgcctcactttcccaatttatcgtgcaatctgcatgattattagccaagccagatacaaagaaagattatgcatgatgcatatgatgcggttttaaattacagcacgtacctccaggtatacatggagactgtagacgagagcttttattggtcttcttttttcaaggctatagaattatcagtatcactttggaaatgctgcgagtttcttttatttacgtattctaatcacgttagaggtcatcagttgagtctatctcttaacacccgattaagctagggagacgccttttttacgtggatggcacaatcaaatgattcagatgatcaaaaatgttgctccatatagtttacattaggggaattatgctgtgccgcattcattagcttattacgttaccttatttgaaattatgcaacaacccaaatttatgtcatctgataatgcaagttgtcaacctcaaaatctagaatgaaatctcaattcctgaagtttctaaaaagtgctgctttgaaatggaatcaaagtaaactcaattgagccaaaaagcccacatatacaagacgggcactattgtgaacgattcggtcttatcggcttgcttctgtacagatacgtataagctgtacagtcgaagtaggtatgcactgaatggatagtagtgaaatttcatcttcaatctactttgaaaattctgccacaatgaatgatgggtgagattttttggagcattttccattgcacatctgttttgtatggtttctcttctacattttgtttgttttggttagggctaaggcaagagttggatccattatgatcagattgataacctcagtaagccaaatctgtcacttaggggtttgagattatccttgttactggctttaggataagagtttaacatttgaagctcaagtattcgttgcgaccggctcagttacggcgaggacatccaaagggaaatatcatcttgaagagtcagcacagctcgattctacagtaaaattgccattttcgacatctggtttggaaatggtagatatctacatggacttcccgtgatgtcctccacattatacatttgaccattgggtcatttgaaattgataacagtttgacgactttgatgatgcgaaagcttcatttacactttggacctttgcccaattgagaactatactatcattattcaagatctgcactacttccaaagatcctagttaattgtactttaaaccttgcatgttggtctgtgtagggaaacaaggtcatacttactaatgggtggggccacaacaactcaaagaatcccaatggcctattaccacacgctccttagtgccagcacaagtaatttttggctaggttatattccttgtcttgccaaagaaaaccattcaacttggtaacaccgtgtccaccatcagctggtgcctccttagctagattgctaataaaacatcgatacagtaacaagtcagccctttttgagcaaccagtggcattttaagaaaaaacctgcggctatcgaaactactttgcggacactgttgttctatctgctattgcgactgtgactgattatgatgccactaagtgtaccaagctggcccgggttcatgcagacatctcttcaatggaggacaaagtgaatgacactgttattgtgaagacacaatttagttgggaatgaggttctacaaacaatgtataccgcaagctatataggcagttttccccagatatccaacatttgagtgttgcaagtccaagagaaatgagtgataatcacagttgcacgaaatctaccctgctgatatagccttggctactgcagttcggtgtatgttgcattggagaaccatcagcccataattaagaaccattttctttaggaccaaagttgaggtgttttggtagtttattctgtgggccacaatttatattagcaattaatacttcaatctatttttcagcgagcacacacagtcagaattgttggcaagagagaacttagaaagtcaaacctagcccgagaggggcaaaataggatcaaaagcgtgttcataggttgcaactgtggatactaagctaaactttagttaagagcacatgcgaacggcagcactgctgccgcaaagttagacccataagaaaaataggttctgaactgactggtcaataaaaattcgtactgttgagtttgcaagcgacaatttttccccaaggtggcattaatggcaagagacaaggttgaactccttatgaatgaccacccaacagagcttatttgtggggtgttggagtatccaaacatacaagagtgtgaattgaaaatgttcgtggtaagcagatgtttatttgaagccatcatgtagtcgatgctaaatgccatttatgcatggcacaagaagtcatgctttccaaatatgacattcctggttttcttttatttcttttacgtatccaagcagccatatgacgaataagtcatttagtgatctcttattgcctcttgttctctatgattcctgtcatgatcaaacgcatcaaaattgggatgcagggaggagacactttctttctagtgcacgtgaaagcactacatattacatagtggtaagtgtactcgctgaaaagggtatgctgcagcaaaaatgtaattcgatcagttctcggcaagaagacttcttttgatgactgctttgaaagaataagtttggaatctgcacgctgcatgcaaagtggtgtagcatttgattaagattatgcacccttgaaattttgacgctccaatgacctcaaatggtgaaattcagtctgagattaaaaggttaaactagctcttggcagacattttaactagttgattatcagcctcttgaggtcgtaaaaaaaagaatgtcagcaaagccagccgcgttatgaaggaaagttattgtgcagacagaattaccaatctaagtttatgcagtcatgcaatttaattcattaatatctaattgcttatttcatttctgctggaagatgagacgaaacttctcgggctttttacaatttctgtgtctagatgtcatggacgtagaaataggctggtataattgtagataacagtgcagctccaaaaccggtaatcgatggctgtgaccaaaaacccgttttcatcataatggataaattgatatcattggggaagaataccgaccatccatttaggtagaagtaaatttcgtttaatgagtatgttattttacatttggcttcggagatagtgcagggtctacaaggctatccatataactgcttttctgaatctgagacagaacctgtttttgaacaacaaggtgcgcaaatttcggctacttgtaactattgatcaagctttcatgctgtcttagttctattagtctggcggagtacaagaaactttcacttggtcgaacactgcgaatgttgcgttaggaacatgcgctatagtgcatttattgatttaggaatatgcggcaacgtcctgccattttgtattactatttgcctattttgtcgtgattgaaaatgaaactggaaaaataccaatactcaatgatctagaaaaaggttatggagttatacgtcacgctcaaaacgaataacaaggattattgcttttctttctgaaactaaagttcatggcgagtatgtaaactggcacatcattggtgcggattaaaataaatataggaatatcctaatctggaataagttgcacagccttcagggaatttcttcatctctgaacacattctagaaaccaatgctgcaactcaaacatcgaatctggtattaccaatagacggaactacactgaaatttcagatatccggatgcaaaataagttgcttaacctatttaggactccatacctttttaggatggaatttggaaaccctattgcatgtctttcgtattactaaatgaggctaaagtcaagccaaacacggctagcctgactcatttcgatagttctagaatctccaggctgcatttcaccaaaaatggcgtgtattgcatatccatactagtatacataatttcacagaagataatttgttttccatttaccgaggcctatatatattacagctaatgtaccagtgtatctacatatttcgaagttaaacctaacaagatgagtttgctattgttcttagtgctaggcgctttcctcttgtcctctgtaaaagcagcagatattggggcattcagattaagagtatacactccaggacggtttacaaatggagctctaaattttaacaattgggggtatcaataccttgatgcaagctcatcaaatgggcagttgtttgccggttatgcaaccgttacaagtgtgaccacgtttttagctccagacgacgaaggattcgtatgggggtcaagcttggggggataccccggatttttgggtataggcgcaggggcaacagctttccatctaacgggtattccaggagatgctctaagttggtatatagaagacaatattttaaaaacttcttcaccaacttacgtttgctcccggaacgatggagatgtggtcgtcggcatcgaagcgaacacaagatggttagccatgcatgatacgtcccagttgccccctaattattattgcttccaagcagactacgaaatagtcgcactatggtacatccctgacaccacatccacatggaccggtactgagacttctactaccaccgatgatgacggatcagtcattgagcttgttcctactccattgcctgacaccacatctacctggactggcacatttactacgttcaccaccgatgatgacggatcagtcattgagcttgttcctactccattgcctgactccacatccacctggactggtacttacaccacgttcactaccgatgaggatggaagtactattgctgtggtaccatcgtctactatcgactctacatccacctggactggtacttacaccacgttcactaccgatgaggatggaagtactattgctgtggtaccatcatctactatcgactccacatccacctggactggtacttacaccacgttcactaccgatgaggatggaagtactattgctgtggtaccatcatctactatcgactctacatccacctggactggtacttacaccacgttcactaccgatgaggatggaagtactattgctgtggtaccatcgtctactatcgactccacatccacctggactggtacttacaccacgttcactaccgatgaggatggaagtactattgctgtggtaccatcgtctactatcgactctacatccacctggactggtacttacaccacgttcactaccgatgaggatggaagtactattgctgtggtaccatcatctactatcgactctacatc

SEQ ID NO: 109 - DNA, 12383 bp, Pichia pastoris
ctgtggtaccatcatctactatcgactccacatccacctggactggtacttacaccacgttcactaccgatgaggatggaagtactattgctgtggtaccatcgtctactatcgactctacatccacctggactggtacttacaccacgttcactaccgatgaggatggaagtactattgctgtggtaccatcgtctactatcgactccacatccacctggactggcacatttactacgttcactaccgatgaggatggaagcaccattgtcgttgtgccatcgtctactagtgaccaccacgacaagcccggggccagtgaaaccattttgacaaatggtggtatttcaactactgttgtgacggtgaccagttgtgacattgaaaagtgcaccaagactactgctctgacaggtgtcacagagacaactctcacgaccggaggtacgactacggttgtaactacctactgtcctttgccaaccgacattgtcactgtgaagacaacaagcattagtggaagtgaggttctgcaaacaatctatacggcaaaacctagcaacgatgtaccggatgtccaaactttgactgttacaatcacaagagaagtgtgcgatgcttctacctgcactcaagctactattgtgactggagagattttgaagactaccactcttgcagatacgcattctacaaccgtggttccagtgtatgttccgttagacactgatcagccgttagttgagctgagcactctcgaaacggtattaaagtcatccgagttcgccagtggaccggccgtaacggctggatcagcccagcagccatcgtaccaatctggtggggtagcggaaagcagtctgacagtttccgagtttgaggctcacagtacatctgacacagtctctcaaccttcaacgatttccccgcaaactggagaagcaaatgccctgagatggtcatcgttctttggagcagctttggttccgctggttaacgtgttcttcgtttagatgcccctttttatttttcattttcatttaactttatttacttctaaatgtttttcttttttattgtgtgcttttgaaatctatggaaggcttcatattgattttcattccatcgtaggacgtttgaaaacttggaatagaattgtttaaaccgattgatcaccccctgttagaatcacgaaactttacgaaaactttgctgccatcgcgaacgatccttttgcacacctttttttcgaaactttccgcgcttaatgagagagaaacacaaatttgcccccttgtgcgtcgaacatgttcgttcggaccatcttggacctgccgtgcatggttatacgtcgcagcaagctatgtgatgtcattgaagttcgttaacgtcaatttattgttggtagacattgacttgcacatgaaatgatacaaccacacacaccaatgggttttacaaaagaaatatgatgcgaatcacaaaatgaagcttagaattgttggcgcagggtacataggcattagtccttcctgccagtttgccagtagtttgcatctaaagtgcagaacatgaaggtggcatattgaggagtatctgagactgtgtttttgaacttgttcataatttagagcagacactgtatcaaaatgaaggctatttaaattgccgaagtgatcatcctatcgaccctaccctttgttgagtaacttcaacactggcttatattatctgcactgttacgtttagagtcattaatcgatgaacccagcgatgttccacacagagacggttagatgaaggaatttgataatcgtagagcaaaagtctgttgattccagatgttctcaatactcaactactgatagaaatggaaattttgctgaaatacggcgaaagcaggccataacttctgtcgtttgtactgaaaccatatcgaaaaatacacaaataccactcgaacctgctaaccgggaacgtgcatcccaaatcctgagctcgaaagagcttggaaagaaggtcactgtacttttcaaggatttgttagcttcgctcgctcacttgtattccaagaggttgatttgggtaattagactccacgtgccagtaatgttggggatctgtgtctggtgcaaaaatcaacaggtgagaatagtttatttttgatcctatcatgaaatgcaatcaggggttcattattcttgaaacaaattccacgaaaacgccaatcatgtcgaatgtttcccatagattcaacactgtgatttgagctctgtaattcggaggcaatagcctattttaacgcagcagccataggcactggacaacaattattttgccaaggtagcaaacactttcaactttaactctaaagttactttacttttgcatggctgttcaaacccttgtagagcaggagacacagacaacaccaactgcgaggcaaagtggaacctggaactctctgcaggtttcaaatagtatttgcatgcacgaaaggctattaacgcgaacaggattgcagtatgcataaggccaaccaatagaaaataaatgatactagctggcaattcatttcgaagtatacttggtttgaaaacgtatatgaatggaacaaaaataacatcccccaatgcattagtgcgcagcgcttggtctttcttctggcgaacatcaggtctgggccttgcaatctttggtaggatgacattttctttcgagttggacttggaagatgcaacttgtcctacagtcaatacgtcaccgcaatcatagtttcttcgcaagaaagtgaaagattttgcagcaactagacctttgcaaccagaatgtggattaagcgtagatgagtaagtgatttccttcaagtgaaggatacagtttatattgatccgagagtgagtaagttgaaatatttacattaaggtttggtatctttatgggtggcggcaaagaatgtcatcaatagggatacaagatgaaaaataggtagtgaaggtgattgttgtacagctagactacttgtttagtcaaagtgaagttgtttattaggttaacttttagctcgattatatctagttaagtagtctttgagagaattcaggctgctatattgacagagatagattagcaaaacttaaaagattagtagttaaactttgggcctatattttcagtttccattggtgatttgaaattagtgttgtcagacgactgaaggtagtctcatatccaagtacgaaaccagaagactaagtgttgatgcacaaagaatacaaatatacgtagaaatcctccattgcatttaagaaaaccatgttttttgaggtcagaaacatgattgttatgcctaaacatttagattaagagttaataaaggcaatgccgcaatcatacaatgatatacacaagagaatcacaaacgaccgaaaattaatcaaagtttcgttttggtgtcgtagaatattctattctgaagatggtcggctaaatatgtaacttctgccatttcgattgtttatgaaagaaagtgatcaaatacgcaaacacaaatctaacttttatttagtctttgaccaagttgaccaagtacgtagggaataggaattacagtagtataatatcatatccgcaatatccaatggtgtaatctccttagttcacctgtatttaaccttgaggaaacacattactattactgtcttcatatttgtatttggataacaacatggccaattgctatgataagggtacatacaatggtatctacacaggttctaccaatccagaaaaacgagatgaagatcattttggctgagagcggtatgacaaagaaagccataggtaagtatcgtaggtgtaacaaacgtatataaatggttagaattattataaatttgtcctctgggtctatctcatatcagagttaaattttggtattatggaagagtatactaaatgtagtttattactattctatttcagtaattgtaaataagttaggtaatgttacccctccgtattgaacaataaccaaattaatacacgttgactaattgtgaattatactcaaatacttttactatcgatagatatttcacgcttatagttatgcaaacaacctagtgatttataaatttatgtatgtgctttgcttataccagttcataatttgaaatcaatggaaagacgtttacaagaaatttttcggaatacgctcgatggacaaggggtttttgtcaaatggtgagcacttctcatctctcgaaatattgagaatacttacatatctactaaacccttataaaactttcatatggactttgtgatcgaaaaacaacagaacatttgccaaaccaaatcacctcttcaatcccacctaaaaaagaccaatatctctccttctcagcaccagcgactatgacaaaaactggagaaaactctgcggcaagagaaaaaaacaacaagtccaaccgcgggagactatgcggcgagggtggccggcaagcggagcgcagctgggcggagaggctggggggactcaagatgatggcaagtccaaccgcgggagattatccggcgaaggtggccggcgagcggagcgcagctgggcggagaggctggggggactcaagatgatggcaagtccaaccgcgggagatcatgcggcgagggtggccggcaagcggagcgcagctgggcggagaggctggggggactcaagatgatggcaagtccaaccgcgggagatcatgcggcgagggtagccagcgggcggtgatgctgggggagtcaaggtgaggtcaggtgatgtttctcaagtttatcgagtgcgtgcaagtgcaagtccaggtgggacagttttttggaagtggaggtgtcacgtgaggacttccaaggagaatctcaagtccaggacaatcctcacagatccaggtggtcaatggaacggctcattgccgggaatgcatttgtgggcggcaggccacgggagcggagcaggacagggccgcctgttggactcaacaaggagggtctgtcggggtacgacggggcgtggttgactggtggagatttgcgtccaccaaccagcgttgttgcggttgcttggtacgcttggtgggtggttggctggtggagatttgcgtccaccaaccagcgttgttgcggtacgcttggtgggcgttgactggtggagatttgcgtccaccaaccagcgtcgctgcgctcgcttggtgggcgttgactggtggatatttgcgtccaccaaccagcgtcgctgcgctcgcttggtgggcgttgactggtggatatttgcgtccaccaaccagcgtcgctgcgctcgcttggtgggactaagacgacacaacctcgctgcgctcggtgtgtttccttcggtggatgttactccaatcgctcgaccggggcttaatctcagcagatcgtgacggcaaggccactcttctgcgtacaataccctgtcggggtcaagtcgtgggcgggagattgtggaatgctgctatgaaatatatccttcttgtacactcctccccaccccagcacagattctgacttagaggcgttcagccatgatctgacggacgtagcgtcggggctgctttgtcaggcagccccaaaaaccaaatgtccgaatgaacggttcctctcgtactaagttcaattactgccgtggggctcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcagggtctgagggtgtaaaggatcgataggccacactttcatggtttgtattcacactgaaaatcaaaatcaagggggcatttgcccttttgctcggctgaagatttctgttcttcatgagccccccttgggacatctgcgttatggtttaacagatgtgccgccccagccaaactccccgcctggaggtttctctgcgattagtggaggaactataggggtgggggtatttcacgggcgccgccgaaacggctcccccctatactacaccccccatgttcccccacggcccaaactagagtcaagctcaacagggtcttctttccccgctgacgcgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggatgaatttcttcactttgacattcagagcactgggcagaaatcaggtggtgtgcacatccgttgggactcgcaccaccctatgttttaattagacagtcagattccctttgtccgtaccagttctgggttggtcgataaaagcgacccccagagccaatccttgtcccgaggttacggatccaatttgccgacttcccttatctacattgttctatcaccagaggctgttcaccttggagacctgctgcggttgtcagtacgggcgggggaataacataaataaaccaaattttcacgggatgtcggagatgcgtagacgcaccaactaggggcacgctcttcgggttttactgcccttcgccggctaaaccatccaggcacaacgcccttaagaagaaaagaaaactcctcctacgccttccgccaccgtctttggccgtctcgtgtcaccactcattcccccggagacagaatcttgactgtcttccctttcggacgctaccgtacgcgcgcccttaggaccgtctcacccacggaggatctcccttcccgtggaacctttccccacttcggtcttcaacggctccgttgaatattgctactgccaccaagatctgcactaggggcggttccaggcaccttcacaagcacccttccacaccacccccacgcctgcctactcggagagctttctgttctccggcagggtataggtagcacgcttagcgccatccattttcagggctagttcattcggccggtgagttgttacacactccttggcggattccgacttccatggccaccgtccggctgtccagatgaaccaacaccttttgtggtgtctttgagcgtgcttccggcaccttaaccctgcgttcggttcatcccgcatcgccagttctgcttaccaaaaatggcccactgagggggtctagtatttgaagaagcctcactaaagcaggtcttcgccacacatttaaagtttgagaatgggcggaggtcaaccccccgtccccctaatcattgctttacctcatggaactaaacaaccacccccccgctatcctgagggaaacttcggcaggaaccagctactagatggttcgattagtctttcgcccctatacccaaattcgacgatcgatttgcacgtcagaaccgctgcgggcctccaccagagtttcctcaggcttcgccctattcaggcatagttcaccatctttcgggtcccaacaggggtgctggctcactcaccaccaaaggtgagtgtcgctttcgcttcgcgcttggatgttcgtccgcacactcgcaccccggttagactccttggtccgtgtttcaagacgggcgcaggaccacttgtcgtggccttgccttccctcccccaatttctacgcactgtttcactctcttttcaaagttcttttcatctttccatcactgtacttgtttgctatcggtctctcgctgatatttagtctttgatggaccctaccacctttagagctgcattcccaaacaactcgactctgtcggctgggaaggttgaccgtgctacggggctatcaccctctttggcggccgttccaggcgacttgtgcacattgcctctcccaaccacgtcaatacttcaaaggtggacttttgccgcttcactcgccgttactgaggcaatccctgttggtttcttttcctccgcttattgatatgcttaagttcagcgggtaatctgagggggcgggggagaaaatttgggggctgacgattgtattagtcatcctttgtatttaaaccacgatagtgagagtagactcaccccaccctccctgtatgcaatgtgcgttcgaaaattgatggttcacggcggcttccaggacgtatcgcggatcgctgcgttcttcatcgtcgcgagagccaagagatccgttgggaggagatttaaataatctgattgtgtatatgtattatcctagaagttatactcagtgtgtaataaactcgctcgcgcagagtttcttgtatgatccttccgcaggttcacctacggaaaccttgttacgacttttacttcctctaaatgaccaagtttgtccaagttcaggctcgcgccctcccaaagcctcactaaaccattcaatcggtagtagcgacgggcggtgtgtacaaagggcagggacgtaatcagcgcgagctgatgactcgcgcttactaggaattcctcgttgaagcgcctcttgcaaagcgctatccccagcacgacggagtctaagattccccggccatctctggcaaggactcgctgcctccgtcagtgtagcgcgcgtgcggcccagaacgtctaagggcatcacagacctgttattgcctcgcttccgctggcttgcgccagttgtccttctaagaagatcccccagcaatgccaggtaacctagttaaaagccaaggtctcgttcgttatcgcaattaagcagacaaatcactccaccaactaagaacggccatgcaccaccacccacaaaatcaagaaagtgctctcatcctgtcaatcctcattgtgtctggacctggtgagtttccccgtgttgagtcaaattaagccgcaggctccactcctggtggtgcccttccgtcaattcctttaagtttcagccttgcgaccatactccccccagaacccaaagactttgatttctcgtaaggtgccggggaaggctattccccgatccctagtcggcatcgtttatggttaagactacgacggtatctaatcatcttcgatcccctaactttcgttcttgattaatgaaaacgtccttggcgaatgctttcgcagtagttagtcttggggcgatccaagaatttcacctctgacgccccaatactgacgcccccgaccgtccctgttaatcattacgcggccccgaaccaacaaaagaaccgtatcctcttctgttattccatgctaatatattcaactactgccttgaacactctaatttcctcaaagtaacgtccgttcaactacgagctttttaactgcaacaactttaatatacgctattggagctggaattaccgcggctgctggcaccagacttgccctccaattgttcctcgttaaggtatttacgttgtactcattccaattacaagaccaaaggccctgtatcgttatttattgtcactacctccctgtgtcaggattgggtaatttgcgcgcctgctgccttccttggatgtggtagccgtctctcaggctccctctccggaatcgaacccttattccccgttacccgtagaaaccatggtaggcctctatcctaccatcgaaagttgatagggcagaaatttgaatgaaccatcctaagattcgaaaagttattatgaatcaccaaaacgaaggttttatctaataaatacgcccgagggctgatcaagtattagctctagaattaccacggttatccttgtagcaacactatcaaataaacgataactgatttaatgagccattcgcagtttcaccgtataatgctatacttagacatgcatggcttaatctttgagacaagcatatgactactggcaggatcaaccagataactaggttttgaagctagataaagtgtttgttcccccggctcttttagagttagtaggcttaaggccctacgattatttatctacgtagtaatccacttttcccttgtgggcatgttaggctggctcgtgtctcccgaccctttgccagtgttcccatgccctgcgttctcagagttttcactcttctttcatgtatatccttccgggtccttttcgtcgggtgcaaaactagactaggtggatatgcgttgggtggactagcggagtgaattggtcgactgtttgttaggagtctggtgtgcgcgagacgtccctaacaaatgtgcgatttcgacttacgatttttcagaccgtgagatgggacaagtatccgcgaattgccttgctgggcattctgggcgggaagaatgtttcgctggaaggggaactttagattacagggcaaacatgcaaatcccaggcggggaaagcgctgatttctgcggttcaggccctgatccggagtttgagaaccccaacatcagaatacaccaaaatgggttgaggtggtgaatgctatgtagtgaacgcttatgtaagtgagcacttatgtaagcggttgaccattatgtaagcttgtggtttacgtaaactgttatgtaagctttgaccattatgtaagcttgtggtttacgtaaactgttatgtaagcttgtggtttacgtaaactgttatgtaagctttggccattatgtaagcttgtggtttacgtaaactgttatgtaagctttggccattatgtaagctcgagaccagttaggtaagcagattgatctattatgtaagctttgaatacttatgtaagctcgagcccagttatgtaagcttcgaccattatgtaagctttgaatacttatgtaagctcgagcccagtatgtaagcagattgacccattatgtaagctttgaacacttatgtaagctcgaaaccggttaggtaagcagctttgtaagcaatctggacaattatgtaagcgggttacgtaaacagttatgtaagcaggaaaatttcaaacgacaaaacttggggtctacagacacagtagccagaagattgcactaccattcgactcctcatgatccactctttcgatccatgtagttaggttaccgtttttcctaatatttaaggatgttgaaaattcattttcatttttttcgtttttaagattttctcacaactcttccaaagattactagttgacttttcaaatatttagggtatttttctcactttttcctagcaaactccaattggtgggttcagtgcaatggagtatcaccttgcaaccacaacgtaatagctaacttgtggccaccatgtctggttgtagagataattggattctaatgtggatcacatgactactcacgtgtcaaaaacccaacctgacttggcccagcttagcaagaatatttcgaatccactcttgtggcctagtggacaactgggaaagcttgcgacgcagtcgtttttggcgatccaggcgtagtactaggttcgagcctggtcattcagatggctcagaacttgaggttgacttgagttccaggttcgagtccaggacgggttggttggtgtcgtcggctttcggttggtctttgatcggcactcggcatgatgatgttgagactgacgcgtcgactggacgtgtttagtacacggtccacgcgtaatgtgtggtcttgtatcttatcttgtctggtgtcttttgtctggtatcttatcttatctgggatgtgtattatgtaagcaggagaaaactctgcggcaagagaaaaaaacaacaagtccaaccgcgggagactatccggcgggagatcatccggcgagcggagcgcagctggggggagtcaagatgatggcaagtccaaccgcgggagactatccggcgggagatggtccggcgagcggagcgcagctggggggtgatgctgagggagtcaaggtgaggtcaggtgaaggtctcaagttcctatagtttttcaagtgcgtgcaagtgcaagtgcaagtccaggtgggacagttttttggaagtggaggtgtcacgtgaggacttctaaggagaatctcaagtccaggacaatcctcacagatccaggtggtcaatggaacggcaggccacgggagcggagcaggacagggccgcctgttggactcaacaaggagggtctgtcggggtacgacggggcgtggttgactggtggagatttgcgttcaccaaccagcgttgttgcggttgcttggtacgcttggtgggtagttgactggtggttgactgttggtggaagaatacaagttcaccaaccagcgtcgctgcgctcgcttggtaccgcttggtt

SEQ ID NO: 110 - DNA, 2348 bp, Pichia pastoris
gcaaaggacagtaggttgttacaaccgtagtcgtaccaccggtcgtgagagttgtctctctaacaccagtcagagcagtagttttggtgcacttttcaatgtcacaactggtcaccgtcacaacagtagttgaaatactactgtctgtcaaggtgctctcactgggcttgtcgttgtgatcactggtgattgaaggacaaatcacaacggtgctaccatctgaatctgtagtccatgtcgtgtacgatccagtccaagtggaggtcttatcggcagtgatggtagctggtggcacaactacaatagtgcttccatcagagtcggtggtccatgtagtgtagctaccagtccaggtagaagttttatcaccaataaccgtggtcgactcggatccctcgagagcaaagttgtaaacgtacccttggtactgagtcaacgaggcgccatttggtagtttgatctggaagtctagcaaagcgtgctgcgatatcgccgcaatcacaactcgtagagggtagtactggtcagctaagaggtactgtgtagtgcttacagtctttcccaagtctctagtgttgttgaataacaagacatagtcgggacttgtttcaggtttcaaaaattgcacctcacgcttttgcaaagcctgatcggcagcagcaggactgcccacaaacaaaattgaattgtagtcagtgctgctgaacgaaaagacatactcaccatccactggagctctgaagaacccttcatactctatggttgcgttaacgtatgatccggtattacccaaagcatctctgtcaatgtaataaggccagtttgaatccgtgtcaaagttaatgtcgctgacgccagtaactgttgtcactaatcccaggttctcataaccatagctcaggaaactgatctcattggcaagctcgtagttgtcagcgggatagtggaacacttcaacattaaagccgttaaacacagacactccgtcactgactcccgaactaggaacgggtgtttgcataacgtttgttgaagtactactttccgtaggtacgagctcaacgactgtgctgcttccgccatcacctacttcagtggtccaggtggtgtaacttccagtccatacagaggtggtgtcagctgacggagtatctgccgatggagtaggaacctgttcaataaccgttccatcctcatcagtggtccaggtggtgtaacttccagtccatacagaagtggtgtcagctgaaggcgtaggaacctgctcaatcacagttccatcctcatcagttgtccaggtggtgtaacttccagtccatacagaggtggtgtcagctgacggagtatctgccgatggagtaggaacctgctcaatcacagttccatcctcatcagtggtccaggtggtgtaacttccagtccatacagaagtggtgtcagctgaaggcgtaggaacctgctcaatcacagttccatcctcatcagttgtccaggtggtgtaacttccagtccatacagaggtggtgtcagctgacggagtatctgccgatggagtaggaacctgttcaataaccgttccatcctcatcagtggtccaggtggtgtaacttccagtccatacagaagtagtgtcagcggacggagtaggaaccagctcgatgactgttccgtctgcatcagtagtccaggaagtttcagaacccgtccacatcgaagtgatgtcagcggacggagtaggaaccagctcgatgactgttccgtctgcatcagtagtccaggaagtttcagaacccgtccacatcgaagtgatgtcagcggagggagtaggaaccagctcgatgactgttccgtctgcatcagtagtccaggaagtttcagaacccgtccacatcgaagtgatgtcagcggatggagtgggaatctgctcgatcacattaccgtcgtcatcggtggtccatgtagtgtggtcaccagtccatacagacgtagcgtcagcggacggagtaggaaccagctcgatgactgttccgtctgcatcagtagtccaggaagtttcagaacccgtccacatcgaagtgatgtcagcggacggagtaggaaccagctcgatgactgttccgtctgcatcagtagtccaggaagtttcagaacccgtccacatcgaagtgatgtcagcggatggagtaggaaccagctcgatgactgttccgtctgcatcagtggtccaggaagtttcagagcctgtccacatcgaagtgatgtcagcggagggagtaggaatctgctcgatcacattaccgtcgtcatcggtggtccatgtagtgtggtcaccagtccatacagacgta

SEQ ID NO: 111 - DNA, 15618 bp, Pichia pastoris
agtgatgtcagcggacggagtaggaaccagctcgatgactgttccgtctgcatcagtagtccaggaagtttcagaacccgtccacatcgaagtgatgtcagccggcggagtaggaaccagctcgatgactgttccgtctgcatcagtagtccaggaagtttcagaacccgtccacatcgaagtgatgtcagcggatggagtgggaatctgctcgatcacattaccgtcgtcatcggtggtccatgtagtgtggtcaccagtccatacagacgtagcgtcagcggacggagtaggaaccagctcgatgactgttccgtctgcatcagtagtccaggaagtttcagaacctgtccacatcgaagtgatgtcagcagacggagtaggtacgaaatcaacataaactttgcatggttcacatacaaaatttgaactagcgatgttgccgggctcatcgatcgaagcccaataccacgagtattgtggagggttcttataatagcagccaagcaaaggttggacatttatagatgtcgacttaagttcttcattctcgatataccagtttactgaagtcgtttgatcatactgtacaccaggcattataactgagagataggtgtactcaccatagtcgtcagtaacgagaccaagatatccaatatactcatctgtatcttgacgataggcgttgatttggccatgttcgtctggaagatgatagacaactgtgatttggtcatcgcctacataggcatttccataatcaaagtgtgactcaagcgcaccgttcgccattgctggaagtgttaagttaccatagttgctactcaacaaagaaggactattcctaataggttcctttgcattaagcaacagctgaaagtctcccacctggcccaaaacaatagaagcataaataggtaaaatgagaagatacctgaagttcattgtcattcttttttcctggttttggtttttagtagtttgctggcttaactgaaactcttaagtactattgcgtttatataacgcaattttagatgtaatttttttagtgaatttaaacccccggctctcaacgattaaccatagacagaataggcaatcctctattacaaaataaaaagcactcattcttgcatgttccccaatcaaaagaaacaaaaaaaatccacttcgtgtatattccttaatacaaacacgtgcagtgcatctaagaagcagaaacttttgacaaaaccgatccttaaaataatgaaagcagctgggttgatcaactgttataagatatagatcaatccaatgaccattctgttgtttagaaattgtgatgcacttttggcactttagagcggctctgatttttccataaccttgtgcaacagatcgaataaaaatgcttggatgaactttgcgtaagcatgagagggttgctgcaatcaaaaaaaaaaatgataaaccctaatcttggaattggcgtttcaattcaagcactaacaaaacaggcagttagtactctaagatgagaaggatttgcattgctgcatattcctaaactaataaacgcgctaaagtttatgtcgtataatgcaggatatgcaataagtttcaccaaatgaatttttcgtacacctttcttgactaataatagataacacagccagaaaatttgaaaaatcttagttataaatcggtcaaagctatgcgcacattattttaaaaatcatgtccagtctcagcatttgaaaagctgctctcttggagccatgcatattacgttctgcatgaatgctaggatctaatcgctctaatcccagccagtgtcacatacctatactttttctttctagctgcagccgtgtgctatgcttggctggcatgtcgtcgtgcttttcgagtctaaattactatttgggtgaaacaacattgcacttcatgcaatctagctgaaataggcaagattcaaataaaagaaaaaaaacaattgtggttgttgcatgaatcaaactgataatagctaaagaatcgcaataagtatcaacacttcagtagatactccagacacaacactaggtttagggctagatgtgggacatattcattccacaaattttgcttctacccggatgagcagctggtatctcagtacaatagtttctatttatttgttagaatgaaataaggttctggcgattgtctgatgattttttctactacatcaatattttacgctttgtgctggtctactttctcatgcacgcccttttgaacgcaacaattctaaaaatttcagaattgtcgtctgcacatacgaaataggcatctggtcagcaaaaagtaagttaaccgtataaccgcatagacttgaattactaatgttctctggtctatatcatagattcaaaacatccagcatccaacatactgagcctatttttttagtgcccgactgaggattgataaccagctaattcaattaactgccaaaaattactgcaacatctaccggaccgcaaacctaatagcaacatttaaatctactgccataaaggtaataggatcgtctaaattaagcagaaaattttgactgattcttacgcggttttgtgcatgaattatacagcttgtagcttgccaatttcgaactcatcgttcagagcagcaatgtggagaatatgaagacgatttttatagaatttttggaagtattgtaaatctggaataactacagtatgctcctcggctgggtaatgttgagagctcaaataaacctttcgcattgtcataaatggcaaatctgttacaggatcgagccttaatgtctctttcaataatggtttcctttggttgttctcaatatagctgagcaaatcacaacgagcgctggaacttcaaatagtcagctcttgtcctaaagacaatgatagcagaaataaaatttcaaacccaaaaggaagaagtttgttatgatcaggttgttagtatttttatctaaatccaattctggcctgagctttaaatataagcgaataaggccttagagaagaaaacaaacaaaactgctgtacacatgtacacatggagaatgctccaataacttcatccgtccttcactataacggaatctccaaaaagagattgaagatgaaatttcaatacaacctcaactgttttgcttagacatttgagtaaaccagcaagaactcgatatacccgaatcgttcgcaatattgctagccttctatatttgagcttctgtacttaatgtgtttacttttatctcattataacgcagtgctttttcaaaacttgaggaaagatatttcagtctagattttgaatctagcaaccagcattgtcagatgacagaacttgaagttgttgcataatttcaaaaaaataatttaacgaattaataaatgcaatgcagtacacgtccgtaatgcaaatattggaacatatttcccatctgaattctggttgtgccatgcaactaataaagaagtctccttagtttaatcaagtgttgaaaacagactcagtggatgaactctagcgtgattaaagtacataaataaagaggacttgctgaatttgaaaaaagaatggtactaatatttctaagcctcgagaaacgtaagaccaataaaaatgcgcacacacagtctccatgtctatatgggaatacatgcagtaatttagagctgcgtcacataatagtgcataaagatcatttgcgtctagcatggtcattttgtgcagatagcaagataaattaggaaagtgaggtgtaaatccgaagatttctatataagggaatagactaaacaggatagtaccataaataattcttagttccccacttgatttcgtgcatattttaaaaccaaatgtatgaccatcctgccacctcaagaaggcacttatgcatatagagggtaacgagaccagtatcaatgtatgtaataaaattttagacactcgactacaacggacaccagagatgagacgtaatctttagttaattttgctggtgaaccaaatcatcatgcgcatcgaagtacagttaccagcttgggttaagatcctacttcgaagggcacttaagctaagcctgaaatttaattcaccgcttgattctactatattttgaaacatcggacaagcgtccgtaaatagaaaagtatggaatgtgatccgattgaaaatcatttacatccaactagcaaatatacctgtaattaaaccctaagaataactatgcttatgccaaggagtgattcttctcagaggagcccattaaaaatatatagtttaacgagaactttaactaattttgcagtttacgtactaggtgatggtgtcacgtgcactaaaagataaaattcttggcttagctgattttggtatggctgctgaacgtaaagataatcaataaaattaggatatactacaaaaataccaatatatgtatagatgcaaactgaagaggtgatgtaatatctgaaaattattattctcttgacagtcaattgtgatccagcatggctagaaattgttcaaaatatattcactgaaaacacctcgtcgtagtacaaagggatagatatcgaaattccacaaatagatatgcgtgtagtgatggctcaagatggtttagcatgcaagtactttgctgtgagaaaaaaagaaacaaagtcgcgcatgctgcataattcccaatcggaataagatccaccttgcagcaaggctgaagtcactctatgcacaatgttctcatcttatttacttttgggttgaaactctgttttagtggttttcattttttagatttgtatccgcatccttgttggctttcaatagtgaaccgaaagaactgttcagtttaaacaccagtcagcttgttttccgacgtccattttcacatatcgacaatctcaagcttgtatcactcgaaatgcggttgtctttagcaacacgagaaacaccgtctaccggtacatcgccggtgtttgctggtgacgaagatcatagcagtgccaacaatagcagtagcaacactttcaactatgactactatataaaagaagaactctctggaaatctcctggaaacagccttttttgaatctccgattaatgatacaatgctctgctccatgttatcgtatccaaaaattgctggtactgagaaaatacaagaaccagaccatgaactgcagcaacacaggaatcccttcggttgctgccaggaactcaaagctgaattggccgaacagcaagagctgtatctgctgccaaataaacttaccaagaatatttttaattcagggtctcctgtgttcatatacaccaagatcccacaaacaagctcggttcagtcatttgtggatgttagcaattctttatttgccactgactccgccttgcctacaagttcatttcgtgtagactcaacagtcgacatatcgtttgagcactcaattcaagattcatactgttaccgttcaaactctgcagaaatagcacctccatccacagcactctcttcagggactcacgacctggtatccaccgtggaagcatccacgacgttactggaggcagccgtcaactctaaaagacgaatgcttgaacttagacagcaaaacagaatcgaggatctcagtttttcaacatcaatattccttgaccattcacgcctaccgttggttcgtgggcgtagctttggaggaaatagcagtagacctcccaagacgccattgattcctgggacgcggtacgttactgcccgtttaagactggaaaacagcacaagtgaggatatgtgtttgccccagtggaacaaggcggaactcaaagactctagaagaataatccgtattgaaagaagataccagtctgatgaaattgtcgcttccttttccatagttggatcggccatagagtacccaaagactaagcctgcattcgatcctgacgtcaaggttttggaagtctcgtgtctaaaatgtcccaccaacgaaaatgaacctaacgaggagcgatttgtcagtgaatgtacgtcagatgaagcacgaacacaacatgccttaacagaacccctaacgtcaggcttcaacagagaaccgaatggccataaccctaaaacggctgggaattcaattggatgcaggtactatattaccagtgtcgaagtcatcaagataatagaactactgattggaagctattcaacctcagaccccgtgcaaaggagaaaagagagaggccgtatacgatctaacttggtgcagttctggtccaaacacctagtcttttcctcgaagaactctatgaagcgccgttccgtgccaacaggcaacgatgcttatcttacggagctggagcatcgtattaacacttatgacgtgagaaaacctcgactatttgacaagagtgtcaagattctggaatggtccaaacttgggccagctttgcagcgggctatccaaagctattacatggttcggctagataattccagcgacataactgcaacaacaaatagcagctaagtttggtcaaaactgtcggtacgaagggacaagttcttgagcggaattgagtagcaaaaaatggttccttttgcttcaatttttaaagtttcgactttctttgaaaggacgcagataattggctgtattcaagaatcagtgaataacaagatgtgtgtatgtacatggtgtagaacacggctaggttattgagataactctctcttatgaatcttagtttaggtgaacttgactagtacttcttgcaagtactttcttcataagtacaaagctgcccacagtgtatataagcatgcaccagataaattctacagggagatactaacaggttagttagcgggtgcgcccttgattgcccacaaaccatgtaggaactgatatgtattttgggaaactgagctgctaaaaatctcactgctctcatgacccaactcgtgacaacaacctcaacacgcacaatttggactccgacacgacaggccaagacacgtcaacgattaagctggggtaacaatccatctcatcgcgcgaaactttatctcatggggacgtgcagtcaccaaaaaatccaggattgatgacgaaaccaaagtcgaccttgaccgtaaaacacataccaatgcaaagttcgcattcctataactagattctttttgatgccatgtctagcaaaagaatcccgcctaccgcccaatatgctgaactatgtacagccggacctagtactacagtagcagactatgtgcggaactcaagtgatgcactctttctccacagaatcacggtcttttatcctggaacactagaacactagtagttccacaagcagtaagccacactaataaagaagcatgcgttcttgctgcagattgcagtttatctgatagtaattgctgcagcagaacaatatgccatcttttggaactggagagataaaatgaaaattctcacttcataccagtctaggtgggtctaatggacaggataagtgatcttattgttgatatcaagtcttcaggttttcaacactgcgcaaggcattctgcgataacgactagggctcctgcaagcagtataagcgttcaattacgaggggtcgcaacagacaaatcggagatctgaggagctgacaaagtgtaccttaaacaggtgcaacttggattaatacagtcgggcaacagtacgcaaccgattctgggaatcgtacaactatcgacagaggctagtgacctacggtgcgccagtcttccatatttgctgaaaggtcacaggatcattgctacggtggtgtattcaatgtcgacgatggagcactgttgtttggggccattgactacaaatattggggtgagctttgaaggcacctcgagcgagaatccactcctttggattttgatctctcacattagactcaatgaaatcttgctagatcgtgcttgaactgtttcaaaagataattcattgaacttctatctaactacgtcctacgaaaacgctactccttgactttacttagactctcaatttcaatcacaaacctatacttcacatcccctttgataagccgctcgtatgcatcgttgatctcttggatcgcaatcatttcaacgtccggcgagatctttttggcggcacaaaagtcaagcagctcttgcgtctcttgtatccctccaattcctgagcctgataccgagcgtcgcgcagatagcagtggcccagtgttcagtggcgttgcctggatgttgccaattaacccaagcagaacgagattcccgtctcgtcgaagtaggctcaggtacgggttcacgtcgtggtcgtacggtactgtatcgagtatgatgtcgaactggttgcttgcccctgcgaccgctgcttcgtctgtggtgatcagcacttcgtctgcccccagtcgtcgcccgtctgtggcctttcctggcgaacgagaaagtagtgtaacgtgtgcccccaggcctttagcaagcttgatacccatatgacccaatcctccaagcccagccactgcaaccttggacttgctgttcactttccaatttcgcaacggcgaccacatagtgattccagcgcaaagaagtggtgccgcagacttcacgtccaacccgctgggcactcgcaacacaaaactttctctgacaataatcgactcagaatatcctccataaagacgcttgccatccttgcggtcatcagcgtcataagtcagagttggcgcgttttcacaatagttctccagtccgtccttgcacgatcggcagttcccacatgaatccacaagacatcccaccgccgcaacatctcccagcttgtatttggtaaccgatgtcccgactcgggctaccttccccacgatttcgtgtcctggaacaagtgggtactgtgaacctccccagtgattccgacacttgtgcaggtctgtgtgacaaactccgcaatacagaatctttatttccacatcgtcatttctgagatctctaggctcatatgaaaaaggtcctagctcaccactggcagagggagctgcgtaagcgaaaactgtggtcattttggttctgctgttcaaagttttaatgatatgaattactatttgcgaggaaattgatactcatcgagcagtttaagtactgctgattttctcgcgctatcagcaatgacagtagacactctggggagttgattactaattcttgtgcaagcgctattatctgaaaaattgtcaaaactgccacttatgcgaaacttcctagataagttcaaagctgtccacgtgtatacagaaaagaatgcgccagagacattctacagggaggtacttacagtaaacgactgcgcgattgccaacaaactatgtaggtaacatgtggaaaattgtctccacactagataggccaaagagaacgcatcatcgttcgcttttagtatccaataagatttcatttacattctttttttaaatgatcttgcccttagatagacatcgatttgggctcctttctgagaacatgtgtggggcaatggtaaccattaggattcttcatgagataatcttgatggtaatcgtcagcatccaagtaactagttaacttttccacttgagtaacaatcttatggtgcggaaaccacttcttctgtgcttctgccagcgattgctccgttatctctttctccttctcatcgaggtaaaagacagcagatctgtattgacttccaatatcattaccttggcgatctttctgagttgggtcgtggactaggaaaaagaaatctatcaactcgttaaatgaagtgacgtctggattgtatgagatttgcagaacctcagcatggtgggtcattcccaggcaaatctgagtgtaagttggattggccacatttccattggcaaagccgacttgtgtatcaacaattctgtctttaaaatgcattttgtagatgtgctctaatccccaaaaacagcctccagcgactgtcactactttgtcctgaggagattttctgatgttcgacgaaacaagactgctattgacgggcatatgagaagaactacgtttgaaaaaatttcggaaagagcccatgaatgcaaaaccgcttgccttgcttgaactgggagcaagcaagaatatatatcctttcattccgtttcgtttaatcaaatgatatttgaaattttgggagctgtactgaaatgtgattggttcatttgatatgaaattgatgtgaaatggtaaaagtttttactcttgttgcagagctcatcattaatatggccaccgtgatcctatccttctctcaacccgttggtcgcgaaagttcttcaaatcttaggtaataataactagggtcgaaatatcgctaaagctttctttaatcctactagttggaatatgaggttgacaggaattactgcttagttgcaaattgtgaaaaagaatcgctaggttatatatgcggcaatttatattgacatcctaataacaactctttgcaaacttgatccagagccagtttttcccctcaaagtggcaattacggattcccaacttctaatccggtgctaagcctcaagggatgattatcttgcgcaacgctcctagttgtcgcttgcagattccaaacatgaatgcctgagaatcactttgcgcgatgcctctagttaccactcacaaagaatgaatttactctgattaaacagtaattgcatcgacatgactaactggaaagcttcattgactccaactcagtatcaagtgcttcgcttgggaaacacagaaagaccttacaccggacagtatgtgaacttcaaagaaagtgggaattattcatgcagtggttgtcaaattccactttacaaaagtagcaccaagtttgactcttcctatggttggcctgcatttaatgaagcaatacctggagcagtaaaacgtggaagacaattcacttggaatgcgacgaaatgagattaggtgcgtgatggacattttggtcatctttttgaaggtgaaggattcaacagacccatagattccagacattgtttcaaaagtatcagcctgaaatttcaaaggaaaaggaaaaagagagaggaaattaaaataatgataatagcctttagtacttgttttttgtgagttgctatttcaccaagaaagctcttatttggagagtttctagaatgaatcaatcagggttcttggaggaggcaaacttatcgccgactttcctcaatttatggatctattctacgtcattctcagcctctttgacaggtgtgagcatgtcctttgttttagtactgtatgcttattcaaagggccctgtattgttgatacggtaccttttggatctgcatgcagaagccaggttcgtcacatggccttctgtaaccaagtgatgcacttcagaagtccgagtttatgaagattcatctcataaataaaaaaacacactccgattacccttcaccggcttatttatggtttccttatgttcatcgatatccgcccatataactaacgaccttgaaattttcaaaatgccacccggcacgcttcaagttttctgaacctaatccatatctgataaatacttggattaatgaagtcaatcattcaaagccaaaatttttccaaattacaataacaagcgggcgatactggactcaataataactcactacgcgagtcggacaatgcgagactgaaatgtggtacggtatgattgctgcctttcacttacaatacaagtatagtttgagttgattcttttatcttggcgttgcacgtaggaaatactcgacacgatccacattctcgtacctgttcgaagaaagtgaaccctttagtgtattccctagcaaaatgaataacatacgattcacattaattacttgacttaattacatattgctcacattactaaggcataaacctatgctgacactcagaatcgaatcacaagctaattgacgttttggaatactggaagcgagagtgaagcgaccggacttttcaagcgtacgtttcccctcctctttctcctagttttctcagcatcagttcaggattatgagaggcaggtttcgatttgttagtgctagtgatttcgttatactttggctttgatttctttgcaaaagacagatgttccagactcctgtcgccccggcacagcaaaagtacaaaagcaacaccatcaaatcctgtatgttccccaagctccatcgcgacggactttgaatcttcatcatctgctgcaactggtatcgcaattcgccataatcggataaagtaacttctccaactgcatttcaagcgttaacgattcagtttttgagaatacctgaaagtcgcagattatttattctgacagtatcattttacgccatctgaccatcaccgtggttcatagttggaggtatggattcccacacggttgacggaatagcgcgaataagacaggccaattcagtcttacttaccaaaaaggctatacgatgatcgcttcaacagcttgaatgcccttttccttgcttacagagtctgtgccgatattacgaaccagctcagagatagatggtctgagatagtcctcagtttgccacattcgcattatggtctctggatgcaagtttacgagcaagaaaaagtatggctgatgtcctttgtgtcaatgattctaattttcgttttgtgattcgcatatgctttatgttataaggctaattcatgtctctgtatcactttttctgtaagactcaacaactatcaagcttgaatcgagtttaacctagtctcgaaggtatatatggattgacgcgatgtttatgcatgcacagcaggcaggcgatgatcggaaattatttcatgcacatggggcagatttatgtttttatctttacgcgcgtagatcacaataggaaaaatgtatctacaccgcacatttagaacatctcacatccaaagatccttcgcgatggcaaatatttgaatgaaagtttggtgattctgatcccgtattatatcgacggtcaaaaagttcaaaaactttactcagttctgagctttccctgataaaccgaaaaagaatgtggagcttccagaagttcttgtaagcatgcactagaaaaaaaaagaacatttagaagtaaaaaaaagttaaatgaaaataagaaaggagcatctaccatctaaacgaaaaacacgttgaacagtgaaatcactgctgctccaaggaacggtgaccattttagggcgcttgcttttccagtttgcaaagaaacagctgaagaaggttgtgagactgcgccagatgtactgtcgctgtcaaactcagaaacgaccacaccagattgatgtgataacgactcgactgatacacttgttatcgccggtccattggcaaagtcggacgacttcaaaaccgtttcgagagtgatcaggtcaagtgccggttgatgggtttccagaggaacatacactggaattacggttgtcgagtgcgtatctgcgagagtggtagtcttcagaatctctccagtcacaatagtagctggaatgcacgtcaaagcgtcacacacctcccttgtaattgtaacagtcaaagtttgcacatcaggcacaatgtggctaggttttgccgtataaactgtttgcaaaacttcacttccaccaacgcttattgtcttcacagtggcaacgtcggttggtaagggacagtaggctgttacaaccgtagttgttcctttgaccgtaagagtcttctgcgtgacgccggtcagagcagtagttttggtgcacttcttaatgtcacagctggtcaccgtcacaacagtagttgaaatactgccgtcggttaaggtggtgtcagcgggcttgccgttgtggtcactgatgattgaaggacataacacgatggtgctgccttcagagtcggtggtccatgtggtgtaggtaccagtccaggtggaagttttgtcaccaataaccgttgtcgactccgctccctcgagtgcaaagttgtaaacatagccttggaactgagtcagcgaaacgccatttggtagtttgatctggaaatcaagcaacgcgtgttgcgatacagcagcaattacaactcgtaagggatagtagctgtcagcggagaggtactgtgtggtgcttatagtttgcccaacgtctctactattgttgaagaacaagatatggttgggacttgtttcaggttttaagaattgcgcctcacgctttcgcaaagcctgatcagcagcagcactgcccacaaataaaatagaattgtagtcaatgttactgaacgaaaactcataatctccatccactggagctctgaagaatccttcgtactttatagttgcgttgacatatgatccggtatttcccaaagcatttctgtcaatataagaaggccagtttgaatcagtgtcaaagttgatgtcgctgacgccagtagcagttgtcactagacccaggttctcatagccatagctgaggaaactgatttcgttggcaagctcgtaattgtccgcgggataatggaaaacttcaacattaaagccgtcaagcgcagaaactccgtcactgattcccgaactaggaactggtgtctgaacaacgtttgtagctgttccagtctcggaaggaaccagctcaacaacaatactgcttccgtcgccaccaacttcagtagtccacgtagtgtggtcaccagtccagatcgaagtggtgtcagcagatggagtaggaatttgttcgatcacattgccctcactatcagtggtccatgtagtgtggtcaccggtccagatcgaagtggcgtcagcggatggagtaggaatctgttcgatcacattgccctcactatcagtggtccatgtagtgtggtcaccggtccagatcgaagtggcgtcagcagacggagtaggaaccagctcgatgactgttccatctgaatcagttgtccaggaagtttccgacccagtccagatcgaagtggcgtcagcggacggagtaggaatctgttcgatcacattgccctcactgtcagtggtccatgtagtgtggtcaccagtccagatcgaagtggcgtcagcagacggagtaggaaccagctcgatgactgttccatctgaatcagttgtccaggaagtttccgacccagtccagattgaagtggtgtcagcggatggagtaggaatttgttcgatcacattgccctcactatcagtggtccatgtggtgtggtcaccggtccagatcgaagtggcgtcagcggatggagtaggaatctgttcgatcacattgccctcactatcagtggtccatgtagtgtggtcaccagtccagatcgaagtggcgtcagcagacggagtaggaaccagctcgatgactgttccatctgaatcagttgtccaggaagtttccgacccagtccagattgaagtggtgtcagcggatggagtaggaatctgttcgatcacattgccctcactagtcagtggtccatgtagtgtggtcaccagtccagatcgaagt

SEQ ID NO: 112 - DNA, 686705 bp, Pichia pastoris
atcacattgccctctctatcagtggtccatgtggtgtggtcaccggtccagatcgaagtggcgtcagcggatggagtaggaatctgttcgatcacattgccctcactgtcagtggtccatgtagtgtggtcaccagtccagatcgaagtggcgtcagcagacggagtaggaaccagctcgatgactgttccatctgaatcagttgtccaggaagtttccgacccagtccagattgaagtggtgtcagcggatggagtaggaatctgttcgatcacattgccctcactatcagtggtccatgtagtgtggtcaccagtccagatcgaagtggcgtcagcagacggagtaggaaccagctcgatgactgttccatctgaatcagttgtccaggaagtttccgacccagtccagatcgaagttgtgtcagcggatggagtcggaatctgctcaaccacaatcccgttagaatcagtggtccatgtggtataagaaccatcccaaattgaagtggtatctgcggaaggaggaatgaattctaagtcgaattctgtcgcttgacaagagacctggccggtgtaagcgggggatccttctagcgagatcgcatatcgatctctaccgctggattgagtgaaataacaagcctgcaaggttgtcgagttgttggggcccaacccactagtgagttttagcttattatcatctacataccagctcgaagggtgtgctgaagatgaagtcgagtaaactatgaccgcccattgtggccaatctgcgctgacactgccgaccgtaaagcgtcccaaaagcccaccgtccctctcagcgtaagcataaactgtcccgtcttcatcgggatgactaatggtcacattttgggtactgataagcagactacttgagctggaacaagacaaaggttgactatctgtggagttccagcaataataaggttcaccatcatagaaaaattcccccaaatcaccatactgaccggtgtttcccaccaggaaatcatagttaactactgttgtcccgactgactctcggccagtgacaactagtgcgggaaatttcaatctgtatactccttgtcccaaggtcaatgaaacacataaaagattacaaaccaacagggtaacaagattcattctttttgttatctgagcttggtgaggaaaaaggacaatttgtatcatatttatataatcgcttggtgtagacgcctcgatatggaaaacatatgctatgtggacgaattcagaaccaccattcttggtcttcgacatggacgcactatgcaatgcaaatattccataagtggaaactcgatagaatttggttttccgggaataatctcatacacaaaccaagtcggacttacattatgagctaagacaagatagtgttcaattccgtactatccgttgttttggactaggattccaagttccaagtttaccaacaaggaaagacagctaaatttttgcagcttttattggcaatttgtgatttctgactaatcctaggcaaactataaacaagcataaataacgatggaggctggaacaatgtggctcatgctccatcctaatacactgtgaccgcatctccaaaattgaattcaagatgacattttgaatccaatctattcactgcatgcgttgtattcgtcctttttttttcctgagtatgagtgagtcctgagggaattgtcaatacccaacatttgcagcaggtgtcttactgaatatctcaacttgtcggttcaattcggtttcacgttattcggaagcatgatttcttggtaacaaaagaattcggtgtttcattttttcaagcatgaacaaaacaggcaattagtagtacaagatagcaaaacttggcattgctgcttatttctaaatcaataagtgcgctgtagtgtatgttccttaatctagcatcagcaggaggattaaccaattatttttttggtatactacgccagacgaataagacagactgaaagttcgatcaatagttatgaggtggccgcaactagaaacttattagcactctctagtctcgtcatttgaaaaaccgataaatttatagactaaaatattagatcccttactaatctcgtttaccttgtacgaatatttagagttactcttgtccagatccacgtcacatagttattacttttttttgctgcagctgtgtattatgcttggcagtgccccgtatttactgaaatctgcagtactatttgggtaaattgaacatgcataccatgctatctaaattaaataaaccagactcaaacgaggaaaaaaaactgtggctagttgcatgaatcatgctgctgatgaaaagaaggtgtagtggattcaatactttactattcacgttagacgctacattatccccatagctatatgtgaaaacatgcccattttacgatcttttacaagctttactcttaagacggtgcatagttggtatctcagctgcaatgatattctataccctatactaggctatctccccatggacgccatcttgaaggcaatgactctaagaagctgtgaaattgtcaccccagttttcagcacaaacaaaaattaggcaaccaatcattatcaagtaaccaaattggacttttgcataacttaaattaataatgtggccggctctctactccgaatgcaaagcatgtgcggttggctttactcactgaaaaatgttcaagaattccatgctagacagatgaccggcttgtttaaataactgctaaatattggtgaaacttttgtcgaacctcagaactaattccaccgcgtccttttaccatcatcaaggtagtatgattgtcagaattttggaggcaatttttattcaatgttgcgcggcttttcatgcagcatgtggcgtgcagcgtccaaaatcatcagcagaccccaaaaagatcctcttgcgccaaggaatgattgaattcctttttgctgcagtacacctttttggccaatatgctcagcaataatatagtggccatatgtactgcatgaaactacctcttgctgcatctgaattttgacgcgctgttgatcatgagggaagtcaaagaataaaaaatcactaatagaaccgtcaaaacacggctgtgcatacggcatatgcccctttgggacataattacgtgttttacaaatcgaatgggaatacgtcatgtacaatatcttctttcgtattttgtattttcctaacttggagcaacttggagcaactcatcgcagagttttgaaatgtacatacctttgctgacttttgaaattgaagccacagaaggacgtaatctgatcagaattatccatcttcttatcaatagttcctttcgtaatgcaaccattccatgcctgaactacaacatgtatcagtacacacagaatgtggctttgtttaacgcgtgtaagcgcttcgtttgttaatacgtcggtaatgcttactaaaagcgtgagtcaaaaaaaataccaactagttgttcataggtgctaacaccctctcccttgccattcctgcatccctgaaaaaaagttatggttttctggattcagtaatgggtaattttttggccactcgtttcacaacccatactctatgaatccaattctgcggctgcaccaacacttacatcctgcaaatacccatacaatccgagttagtccttttagtggttggctgaccgtttaagcttttttttttagcaaataagtttgagaaacaactcgatggaacaatgtggacttgctaaagaaatttgtatttttgtatttgacagattagctaaaaactgttccaactataatttaccaagaagatcttgcaatagctacggttcttataccttcaagcaccacaaagtttttcgctagcattattcagtgcgtgatgccaattttcggctggaagcttgctaactcaaactggacaataattgaagctcgcagaagtttaaatacgtcaagaaaagttcccagatttttatctgggtttgaggacttaacacagtctgcaacccttattttgattgcggctgatgtaactccaatggaacataaaacggaactgcagtgatcatcttcgcaatagtggttgtctgcagaatttactcaatcacaataaatatcggcctcaagtgtagtagttatcaaagaccctcttgtaattgtgccactgttttggacatttgctacaagctggtcaaggttcgtaatatatattgtttggagaaatttacttccacaagcatttgttatgttaagataaacaatgttaactggagcaaaacagtaattatgatctccacgcatatgcatgggccagtaaaggctgaattttttgtgtacttggcggtactgcctctggtcacaataaaaatggtagccaaaataatagtgtacaagaaaggagtttggctagccatagtttctttgtttgaatgatcactagtggcaagaacggcagtctcagatttctgtatcgttagttagtgtgtttattgacaatctagctgaaaatgcataagttgatagtgagaaagctttcttttagttgaatggggtcatttgacaagaaataaaaccaattcaattggcagctcccaacatcaaaaaaatacctgtattggtcactaagtaactatttgaactattcgacaagatatgaaccttcttgaaactttctgagcttaacctacctctgaatttattctctagcacataacaacctgagcataaaatagagttgagtaaagtctgtagaagttttgcaaatttgattaatggttatacacccttcagatgggcaaaggtcagacattcggataaagcctccatattttcacatgagaaaaatgttttatcagtaacagatgaccaacggtttatttataaggtgactacatcagaggaagtccttggggatacttatcaactttaaaccaaaagtcataaatggcaatctccctataggattgagctttgttgtcccttcaagatgatagtttttatggttcttctgaaaatgactaatccagtcacgacgaatacttgaacttcgaacaaaaaactgtttgtttaaagttattaaagcacaataggagcttggcatagcctggctataaattcaaaaagatccatgtccagatgggttatatcaccagactaagcaagctgcaaaagagaaaacaagaaccgacgcatgcttggaaactgcgttgaatatctcatctattatttgctacgacggaatgttcaaaagtagattgagaaatgcgctgtagttatgtctactaatgcaaacgtaggcagcaacatttgacacaggattttttggtattatccgactaataaagccgtctacctagcttaatcatttgctaagtgacagactcagctgacaacctttatcttgctcgaaatacgaatttaaaaaggcctacaacttttcgaaagctagcatcgaacagtaagtccaatagataccgcacctacagtctccatatatatttgaaggtgcatgctgtagtttaaagccgaatcccatgcattatgcataatagctttctgcatctggctttgcacgataatttggtaaagtgaggcgtaaatcagcagatttcaattcagaacatatacaaaacaggatattaccgaacttgttttttgagttctacacttggtttcatacaagttttgaaaaaaaacatatgactatctacgcaacctcaagtggtagcaccagttcaagttgaaaggcagagaccaacataaacgtatgcaataaaattctagacgctcatctatggtccagaactagagagacaacgctcatcttttgattaacctcgataatcgacaaaactaagactggcatccaaatcaaagcgcagctactagaataagtttagtcctgagttaaaggattctaaagtagagagcacttgagctaagcccttaaatccggctcttcctcttggttttgccgctatgaagatcaggcgagcgtccgtgaataaaaagctgcaaaatttgagattattagacaataccttgcatgcagcgtgcagactacgaagtcctgcctctgaattaaaccttgaaaataaatttctctaggccaaggaatgatcatattcccaccatattgtggtcagaggatctacaaacactgtaactgatgcttcaggtcacataatagatgatgctgtcacgtgcactgaatgataacttcttggctgcagctcaattctgatatggctgccgaacataataatagtcagcaaaattaagagatacgaagagaacttcaataggtgcacgaatagaaaactaaaaagagtggtatcttgtttggaatttattattttttgggtaggcgaatgatgagtggtctgaatgaaccatatttcaattaaaaaggacccttcgtggtacaagaaagatattcgactagggtaaaggtggacatgtgtgtcgtgagatgcctcaacacatggttttaacatgcaagtattttgttgagacacaaacacggttgtgcatactgcataaatgcccagctgggataaaaattacttcctagcagcaaggctgagaacattttatgtacgaagctcctattctgtctacttctgttcaagtttggagccctttcctagttctcattcgtttttaaacttgcgtgctaagccttgttggctttcaaaagtgaaaccacaagagttgactttatcgaacatcagtcaagttttctgaggtccattttccaaaaacacttatatccagcacctatcactcacccgaaatgcggttgtatttagcaactgtaggaactccattcatcggtgcaccgccagtgattgctagtaatgaagaccatagcactgctcacaataacaatagcaacgactttaattatgaatgctataataaagaaaagctctctggggatctcttggaagctgacctttttgatcctccaattgatgatacaatgcactgctccatgttttcgtcatcaacaactgctgacactgagcagctacaaaaaccaaagcatgaatcgcaacacaagaatcccttcgattgttgtcaggaactcaagcttaaaatggccgatcagcaagagttgcatttgttgccggagaaaattaccaagaatatttttaattcagagtcgcctgtgttcatatgcaccaagattccccaaacaagtccggtccagtcgttcgtagatgttaatgcttctttacttgccactaactccgccctgactacaaattcattctctgtagacacaacagttgatatattgtttgagcaaacagttcaagatccatactcttaccgtttaaactctaaggaaacagcacctccatccacagctagcttctttgggactctcgatctgggacccaccgtggaagcatccacaacgttactggaggcagccgtcaactctaaaagacgaatagttgaacttagacagcaaaacagaatcgaggatctcaatttttcaacatcaatgttccttgaccattcacgcataccgttggtgcgtgggcgtagctttggaggaaatagcagcagacctcccaagacgccattaattcctgggacgcggtacgttactgcccgtttaagactggaaaacagcacaagtgaggatatatgtttgccccattggaacaaagcggaactcaaagactctagaagaataatccgtattgaaagaagataccagtccaatgagattgtagcaaccttttccatagttggatcggccatagagcacccaaagactaagcctgcattcgatcctgacgtcaaggttttggaagtctcgtgtctaaaatgtcccaccaacgaaaatgaacctaacgaggagcgatttgtcagtgaatgtacgtcagatgaagcacgagcacaacatgccttaacagaacccctaatgtcaggcttcaacagagaaccgaatggccgtaaccctaaaacggctgggaattcaattggatgcaggtactatattaccagtgtcgaagtcatcaagataatagaactactgattggaagctattcaacctcagaccccgtgcaaaggagaaaagagagaggccgtatacgatctaacttggtgcagttctggtccaaacacctagtcttttcctcgaagaactctatgaagcgccgttccgtgccaacaggcaacgatgcttatcttacggagctggagcatcgtattaacacttatgatgtgagaaaacctcgactatttgataagagtgtcaagattctggaatggtctaaacttggacctgctttgcgtcgggctatccaaagctattacatggtacgactagacgaatccagcaactaatggcaccaacaaatagtaactacattcaagcatagttattggtacaaagatccaaattctccaggcagagaaaagtaacaaatagctcttttggttccatcttccgatgttcaagttttcttaaaaagtcaggaaagtactactattcagggtcaccgagtaaataaaactctttatacgtacgcaacatggcataaagcatagcgaagtctactgagacaccagcctcctaggagtctcaatttaagtgaacttgactggtacctcttacaagtacattttgtattagttcagtgctcggcacagtgtatacacataagaatgcaccagacacatgttacagggaggtacttacaggttagcaagcaactgcacaactgaccacaaactatgttggaaacactggtacgtatatctcaaatattgtaagaaactaagttgtcgaaaatctcttactgcttacatggctcaagacgtcagaacaaactcagcattaaaattcggactccgatgcatcaaagagttacggggtaaatattatctcatggcggcaaaatataatcacatcaaagcagagaactttcacgtcatgtgcacgaccagttaccactcactgtgatgttcgagttcttaaccggtttcctgaccagacagatgagatttcataattaaaagtagacgttgacccccttaatctaaggttgtcttacaaaacagggatggatttcgtccgatcaaagtccatcacaagcaagttcatcagagatggtactgtaaggcataatttcccaactgatcttcatttgaactctcgatgaatgatcaaaccacaagatggaacaagtttctgctagttacattcacctgttttaaataagtcagttcaataccggagaaattggcactgaactagtagttattcccaatggtcacatgtatcagattgaatatacttcaaagatgtgaaaagtggaacctgtgccattggcgtaaagagaaagatgcagtagtcttcggtgaaagaaagaagaattagtctcaaactttaaggccctagcgtagctcccttcaaaataataatagtgaaaagcaagcgttgctggcgtttggcggattgaatgtaatgcaactattcttatctataacgcgagggtatggggaatactcttgctattccttttttgaagccaatttgaattttctacatttgctcttcctgcacccaaacaaattcattcagcaacagccaaatcatcaagaacatcaacatttctcatcagaggcgtaattaggagttaaaatcaacttgccatggaaataggacgcgcgaatgaaaattagctttgatttacgttctcagtaatgcgacgcagcactttcgcatcaacctttctttcaaaaatttatgttgttgtcatagtcgtggcaactaaatgaacttcaatttaatggatgctttggagggagtttcaggattggttatacgacaaaaatttggaaatatgatgaacaaggcgtaatttcttaagttctgcttgaaagaattgaatatgaaggtaaaaagagattctaaactactaaccagagcaaacactgggggttggagttcggcaaggttaaacaacgtaagattcgtaagaaagtgaaatttaattcaaaggagtacttacgacttatgagaagacttgtctcctacaatcggtattggaattcggttgggtgatggttgggtgcttctgctcgtccgccatagtcgtataaagtggccgcagcaacagcatctagtggtttgacgtcagaatgtagagaagctgcaagggctacacgtttctgttttgccattatcgatttcggctatttgaccgtcactctgtagcacatatttgggcaaaatgaggagcacttggacaatatacgatatagcaccgatcggattacatatctgcttagtcaaacttgtctgatttttggattggaaaagtttattgattttctgattgaaaagcaaagtcaaattgttgatatcgatgttgttctggatcaaacacactccattttccttcatcctccactgttgatggccgaccaaaacttctgtactggtagtgaagtttaagaacagcgtaggcaggcaatctttaatgttatatgtagcttattatgatgcgtcctttttcaaagaaactttgttttaactctgagaaaagaggaattcctaattcgattggaaatgcgtacattatcaatgcactaccatttctttcatgaatacctgcaagtagacttaagcaaatggtatagaagttcgtcacagtgacttttttggcatctattttacatcacaattggcggaatattaatgtggctcttagatgcatatacgcacgcatagaacatctactatgaaacaagttttagattgtcgcgcaccagggctactttgatggggtcacggaagcaataagctacatgtgtcgccttatgtttagagtgccaatgataccacgaacagaaaactctgttttagaaatgtttctactgtgaccacagtttcaccgttaactcttttctgcagcgaacaatacatccttgaaattcacgaataaggaactgcaatttaggtgacgcacggtgggattcaatgtcgaagataccactagcaatcgtgattttgtactgctcatcattgcggggacaaaaggctccattttttgtcactattacgagttcctaaccttattgatattgttttaacgagaaaaagttctttgtttcaaaagaatttaaactagacgttgaagcaatagctccaatcatgatcgtgagagtaggccacaggagcggttgttgaaaaattcatccagctgtcatcctcactattcttgattgatgttttcagcttctattatgcacttttcgtttttttttttcattggagtaatctgtcatgcagcgagcaagataaggttgttttattgtattcctattgcttggcaaatatgtcaatctaatcacaacgaaaacctacattgaaacagtcctaatttattcgagagaagtgctaatggttggcaaactgctttgtatgtacgaatcagacatgatgatgactggtccttgtctgtccgagcttaaacaatcgccatatttgcaaatgtcatgcagcgatctcttaattgcagtcgtgcggcaatgcagccttaaagccacaatattagaaaagatgtattattaatgtactacgtcaaaagtcaacccatttctgaagttataactaagtgatatccgctttcgcattagaatttactgaaaaagaaaattgataaatgtctagactgagtcagcaggtagcaaattcaattaccagtacaaccagcgatgatttagatgcgcgtcaaacagacgaggagcaactcaaatcaaccatctttgtttatgattctgagaactacagctctgcggagcctcagtttaaatcaggagtcaaaacaaacgttgcggagaaaacaatagaggttgatgaagatgatttttcattcattgaaggtgatatctccttgatgaataactcaccatatcctgaagtgcgagaagttgtcccgaatacagatgacccgacaattcaaatcaaccactggcggacctggacgcttaccaccatcttcgttgttgtatttgcaggagttaaccagttcttttcattgcgttatcctagtttaacaattaattttcttgtcgctcaggttgttgcttatccagctggaaaatttttggcaagagttttaccagatattagatttaaaaactcatggttcaacttgaaccccggtccctacactatcaaagagcatggaatcctaacaatttgtgtcgctttgacttcatcaactgcatatgccatgaatattttgattgctcaaacaaatttttttgatcgggatttcggtgcaggatatcaaattcttttggtctggacaacccagtgtctaggatacggtctagcaggggtgtcaagaagattcctggtcgattctccagctatgatttggcctcaaactttgatcagtgtttccatgtttgaaacattacactcctcaaaacttgagaacgctgtcatcaatggttggaagatatcaagatactacttttttttagctgtctttgccatttcctttgtgtggtactggtttccgggatttttatggaccgggctctcatatttcaactttgttttatggagccctgaaaccaggaacaattttgttgtcaactttatttttggggttagcggtggtattggtgccattgctataacttttgactacactcaaatctcgcaagccatgactggctctgtgtttgccactccgttttgggtagttgctaacacttatgcctcagtcttcattttcttcatctttttactgcctatcttgtacttcaccaacacctgggattctaaatacttgcccgttatttcaacatctacttttgacaacaagcagcaaaagtacaacgttaccagaattttacaacccgattttatcattgatagacaaaaatacagagaatattcccctttgtttataccattttcgtatctgttaagttacgctttgaactttgctgctgttatcggaatctttattcatacatatttgtatcatgggaaagagatatatggcaagcttaaagatgcaagacatggaggtgaagacattcacaaaagattgatgaaccaatacacagaagctccagactggtggtacttggttttatttgtaatcactttggcactgtcgttcgtcactgtctgcaattgggataccggatttccagcatggggccttgtcattgccatcctaattagcgtgctcaattttgttccacaaggtctattggagggtatcactaatcagcatgtgggtttaaacatcatcactgaactcgtctgtgggtatatgttgccgtataggcctttggctaacgttttgttcaaagtttacggctttattgtcatgaggcaaggtcttgaactgtcgagagatttgaaattgggaaggtatttgaagattgcaccgagactattgttctttatgcagatttggtccactttgattgcaggtctggtcaatgttggcattcaagaatggatgagacataacattaaggatatctgtctcacctcccaaccagacggattcatctgtgcaaatggccgaactattttcaatgcgtccatcatctggtcgcttccaaaatacttgttttcaccaggtcaaagatacaacgcaatcatgtactttttccttatcggagcctttgcaccatttttcacatatgcccttcacaagaaatggccccacaggtggttcggcaaaataaatgctcctgtgttctttacaggacctggaaatattccaccttccacgccgtataattacagtgtctattttgtggctagcgccatacttaccaccataaaaaacaaatggccgagatggcatggcaaatacaattttgtgatgggagcagctgttgagacgggagttgctttggctgttgttctaatattcttgtgtgtgcaattccctggagggacgcttgaatggtggggaaacactgtatggaaggatactttggatgtcaaaggtacacctttttatacattgcctgaaggcgagacctttggtcctgataaatggtggtaatttttagacataaattgacaatctctttaagtagaaaaaaataccaggataggttagaaaattgggtttaaatcgatgtctacttctttgacttgttacacatggtgccagggtttattgaaaaactaaacactcaaaaaatctaagtggccgtcatgattctgatctctttttcaagcattaatggttctattttcattgtctctacttcttggtttttcatgattaatgcagtgcaggtgacacatttttggttctgcagaatcagttgccgattactgttgagtatatgctagagaagctgtgctgcagcaaaagcatttctcagtgattcttaaccaatcttgagtcttacgtaaatgaagatcttttcaactgcatgcttgcatacaaaatactgtactaacaataatgcactacaaactaaccatataacgagtcaatcgcaacattgactaacaggaaaatatgtattgcaaaaacttccggtcactcatatatgccctagatactaaaactcaacaaggtaacgaaggacgaagaacagcaaattgaaaccagtttaaattcttctttgtttagccaagccgaatcgtttaagcaacgatcatctcacgtttaataatcttacattcaggactcggttttgttctatgtgcacatgaactcactaagattaaaggccatgaaaattaccggtctaatcaaatccatcctgaattttgaattggccaacctggaatacttcacctgctcttttgccatagtcactagactcatggtagtttttcactctttgtcgaacataatgatggccattgactggctctactttattgtacaagcccaacctctttagaagaggagacggagcaacttcaatatctgccgtctttcctggtctgtcgaaataaaacagccccacacgtggctcatccaactggtcctctgggggcctaacgacacggtgaattgtagacttgaaataaccaccactccaaaagttaagggtgtctccgatattacaaatgacgcctccgtatacgggcttgacgtatttccaggaattgtcagacagtttcagctgaagcccattaacctcctggttgaaaagcaaggtcaaactgccgaaatctgtgtgtgctctagaccaaatacgttccactctttcatcatcttccaacgatctgggatggtactgcatgtatctcaagtgtgtgtcacttgggagatcataatcatgcttgtttgcaaaatagctctcatctaattcaagtatgatagcaaataactggtacaatcgcttgactagtaaatcatgggttatcctcgaaaatgacgatacctcatcgtaaaagtcatcgtagaacggttgtttcaaaagttctttgtacgtttcatctttggtgaatttaggcatattgaaagtctccacattctctctgactgcagttccaaaaaccgttttcgcgcctacctttttgtagccgaagtaatctccattctcaaaatcgcatgctttggcactcttctcttctaatgaatagttgttgaaaaaatgtttccccaaggcaaattgacgatcaattaagtcttgagggataccaaagttaactacaacccagaatccatcgtactggagcgcttctgccaagtccttcgctagttcgaatttgccgttgggtttatcaaacttgctaaagtcaattgtaaccagttctgagtagtccaatacctctttagttggtttaggtctactccaaggttgtactacgtttcgttttgagataggcatgcattttctgtgtgcaatgttagatgtttatatggagagagtgaacctctatgattgtggcaacaacttatcgctaagatttgcaaatcccgatgccgattattgatgcataacatatgagccaccacaaaatcttaaccggcgaaaatcaaccggtaaattacatcatacaatgccaaatgttgggatcaagtaagacgcaattttggtgagcgcctgcgtggtcggctagccgtttggaccgcattcagacgtacaagcatttcatttacgcggtaggcggctcttgtctcttcaaggacttcaattcacttttatcggacaaaaactgtaatttcctttaaacaacttcaaaataaaattataccaagtatatagctcgcaaataaaatacacctaagttgaatgacctgccctgccggttgacttcaaacctagttgaattaatacttgggtcagcagaggcggatcttctctggctctgatgacctcatcaatgcgagcttgtgtcaatccaaactcatctcttttaacgatatcttcatcttccaggtaagcaccttcagtgtgtaaaataccccgtcggtaaactaatagccatgttgctgccacactgacagttccgcagaagcatagcgctgcggaaataataaaactagttctgtaagtaggtccaaattttggctggtaaaactgaggagaaacaatacccatcagctggcaaatggcattggtccatcctactgcaagccctgtagagctcgtcccacgagcgacacgaactctgtcagcccagagaatagcaaaaatggagttagtgacagcagtgcatatgaccagaaaaacgtattttgcatatgggttatcgatagccgccagaataatatacccaactgtcagagtgacggccatgccaaatccaacttggtaaccattcattagacgcttttgaattagccacccaaatagattcagtaagaagaaaccaataatgcttccgggcatagtcattaactgtgtttcagcagtagatgaaaatccaagttcgaaaagcacagttggaatcactgtgcttaatccccaagacccaataccaaaaaacaaccaaataccagtatacgagtagaatgttgagtctttcagcaattctttaatttccgaaagaacaaaaaatccgtcctttctctttggtgcagacttaggcaatctggagatgatcagtagtttttctcgttcactgaggaacttcgagtcttccggataattaggcaagtagaaagcactgtagataccacaggcgacggtcgggatgccttcaaaaatgaacagccactgccaaccatagagaccctgtttcccattcatgaaactaataccatacgcaacaattcctgaaaaagcggaggaaagttgaccagatccgtagaaaatggcaatgcgggtgggcagctgtcgaggtctataccagaatgaaaaatgataaatgatcccagtgtaaaaacctgcttcagccagacctaggaaaaaacgtatagccaaaataccttgatagtccttcgcaactgcctgtagcatactaattgtaccccaagttaacattaatcttgactgccatactcgtggtgagaactttttcaacaacattgtagtaacgggctcaaaaaaaaggtaggggtaaaaaaaaatggataatacccaggcccactgttgagatgtcaaatttcctaaagcttttctaataccgtcaccttcttccacgttcatgatagcggcattcccaacgttgctcttgttgatttgtgtgaacaagtaagcgatcgaataaataatcagcatcctgagatcagctttcttcagagcagcattgtattctttagtctcatagacatctccatcttgaaaatcaatgtcgtaatagttgagattctgatcatcggaacttgaagtgctctgagtctctagatggacaggtcgcttctcttcaaaagacatggacaccgaaacgaattgcaatgaatgaatgtctttgaactaataatgcgacatataagtacacctacgtcggtgatcggcccggcaattgaattgaaatatgcacccagactgtggatctaaagataataacccccattatttctggctatggctcttcgttttagctcttctacttgaaataatgatgaaaaattaccaccccaacaccgtttacgctaatccttttgagccacagtaccacatccgacggtttgaacttcgtgaagtggctcggactcctgtgtagaagttgccaagccatgcacattccttaagtgccagtcacggttacagtgtgtaatgataatgtggattccgaatattaagctcaatgtggtatgccaaggcagattgatgctcaatttggaccaattcccggggactatgtgttgagtatcatggaatcccaggtacaattatcttccaaatataatcatttatcctgatgaaagattgtcagcatgaataggttagtaaatataactgaaacctgaactcaaagttctacggtttcgcatcagcatcaagttttattttgagtatagcctgacaagtttactattttttccccaaaagcttacgccgatttctgaatttaattggacaatcgtgtgtcttattaggcagaattgactaatagtttgactttcatttgatgaccttcaaatggcagttttgtcatctgcttcagagcatgatctgtcatctgacaatatgagctgggttagagatatgactagaaacaggtaccaaaaacttgtacactgtcttttactcgtctgaagttagctcatactattctttgcccgtaaccgacaacattgaaatgtttaatcctcaatctacccagtgacgcagccagtgacatctatgtgtttacggttctcaagattatagtcaacaagtatccttgttaccatatacgtacatacaacctaagaaagaattccagaagccttaagcaatatgttcgccctggcgcttccttccatcaaaaccttcacgctctagtcactctacaaactttgaacgaatgtatttagagtagaacgtcgcatgcaaagagctgaagtttcagtccgtgttttgacatcagcccatttatgagcctgaagaagaattataagaaagaatccttcgataatcatggtcggactattacagatcaattgagctgttgtgttccatcgaagtccacaagcacatgctattaaacccacaataataaggatcgacacacctacagcactcgtagttgagcacttaacgtttatgaatgcagaaattcgataggaaattgttttatttggttcaggtgcactttctggccatggtagaccgacttcctcaaaaaaggttctctccttctctctacatttttcatagattgattgatctctaataacgattcggttatagacgtttcgaagaacgaacccgtcaataaacccaactagaccggtgtaagttccaataataagccaccaattgtcactccaacccattggacctccaatgattatccaaattacaatgactatgatagcaatgactccaccgataccggtaccgataatgtcagaataccaatctatagcatgtagaactttatttctcttctcgggtacaagcacttgctcttcgtttggttcaagatcgtcgctcagactgcgaagttttgattcaatggcgtagtcgagatgaagtatatgatcaagcatgtgtctcacgaactgatcatgcctttctcgggcgttttgtaagaacactgacgtaatgagcaaatgaacagcaacagcagtgttgatatacagttgccaagtgtcactaaatggctttttctggggattggaacctgttgtgacgcctgtaaacggaggatcattttgagcatttgaaggaattgctccacaaccgatccagattatgataccagaccaatagatgacaacagctgtgagggaaccaacaaactcagttagccaagatgacatcctatcaaaccaatcttcagtaggaagttcaacagatatctcattagaggaacactcggatttggtttcctcaacaaatgacgatgatttctcaatgtcaacagtgcgaagaagcctgcgaaaagtagcagtacgagattcgaattcagcccagactaagttttgatgaaatgaatgtaccaattgttgtctcatcagaaaggtatcccagatgtatgtctgaatagattgaccatcttgcataatgacttgccagttgaatggagcatgaaagacaattccaacaataatccatatgataagaattatccacatgaggaaaaatgcagcttttgaacccatagcccagaccaagtaatcaaggactctatcaaagcctgttttcctacagccattgaacccaacttcatcgtgtgcctcgacatatagatcagggtttttttcatctaaagaattgaaatctaggggctttattgtcttgaccttgtgtgaaactttatttctttgaccgggatagccaacccaatttctccagactcccattattttgatattcgatgcactggatagcacttcgcccttacttatatacagtactttttaaaaccatcccattggctaaaagtattcttcctgtgtttcactactagtgttatttgctcgtggggagatatagctagcaaaatggtcggatcaatcgaacccaatagatctcggtgcgatgcaatccagtagtacgcctagaataataattaattgagttatacgcaggtttgcatgcatattgacgtagtatttgacagttgttgaactttaacgaaggaactttgtttttgcaagcattcgacggcatacacatcagttattatgcatacgttttcattgtgcatgtcttgatccggacatatgattcgacggaatgtttgctaaatccaaaaataaaagcaagtggtcggtaacttaatcaatgttcaaaagcaggttaccccaatgcgttactttctattattgtttccaaaaatggctcatagcttgctcaaaggaattctagtatccagttaactgcaaatactccgttgaagaagggaaaaaaaaagcgaggaacacgatatagtgtactaggaaataacaacaatagttaaatgaataagcatttattcataaacactgtatttggacagaaagtaaagtctattttttcagtttagttatcgatgctcatctcgtgctgcaggtggtatgtcaaaatcggcaagttaaggttacatgtacgaaacggataaaaaaaaaaaaacatgtgattcaaaggccgtgtaggagtgtacagggccagtcaacgataagtcctatttccttgatagaaaagcaatttaacccaaaacgttagtttatctgcaaagttttgaggcaacctcgtcattatgatgttatactctagcttttgtgagcccacatttaaaagttaaatttagattgtatccaactcgtcaagtgaaaagaaaaaaattcaactaaagctgctccagtcttcaagaaccaataattttcaatacccacttacttgctttcagatcagtagagctattgaaattttgcaaaaactcagactcatacaattttgattttgggtttttccgtttgctagagggtcctgccacgggaatatctgatactgataaatccgatacgtcagtacttgcaccaacatgttgctttgatgcgaggaatcgactgatcttatgccctgtttatattctaacttggaacaattaggtttgtgattgacaaactttacaggcctcaaccattgttgttcttcaactccgaacccattttttgaggaagaactagtactgattaagtatcaatcaagctgtagaattgactcaggggcaggtgcctatttcaattcctgtgtaaacgtaaaaatctggttgctaagctatcaaagcgactcttccgagcatcccatgattggctacaatagtaacttggcaagatgctccgtttcaactagctaatggttaactgatagcttaacatacaatgccgttttgtgtgatgcactacctctaacatgtgatggagcttaatttgagaccagcatattcgatcttggattatcttgctagctcaagatccactgtaactgtatgcagtctccttatcgtaaagtcggagcaacttcttcaattacaattattgccagagatttaactgattgtgctgaaaagagtgttttggagtcctcttcaatacatctggagaaggctagtttgattgacctatcatggtgaaccgtttgtactgcgttcaatatttgagtgacagaggggcaaaaaataatcaaggcatggtcaacttttagagggatcgaaaagtctttaaatttggcctctggatcaggcatatcagattgacgaatatattgaataaattctcatataaaaggtttatcataattctcatcctcagtgatcgcattatttgcttgtcgtttgtggaaatgtaccacataataagtggacaggaaaatacacccagaaataaactccatggttgtggccagtacatactcagtgacgataaaactagttgacattcccgttgatgcgtaattcgccatggaagcatagtttgccccttgaatgaaaggagataataaaccatacacacctctcaccagcaggaatggagtagctaagaaaacagatgctagcaaataagatctaatgttatccaggactatagcgcaggcagccaaagtcaacacagctaatgttgacattagaaacaatgcttgacccgttgctcgaaggcctttgctgctattgattctggcaagattgtttccgtactcgttagtattcacgctggccaacagggtacctcccactaccaccaatacattggcaacaactgctaagcaatataatagaacgactgtgttgagattgaatcttttgaaacccagtaatgattttgacgaatcgaaagaggcacgtttcgaccaagatcccccattggcttccaaataagaagcacacaccaaaaagagactgataaggatcagtaaatagtacgcttccgttttcaacacaatataggcgatgagccattgtcgggggatgaattcttgtgctgagaagcctatcaaacatccctgcgctgcggcccgaagcagaccaaataaaaatagtcctgtatagaaggtcctaattgtccttttcttccacaggatgcttatgctgacgatagcaaagataccgtataggattgtaaacacaatcgctgctataacgaaatgaactgacatgattgcactagagaaggcatattccccatgttcatactttgagttattaagtacttctagctcatatgaataacgcttgcttctatgcgagccaaggaaacgcttagtatgaggtaggaatggagaccaactgcccttgacacgaaccttaaagatttgagaattcctccactattcaaactaaatttgttaatcctctgctaatattgcacggagaaactggtgttccaattggtgctatatttagaactgatagggtcactccaagtatacccacaatctggtacaattttcgctgtaaaagtatgagaatagttcatgcagcttctccattgctcgctcttcaacgtgagggagcttcgttcgataagttttcataaatggttcataattgtatcaccaaaatagatttcttaccaaacttcaagctaaccatatccgatcagatctaaagtttagatgagtgcctcaagaatctcgtgctcctttgagcaatagttcttggctgaattcatccctttaccatgaaacatgtacccttaaagcgcagaaatatgagcaggcccagttattataaggtttccaatcgagaatatcaggactatccgccttgtaataagcacaagcaaattatcttcatcaaactaccttcaaagcgtgtttcgggagaaattcaacgatgggtttgataaccactttgccgtaatagatcttcaccttctggattcaagggtttcaagaacgttaagcaatgttacgagttgattgaacttgcttgttgtgttttgtttaatgtgaagagaaggcagatacaagtaaatatattgtcagggcttagaacgtgttgctcatgttgtaaaattctgttgaaacaacacaagagctctgtcaatttgagcagcgctaacgacttaacaaaatcaacagcagctttctttgccacctttgtttcatttagttttggttatggattcatttttgataaagtgcaaaggaaaagaaaatatgtggtttggcctatgccactattacggtttagattggttttttgtgaacttcatctacttcctgtgtaaagttgactagcttatgctttgttcgatatgtgaccctatcttccggctatttaccgtatggaatgatcaaaaatgccctgcttttgaatatcattcaaatgacatttttcattaaaatgaaacttccacagattagtggaccaaaagaaatgccgtaccataaacaccccaaattgtgttcattcatgcgtttcctctcaccacgactttcaacaaaaagtgaggcgtcttcttacaagtcgactttaatacgaattctgggcatagccagcgcatatcggaaattgagtcatgctagaagtattctttgcggacctaacgcatacaagggtcaaatgacaccactttcattgctatcgaccgttggctacttacttgtcaactttcaatttttcaacgaaggaaaatgtttcacgaagatccgtaaaaccgacgaaaaaccagaaaacatctacatatcatagggtggtttgaataatatttacctgcctcaagactagtcccgatattcaacaataaccccgataatagagtcccgataacccaaggagaactttggactgggaatgtggggtgcgcatagggtcgaaatcctgatgacaaaggtttcagggcagggttgtcggaaattgactaacgcaattccgcaagttccatgttccccacagcattgtcaaaattactgtcagaaaattgcaaaccagaagtaatttcaaatatctcacagcgtgacctgataagagttatacgcatgatcgcctgtttttcaagggagttctgaactggaacacagaatcaaatgcccttagtcaagttgagcaagctcgccataagaagatctgatgaaggactatattttataccactgaagacataagcaagattatatgaacctcacattttgcttagaacctaccattatttcattaaaaacaggtaaacgctagaaacatataatagtatatattaaacacgctcaatatgattgatctcacccttaacttcgttaaatacctgcgcagcttcaatttggactcgacacttgtgacccttaaattttctgatggggattttgtcattgaacatttcatcaatctcttcaaatgatctaccagccgtctcaggtagatagaaaaagaaaacaagcaggtacaatgcagacaatcctccaaagatgaacaggactttggatcccatgttagcttgatcaggattgaacatatatggcaagacaaaactccacatacactgaataccattattcaggaaactacctgtggcaatggtctttgatcttaaattgttagttggtacttcaccagatacaacataagcccctggaccaatactggcattatagaaaaagttgtacatggccatgaatgcgcaagatgccgtaacagcggggatattattgatattaagcccaagacaagcaaccagcaaattgagaacagccatacatgttgttccaataatcatcaaagatcttcttccaaagaaatcaagagtgaaccacgatgttatggttccgaaaatggaaagaccttgagcaccgcatgaaagttgaaatgatctatcgtcagtgaaaccagccaactgataatagtatgttgagtaaccagaaataaaagccacaccggaaaggggctggataaggaatgagcacacacctgcaagcgttctcttgaagtttctcttgtagaaaagctcctgtagagacgaaccttctccgttggctagttgagcttcctgaatggtaactttcatcaaagcatattgagcctctacaagatctgagcccttgtaaattttgttcaaagactttaaagttttttcagttttgtccttggtcaaaagatagtaaggagactcggggaggaacaagcaccatactatggagataccagcaattataaactgaggaatcatcatagaacggtaagccatacggcctaccttattttgagtcttgtaggtaatgatgtagcacaagaaaggtccaacacatagagccaggtttatcgaagcaatagcaacacctctcaatgccaggggcgaaatctcagcaatatacgcagtgacaacagtcaacaaaattcccaaacagaaggcattgataaattttccagcaaaaaatacctcgatagtcgtcgcaacaaactctaaaatgaccgaagggatactaagcaataaagcaaacataatgacccatttacggccccatttatcagttgtgaaagaaccaaaaaaagaaccaacaactagggcacctgtagcacctcctgtgatagctgattgccagtcagcaggcaagacgtatcctccttgataggcattaccaaagtcctctctgaatcgagggatggatagcacaatacctccagcttgactttcgtaccccactagaatagcaatgaatataccagcacagatccaaaagaaagctttaggataggttttaatggcttcccatttgctgaggccatgttcaacttcttgctgagctctagccagtttctcgagttcagagaattcataagcagtgactgtcttggcgactgattgtagctctttttcctcggcagtttgtttggaagtaatagagctcatagtttctggggaaatatcacaacgaatattgcattatttatatattccaaacctgcagacttcaataattttatttcttggggtaataagcagtgaacaccccacgtctaccgttcatcgagaaaaatgttgaaaaacatcattcataacctctgctatccgtacaagcgtttccccgttgaacgcgagatcgctttctccatatcttatcaaaataccgaaggcggaaaataagttgagatgctccgcacttttcagttagagctctgcttttaactagctcctttttgcagtttcgttcaacttctgtaaaaatgtcttttgcaaaaagtgtgttagaagccacccctaatgagggtgaatggaacaagaacaagttctcaccgtcctctcgacgagtgaatgctcagaagatccaccgcattgaagggaacactgaaaatgtggagaatctgttggtgcaggatacaaccaaaattgcagtgctacatggctcagatactgcagttactctggactttggattcaatacttgcggattggttcaaatcgaattcgacaatgacaatgataatgataaacacattgaactgtctttctctgaatctaaacagtttattgacaagactacttcagacaggtctatggatttcctaatggaagatctcactctcaaggtactttgcaaaggtacttatcagatgccatgggtttcccaaagaggtgcattcagatacctaaccctctggacccatgaagaatcaagatctatttccattaaaagtattagtacttatatgacatgcatgccgtccctaggagaggacttgtcccgatactctggttacttccattcaagtgaccaatttgccaattctctctggtacgcgggagcatacaccattcaactagccactattcccgttgattcaggacgtaggcattcagttataatgcccagaactggttggttcaacgatgcactagctggcctgaaggatgcttcggaaattctaacagatggcgcacgtagagacagaagtgtatggtcaggagatcgttctgtttccctattaaccgaagcagtatgcttcgatggtgttgggggacaagcggctactgactggcttctgactcatcagaaggaatctggagagtttccatatgcttgcaaaccaattgatatgtatggttcagacacatatcacctttggtccttggttaatgtttatgactccttcaagcttacgggagacgataccactgcattgcatcactggcagagctacaagaagggtctggaatattcgcgcaataaagtttctgaactgggcctaatcaaagtcactaatgtacttgactgggggagagatgtgttacagaatcatgcagctagctgtaacatgatttactaccataccttgaacggtgctgtagaactggcaactcgatttggggatgagaaagcggcttctgagtatgcttctcaggctaaagagttaaagttacgcatcaacgaagttctttgggacgagcagcatgggatgttcaaagacaacgaactatcttctgttctttctcaagatgcaaactgttttgctgtctggttcgatgtcactagtgaagaaagaaaagagagcatctctgaaaatcttgccaaaagatggactaagtttggagctcctgctgtggagtctccaggtatgatctccccattcatctccagttgcgaattattttgccactctttggctggtcatccagagagagcattagaactgttccgaactatgtggggttatatctggaattccccttatgctgttcaatcttctttgattgaaggatacttccaagatggaagttgtaagtatccattcactctttatgatccagcttacatttctcatgctcatccttgggctactggtcccacggtgctgctgactaaccacattgttggattgagctttgaacacgaccactctcagtggaatctcttcccggcaggcattttctcggagaatgcaattgaatgggctcaaacaggattcacttccaagaccaagggtttcatcagtgcgggatataagtttgaaaggcatttaaaatctctggaattggctgtaaagagccctaaggagacaaagggaaagattggaattccgtacgattcagattacgctatttctacggtgactctaaatggtgaggttcttggcactgaaaaactggaaatccaagagaaatactatgtagtttcggtcaaggagagtgttaccgttatagtttcatattgttagtctacatatttgttaaatgaactagatgaccaaattttttacaaggttagaacttactttatcattcattcgaagatccgaattccgggatctttctacatttccggcatgacttcagggctttcatctccggaatttaatgaagtttgattgcattcagtgcatattattgttgcggggcaattgtgccttccttcgtgtgcggaaactgttaaaaaatgttccgcgttccccagattttcgtttaaggttaaaggcgctcaaagatcccttctcccttcttttcaaaataaaactcaaaatgactcaattagatgtcgaatcattgattcaagaactcacactaaatgaaaaggttcaacttctgtccggatcagacttttggcacaccaccccagttagacgtctaggaattccaaagatgagattatctgacggtcctaacggcgtccgaggaaccaagtttttcaatggagttccaaccgcatgttttccttgtggtactggattaggtgccactttcgataaagaacttctaaaagaagctggctccttgatggcagacgaagctaaagcaaaagctgcctcggtagttttgggtcctacagctaacattgctcgaggccccaacggaggaagaggcttcgaatcttttggagaggatccagtggttaatggattatctagtgctgcaatgattaatggattgcaaggtaaatatattgcggctaccatgaaacattatgtttgtaacgatttagagatggatcgtaattgcattgatgcacaggtgtctcacagagctctaagagaagtgtaccttcttccattccaaattgcggtaagagatgcaaatcctcgcgctatcatgactgcttataataaagcaaacggtgaacatgtatctcagtcaaagtttcttctagatgaggttttgagaaaagaatggggctgggatggtttgttaatgtccgattggttcggtgtgtacgatgcaaagtcttctatcactaatggtcttgacctggaaatgcctggtccacctcagtgcagagtccattcggcaaccgatcatgccatcaattctggggagatacacataaatgatgtcgatgagcgggtgcgaagcctcttaagtttaattaactattgtcaccagagtggcgtcactgaggaggatccggagacatccgataacaacaccccagagaccatcgaaaaactcagaaaaatcagtagagaatcaatcgtcttgctgaaggatgatgacaggaacagaagtatccttcctctgaagaagtcagataaaattgccgtgattggaaacaatgctaagcaggctgcatattgcggaggaggttctgcttctgttctctcgtaccatactacaactcctttcgactctatcaaatcacgattggaagattcaaacactccagcttacaccatcggtgctgatgcttacaagaaccttccgcctttgggccctcagatgacagacagcgatggaaaaccggggttcgacgccaaattttttgttggctcgcctacatctaaagatagaaagctgattgatcactttcagttgaccaattcacaagtcttcctggttgactactataatgaacagatccctgaaaacaaagagttttacgtagacgttgaagggcaattcattcctgaggaagatggaacctataactttggcttgaccgtattcggaacgggaagattattcgtggatgataagctggtttccgatagtagccaaaaccagacccctggagattccttttttggactagcagctcaagaggttatcgggtccattcatttggtcaagggtaaagcatataaaataaaggttctttatggatccagtgtcaccagaacatatgaaattgcagccagtgttgcttttgaaggaggagcatttacttttggtgcagcaaaacaaagaaatgaagatgaagaaattgctagagctgtggaaattgctaaggcaaatgataaagtggtgttgtgcataggtctaaatcaagactttgaaagtgagggattcgacaggccggatatcaaaattcctggagcaaccaacaagatggtaagtgctgttttgaaggctaaccctaacactgtgatcgtcaaccaaacaggaaccccagtcgagatgccatgggccagtgacgctccagtgatcttgcaggcttggtttggggggtctgaggcagggaccgctatagctgatgtactattcggtgactacaaccctagcggaaaactaacggttacttttcccttgagatttgaggataaccctgcatatctcaacttccaatccaataagcaagcatgttggtatggggaagacgtttatgtgggctacagatattacgagaccatagacaggcctgtgttattcccatttggccacggattgtcattcaccgaatttgattttaccgacatgtttgtcaggcttgaagaagaaaaccttgaagttgaggttgtagtcagaaacacaggaaagtatgatggtgctgaagttgtgcagttgtacgtagcaccagtatccccatccctgaaaaggcccatcaaagaactcaaggaatatgctaagattttcttagccagtggtgaggcaaaaacagttcacctgagcgttcctattaagtatgccacttcgttctttgacgaatatcagaagaaatggtgctccgagaaaggagagtacacaatcttactgggatccagctcagcagatattaaagtttcgcaatctattactttagaaaaaacaactttttggaaaggtttatagtaactaacgaaagcttagtaagtagacttaatataatctcactagtaagagtaaggtagaggataccgattaaaggtatgatagatactttcgcgaacagtatcatcataaatgtgtgggttcctgagaactctccgcctttataatgacagatcagcaagcatccatagtggtacccaaaatttaccgaaccaagcggcgtgtcactcacaattctaaaggcagagcgatctatagctgtgatagatgtaaattaaagaaaagagcttgcaaacgagttgccgtagaaggttcttcaaatgttattcaaagtgacgtaccttgtgaggggtgtaagaaagcttctgtaccttgtaagactacaatcactcgcaaatctaagttcaaagttccagttgccagtctaggattgcattacagatgtttgttgttgataatggatggtttgtttcctcatatcgatgtcaagaacatagacagtttgatagatcttggtaattcgttgcacctgagaatgccttccagagatggcgattttagtgaagaagatctaaagagcatggaagatacatctttgctgatcacttctacgaaatggttcaagccaagcatgaaaatttttgacgatattggcacagagcatcagcgatctcaggagaaagaaggatccttgaagcacaagccagatatatctcaagagcaagcgttagcagaaccactccaggaaacttcagacgcgctatctgtaccagttgtccataatcagatgaaaattttggagcccaggaaggtcaagcagccggtgagctattcaatggatggtcccctcgtctatgataacgttgaactgattgataactatggtaataagcattacttgggacctttttcaagcatcacattgatgggaacatttggtaacatcattacgtcaaaaattggggatacttccaagctcaaactcaataaatttagagaaaatgccaatgatatgaattttgcaatgcttagggatggaaagggctatacgccatcactgatccgtgagggatttcctaccttgaggccgataaagggattgacgagatctgttatggacaggtggttggaagtgtttgtcggccaaattcatcccatatatacctgttttgatgaggaagatttgctaggcaaataccaaaagttagtaatagatctccagttagccgaaaaaactaacaaatctgttcttggtctccccaacgacgaagtttgcaagttctacagtatatttctgcttggtgacactttcatgacgcataataacgactccaggcgctatgatccggttattcaaagcttgtcacattttgttgagatcaatctttctagcttacttctcacgccaacgcttgctggagtacagagtgagtttctttatggactttacctgggaacgcaaggtcagaaggaggggtcatatttattagtcgaacttgcatatcgccagtgccttacaatgggttatcaaagagaagctttgtactcgtataaaagactgattaatgagggagagattaaaacgacattttggagcatagtgcaacaagaaatctacttgagtacatttatgggaagaatatcgggaatacaattggaagagatcaatatcaagccatactcaggtgaattatcagccctgaagagaagtgacagggttgcttctttttttagggaagagaaggtagatctatgcaagctttgttacaatctgttacagtatcgcaaagaaattacgtttagtagcaagaagctattggctgcgtcaaacgaagaaaaagccattcgatgtaataatcgattaaacagctggatttcgaattttaatttcaatctttcatcgttactggttgagaaagagaatcccaatactgacaaaactgctctcgtttactcaacatttccagaggagatgtggatacggatacatcactcttactacatcataagcctttgcgagccattcttactatatttgcttggtcagactgaatccctgactgtaaatgcaggtgaccctttaatgagtttgatcatagatgcagttaaagcttcccagcatataattgacatgatactttactttgatcaagtatcagagaacctggagttttttgacaatttttcaatcctatccttagcgactcaatgcctgttgataacagacattattatctccatgaatcagtattcttcggttcatttggatgaggaatacttgaattcagagcatggaatcaacgagccaagccttcaagatcatatacataaatcgtcgagaatcctggaagacaatatcgaaagcccccattcgagtgttagaagtttatgtgaatccaccatagcttcccgggatgatgtgcaggcgctgaaggaagctttaaaaaagaattcccaaatatttgagagtcaacagtctctttcgtttcttcaaaaagacctctctttcatctttccaatcaatggggagttttccttcagcggtaatacagaactcaatgatgttttatttggggatccagagtatctcaaatttaatagttaacacagctgtgagattgagatggttcagttttatctgaaaaaagtaataaatctaagtttcatggtagatttttgtagtcaacatcgaaagggacggtcaccctgtattcgatacagcaggctaatagcaggacgtaattattagttgtagtcggagcatgtcatactaagaaataggtaaatttcctgatttgcagtattggtagcaataatctgttgtcaatacactcgttcttagtacatgtttccagaatattttgaacgaaactcctctaactgacaaagacaagaaaggaatgaaccaaatgggacatatcatagcagtgactaatctttgtagtgaagttcagatatttgctagtgatttttcaagggaggaagttcttatctgaaaaatctacaatgaaaatttcctattcaaggtcagccttaattactggatatacagaactattacaaaaagatttcggttgcggccatatctagcagaaagcaccgtttcccgtccgatcaaccgtagttaagctgctaagagcctgaccgagtagtgtagtgggagaccatacgcgaaactcaggtgctgcaattttcattttttcaactcaattgctcaataggtacaattcactcgatacgtgggtgcggatgggacaaaccttcttatgctatcaactacgaaaggtcatagttggctggacctgatctcttatttgcgctcccgggccaatcacaagcctcttctcaataagaaaagcatggtttcgcctcttggtcactttgttcaactccccctttaaccttgtgcagatacaaacgtcaagggtgactgacctgaccgtaaaaatgatctgctaaaaacataaggcgagctttttgtcaatttagttcgttacactagtaagaaaccctattgcatccaaggaatagttaatagtacagaattgttgcctacactattgggtcagccaatatgagtttgtccaaagaggattattttattgaggtgtcgtgtctagtcggagatgatcgttttcatcgggcttagaaggagtagaatagccaatcttgttgctgtgtatttcaaccatgcattgaattatttctttttacatctgatgtactgcaatgcttaataattgcagggcagatggtggcgctgctgaacttgattatgtacgattaataaattagaatgtctttccaaaattggccaaaattccccaaaacatgcaatagagtaaagctcaaaacccttggcattaaaactaatctttattcaaggcacttggtatgtagtactatggaatttgtccccccaagattacaattttgtttctttttataaccgagaatgcttcatggctcgaagcactgataaggaagacacagtcaaagggggaggtaagattcatactctgctcacaataaggtcgactagttcaactcattggatttttttttcaaatgaacaggtgtagattgattcttaaaacctaaaaagctgcctattaccggcacgaactaaaaattttcaacatagttgaaaatgttacagaaaaatataagaagcacgcactcaagcaaataatcaaaccatcagggtcaggaaaaaacccgacacaacagaaaatagcagtgatacttcaaaagtcgaaccagaattttcgtcgtataaagatgatacctgaactgaaattgctgaacttgttgaaaacgatggtacgctcgcacgtgagtttcctcctgagctgacgcttgaaatagcacttggaatatcacttggattaccaccaccaataggttgagtaggtgtagtaataattcctggcttatcatttggatgagaaggcggacttccaccaccaatagatccagtagaagtaataaaatcagtctttgttttatcttcaggggatgaaagtgtaatttttgaggggggttgagaaataataacagtaacatctccaggcccagtaggcgtgatgtattgtgttttggattccgaacactgagaacatggaacaacagacgtaattgttcgtttatctgtcttagtagagatggaagaagtgttgaagtagccgaaaggagtttcaataataacagtgcccggaatagttccacttggtgggacagtgtaagtagttttgtaaacaccagtccatggctgcgtggtagttacataggaacctggaacatcaggggtctcgacgataacggtgcctggctcggttccacttggtgggacggtgtaagtggtctcgtaagtaccagtccatggctgcgtggtagtcacataggaacctggaacatcaggggtctcaacaacaacggtacctggctcagtgccggtaggtggaacagtatgggttgtctcgtaagtaccagtccatggctgcgtggtagtcacataggaacctggaacatcaggggtctcgacgataacggtgcctggctcggttccacttggtgggacggtgtaagtagtctcgtaagtgccggtccatggttgggtagtagttacgtaactctcaggggtctcgataataacagttcctggttgggtgccacttggtgggacggtgtaagtagtctcgtaagtgccggtccatggttgggtggtagttacgtaactctcaggggtctcgataataacagttcctggctcggttccacttggtgggacggtgtaagtagtctcgtaagtgccggtccatggttgggtggtagttacgtaactctcgggagtctcgatgataacggtgcctggttcagtaccggtaggtgggacggtgtaagtagtctcgtaagtgccggtccatggttgggtagtagttacgtaactctcaggggtctcgataataacagttcctggttgggtgccacttggtgggacggtgtaagtagtctcgtaagtgccggtccatggttgggtggtagttacgtaactctcgggagtctcgatgataacggtgcctggttcagtaccggtaggtgggacggtgtaagtagtctcgtaagtgccggtccatggttgggtggtagttacgtaactctcaggggtctcgataataacagttcctggctcggttccacttggtgggacggtgtaagtggtctcgtaagtaccggtccatggttgggtagtggtcacgtacgtttcacagtttgtatctcctggacagcagaaagtttcacagtcacaaacgtctctccttctaagtgggtctgatgttggcactgctccacaacaaactgcctcacaatcagtaatttcgggagtctcaatcacaacagttcctggctcagtacctgaaggcggaaccgtgtaagtggtctcgtaagtaccagtccacggttgggtagtagttacgtaactctcaggggtctcgataataacaattcctggctcggttccacttggtgggacggtgtaagtagtctcgtaagtaccagtccacggttgggtagtagttacgtaactctcaggggtctcgatgataacagttcctggttcagtaccggtaggtgggacggtgtaagtagtctcgtaagtgccggtccatggttgggtggtagttacgtaaccctcgggagtctcgatgataacggtgcctggttcagtaccggtaggtgggacggtgtaagtagtctcgtaagtaccagtccacggttgggtagtagttacgtaactctcaggagtctcgataataacaattcctggctcggttccacttggtgggacggtgtaagtagtctcgtaagtgccggtccatggttgggtggtagttacgtaactctcaggggtctcgataataacagttcctggctcggttccacttggtgggacggtgtaagtggtctcgtaagtaccggtccatggttgggtagtggtcacgtacgtttcacagtttgtatctcctggacagcagaaagtttcacagtcacaaacgtctctccttctaagtgggtctgatgttggcactgctccacaacaaactgcctcacaatcagtaatttcgggagtctcaatcacaacagttcctggctcagtacctgaaggcggaaccgtgtaagtggtctcgtaagtaccagtccacggttgggtagtagttacgtaactctcgggagtctcgatgataacagttcctggctcagtacctgaaggcggaaccgtgtaagtggtctcgtaagtaccagtccacggttgggtagtagttacgtaactctcaggagtctcgatgataacaattcctggctcggttccacttggtgggacggtgtaagtagtctcgtaagtgccggtccatggttgggtggtagttacgtaactctcaggagtctcgatgataacagttcctggttcagtaccggtaggcggaaccgtgtaagtagtctcgtaagtgccggtccatggttgggtagtagtgacgtaactctcgggagtctcgataataacagttcctggttgcgtgccacttggtggaacagtataggtggtctcgtaagtaccagtccacgcctgggtagtagtagtaaaatattccacatctggcgtgcacgttcctggactaagattgttgggaaactggtatacaaaagccccaagtgaagttatgctggctccgctaggcagaactactctcaaatcaagggatccaatgtttcctatgtttgtatatgtcactcttagagggtaatattttcctgcctctagataaatagttgcagataagatttggtctgtagcagtatgagggtatacagaatacaaggagtattcggctgattgttcaggcaaaatataatcggagttacaacagtcaaatgctcctgccttaccaaagaacaccattgcagcatcatcgacattggctccgttgaagtcaatggtatactgaccagtaattggtggtcgaaagtatccctttaattccatcgagaaattataaagatatacgttagggcgtccatacaaggttccgtaggcactatttgctccctgaccttggtagtagaagtaggggctaattatattggaaatagtgtcgtacaaccttccctccttgtatcggtagcgcacataagtcttgagttccgcattggatattgccatattaggaaactcatagagattagcaacaaatccggttgatcttggagaggttgcaatagagcaaccatatgaatcatcagccagcacattcactgcgctgagcaaaaagaatacaaaagattgcaattgtaacttcatgtctggctcagtagtagtcagaggacatgaggtttatatttatagtacctctttaaaagtttccattcccaattctttgacctttatcgaagcttggtcgcatgaatcctgcagattgaatcgtatgattttcacatcttaaagcaaaataaatgctttggtttgccgtgcgtacctaataaattagtacggagattttgcatcagccaaagccgtttgtgtagagtcgaatcgacatgtagggacggcgcgaatgccacgttttccccaaaagttgcatgctgcaacgctgatgaaagcaagcaagcacgcgaactccagaatgtcatagcaacttgcggcatggaatatacacccaatactgtaacaagatttgcgtcgcatttcacaaagatacagatattcttatgaagaagcaatttaagccaaaatacaaaaaacactgttcgaaaaattatcacgcgtgagccaaaaagaggttattccattttgaaattaaaatatcatgctctaatttcatcttgataactaatcgcttggaaaattaataggttggcgtttaaatcttatgccgctctagtgaatcatggatgattgtttatttggacgctttctctgttaggctattcccgacttaattattgagaccctttccagaaggtgcgcgataaaaagcaattacagtatggcgctttaatgattatgtattaatttagttctggaagcgaagccatgcatgacagaatatgtaaaagcaaggtgcgtgatgtggttggcaaatcgataccagaaaaggaacgttgcccaatttgacttcagtcgtctcctacagtcatcggttaaaacatttccagacttgggagattcaattgaaacgacgggtacacaatggttgcatgcacccaccgaagttattacaataattttacaactttgttccattggggagacatacatagaaaaggcattgtagaatcagggagtgtctgttattcatgcttggaaaaagagaccattagtttaaagtatttgcaatgaacgatgaaactctgttacagctacatagcatcagtattcatataattaaccccagaagtaacaattatacgcttcaaagtgctcaaacgcagcaattatcaaaattcaaacaataagaggcctgcctaggaagtccattagcatctagcatccttcattcgcaccagaatgattaccattttatgctacgatacgcttaatgcctgacaagtcagttggagagtaagagagtaagaaaaaactatttcaaaaggtagataactatctttgtacttggtttgtatgggctgcacaatgatgattacaggaatgcaagcagtttcttgcctgttaagtttagaatcgaatatcacacgtttaacatattttacagcctaagcccaaggtagcagaaacgagctttcttattgttagatccatattcttgagataaaacctaaagtgaacaactaaattgaaaaataattcaaagctatgacagtagatagtaaagaatcaaaccaaagtcaggaaataaaggtaagcatcaagaaacataggtgatgatattgaattgaaccagtgttcatgttcgtcttagcaaacgtagaaaaattattaaagtaatcaaaagtgattcaaatagtaacagtgctcagatgagtctcaggtggaggaacaatgcatgtagccttgtagacaccagtgcatctctgggcggtcgttacatcagtatctggaacatatggaattttgacgatcaaaggtcttagctcagtgccacttggtgggacaatgtaagtagaattgtagatactggttcaggtctgggtggtggtcttccaaaagtttgcaggccacacgattttgtttcctagtgtagtatccgaagggaagagagttttgttgatgcaactgtcctggtcataaatgatgtgatggtagcagagcaattattatctggtatacaggcggatgggctagatttgacgagacattggttgaccacagtcccaaagttgttgatgctcgctccagcagggatgatcagttacaaactaaactgtccgataattcctaactagtgcatgtcacaattagagggctgtattctcctacctcgggatattttattgcaaactttgcttgacatggagcagtttggagatatgtagaaaaatcgttggattgttgagacaaaacatagtcagagttgcaagagtcgaaggctattcagccttagcaaaaagaagtttgtagatccgttgaaatgtatggtatactggtccgtgattggtggtcggaatccttttagttttattgaagattatttagctatatgttagggtgtacgtggaaccttctttctttgcatcagtagcgcacataagtcttcacttacgcatttgatgtttccacattaaaaaactcataaagactagttacaaatcctgttttttttggataggacgcaatcaagctatcgtgtgaatacaaatacaaaaaatgcagctgtgatcacattcatcattatagttagcggttttgttcctctcttgttttttattcttcctctattgcaacaatttatttaatattcgtgtttttagcattgctatacaagatctatgcataagataaaatcaattttggcaactcaaagtagaatcatatacatgtagagaagacgcgaagtccgctccgctctcgaaaagatggatattgcattagagtcaagcacgtattacaaatacatgatgcatattgaaacgtcatggcaacacacaacatctcctattctatcaaaatttgagatttgagagatttgagtgccagtgcacttagattgtgaacatcataaatacgacgaagaagcaacacaacccaggcagtaaataatacaatgaaaatttgcatcagcatggaccaaaaacagccggtcattttggtataagtaagactttcgcaatcacaactcggtgactttcttgaaaagactgcagaagatctaggtcaaaaagatatgcagccgaatgaatcatagaaaatttcttgttgggaccgccctattgggttattgccgactattcatttagttgaagaattgtccgcgaatgcgcaaccactaataacactctacgttgatttcaaataggtttaagttttggaaacatgtataacggatataggtactgccaagaggtcaagaggtcacggttaagaataagcgaataacaggaccagaaacggtaatttgaccaaattgacctgaatcgtttccaagtctccttgcatagaacgcttgtccggaatttaagtagttacaaaattaaaccaaaaagttccagctcctgaattaactttcgatacatttcaacggaggacgcaataattgaaagattcccaaattggcagagtaattcagttagaaaaagagggaaatatgctacctttcatatttggctaacagagactgttcttcacaagagtgcctgcaataaaaagtaaaacatagttttgaaggccggcaaaagaaaacatctgttggattccagacgtcgaaagtcttgcctgctgtgatagaattcaaaaccaatgaatcaaaataccaaacatttctctgctcttgcagtattattatatggtcacatgtatgagacttcacttcaaggccaaatgcaacgcaacacaaattttactccacttgctcttttaaatgtgtctcctcacaaatattgaatagtgagatagagtaccagaaaaagcaccattttctcctgctcatggtcaaaagaaagaatttgctctttttctgaagtgctgcttactgcgaagcaaaacagtttgtttatacaaaaaggttccaaaaattatggttgacagtcaaatgctacccaggaaataccaaaacctataactgttatcgtcaagatttcaggcctcaactatccattatttttacaagtttcgtagctgcaaacttaacataatgatagggcatgggctgaaggttcaaaagagttgagacactttgtggtaaggctatcggtagttgtttacttaactgttgatcttcgagggcatcagtactaagctgaagggccgtaaattcatatcacactgattttgggggctttattaatgacggggctctgaaagtttaaacttgcattatagctttttcataagcagtaatgagactttgctcatcaccacacagtcatctcgatcagatcacattaattctacggaatacgccctcttggaaaggagaaagttgatcgggttctttcggacttcctctgagttcaactcgcctcagaaatgatccacttattaacactaatggaaatggcatcacgaataccaccaaacaagtcaccgtcaataaggtttttgacagtctaaaactttctataacgagtatgccttacatcttgaaacgatggcttggaccagaccgaggagtagcatttcgattcacttacggcagtatatattagcattcgtttcattaatccaaaaggggggccaattcttggtcaatttgactagaggatcaagtgaggaaactgagcttcgtcaatagtgggcaagtctccgtgctgccgcggggcttttcttgttacaggcttcaaatttcgaggcacttccaagatgaagcacaatatcgtacagatggcgtacgatcctggttgcctgtcagcatattataaggttctggtcgagctaggttgtttagtagaactggccaaatagctaaggcttctcaaactagtgagcggagtttaaattagcgttttcttcactgacatgttcaacgacaacttctgcactggcaaaacctacaaccagaaggatttaaaaaaaaaaaaaaattatctaatgcaagcatgtacacccctaaagccagcatgcgttttggcataccagctactcatatcatttgacacgtcttccccaaaccacgctttcctctgttttatcggaattaactgtaagctatcagattacataagacctgtccgcgatcgcccgatctcagagttcccacaagagccaataaaatcgcgcgaatttgaaatcggaaaatgtaggaactcaattgtcctatataaataattcccttcccgtggaaactgaaaaaaaagttcaccccgacttatttattcaattcaacacaaaaatgccagctccatacgaaaaaggttcagagaagaaaggtgctactttgttcaagaccagatgtctgcaatgtcacactgtcgaggctggtggaccacacaaagttggtcctaacttgcatggtgtcttcggaagaaagtctggtttggctgagggatactcttacaccgatgccaacaagagaaagggagttgaatggtccgagcaaaccatgtccgactacttggagaacccaaagaagtacattccaggaaccaagatggctttcggtggtctaaagaaggccaaggacagaaacgacttgattacctacttggccaaggccaccaaataggtttacgaatactttagacaaattggtttttatttgtatatagctaggtaaaagaccgatcgaaaagaggcacgctttgtaggtttaacgaagttatttatttatttacgagactgttccaatggatgtaacctggtttcctttgattttgcatccttgccagccaaattagaaaaagaaacgagggatgtaagatgtccgatgtttcacctctgtgggtatcaggttgaacatcagcagtctccccccccacctcctccatcctttatctgttgagactctcctcacaaaatctcattctgaaattcgttagaaattacatcccccaagcattacaaattacaacagctacgaagttgacggaaaatggatcaagatgatcttttcccgaatcgtggtagctcctcatctagcaccctacccgatagtaccagcttgcggtcagtagatactgagctggtgaaagaagtcctggaggcaactgatccagtcgatctaaatcatgtcgataaactgcacttcaccaatttatttggtatgcacctaaagcaagatcagagagagtttgcaagcgactttgaaaagtttaataaggagactttgatggaggagcgtttgcgttccaaagtgtcgaaagttttaagctctcaacagaaatccaatcatcgacttcgtgtcgttggatcgtctgacacctgggaccagaagtctgactcaaactcgttcaagaccataccgttgaatgaaaccgaatggaacgagaatgttcctatcgacttggaaaagaactttgagactattcaggatgatgtctcgtctgtggagaaaggattcattccagtgtccagaaggaactttgtatcagagtggtaccataagccgaaaagatacgatattcaacgaaagctgaaaacccgaaacttgcttaacattgccctcggcggaactataggagttggtatccttctttcttctggaaagggctttagtattgcaggtcctctgggatgtttaattggtttcatgattacgggaatggttgtattagcaacgatgttatccttctgtgaaatggttacgctattacctctatgtggtggtgtgagtggcgtggcttctcgttttgtagacgatgcctttgggtttgctttaggcattggttactggttttcatacacaataggacttccaacggagatcattgcggctacgattatgctaagttattacgaacatcttcatgtccctggaccatccacttcagcctgggttgtgtttttcattgtggtcattgtgtcaataaatctttgtgatgttagagtctacggcgaagttgaatacttttcaaccattataaaagtgttagcattgctggtgttgatcattttcatggtagtcctcaatgctggaggcgttgcaccaagccacgaatacattggttttcggtattgggattcttccaaaacgaatagaacagagttcatatcgaatgggccgtttcgacctacttttgacttggcagataagggtctggggtcgttcaatggaattggagggaacttgggtagattctgctctgttcttgtagcttgcgtactggcagcatattcatatgttgggactgaaattgtgttgatcgcaggaggagaaagtcaaaatccacgtaaagctatcccagctgcaactaaagtcatatattggagaattatatttttttacatgctggcaatattcgtcattggactgaacatcaactcaggagatcctcggttacttaggttttataccgatgggggtgctccagcggactcacaggaacaacaagatatacaatcagtgatggacaggaacaatggaaacaattgccattttacattattgaaatggggaggattttcgaatggtaaccaatctccatggattatcgctctacagagtgcgggattatgcagttttgcagccgtcttaaatgcgtttttaatatactttgcactcacagcaggatcatctcagttgtatgcgtcatcccgaactctttactacctatcaattcaaggaaaggtaccgaaagtctttggaatctgctcaaaaagaggtgttccgtatattagcgttctatttacaggatcattctccaccttagcattttttgctgtggagcaaaacactgtggtagttttttcaaggtacctaagtatctgcgcatcagcgggactaattgtgtggactggcatgtgcctttcatttattcgtttttactatgggttacagctgagacccgacatcataaccagaaacgatgacaactacccatacagatcaccatttcaaccgtatctggcctattttggattctgtatggggtcaattctggtactatcttctggcttcgtggtgttccttaacggtcactggtccactactttctttttcaccagttatggatcattaatactgctgttcgtttgttattttggatacaaaatattgcggagaacctcaattcaaaggctagaccaacttgatttagattctggtcggagagaaattgaccgaattatttgggaagaagaaaaagactatacggtaaccgtgaagggatggatacggtttattatcaaaaaatttgtctactaaagactggataggagcttttccttctttttttgtataatgtatttctcaattgctgaactctccggtattttaaggtgtagaagggaaacttcgtcgtcagatcttgtagaagcgccactaaattgaacgttcagtttccgcctgcgttcagttgttagtctgctttcgtattccaggagttcttcgtcctggccctgtgcatcagtgtgacttgtctcttcaactgttgtgttcaccactccgaagtaggatagaggtagtttttcttttgactcttctaaaagacgtaaacgcagttttttatcttttgctacttgtatctgtgtttcttgttcagttttatgtttcttccttgcctccagcatctgtttaacatcgggaagatctttagctcgtccaaaatacctgtacccacttgagtcaacattaacgctgctcatggctttgttggaattcaggatgtaatttggcccacccaattccttgatgtgatactcccaggcaaatctttctttcgtcaatttgttcaattcatcatttaaatcacgtatctgataatcattgagagagacgtcattgattctcgatatcttctgcgaaatctcctggacacacaataatcgaaatttttctgctactcgcaagtctttcacagactgcactctttttggcctagcatctcctgtgacaggaagaacatttttctgtctatggtacctgttaagaagggagtttgccttctctgaattcctggacatcactggttgaaggaagatttctagttctttttatcgtcgcgcgcgatctacgtgccagacgaaaaatctcaggaacggtcaagattttttgctcctttcgtttgaacgcccatacaaatacatcaaatgtcaggattattctctacaagacactccaagtatgtctttgctgggattttcgtatttggactgttcttatttttgctggcgaacccttcttctggaaatccaggtctcccaaagatgaaaacacccagcactggatcaggaggacgtgttatccatggattggaagacgagggtgagaacatttaccccggcaaaactactcctgttgttacaccaaaaacacctaacgttgacggtgaagtgatctcaaagaaccctggatctgaagactcaattggtgtctcaggatcaacctcatcggtgcagaacggttcatcatctgattgtggcacagaatacgtggtgatgatcgacgcgggttccagtggttcaagagttcacgtatattcctttgatacctgtttttcgcctcctaaactattgggtgaaacatttgagatgttaaagccaggattgtcttctttcgataccgatactgttggggctgcaaagtctttggatccactgcttaaagttgctgtagatgctgtacccaaagaaaaacaagcttgcaccccagtttccgttaaagctaccgctggtttgcgtttattaggaccagagaagtccgataatattttgaaaaaggtacgaagctacctggaagaacaatacccgttctctgttgttgaaggtgatggtgtagccatcatggaaggaagtgatgaaggtgtctatgcttggattacaacaaactacctgctgggaaatattggatctgctgagttaattcccacggttgccgtttttgatcttggcggtggttccacgcaaatcgtttttgagcccaaagaaggagagaaaatgctccctggcgaacacaagtacgagattgaattcgggggacgacatttcaccctatatcagtattctcatctaggatacggcttgatgcagggccgtgaaaagatcaatgctttggtaatagaaactgccctcaagaatggtaacacgaagctagaaaagttggacagtaaaggcaaagaaccagccacaaaacaaacattagtccatccatgtcttccaccggctgttaccgcttcagatgtgaaggtgaagttagaaaatggagatagttatattgttgatttcgtgtcccctctgagggatgatcaatctagtgaactagctagcacctcagctactcaatgtcgctacttggcagaaacagtgctcaacaaagatttggagtgtaaaacaaaatcttgctcattcaatggaatttaccagccatctctaactcaccagtttgaaacaacaagagacatgtacatcttttcatttttttatgacagattacaaccgttaggcttcccctccagttttacgttggatgaagtcaaggatataacaaagttggtgtgttcaggatcttccttctggaatcagttcctatttcagccagaaagtgttcacgagctagaaaacgaacctctttggtgccttgacctgtctttcatggtagcgttattacatactggctacgagattcctctatcaagggaattgcatacagccaagaagatcaaggataatgagttgggctggtgtttgggcgcatccttacctttattggacaacaatgccaattggaagtgtcgagtcgcataggtgactttatcttattttgtagacaacagactcgttcatagatacatacagtacagatcgcatttagcgtagcgcgatcagacccaacgtttttggtactgtaaggttcgcgaaggtttctccttgcccccctcccaacttagaactagtccgaaatgcatttctcatctaagaatcgtatttgacctggccatcccataccacacaaaagtcgtttagctcggtatctatccaataaaatttgatgtcttctttgaagccgcacaagggagaagatcctgaaccttctattttggataatacctctacggagcccaagcatagatatgagtcactccctaagcttcctatattgcacaacagtttgtactgtaaggataacccaagagaattgccatcagacaaggagatcagtggccttcaacgcaagccgtcaaaactaaagtcgaagctttcagacgagattaagcacctctcaccttcgctgaaaagtgtgaagtcccatgcacagttagctaagacggcgaacggagttagatcactggctagaaacttgaacaaggccaccatcaagctcaatgttcggtcggtgatgatcatcacaaaagcccgtgacaattcacttatatacctgacaaaggagttgacagagtggctgctgagaagagagcctcacatggacatttatgttgaccatcaccttgagaaatctagaagattcgatccaaaatcaatatggcaggagataccaacagcgcagaaacacctcaagttttggaacaaggctttgattagggactgtccggatatgtttgacttggttatcactcttgggggtgatgggactgtattgtacgcatctacactgtttcaaagagtggtcccacctgttctttcattttcccttggttcgctgggttttttgactaactttgcatttgaagactttgcttccattttgaccgatgttctggagaatggtgtgcgcaccaacttgcgtatgagatttacctgtcgagctcataaagaaaatggtgaattgatgtgcgagcagcaggccctcaatgagctgactgttgatagaggcccttcaccttgggtatcgatgcttgagttatacggagatggttctttgttgaccgtagcccaagccgacggcctcataatagctacaccaacggggtctaccgcatattctctcagcgcaggtggatctctagtacaccccagtgtttctgctattagtgttacacctatttgccctcacaccctttcctttcgacctattcttttgccagactcaatgactttacgcataaaggttcctgcaagatcaagatccacggcatgggcctcctttgatggtaggtcacgcgtggagcttctcaaagggtattatgtaactgtggccgcctcacccttcccatttccaacggtgaggtcgtccaagaatgaatatttcgacagcgtgagcagggtcttaaattggaacagtcgagaggagcaaaaatcatttgtacacctgttgagcgacaagaataaggaatcttacaatcaatatcattcagggagaactgctgctgggaatatacgttctggccagagtagaatgaacagcatcggcaacccacaagaagagtccgaacagacgaacatgaacgtaggccgtcatgcctacaatagagtgacagactcgcttagacaagttcaattagagagaagacacagtaatacttttgaaattgactacaacgatagttcaagctccgatgataacaataatcaactgcctggagaagcatctgattctaccatcgagttagaagacaatgctggtgacaactattttgtgcctcttcctggtgaaggaatcaacactccagtgccacaacctttcttatccaatgattcaaacgtgcactcaatgtctagtagtagggttagcccactacacgacggtttagaccgcgcttccaaatgataaatgaagtgcgcatgtatgtctttcaatccgattaattttaggccaatgtcacttcttgcgacggagacgatacttctggtcatcactcagtaccgtctcgctatctatgtatctttaccatgaccctcgttgtaccattttataaatgccttaagtaaaaccataatgatcaatccgggtaacacccagatctcgagcgaaagggtgcctatgtttctatcattcttgttcttatcctaatcagatctccccctttgattttaacaaaggagtcccaattgcaatttgaaacagcttcctgacaaccaattggaacagagtactgataattttgctgtttcttttctttcattggattaaatctttgtaacgacactttttttgctgagatcttttggagcaacccacccatatattctaatggaggagtcaattcctacgccaccactggaagaaatggaggtttctggcatggactcaagtgctagtcagtctcctaatccggttgatgtgatccaacatgactccagcaatttcgaagcggtcaaggagcatgttcttccgccagtcccacctgactatgaggttgagtttgaaggctatttcacctggaatatacaggactggaggaaactgtctgattccaagattgtaagcccccgatttgtgctaggaaattacaaatggaacctgctaatatttctcaagagagctaataatggcaccaatattggaatctacctggaacctcacccccttgatgacgatcaagagcaggacccgaattggtacgtttgcgctcagtttgcaattgatttgtggaaccccgagtacccttatatacacaaatcgaatgcttcttaccacagattcaaccaagatgtgaccgattggggatttagcaccttccttgaacttagaaatttacatcgtgctagcaagtcatatgataagccgtttttattcgataataagctcaatatcacagtctatgtgagagtaatcaaagaccacaccggagttctgtggcatagttttgtgaattatgatagtaagaaggaaactggcttggtgggcttgaataaccaaggagctacttgttatttgaactcacttctacagtcatactattttacaaatatcttccgtaaaaaagtttatgctattccaacggatgatgaggcaaagaacgagcaaatcagtgaagagaccatcagtgtttctctagcgctacaacgagtcttctatcagcttcaaaaatcaaaccttccagttgacacaaccgaactaaccaggtcgtttggatgggatactaatgaagctttcattcaaaacgatgttcaggaaatgaatcgtcttttaatggaaaaattagagaataaaatgaaggggacttccattgaaggatgtttgaatgatattttcgttggcaagatgaaaagttttattcgatgcattcacgtcgactatgagagtagcaggatagaagatttttgggatatacagttgaacgtcaagaacatgggttctttacaaaactcttttgagaactacattgaactggagacgttgagcggcgaaaataaatacgacgcctctggttttggccttcaggacgccgagaaaggtgttgtatttgaaagcttcccaccagttttgcatttgcaattaaaaagattcgaatacgactttgtctacgatcagttagttaaaataaacgatcgccactccttccctgatgaaattgacctcaagccgtatttggatagtgctggtgatgcttatgatgaggattgggtctattctttacatggtgtacttgttcacacaggagatatttctacgggccactactacgctatgattaagccaagtattgaaaacacctggtacagatttgatgatgacaaagtctggaaagtaactaggagccaggtgtttgacgaaaattttggctttgacgagcttcagccggatgtggttagatcaatgactagatctcagtttttggattaccaacagaaacgtcatacgtctgcatatatgcttgtctacattaggaagagccaagagaaagcagttctagaaccagtgacagacgcagacgttccatcgcacattcctgagcagatccacaaagaattagaggagcgtgaccttttggaaaaagaaagaagggagatgcacttgtatgagcatctgaagattatcaccaaccagacattctccaagtatgagggctttgatttgaccccgaatgtttcggacttgaactattatgctagtgacttgtttgacgaagaatcttacccactagacgttaagctactgaaaaccgaacctttgtcgaagttatatgatctggtatcagattctttgggaggagtggatcccagacattttagattctggcatgtatccacgcgacgaaattatacagcaagacctgatggtccggttccactgacttatgatacttctaaaataccaattggcgaggtatttaaactgaattctggtaagaagctagttcaacagacattcttgtttgtggaagaagtcggcaaagagcttaattttgtctccaagaaacttctggaactaaataagcaaaacccaaagcttgattctgagatcaattccaacaacaagtttgaaattctcaagcaaaggtattctcagatccctagtgatacttttcctccttttcatagctgcgaccaagattcgattcttttatttctgaagtactttgaccccaagtcccaaaatttgcaaggtttgactcatgtcgtcgtgaacaaggatgccaaggtgtctacattgaccaaatctgtcaattattttatgggatttgatttagagactccgttaaacttttacgaagaaattgagccgaaatctattgaaccaatcatccttgaaatttcgtttgctgagtcagagctattgaatggagatatcatttgtttcacgcgggccgacaccgaatctgatggatcaatcaaggagaatatagatggttatggatctgttattacctactacaactttttggaatctagaattcatctgtttgtgagaccggctctactggattcctacttgaacgaagaggatgagaaaaatttggagtccaagacattccatgtatgggttccctctcaaattccttatgactgtcttgttgccagatttgcaaaagaaatcaaaactgatcccgactatttacgcctgtatggagtgaaccatgatgatactagaatcgctatccataggaacacacggttgcgtgacatccttcctcgaagcgtcaaaccgtctcaaacaattacctttgagtatgagattttagatatcactttggcggaatttgaaagtttggtcccaatcgaggtttattggttcaacaattcagttctccacctacaaaagtatgagcttttaatatccaaacaggaatctatatttgatttgctgggcaagctacagtacaagatcggcttcaacgatgaagttcgggagggtattcttgcatggacttctgttgatcacaagttcggaaccttagtcgctgacgaaaatatagttagtttggttctgcgagagagtaccaaccatatattcgttggctcctttcctcatctcaaaaagatcctcaccacaaccgacgagaaccaagttttggaacttgatgacgttgagatcatcagaggggatatcagggaggttcctgtgttccaatttaggaatgaaattcatcgtaaacatggcgcgcctttcatctttgatgttagaagaaatgagagattcaaagatactaagaatagatttcaacgactgttgggattaggagacaaagaatttacgaagacagagcttgtaatagtctctaattccatagaccaacagatacgttatgtgacggatgaatcactcttactttatgatgaactggcagaacatgaacaacttgccattgacacaccaccaagggctgtcagacgtccaactatccaagaacgagcgctattcattaaagattagggtctctctgatctcccgaaatgaaagggtgtattacatacaaatctgtgaatgtagtacaatggaatcataatcaaatttgggcagtagccttctcgtagtcccgcctgcgcaactcagtgctactcaatttgtcactaaagctcgtcttatccgaaccaccaagaacgttcacaacaaagacctctaacgcggggaggttcttctctcgacgaaccttattgacatattctcctccggagcttgtttcttcactaacgacgagtccctcaatttctcttaccgtagctgttggcccacaaacatcattgatttcatgtatagccactggaagaccgggatatgcaaaatccaaaaacctaagaattttctccttgcgttctatgaaagattccagataatctttgtattttttattcttcagcattgcttcccctgtaactcctacaattagttcatctcttgacagaaaggcactaatgcctagcaaaatcttgtgaccatcgtgaagatggtcaaaagtccctccaactgcaacgactctgaactgctcagcattgaagtcgtttgcagatgactcattagtatattcagttgtgctagtgtcgctggggttaaaacagatgtgaactggttcgacattagagatattgttcaattgcagttgatgagggatgttgtcgccgtcagcaatgtaaatttgggaccattgtttatgtggatctttgaacacccacttagcaaaccctacttgtatatctacgtctagcccatatgagtttctcgtagcttcatacaagtgttgtagtacaatgtttaccttatgcgcacttgctatctcaactgtcaaaaccacatcgatattgggaaagtctcccagttgactaactttacaaatgaactgcgtgtagagaccttgcactaatattttctccgatacaacaatcaaacatgaatgagaacgcatttgttaaggatctggttacgttttcaagaagggtgttggatggttccccaaacatcgaaataattaggcatcggaggtttgaggaatctcgcgatgtcctcaattgatggatgggtgggtaggcaaccttccactgagatcagatcatggattttattgataagtcccgaatttcggttcatttgtagcagttgttagagtttggtttgtttccagaattttgagcctggctttactttgatttcggatagctagcccatcccaggtatagtggagtcgcgtctttattccttcgtgacatttctaatatttacatctctcttttcccatacaccctgctgcgtcattaatgtcttccaaacctaataataaatcgtcatcctactttgaaaagcaacgagatgctttggttgcagaaatatcagtttccatggatactcttttgaataacgtcaacaccctgaatagatcgttggaaggtgctatagctgtggggaaggaatttgataacgttgcggccatatggaacaatttttatgacggaatggaccagacggatagattgttccaaaagaattccagattatcacccgagcaagattttgaaactccaccagtagattcatcaaggtgattctggtctggacacagacttcagttttgaagggcagaagaattctcggctgttggattcatttacatcagtaattgagactatgtttgacattaaatacttgatgttgacgtcagtttgtttcctgagcagaaatttttgcagacaactatttatacttcaactgacttacgcaccacttgaaatctgataagaacagattgatttctcttcctcgcatagcttacttctttggcaaccagaaggctgaaagttcaaaggaaatggctagttctttgtattattatgtattatacagcgtattatgttagtccgaaacgtcttccaataatggttcaaactttagttcttgatccaaatagctatgttgattttctggaaccacagaattcattgtctctgcgtcgaaagagtctaaccattgatttggagaatgaaggtgtgattttagaatctcagaattggatttgatgacagacagagcatgttcgtgatcgacaaaattgatattggtaagcagttcaaagatcttgataaaatagtaaatcaatgcctccagaccacggagataaccgtcatcaaccctgttatgatgaacaggtgggaagtttgtggtgggaggatgagggtcctcacctgtaacgcattgtgcaaaatcaataatcttgacaagtatctgactttcttccagtgtatctctactggcatcatacatcaacaacaaggatgaaccgtacatcctataatttaccaacttggaaaattcctgcttcagcttctcaatctctttgatcaaagacggaatgtgcctgaccacactataagaggtcttcccatcatagagaaatctacataggcaccttgcaaattgttctccttcttttactcgtcgcccaaagtatttgtctcggtacaaaaagctatcagatgatctatcccacactttcattccgcatatccgcacacccaatctcctactggtggtcttttggcattttcgacgttgagagatacgttttgaaacactggcctctatgccatattgtctcgtacccatcttcaaatcaagaacacatggccttttcatttcgttggttagatcttctagtagaagaaactgctctagtttagtgtgtattctgggacgatcatgatccatggcaaatatggagtcactgtttgacctatccaccttgtgagaagcttgaatggtttcatcaaacccatcactaggggtaggagagggagggatggatgactcatcaatagtggtagatgatcgaaacatttctggaaatgtggaaacgttggactgtgcagagtggctgagacggggtgggtgagatgatgaacatgattgagcttgacaatggttcgatttccgtcgataagaaagtttgcggcgatgaatgctatgtgttgctggctgacaatgatctctaaaagggccaaaaacttccttcaaaaccagttcctggagttttttattaactgtagtggtaccaatgctgttacttgtgagagggaaagaatgagggggagaaattgatatagagtcctcagaagatgcgaaattagtggcagaatagtgtcctagaaactctttgggaatgatgtgcttgttatcgtctagcaagacttcaggagcaacgagaggatcagcatccacctgggatgtagatctttttacggacacgtcgtaattttcttccaaaacggtactatagcgtacattcagcactccaatgtacttgggcatgaattctagtagctctggatgacgcatctctatgatttcataccatgtattttctctgtttaccaaagctttacaaacagccctgtgcgagaatttgaagatggccgtgtgcccacccactttattcttaaagggagtcagttctacggccaaaggaaaattgtataccgctgactcctcttcttgatcattgtgttgagaaactggtggctctgagtccgattgcttgggactatgaaacaaacgcaatgactgagctgctttacgtccaacgagctgaccagatttctctgtcgtattagcagaagcttccgctatgctgcttccttgttgcatttttattaggacgactatgggctcattaacaatggatctctgatgggtcaaagacgttgattataaggaaagagggaagaagaagtaagtccgtttattagtagccttctcaataattcgcgacaatcaacgtgcagcggagatggcatgtaatatcaaagatctggctgggcgggtaatctaacgatgaggatggatccctttaggaataatagataaagcggagagattgcgcagaaggtgcttttattaaggggggtagaaaaaaaagttaagaatagaaaaaggttccctaattagactgacttttcagccaaggaatcagaactggcactttccgaagatgtcgcaataggaacgttgttcttcttggacctggtgacccttttgaacaccaaaaacaatgcgccaaggaccaacattgtaccgatggttacacctgcaccaattccacctgcagcggcattggaaagcttggagtgatggctatcctggatgtccaaagacgagtaatcaccggacaggatactttcaaggtcaaccccgttactttgaagttcttttgcagccttataagtagaagagtagggaacacacaccgatggatatttggaagattgctccacgcctgcattacatctgtcacaccaatcgctcaaagttaagatggaatactgcttgatgttctcggagaaatcgtcccatgacatcattgtatcttcagatccaaagattgggtatacagtaaactgatcccaggaatcagttccatttttgaaagaaaattgcacgaagtagttatcggatgtgtcctgcatcagatcaaatatgtaggtggctccgtagtctggcattccagtaaagttggcagatagtttgtccaattgaagcaaaccattcaattgaaacattgtattgaaagagcctgtgaagtagtttatcagaggagattgtgcctccttggtagtgtttaggtatgtccaaacacctcccaaaatagattggcctccaatagaaatgtctccagttacatctgtctcattgtaagatatgagccattgaaactggtttgataaaagtcttacttcgtccaggagagtgatattccattggtcatgtaaagtgctgttgtgaatccagttgacgttcatgtaatcgaaaatatccatagcattaccgaaattcaaaaacgaagtagcaatgtcttcctcgggtagaacatctctcaatgactggtaaaagtcaaaagtggtatcattgaggttctgaaactcttcagtcttatatgcagctgcaattgctgaatctgagtttgcacagttaacgtcacccttaataatgaaattattgggagcattggggtcttggaaatccatcatgacgtattggtagccattcaaaggatattccataacagtcccattgtccaaatcggattcagtgctttgaatcagcagttcgttgctcaaagggccatcagttgcaggaaacaatccttgaaggaaagccatatgggatttggcgatggtacctgagtatggagcttgtccatagtactgagaagcttggtaaaatccttcatcgttcaatttttcaatcttatattcagagtccacaggttcgttatcgtaagtgagtccataatatctttccctgaaaagagctccattcttcagttgagcttcagctcctagtggagtttgctggtttgtgggtttggcaggtctgtcattgtggcgaccaaagataaatgtaccgacacattcgtaatcttcggcataggttgaacccaggagggacaacacaatcaatgatatggccctagggtttagcatgatacttggtactaggcgattaaaacagatttgggtactagaacgatttatagagatgacagtgacatgacattgaaatttcaagttccttatctaccagtttccgcgggtcagaccgcggtgaggtgaaacttttcttctgattgatgtgcaaagcttattaaaaaaacgatatctaacgacaatcagcaacggccatatgagaccctatctatctaatgcatatattgcaacccgatatacatacatttagtgcaaccagctatctacatccctgttccatcccttcatattatcatgtcattatttctggactaccctttgagcacaattacgtaagctattcagctggtcgatgcattcactagtcttgcccttacttcgaatgcaagtttcgtaatctttcattacatctgcgcatttatcttggatcttctggaaagaaggcacatcacttttgatacatttggctaattctccttgaaacggaatacactcagtcacgtctttcacattggggtctgacatgcacttgtggtagttgaggaattgctgaggacaaaatttggcaatctttttggacacattgttagtaagttgtcactaaatcataattcacatctatcttacgtcatctagcaataattgatctaatactccagacattggtactttatttgtccgcttgtgaactgaattagcaactaacttgcaggcaatttttcagttttctcaagcaatatggatgaaaaagttcgcctgctggagaatattaacttccaccagttggccgcccagcacccctcgctggaccaatttttcgtgggttcccagtacaactttgacacccacgaggggttgatagagctagcccaggtcatactactagaatatttccaactgaaagtccagttggacaaaacaagattatgtccccgcattcctaacagactgaagtatttgagactggtaggttcgttagttgagcagtttaaattgggggattctccattgatcttagatattggcacgggccacacttgtatatatccattattagggtccaggctaacttcctggaggtttattggcacagacattgatgagagaagtcttgaatgtgcgaagaaggttttagaagagaacaatgtaagcagtgagcggattcaactgaaattggttcgaagtggagacgatccctttatggacatagaaaactgtgacgtcgtcatgaccaaccctcccttttatgacgagactggaatcaaacaaaataaacctgagaaaccagtacttgttggaaaaccgacggaactcgcaactgaaggtggtgaatcacaatttatcatcaatatgataaaccatagtgtgaagtatcccggcagaaacaccgtatattcttccctggttggaaagtataattctctagagcctgtggtaggaaaactgaaggaattgaatattactaattacgggctgagcgagttcagtaataagaccaaacgatggatcgtattctggaccttcaataagaacaggccttccgataacataagaatgatcaaaaggtctactttcaatcctgaaaagcacgaaattttcatcccgctaaagaataaaatcaacttagttgattttctttcctcgatacagcgcacaacaatagagagagagaatgaagtcatcgtctttaagaccaaaggtatagtttggtcccgaaagtttcgacgaacaaacggtactaattttttgaaggaaaaaggtctgggatcaatctttcgaataacggaacttgaaaccaaaataaaaatccactggtgttacggagatgatcgtgcggtgtttgaaagtctcttgggattaatcacccgaaagacacaacaaagttcaggtgaacccttataacttctccaagtagccctgctgaattaacttctccacgtctgcttgtctgacgaagaattgagaatctttagtcaagttaaacactccatactctgtcaatatttctcctgcatctttcaatacacgcacatcgataaatacttctttaggtggttccaaagagccgctaacatccacgtcttgaaaagggcttttgtataatgctactaggttactgtatttcttgaagtactcttgctcgtgatgcgataaattctccatttgttgcggatccatttcctgaccattccatgcgacttccatgagtttttcgactctagatctctgataacccaatagacaacgcttgttgcgacgcatagataagtgcgttacgaataactgacattgtttgacgcggtcttgtgcattggtatcctgggatgcaatgatgtcagattctttctgtaaatcacgagtttcccttatgatgtctctgacatcgtgttcttggtacattggaacaccatctagtgctctagatcttttggcatccaagatgagcttattagctgtatcgccgaacatatcgttgtgtatggttcagatctttctattagagattcggagataatgagatcctcaaaaaatgcgcgtaattaagatacctcactaaataaactttgtgtgggtgggtgttggtaagtcgaccattccttgcatatggaagaccgccatttgaagcagagacggaaaaaatctagaactccattacctgccgttgacgttgatgactacttcatagagagccaagaaaaaccctcttgtgtcctcgctggggctgcagaggcagaaggtgggaagagcaaaaagaggaagaccctggaactggacaaagagctagatgcctgggcattgatcgatgaattggagacggtccaggagtcccagggatcccagagagcaacgctgtttagcaacgatgcaaattatattgacgagccatctttcatcacttcagacgacgatgagcctattgatttggctaatttgaatgaatctttcaatgaagcttttgaatctgcccaacagaaatcaataaaaggaaacgagcaatcaatgcatagtcatgtcaaatatcaagaatctttaaaaacgtattcatctacgcggtcatttttggagaatgacgagaatgaaccaaatgaaatacaccagcacacatctgaagcaggtcgcaaggacactatacaagatatcaatgacctaagaaatttaggagtcacaaacaaaataaaggacgagtatcaattcatgttggaatctttcgaaaccgcagatgagtctcttatgcaagtgacattgtttgatttgctacaaaagttgcaaagtgatcggaaaatgttgagttacttccatcatatgggattccccaaacctctgctggagagtgctcacttaaagaatgatctcgtatcgaaattgatttttgtgagcataataatttttatgtccagtcaagatctgagtatgacctcaatactaaactcagtttccaatataaatgactttttgattttctctaatgcttatagatggcctgataaatgctctaggatgaagaaaaagctggttcttgattttcaaaagattctccacaagttgattggagattcctcgcttacgacaatcactcttcaccttctattgtcattggcaaaaaccaactctttgtgtttattggagcgggaatctattctccaattagatcaaataatattgcattcaatcaaggagcgggaatttgaacttcttaatttggaagcaaccattttggaatctctaatcaccaactcagtttctacgataacgttatttaccagcattgaatctttagtggaactattgttttcaaacaagccacaccatgaactctctaaacaatccaaggcactgtttagctcaataactgcaattggagtcatttacacgaaatcaatgaccgaagatgataaactatacaacacttttctatgttctaaagcagttttatctttgctttccacggtacgttcctcacacattttaagcaatcccaactctgttcaatccaaagatgtccaattatacacttggggatgttttagtctgggctggttattgaatatttcaaaatttccccgttgcttcaaatgcatagaccaatactcagtatcagtcatcaattcagtgctagagtccatgaatagttcagttgatttaaatactggatattttagcatgtttgttgggaggctataccaagcagatgtgttggtgtacaaccgagactctccaatattatacaaccttcggactttcaagaaactaattacagtaaacactttaaatgcgcaggccgacttgatcatcaaagatcttgaaaggaggaattattaattaattatgtttgtcattatgtaactatcaactcacaattctagtagttaaactcattacttgtttcctgtacagccaaagtagccattcgcaacagcttcttcttggaattttctttgttctttttagtcgctttaggtccactccccactcctagcgttttgggagtttctctcaaaccaaaactcttggccaagtgacccaagtgtagagtctttacattgaatgtgtctctttcggacgataaatgagttgcatatgccctaatgtgagatgtaaatgcttgagctgctgcgctatgagcaccaggatcctccaacagccatctttcaacatcaagatgccatgtagtggcatcaacctcccaagttttaccaaatgaggtcttcagcagatcactgaaagatacgtaatctaatcccgccttcttgtggtaaatttcaatctttcccgtatacgtttcttcaattccaggaaacaggaacaacacagaggtaccacctttaccagctcttgcagttctaccaacacgatgcaaatgatcctcaactgcgaatggcggatcatactctatcacatcagaaatgtaaggaagatccagacctctagaggcaacatctgtgcagaaaagaatagtgtgcctcgattctggagtgcttgaaaacatatcaagagtgctagttcgaacttgttgagtgagtgaaccatgcaacttaaatgcaacaacgttgtcacctaaaatgggaactgtgaggatagttgaagattcatcagccctttcgtcacttatttcaacccccgtttccttgagaaccttcttactgttgatctttctacctttcctggtgaaagtactgaaatggaaatctacagagtcagaacaggacaaaaacagcatcgtcctggatcctccaggcttggaagtaatcttcttcaacagagaatgtaaagtaaccagtcttaacttgggaggcacaattaaaatctgttggattaactgatcaggagcctgaatattgttttcttcgtcaaatataacgtcctgatcaggaacggagtttgtggtgaccaattcagcatctttcagggagatttctcccagttttgacacaccccctttcatagttgcggaacaaagaacattaattctggtactgggcaaattagaatactttcggtttgcaattgttgatcgctcccctagcagtttcagtattttatcgagcgtctcctcaaaacccaactccatcagcttgtcaccctcatccatgatcaagtaactaacactactcaaatccagcgtttctgtgttctccatgtggtcaaggagtcgtccaggggtccccactaatatattgacaccttttctaagtctggccttttctgatttctttttctctcctccaatcacaattccaggaacgattctatgacagcatcgagtcagagtttctagaaccgagtatatttgagtagccagctctctcgtaggcgtcaatatgatagcaaataaacccgaatctctcttcaagtcctcaatttccataagtttttgaacaattggaatacaaaatgctagagtcttacccgaaccagtttgagcttggacgaacagatctctttctctggtcagtaatcttggaatgacacttctttgaatcttcgttgggtgctgaaatttgatgtgctcagtgagatgtttgtaaagtatatcattgcagcccaatccatcaaaagtagtagcatctgacaagggagcattggaaggatcttgaacaacggcctcttccttcgtctcatgctcctgtacttcaggatttgaagtgaatagagatgagacaaaagtgtcattttttcctcctcctggtccagtaccctctgcaaatcgcgtcctcttactcgagtaggttcctggtggcgccttctctttgttctcagttccatcctcagaagctctactctttctctttccccatttctgaaagcccattttggtcatattaccatctacagagccatctttgttaatgccgaaatttcctcctctatacttcactgccctaggttgtttcctcactctggagctatcaggagccacaaagttgaccattagcccatcatcgtcagacatttgttgaagataaagatgcagatgcaagatggaaaactgttccaaatttttttatgatagtatttttggttcgcgcattgatctatggtatttttttcttcatgtaggctcagccctctataactcaagtggtccctcatattttcgcagataatgagtctctttgtaccagaagacgatgaaacgcaactagacaccatggatttagatgtctccaaggaaaatttggacggagacagctcaaaagcggacatgaatagtgacgaagaagatccagtaatcaatgaagttcccattcatatcaatagtagactgagggaagaactggtaatcctacagtataccaataggtttaaacagagagagcaaccgaatatatcacaggtaagattcaaaccccaagccggagttcttgagttaaatgtgccactggaaaaatcaaaatacttcagtcctgaaaagtctgctgaatgggacaacatagataaacagatattgcgaggagtattgaacgagtcatctacgtattatgcgggcgtggtgaaaaatggagctatacatctaaatcctatacagaagaatgcacaggtacgaccgtactttgaatacatggaccaacgaaagtcagaaaagcagaaccagtttcaccagcagctcaagatagcgaacgaaacgactgatgcatcgaagaaggaggtccgtgtcgtacagatgtccatgaaaactacagtagacagtcaaccaaggttgggaggagcgcttcaatctaacaagagtgaatctgaagaggcatgggtcgattacgcttggttaggatcatccaaggagcaattgcagctagctaacaaagatgacactctgttacaatctaatatgacaagggatgagtatatgggagagttatttaaagaaactagggtagatctttaatcataccacattttaataagttcctcggaaacagcacttggtgttaggacacccaaatccgtgattaaagcggtaatgtattcatgaggagtaaattccaagtgtctcgtttcgataggtttatcttcagtgctgaactccaacttcttcttaatagataagtcatctgggccgagtgggaacattctaacaaacttgtgagattcagcaacaacatagaaccgtttgttggcgttctttgctaaaacacccatttgataacttccaatatgattaataattcctccgctttctgctactccctctgcccccacaaatactttatctaccttatgcatgaaaaatcctacctcactatcgtagatcatagccacaggtatacctgcttggcggagcaaatatgccatagtgtcagattttgcggtttccgtaggccttgcttctgtgcatataactctgaatcttatgtgtttctggaatgctcttatcagtaaattgcaaactactcgggagtacgagtgtaccaggacaatgtcgtcatcctttataaatggtaaaccaatttcagcaatcttatttctggattccttagctctctggataaataactggccattctcaaccaaattcgtcctacaagattcccaatctgagtacaaatgggtatttctcaatacgaatctcataaacagatcacaaccagcacttaaagaaatagcgtttggaacggaggttttcagctcgctgatggcacctgatagtagcgtaatgagctccgcactagtggaaggttgttttatcttaagaagagtgaccagtgattcaatggcggcgattggcatcgtgatatcgggatcatcttccagaaaacgaagatacgtcgctgtgatgtcaaattcttctaaaggttagtgggcacttaaagattactaagggtaggtgacttaccagaactcattcttgatggaaagaataatttttgtaacgactgaaataaaagtgaagaaaatcgaggtattagaccagtcgctcaaggacagtcaagaacacctgaacaggtagtagtaacgggagatctggggaatactcaggtaaaagattacttttgggctacataaagcattcgtcaatttttctttcgttttcaagtttgcttgtcattcatcatagcctgaatttttttccttcaccagaaccctcacctgaaaatttcagtcttgtacttaacatccgtggatctcaacatgaatttccaaattgctaggtttgggtcacgtttgttcggcacaggtctggacaagattcgaaacataggaatcatagctcatatcgatgcggggaaaactaccacgactgaaaggatgctgtattacagcgggtccatctccaaacttggtgatgtagaccaaggagacacagttaccgactatctggaaacagaaagaaacagaggcattactattcaatccgctgcagttacgattccctggaacaagtacaaaattaatcttattgatactcctggtcattctgatttcacttttgaggttatacgatcgcttcgagttttagacggagttgtgaccattttagatgctgtagcaggagtagaggctcaaactgaaaaggtgtggaagcaagcaaaggatatgaatatcccttccatagtttatattaacaaaatggacagagacggtgcaaattttaacatgactgtgcgtcaaatagtatccaaactggcaactagggttgtgctgtgcaacataccgtactttgtgaatgacctgaaaacccaaagccatcgatttgtcggagtagtggatatttttgagggcaccttgctcaaatatcacgagaacgacgatggaaacgacgtccaggtaataccgttaaatgaactatcagaattcaaggactctgagcaagtgaatcaagatgtaatgaaacttagagaagctgctatagagactctaggcgagtttgatgaccgaattgtcgattcttacttagaaacggaagactatatgaaagtccctacttacattctacacgaagcgttagctaaagcaacaatttcacaggatgtggttcccatattctgtggatcatccttcaagaatattggcgttcagccccttatggatggtgtatcactctacttgcccaatcctggtgaagctcaaaaaccctcggtctattcaccagtcgcatccgttcctgtcaaaattgaccccaaatctggttgtctgatcaacaataacaagaatctttgtgtcgcctttgctttcaaagttatcactcatcctacaagaggacttttgacttttgtcagagtttactcaggaattttgaaatctaacagcaaagttataaatactcagaccggggacaagttcaacattggaaagttgatggtaatgcatggtgataagccccatgatgtggaccagcttggcgtgggaaacattggagttatttcaatcaacgttgaaaataaaagaatttccactggtgacaccttagtttgtcatacacttaaaaagtctgcggatgggcttcataagaatgaaaaacgtttgaagttattacccattgaggtgcctcctcccatgttttcggtttctttacaaccaatgacagcaggagaccgaagaggcttggatcaatcactgaacactctgctaatggaagatcccagtcttcatgtccatgtggacgaagattctggtcagacaattctttccggaatgggagaacttcacttagatattgctaccaccaggctcagagatgacttgggtgcccgaatggaaataggtaaagtcatgatcaattacaaagaaactatcttgaaacccactactcccgtggctaaaagtatcgaagactcggctttcaagaaaggccactttgagattaccctgtcattagattcttttcaaggaaaaccagaagacactgggctaatcagaaaagattcagagggtgcggttttgctgaatgataataatttggtcatttttgaacaagactgtgagcctgactttattcttgagagggtaaagagggtctcgaggggagatcaagactgggaccttcctatgaccatggagaatattcaaaacacaatcctttcaagtattgcagcttccttacaagtaggtggtccagtagctggactatccatgcattcaatgattgttcgggtccataaatgggaaattccgcaagattttgacaaaatctccagtctggtaaccctcataagacaagccatatcaacgtctattggccaacttagtgaaaagcaaacgactctaatggagccaatcatggatgtcgcagtgcatgttggggactcagatctgggtacagtctcccaagatctttctacagcgcgtgccgcacaggttcattcaattgatgatgaactcgattctactagtagcgagaagttatattgggccaaggatctagctgagaacataccgctgcctcaagatccagcagatctagcttctgggagacacagctcccccatatcgggccgtaaagttgtcaaagctattaccccattgagagaaatgatgggctaccttccgaagttgaaaagtctcactcgaggccatggatcatatgacatggtctactcaggaatgcaaagagtttcgcctgagcgtctgaaggttattttggacgagtaagggtgatcaatgagttcatagaatgcatacaatgtacatatactgtaaatagcgggatgccagtcctgtaaatagaagattaatcttttcgcgaatggtagattctctgtccgtctagcaccctacctcttttccaacatgagagtacgcgtaaatatgaacgcgttcccataacctcatctatctatcactagcatatttgccccccatgtcgtaccaaccatacaataactttaatgacaatgcagaaggtggcggattcaccacctataacaataatgacggagatggccagggttcacagggaaaaactcaacagagaaatacaattaagccggttacaatcaagcagatcaatgacagcaagactataatctccgatggcgaatttgtcgtgaatggagtcgaattgaatatggtttcattcgtaggaattatcaggaatgtcaacgacaatacctcttctttgactataacgatagaagatggtactggatctctggatgtcagaaaatgggtggacgaaggctcagatccatccgagaataactaccctttgggacaatatgtatacgtcacagggttgctcaaagagtttaacgaaaaaaagtcacttcaacaggccactatcaatccgattgaagattataaccaagttacttaccactacctctcggccatcaaggttcatgtagaggccaatcaacagggttctcatcagcaaggaaactctttatttgtatctcagaatgcagacgaccatacaaacagcaatgatccttctgagaaggtctaccgtttcattcacgataacacgccctctatggttgaaggcgtccctatacagtacattgcacagtcactatcattgactgataatgaagtaatcaactactgcaaccagctttcagatgttggtaagatttacaatggtaatgacgatagcagctatcttgctgtctaatctattgtatacatgaaagtttacaaaaggctagaaggactgggcttttgcactgaaaattgaaccccacaaatcttcattgctgacgacctctcctccaatgatattcttatgtaccatgccctttgttgttttacttaactcttcctgatcgatgatgtcgctggtgatgttttggtccaaaactttaccatcgtcctcagtgcttttgttttctaccaagcgcattctctttcgagtggaaagtcttagaacgctttcctccactgtgtccttgatggtgaacatccagatggtggttttgtgttgctgaccaattcgatgaattctactaatcgcttgtagctctaacgctgtattcacaagaggttcacataaaaatacgtgagacgcattcactagtgttaatccagcggcttgtgcacgagcattcaataaaaaacatgtaatcgatgggtcactcttaaatagttcaacatcagtcagtttttctttatttcttccagaccctttttcgagtttcaaggagtttttggctcctatacattttaatccattctgtttcaaggcaatagccagtacttctaaaagttcaagccactggctaaatacaacaatttgaacatttgaaatcttgttctttaaccacaatgcttgcttgacaatcaaatcaactttggatccatacatcttctgaatagggatatcttggatctcttgcaaagtctcatcattcatgggcttgtaaatggaataaatctccttcttgaactcttctttttctgcttctgtatctgcctcgtttgccgttaacaatgatgccttaagatcatctctagtaaaggtaaaaaaatagatactaaaatgatccaagtgcgccttacaaagaggacaagtagagctcttcttgagccattctttcaaacattctttgcaatattgatgtccacatttagtcagggctccaatggtaatatcacttcggcaaatgatacatagcctctcatcgttgttttgagcattatcgcccaaagatcgaaggtagttagacctgagttgcgcttgagctacctgttgtttatatcgattctcttctccctctgcgcctctaagttgggctgctgggtccagtcctgttggcgaatatggcatgacattttcggatatttgttgcaaacccttgaaataattaactctgctattgaatgaattgttgaaaacagtgactattttagatgcagagtttagatttttggtcaattcatccacttgactagataccaaagcttttatctccagaaaagcatttttaagagtctcagaatcattatttccggcctctaacgaaatcctatccaaaagctgggtcaatgttattgaaactccggtcattacacgggctttttgaaattctgattcttcttctttcgtactggatggtattctataagttgtaggaacgcctctattcctagaggctttcaaacacacacccctatcagttaaggctaattgaatcacagagaggtatttgtcaatcttgtcttgttcttctgcgtagcttgacatttcatttcccgtggtttcttcggtctcaacaatggatttcgttaacagggaaaaaactactttgatccatttattgacatattcagcttgcgaattcaaacgatggtaaagaccttccaaatcgtcttgaaacgaaaagaaatgcccaccggtgacatctggaacttgaattagtttcaacaagttaactctatcaactttcaagtgcgtgtctgactctttgacatcaatatctttcctgtctttgaaatcagtgtcctttttatggtgagctttacgggtctccttcatgaatccgttgttcttcagaaaagctctggtcttggttaaaagatctttgtcactgttgtcaacttgtttgagtctttcctttagtaactcttttctgatatcttcagctttagcatagtatagcctttcaatttttctgtgttccaaagaatctctatccagcaattcatctggaacttcatctaggttttgacgactccctgactctttctcctcctccgttaattttggattgtatatttggttgtgagcagaagcaatgaagaagtagcatcgatgcaggagctctaaccatgatctcaatctatgtttcaaaagtcctttcttggagaagtccccattttcatccgaactatcagtctcttccatctcctctttttcatctaatggttccaattttacagggctaccttcattaatgccgtttagcaaatcatttaatgctttaatttgtttttcaatttctgttaggcaactttcccatatttccaatgctgatgttggtgccttcatgtactcatatatcataccttgtttgcatctcgaaagaatctcaagtcgtttcgaagtgtccacatcctgatctacctttaacagaatgtcatccaatacagcatccatagtctttaatccaaccagttcaaacatctgtttcttgatgttcccagatccaatttgagcatggcaacatattcttcgtaacttctctagccacactctcattgtagtcagaactgtcgaatttggttcccaattttccaataacggctctcctttatcgtttaaagcaacatcagacagaaaggacttgaaaagattatcataattgtctctttccactggagttagtgatattgaaagctgaattcgttgctgaggtgggagtttgatatcatcagcaaccatcaacttggtatgtctcagagcaatttttgaccagagacgaacaaatgtcagtggaggtttagcagacttgacaagttcccaattgggattcttgatccttactcttttctgagaatcattgtcgtcaaagggatggaatctcagaaacgaaagaattgcttgaagatcatccaagttgtttcgaatcggtgtgcccgaaacaccccaggcatgggctctaggaatcattttgcatattttcgcagcattagaaatcttactggtcaccatttgcacctcgtccaagatgactctccagaattgcagcaaaactaatggagaagaataatcgtatctctctacaaactcatctgagctttgctttcttaatgtagatgctattctctcacttttagcagcatcattttcgttgggaatacttgttgcattctcttcttctatttgtgccttcattcgtccatccttggctgcctttctcagaggtctatcggttgggttatacattgcgtagtgtacctctttggcaacagtattgtacgtggtaagaatgatatcgtgctctgctaaatgttcagcaatgatcgagggatctttgaattgtttattgttggatattcccttgtagaagattactttcaaatggggattgaagttgtaaatgtcatccctccattgcttgagaattgactcgggacatacgatcaaggaggatttacactttctcacgtttctacctgccacaggatcaaatatttggctctcgagttccaattcgggccttggatgaagcattatcgtcgcaatcatttccacagttttccccaatcccatttcttcagacaataggccctgggcatttgtgggggcaagagtcttgaagtatgctattatcttatcaggagagactatgttaccactatactggttgtaaaaatagacctcttcgtctatccttattctattccatccaaacgaaagcttgtttaaacattcaattaagtaattgtgaaaggtgtctgtatcacagctctcaggaggagaatagaaaggcaattgggtagtcgttttggtatcatgattgaactctacaccttcatgtcccaacagccaattcacggtcttactttggaacttgaatagattagcattaagtcctggcaccctgatgagtttctccggaaatgggggtgtccagttggaggtcgcattggagactagtgaatagaacatgggaacatctggtactgagtactcagttgatgttgattcaaacaaagtgggattcgaccacgataatttggtgattagattgagaatatgcgtggaccaattctggggaaagttaataaatattccttgatgaacggatattttgtattctaaatgaaacgcaagtggagcattctcagagaacaaaaatttgatctgtggtctaactatgattatatggtcacttctgtgaacgatcctgactcttttaaagaacgggagatgggagattaccaattctttaatcttgcctagtcgaatgctaagtagaggcaaagatgaaagcctttgcttccttatgcttttgactatcagaatgtcatctgatagagacaactcaatatctttaatcgtgagctcgtctccaagctgtctcagcaaagagcacccttctggctcatctatcgtcccgcaaaaatcaacttgggctaaatccaccgagtttttgctaatttcagccaattctggggagatcgggataggatttggttcatgatcatcctgtagttgattgtaccctctttttctcgaaacaggctcttccttggaaagcttcagcttcgacttgtatgcaagaacctgagcaatattctctatctcaaagatcacgacttcaacattttggtgaagtatacttgacattgagtgatatgaaaggaagttgattagattatataatctaggctaatctctattccgtgccatcgtaagaaatatttcgcgccatctctttgataaacattatgaatccatcagatgggtgacatctttccagatcaagtgcctgttgtcgctgtgaccgagttgtagttgtctttgactgcgaagtatgatatttgctctaaccatttatcagtattgcatacaaagcaatatgctagggttaactggttaggttaaatggatttttgttgtgaagatcttcatcaacgtcattcttaacagtttctgacgacctgaacacattcattagccttgtgtccacaataggccaaatccaggtgagccgttttagttttatatgactgctaatgtgactagtctatttaatcgctgtccaaattccgaagaaactatctttcctttaagaatcatggtagagccaacaagaggctatttcgaagggggctccctatttggaaacagtcagttgaattaaaggattgtaactacaagctatttttcaaaagttgttataaagaatcaggtttgaaacaacataccattacatgaaaaaaaaaggttcaccagtaattcatgctaatgtcctgacaacctcagtgtgcgggtcataacatagaagagcttttcactttagtgcaagaaccaccaaccatttcattgaagtctgttcctttgaaacattacattgcattgcataacatgacattataagcttctctttcgaagcttagatttgatggctcttatcaattcggtacggcagtctgctatcaaatcagtcatatttcctgtagaaaggactgtatcgtagattcagaaaatgacatgtcaatgcgaattatatgttggaactgtgtgaatactccaggtaattgctggaatgttcaccgctagttttccagatgaatgacatcaatgctatttactagcaaatctttgatttccggctcttacgaataaggtactctttattccatgacagaggactcaggaaagtttcgttgttccattaaaaattgacagttcaacaggaattgtatgatgtggataagtattagtgtcaacttaactttgaagtccaagcacaacacggatacagctattgttacctctcaattcacagctcgttggatcattgcatgtcaaggagattcaaaactcacactctacgccagaagagattcccagcaacaccatgtggctctaaagagattagcacctgaaatttgttacaggaaagtccacctggttcttcaggtgcaaaaccactgatgactgctcggacgaatatgattgcacgtacgctaactgctaccctttaaggttgtagttagtagtgctcggctgcatggtaattcatttcttcaagttgtgaccgctgttcccatttctcctcttgccgtcaagaaacagttcatatctctttcaggtgaaacccaattgtgcagtcatgccgcccagattcaggtgatggaagtggatataactacgattaagacctatgtattaaacaactttgagttacgccaattatttgccaagttaccctagcaacgctgttcagtctgcgtggtttctagcaaaatagatcgactacagctggttgacgatcaaaggtggatacgaaataggcagggcaggtgcaagccatgatcctgagtcgccgcttaaaaactttgttgggttgaatgcgtgtcacctacttacaatatgcaagacctctcgacccctagagggcagagattcgcaattcgggagatctatattttcctgacgagacattatttgaccggtacatccaagaagctgtatgagttcatatcctacagactctttcaaacgtacaaatcaagtactgctcagacctattcctgtagctatatattaatgatcggcccctataataaaacatttcgccccaatgagcaatataataccctgattaggtaatctatcttttgattcgctattgtcatttttgaagggggcatttcagataataccttttgcattgattgctccttgccagccaacgctccttttggggattctaaattcatgtttggcgtaagtattcccactccccaatcatgctcgatgaagaaattctaacaagtcgacagaatatcaagcagtttatccgacacgggaaacaagctcatgttcaaccggagcctaccaatcagccttctcctcgggaatcatacagcatggcaaaccatgctgtggaagaccgctttgattacaacatagcgactgatccgaacgctggtaatgataataccaatcaacatcaccataaatctgacaagtactccgagattgctcagggtcttgttgaggaagagagcaaggagcgtcaaaagaagcaacaaagtatgaatatggagagatacgaccttttagagaagatgggagagggtgctttttccgtagttcacaaagcgcaggataagactactggccaatttgtagcgataaagatcatccggaagtaccaactggatgctcaacaacaagcgtctgtgctcaaagaagtcacaatcatgagacagctgcgacatcaaaatattgtagaattcatcgatttcattgaaagtgaggactattatcttattgtgcaggagttggtttctgggggagagctattcgcagagattgttaagtatacctacttctctgaggatttggtgcgacacattatcattcaagtagcgcaggccattagatatcttcatgaggtggtaggcgtcgttcatcgtgatataaagcccgaaaatctgctgttcgagccaataccctttatgccctcaaagcaagtcaaacttcgaaaatctgacgatccatcctccaagagagacgaaggagaatttgtatatggccttggtggaggtggtattggtgtggtaaagttggcagattttggtctttcaaagcagatatgggaattcaatactaagactccttgcggaaccgtcgggtacacagcaccagagattgttcgtgacgaaaggtattccaaggaggtagatatgtgggctattggttgcgttgtatacacattgttatgtggatttcctccattttacgatgaaagaatcgatgtgttaacggaaaaggtcgccagagggcagttcagttttctgcaaccttggtgggatgaaatatctagcggggctaagaactgtgtttccaaacttctcactgttaaccctaaacagaggtataccattgatgagttccttcaagatccttggattatggagcatattcagaaatctcagcaagctcaattgcaacgtctgacgttgaatcctccaattctgccttcttccactactaaacctgctgctggcatatcgaaaccaagtacgaaacacccaatccaatctcttaataaaaatcttgatttggtcggctttgatactgaaatgtatagccctgctgctgttgctctgagagatgccttcgatatatcgaccgctgtccatagaattggagaggaagctgctttaggaaagacatatgctcaaaaaggacaaatggaaagtttaagggaagatgacgagttgcactctccagaatctctggatagtcctccaaagccggctaagcaaactattccagtttccgataaccagctatttgatttgtcattagcgggagcttctatccttgaacgaaggaagaacaaacgaaaaactgtgcctgttatctagttgtgtatcatagatttatcttatttttatgtatatgggaccgtcctagagtctctgtccgtctttgagtgacttgtctatcaagcagctcctcctagagttttccccagggcgcgcttgccgtttaactctgttccatcatctttggatgccaaaccttccttctagcttgaacaagatgactgctcaagccgtgaaatacgcaaacggtatgtcatctgccctctcccgtgtttgagactctatccactaactttagattttatcaccttcctgaacaattcacctactccataccatgctgtcgactccgtaaagtccaaattggtagagtcggggtttaacgagctcagtgagagagttaattgggccggaaaagtcaagaagaatggcgcttactttgtgactcgtaacaattcgtccattatagccttcactgttggcgggcactggcagccaggtaacggagtgtcaattgttggagcccatactgattccccaaccttgagaatcaaacccatatcccattcgactaaggagggatttaaccaagttggaattgaaacttatggtggaggcttgtggcatacgtggtttgacagagatttaggagtagctggacgagtgtttattgaagaagaagaatctggtaacattgtgtccaagttagtcaagatcgataaaccagtattgagaatccccacactagccatacaccttaccaaagagagagctaagtttgagtttaataaggaaactcaattccatccaatctcatcgcttgaaaactcctctgaaaaggagaaaaacaaagatgaggaacatgacgcttgtgcaggagaagatttgactacggaggagtttaagtcaattcaatctgttgtggagagacacaacaaacaattgcttgatctggtggctgcagatcttgattgctctatatcccagatagtggactttgaattgattcttttcgaccacaacaaaccagtactcggaggtttgaatgaagaatttgtgttctcaggaagattggacaacctaacttcttgtttctgtgccactgaagcgcttataaatgccagtaaagataccaacaggttagatctggatactaatattcaactgatctctctgtttgaccacgaagagattggatcagtttctgctcaaggagctgattcttcatttctacctgacatacttcagcgtataacaagactaactggtaatgaggttagcaccgatctggaaggacaaccaaattctttctttttagagtcaatggccaaatctttcctactatcttcagatatggcacatggtgtgcatcccaactatggggaagtctatgagaagctaaataggccaagaatcaacgagggaccagtgatcaaaataaacgctaatcaaaggtacagcaccaattccccaggtattgttttgctcaagaagattggtgagttgggaaaggtccccttgcaattgtttgttgttagaaacgactctccctgtgggtcaacaattggtccaatgttgagtgctaaacttggacttcgaacgctggacctcgggaacccccagctctccatgcattctatcagagaaactggaggtgctcgtgacgttaaaaagttggtcgatcttttcgaaagctattttgagaattattacaccttggagcctaagattaaggtataagatagacgtttggcgaaactagatggtgttagctagatttatatatcactactacatatatcatgtatgaggacttgattgaataattagattaaaaggtcggaatctgaaaaaaagacttatatatctttcaagaatgaaaattaggctactcgtatggaagatcataatagttgcgaccaatatattaaatactcatggcagactttgaaagtacgaaaagggccgctagtaaagatcatccaccaattatagtcatgtccaactaaatgatgagtattgttcacatccttggtcataggcctccaacatatccatcttcattacaggccccaacaaaatctaattaccactacttttccttatcgggaaattcagggctgtatcaaactcatcgatcgagacagattccacttggatgttgttgtgtctgtcacattggaaacaaagatcggcccatctgcttcctcaattgagcccacaactttcaaaaaaaggccccacctatacagatgatacccgttgatacctcatctgacagttgtatataacatagcctccccccataacccacatgtttgagccttcatttcctatttgattaagataacatccatccacccagatgagtgttacccggattgccggcgtacattgtagtatggcgctctctctagcgtatctgtcagactgaacgtgcggctcatgatctttcctttttttttttattttttttttcacgttttccgcaaaaaagaaaatttttttacctactttttttcttcgagggttaattggtataaaaaaaaactcacaaattttctctctctttttttttcccttcaatcagtaaagatgtctgctgctagtgaatctaaacaatcagctgaggtccttgaacagctttttgagaagctctccgtggcagtgccggaggagcgtgacaccgctgctgctaacgtttcttcgtttttgaatggttctattattgaacacgatgttccattcgaattcttcaaagagttgaagaagaccatcaagaacaagaagaacacaaacggtcaactgaatgccttggaggccattgctcacattgcatctgataccaacctgtctccttctgttgagccatacatcgttgacctgactgaggagatttccatcttggctggtgacaagaacaaggaagtccaagaggttgccgctaaggctttgcttgccgtatcgcagagtatcactcctgtcgctatcaaagtcattcttccaattttgactcaaagattggccgagaccgccaagtggactgagaaggtcgccattttggatgctatcacctcttttgttgacacttccaaagaccaattggctcttagaatgcctgagttggttccagttttgtctgaggccatgtgggacaccaagaaggaggttaaggccgccgccaccgccactatcactgctgccactgctaccgtcgtcaacaaggatattgaacctttcattccaaagttgattgagtccatcgctaagccaaccgaggtcccagaaactgtccacaccctgggtgctactacattcgtttctgaggttaccactgctgctttgtctatcatggttcctttgctttcaagaggtcttgctgagcgtgacacttccatcaagcgtaaggctgccgtcattgtcgacaacatgtgtaaattggtcgacgacccacaagttgttgctccattcatggagaagctgttacctgctctgaaggccaacttccaaactattgccgaccctgaagctcgtgatgttacccaaagagctctcaacactttgagaagagtcggtgctgttggtgctgatgatgccattccagaggtttccaccgctggtgacgtccaagtgactttggagatcttgaacttcttgaccaaagacaacaagattgccccaagattcgacattgccaagacttacattgccgccattgctggtgacttggttgacgagagattgatcgacccagagacttggatgcaaaacctgactcctttcctgaccatcttcttgcacgagaagcaatccaaggagcttgttgaagaatacagaaagagatctgtcgacaacatcccacaacctccttcctttgaggatgaggacgatgaaggtgaagatctatgtaactgtgagttctccctggcttacggtgctaagatcttgctgaacaagactcaattccgtttgaagagagctagacgttatggtctctgtggtcctaacggtgctggtaagtcaactttgatgagagctattgccaacggtcaagttgagggcttcccatctcaagatgaatgtagaactgtctacgtcgagcacgacatcgatggttctgaagccgacacctccactgttgacttcatttacggagacggatctcttggtactaaagaagagattattgctaaacttaaggagttctccttctctgacagcatgattgctggtcctatccaatccctgtctggtggttggaagatgaagctggctttggctagagccgttcttagaaatgctgacattctgttgctagatgaaccaactaaccatttggacactgtcaacgttgcttggttggtcaactacttgaatacttgtggaattacatccatcattgtctcccatgactctggtttcctggacaaggttgttcaatacatcatccactacgaaggtttcaagctgagaaagtacaagggtaacttatccgagttcgtcaagcgtgttccttccgccaagtcctactacgagttgggtgcttctgaattggagttcaagttcccagaaccaggtttcttggagggtgttaagaccaagcagaaagctattgttaaagtttccaacatgactttccaatatccaggtactgaaaagccacagattagagacatcaacttccaatgttcgttgtcttcaagaattgccgtcattggtcctaacggtgccggtaagtccactctgatcaacgtcctgactggtgagctgttgccaacaatcggtgaagtctacgttcacgagaactgccgtatcgcttacattaagcaacacgcttttgcccacattgactcccacttagacaagactccttccgagtacattcaatggagattccaaaccggtgaggaccgtgagaccatggaccgtgcatctagacaaatcaacgagaacgatgaggaggctatgaacaagatcttcaagatcgatggtactccaagaagaatcgctgaaatccactccagaagaaagttcaagaactcttacgagtacgagtgttcgttcttgctgggtgagaacattggtatgaagtctgagagatgggttccaatgatgtctgttgacaacgcttggttgccaagaggagagttggtggagtcccactccaagatggttgctgaggtcgatatgaaggaggctttggcttctggtcaattccgtcctttgaccagaaaggaaatcgaggagcactgttccatgttgggtctggatgctgagttggtttctcactcccgtatcagaggtctgtctggtggtcaaaaggtcaagttggtcttggctgcttgtacctggcaaagaccccacctgatcgtcttggacgagcctaccaactatttggacagagactccctgggagctttgtctaaggctttgaaggctttcgagggtggtatcatcatcattacccactctgccgagttcactaaggacttgactgaggaagtctgggctgtcttggacggtaccatgactccatcgggtcacaactgggtccaaggtcaaggtgctggtcctcgtcttgaaaagaaggagaacgaggaagaccaattcgatgctatgggtaacaagatcgctgctgtcaagaagaaggttaagttatcatctgctgagctgagaaagaagaagaaggagagaatgaagaagaagaaggctcttggtgatgcttacgtttcctccgatgaggagttttagatgatataattatgcatcatcttcacttgtaatttcttagtgatttatggcataggaaccgaatgttgtgtttaattcataagttgtacttagtctgtgtagagtgaacacagataatattttattgttgacctgagcggaaagaaaagttaggtgctacctttgggtgtcgcaactgcttaattggcctcctaaaattcgcagcaatgcaaatctcttcttgtagtatcttcaccctatcttatctcgaccctattttactttgtaccatttcatgagagagctttatattctgtcaattcttgttttactaactgtcatcagatctcaattagtcgtacagaaggctaatttcactagtttgaccaatgtatacgctccaaagacaattacctgtccgccgaatacctctttgataagaagagctgtaattattacccattcgaagattatttagaagttgaatgtcgactaaccttcaaaggatagtttatcaattgcagagaaaatttatatcaaatcaagacaacgaagaacccataaagaattgataaagcttcttaaatctctgaatatccccagcctgaacgtagacacactgttcaaaccaaacgttccacgatcagtcaatgttggaatttctgtgtcaggaggtggctacagatcgatgcttaccgctgctggggtgctctcagcatttgactcgagagatcccggtacaagtgaactcgctggtctattacaggctacgagctacatcgctggtgtgtctggaggaagttggcttttgagctcattgatcaccaatgatttcaagcctgtcgtagatatgaaaaatcaaatatggaattttgaaatgcccttgctggagggtttatcatggctggaacggtatgcggacaacgaagggaggaataatcctaaacaggtattagggggaggaaatatgcgaaagagagagcttgagcttcacaacctgtggtttaagaatatatcaatgagctcttcattgtctgcaaaagtacaatcatacttactagaaacacaggaacaatatcataaaacactcaaccccaaaataccagtcacagagagtcaagaattgaaaatgaaaatcagtgcaacctcaaaggttaaagacaacgcattcagttcatttctcaaacgtcttttcaacaaaggtcaagacacagataaaggacttcttcatacgccgaaaaatgttgacgacttttctgttctgaactattacctaaatttacatttggaggttaggtcaaagaaattggctggttttcaactatctctaactgactactggggaagagctttgatgagacgcatctctccagatgggccaagatcgatgaactttacattctctgaaatttattctttgccttcttttcattcatcggaacaaccatttccaattttgttagcagatatttatcagggctctagaaaccacagtagtattgattctcatgtattggagattaatccttttgaaatcggttcttgggaaccttacatgaaagcttacatgaaattgaggtacctaggctcaacattgataagaggtgagcccgtattttattctaaagggtcgacgcctgtttgtgttgaaaactatgacaacttaggatttcttacggccgcttcatcgtctctctttaactgtatattctggtacttgagcgaagctgtacagaaacaatcaccagatacgtacgcagcgtttaccagaatctttgatacttttggattgagtcctttgaaaccagattcgtatggaaatcattcggattatgcactaattaatcccaacccttttctgggttatcctagtatggatgacgaaataagctcttcttcgagtcttcacctcgtagatggaggagaagataaacagaatataccgtttgtgccactcttgtgggagaaaagagaagttgatgtgataatcgccgtagactctagctcagacattggcggatatcccaacggtaccaccctcgtggctaccaatcgtagattcaaccaaagcgcaaagattcaaaatcccacagtgtattacagacatcaaaacgattctgcttccgaaacaccaacccaacattcaatttttccagttgtgccatcttacgaagaaattgtacaaaagggattaaacaaaagacctaccttttttgggtgccatttggataaatccttcccactaacgggactgaataacacaagtgctgatattaaaaatttgagacttcctcctttgattgtgtacctcgccaacactctgagttcttttgcttcgaatacttcaacgttcaagttaagctacaatagagatgagatatctaaaatgattcaaaatggtcatgatattggtacatatagccattcaatggcctttgaggactatccgaaatgtttaggttgtgcactgctaaagagagagtttgataagaaaaccaggggaatggaatcaatcgttaaagataaggcaacactacctaaatattgcaaaagatgctttgcaaaatattgctatagctaaaaagagttacggtctattttgacctgaaaagatcaggaatgttttcaattagaacgaccgtctctttaaaaccatcaataactcgtttattggcaatcgtttcgtcatgttccacttcatgctcgtgatgtaaaagttcatgagctatatcttctggatgttgaattgtaacatcgggatcattttcggcatggtatttaagccagtgatgtctctcatattctgcttcaaagtccaactcatgccccactccaacacccatgtctggaagctctcctccttttgcagagaatttctgccattcatcaaaagatatttcgccgtcactattagagtctatcaatccaaaaacagtggaaataactttgtctttaactttctgggatatcccttcactctcatcatgaccaccagttccgtctccctttccaactacttcttcccttaaaaggccgtacatcctaaggatatcgtcgtggttcaaagaattaacatgtctatagtcatgcagcttgaagacagcgtcagtatcatgtccgtcgatatcatgttctgatttcatatgccacgattgccaggacatgccttttggaggagaagcgtcattcagctcagtatccacctcctttgggtcatctccaaggaccaaaggatagaagattaatagtccagatatgaacagcgaccacatgacagatggcaaaatgaagtcagtaactcccaggaaagaacgatcaagttgaaaaagcaggagatctagaattgttcgcgagcatcgcttaaagcttacatcagctttttctctccgagatggcgagacagaggcattttaggacaatcgaagtgctcgtgtagtgatattcccgcttgggaaaagagaaatggctctgctaaccgatccaatggggaaatccttcaaaccttgaacaagttggttgaattttacatgatctagttatagtttagcgcagatgcttattttatgagatcgcttatctaagctgtaattgtgctgatcggttaaataccgttgcccagaggtcgcagtgcgctttactatttatagaccacaaccagaaacacgacccctcaaattgaatggtttattctttggttgggggcacagagactgtgccatatccagagatatcaaaatagcaaagcaaagcttacatttatcccaatcgggcaattattccatcttgatacaattaccatgtccccgtgatccaaaatgcataagactgattgcgatctagggattgagatcaaagtatttataaagatcagatatccctcatgagtgttgtaatatttcttcatcaaaatgtctgaatcctccagtatctctctagttggaaacaccaacgttgctgcaagctcggttgtcgagtctttgacttccctggtatccgacttatccactgttgctgaatctgaagcaactgctgctagcgtcacttcttctctccacgagacttccgcagcatcaaactcaaccaatgctgcggccatggtacccgttcctgtgaactttgcaaagcttaagcttattgcagtagtgtcagggttggtaggcgccggtgcacttttgggatgtatctagtatatcttacatagcgtgatttcatagcaaaaaactttactagagtatttttacgccataataagagtcgtagtctgtcgaaacgttagaagggtacgacatagttgcaggacttcctatgagcagtagtagtctgcccaaattgcaagaagagatctgatctacacctggctaaattcattaaaccaaaacaccacattattaagtgtttctcattctattatacaactgattacacccatagacaaaaaaaaggagttaaataatttactcttcatcttcctcctcatcatcttcctcagtagcgtagaattgcaaacggtactcgttttttctgatggagatgaatctgatccagtctctgatctggttcttcttcaagtatctcttggacaagtacttcaagtacttaccagagaacttggtgttagagacaacaataatcttgtttccctcctgggtaacggtgatgtcggaacccaagttaccaatgtgaccaccgaccttgatgtggtcaatcaagtacttggcgtaagaggctgggtcgaaaacaccttgctcagttggggcggaagcgtcgacggtgaaagtcttagtctcgtagttaatcttcttggtctgatagggtgttagaaacagttcaatagagaatggcattataccagagaaagagaaaggcgtggagggatcttttttacggtctattaactaacgatgtgacaaggggcaaaccttggatttcaaagacggattaacattcttcaaaatcaaatcattaggttaaatatgaccttataaataagaatcactataacacatttctgatttggaataaatgagggaataacaacttacagatggagccatttgagatgattgaattgtgaggagagaaagaaggaggaaagagaaaaaaaaaattcaatttaaacatggtttgaaaaatttcgagaattggtaagcgaacgaccaagcagattccaaacgtcccggtttgaaatttacacaacagatgcgtataagcgtgcactacaaattattaggaggatggatatcatgtcattaggggaagtgaactacttactataatgtggtcactagaagagaggtcagtacagtcaatgtaatgagccaactgcttttcgaggaagtggttgctgtgttttcgggtgtttccgtagtcgtattaacatcgggtcgacttgggttggaagagtttgatatagcggtagttgatccacctagggacactatcgacacgccagcatcatctgttgatgtgcttactgagtttacaggcccaacttctatggtgcttgtttcaatagcgtgatctctctgctgtgtatagctggtccctgattgtaggctcttgaagtatccgctcgtagatagcgtactctgcgaatactgtggagtggatgtaaacgagacagacgtatctaccaatagtgtgtcagacatggtggttttcaatcgacgagatctgtccgttcataatgagggatcctattacctttaaatccacttctctagtagagagcagcgctgcacctgcattcgtcgcgtgtgtctgttagattggaatgtgtttgaaacatctttcagaggaggacagagggtggtattcgcagattagtgcgctacggtcgaacatctttttggaatgtagcacctagcaatcgtcgctgacaacagagcgcattgcgatggtgcattgttgaacgttttaattgcgtatgaatgacgaaaccaccctgtattgcgatacacggtatgaaaacggtcgagcaatatctaaattctttagtctgacaccaacactaaacgacttcgacgggtcatgctgacacagtagacggggtacagctgtatgatgcgcgaactgacctcctaccatagtttccactatgaatgtgaggtgtgcctacaggagaatattaagcgttttcagaaaccccctgctgcttgagccggtaggcattgttatagtatatgtatattacagattgtcccctgtccctccctcccttgtggtgaactgatttgcggtagtaaaaaaataagtgatctaaagatccgaatgagaaatgaggctataagttgtgagatgttaggtataagttatgtccaaccccgatggacccaaggtgtgtgtttgacttatttatcctctctcaaacgacaaaaaaagaggtccaaatccactttcaccacgaggtaccaaaatctgtgtttaaggaaatgtgactgagaagttcattctagctcggcattccaatttttttcttgtatcttgagatccaactgtcgcaaaagtttaccggttctatcttgttctttttgtatatcactagctttcattgtggttttaaatctgacttctgttcttgtcaaaacagctctggaactggaggcttccgcagcaaactctcttaatgcagacgatctctctttcaggtagtccctcaatgctaacgcctcggtcattgttgcttctacctctttctcttcaatggggtgatagaattttaaaaagatcttggcattggtaaggttgattttaacgacaaggccgacgtactccttgtgctgttcattgtactctaccaataatgcattgctattctctggtgcggaagtaccttcttgaattgtgatgttccgccgtatcctattctccaattgcttcaggttcttatatatgtcttttctgatgatgagggcttctgccaacttcattgtgaatggaacgaaatggttgaaaaatgataaagcgaggtagggaaaactcgatgcctatttataatttttcagatgtgtcagatctacgagtgggaaactaggactatacacttgcatactccgcattgatatgactcattgaagcaccgccccgttttattatttttttgggtaagccgatgctggtattggagtcttcagtgttgtcgggtgtacttgaatgtgcttagtagtgcagcattgatgattcagcctcgccctggatccgattgaacccctttatagtaactgcttgtaactgaatgattaagctttctacgcaaacacttgtgccttgaaaggacaatttactgataactgatggggctccatgactgcatgatcttgcttatatgagtcaccaccaaccattcagcaaaggtttcttgcaagcccccatcgacatcagccaccaaggcattccttttacagcgtcatccagttgaatgaagttcacaattagatcattaacatcacataaacatacataactactacttatgttcaggagtgtaagcaattctgatagccttggcttgagtgtagttatccaaagcctcagcaccaagctctctgccaataccagattctccataacctccgaaaggaaccatgtggtggaaatcgttgtaggtgttaatccaaacgacacccgccttgattctactggcaacatcaatggctttgttcaagttgtttgtgtgaataccagcagctagaccatagttggtgttgttggcatatccaacaacctcatccacggtagagaacttagtgatagtaaccacaggaccaaaaatctcctccttgacaatcttcatgtcttcagtaacgtcagcaaaaattgtgggcttaatgtagtaacctcggttacggtatcttgaaccaccggtaattacacgagcaccttcatccttaccgtgtttgatgtaactaaggattctgttaagttgcaactcagaggtctgaggcccttggaagacaccttcttcgaatggtccaccaaccttaacgttatcagtctccttcttgaaggcttcaagcacttcttcatacacagtgtcttgaatgtagactctggaacctgcacaacagacttcaccagaattgaagaagattcccaaaataatgttatggatagtcttctggatatcagcatcttcaaacacaatgtttggagatttaccacctagttccaaagtgacttttttcaggttagatttagcggctgcttccatgatcttacggcctgttgcagtggatccggtgaaagcaatcttcttgattctgggatgagcagcgatggcagctccagctgggttaccgaaaccactgagaatgttaaccacaccaggtgggaaaccggcctccttgatcaatttggcaacgtataaacccgacagaggggtagactcggcagtcttcaaaacaacagtgttacctgtggccagcgcaggtcccaacttccaagccaacatcaggagaggaaagttccatgggataatttgtcccacaacacccaatggctctcttttaaccaagttaaggtgggtgtttccggaatcaacaacgtttcccaaaatcttgtcggcccatccagcacaggatctgatgtagttgacagcaagagtaacatcaccctgggcagaggtataggccttaccattgtcgatggattcgataccagccaagatgttgaagtcacgatcgataaggtctgccaatttgttcatcagctttcccctctctaatgggtcctgagtagcccatacggagttgttgaaagcatcttcagcggcatcaacagcacggtcaacatccgctgcagaagcttcccaaacttgggttattttagtctcatcacaaggattgatcactggtaagagctttccctctacaccttcaacaaactcattgttgatgaagagtcccaatggttgagtgtacttcaatccgttaggaaggtcaatctcgaattctaagggaggagcaaatgtcatggataaaggtaagggaaaaaagcaagtgtaaaggaattaatctgaactagaaagagtcagaaatatgattgcaattggagaagaagaacacgatcccttgggaacttgcggtggtatttatacgtgatcagttctaataaccctcatagtggtggagtatagggtgtggggtaatttgtgaaaattcgggggtgcggtctcggttgcgcgtgatggcggggggtaatttgaatgtcaaactgaacaccctctccaaaagagggacgatgtagaggagaaccgttgagcggaatcatgggtgatgtcagggtcagggatataggaagcaaaacttaacaagatgggagatgattggtcgaaaggtgaaatagtatagttgatttgtataggttacataaaagtatacccccagatattggttgagtatacgaattcaagctgaatatggaaaatactccgggacacacatcattgcaagcgatgtacatcaaactgggggtgtaacgaaacaattgtcaaaaaatatgggctttgaaacaacggttgcgtgggaattgtagtaatgggtcccagttcacactttgttcatgtatctcgcaacaataaatgattcaattgtggacaagcgcacgatatgcttataaacctgttacaacttccaaacaaacttgagagaatcccacaagaatcctttatttacctcggagtttgtagtgacaaacgagacattgttagtaccagacgttaaagccccacttgggacatccaaagaagtaaggtaccaattgcctccatatgaactagacctgtaagtggatttgtcattggttatgttcgtgttgaaacggtcacggcccagaacgacatcgtttacatggacggccaaactggtagagtttccgccaacaaaagtagcgtttccagtgtaaccagcaaatgacaaatataattgagcatctctcttgacatcgtcagcatcgacttcaaattgaacagtccatacaccctttttgccctttccaaaacaccagtcagattcattgtcttctccaatgacatacgtcagatcgctggggcatgattcaatcaacatgttttcatacttaagaccaccatctaggaatcctagagtggtgcggtcaaaagccccaatgctccagagctcttcgaatttttcgtctgaggcgctccatttgatggtaccaagatcattagttttacctttgtgcacgttaatctttttttcatagaggaatgtttccagttgcttatcagcagcagtgtagcgtgaccagaaacttccaaaggcctgtaaacggtaggatgtttcagtacgaacgtgtggaatctcaaagtagccagcatcatcagtgaatgaatagtattggtatccagcaccctggaccattgtgtagttctcattacctaagaataagttaacgttggaggccggttggccgttactaagcaccagtcttcccttaacagttcctctactttgaaatttcttgtcctctaaccaacgataaggccagttgtgacgttctttcgttgctctacggaggagatccgccttgtcaccgttgttgaagtaccacaggtaaggaccccacatcttgtccttggggaaatcttcaacaaagtctgcttcaaaatgggtaccatgtaacatgttcaacaaaacaacgtctcccgtactggactctctgtggaccataagttcctgcttagtttgatcacccacgtaaaaatccctacctggggaaaccaaccagaacccataatctttgccggtttcattgtaagttccgtacacaccaaaagcctcttcttcatgagtgcgagaagaccaatcatattttgttatgtaggaggagttatctggagctaaccaagtctcatcaaaagttttcgtacccttgaaatcatcaggaaaagttggtagcagaccgtccttcaaagtggtgtggcctgactgataaacgtctggattcaagcggaaaagagtacgaaactcgcccagtgtggggagattcttgttaacaaaatatgaatagaatccgtcaagaccctggaataacaccatgtgatgttcaccctcgtaggcattgaaagacaagtcgatcatgttttcagtctcgtcggatatagtgacggaggtgtagttgagatcgtggagtgccccttcataggaagcatacaagcccactgcagacccgaccaggtcaactgtttcattgtcgaaaccggagttcaaaccgtacgggttccacagcaattttgtaccatattggggccccatttccaaagagaacttgtcgttaccaaattttacaatctgggtcgaattgtcggacttttcacttagtagatcaactacaaaaggagaagattcgtccaccagggatcttggaacggtatcacgaggtttaagagcagcagcacttatagttggagccaacagcagtaacaaattcaatggcaagagcatattcttggtatgattctgaaaaagatctttccaacttatgtctactgaaggtcagaataaataccttttatgaaccacaaccataggcatcttaatgagatacaaaaatctggggtcaatacgaaatatgcaggttaagaaagcggagagcgttaaacacatccagttttattatccaatgcactgctaacccttatttttggactaacggtgcaggacatccttgaaactgtttggtggagggtgtttccactttcattcattcttcatagatgcatgaccgggtctgtagcaaaatcataattctatgattttgtctattgttcaggtagagcagctgagcacgcaattaattaggggtcagatccggtggattggtaactcaaatcgggaaatttgcaagctacgaggagtcttaatagggaaagaaatgaggggtcagggttactaccttagatcaaaatgccgaaatttttgtagcacagtggaatgaatatgacaccttttatagaagagacccaagaagtcccattattggctcttagcagctaatagaggtcacaacggtcatacatgagtgagtgttttgaaatagcatgcttcgctgtgtctgtgaagtttgagagttaaatttcaatggggaaccgattacttagattcagttcgcgaaggtgccaggctttagttttcctgccagctccttcctcgttccagtcaaaagatgcttctccttctagattctagcaaacattccgctgatgtcctctaaccggacttatgccgagctcctagagaaacagggtgaacgactccagaaaaggtggaggtcaatcattgacaaatattctaaagtggaccttgacgaacaaggcgatctaatagatttgcacaccggtgagatcgtggaagacaatggtcacttggaatcagtgtcttccagaaagcataatatatggaaagcggagaaagaggatattctagatgaagattttgagagcaccgaggatatcgaagcggtagaccaaaattcagaacaagacattggtgaggaatccagtttggagagaagttcagatgagacttcaggagcgagctcaaatgagagttcaaatgagagcccagagaactccgaagataactcagagataaagtcaagtcagggagatgtttcaaaggaatctttgagcgaggactcaaaggcttcgaacgaccaagaagaaccggaagaccagatcaataaaaggaacaagttaaagaagacctctaagcttaccttgcaggaaagcttgccagtatttaagaaatcgtctctagatcccagttcaaatgatctacgatatgacaagcgggataacagattgatagcggatgaaaacagtcttagcctgcgagacaatctcatattgatcaataaaaacaccagcacccccttctcttcgccgttgcgaagaagtccccagatacccctcgtatctcctacaacccctaccagaaggacgccgaagcccatatcttacttcagtactccaagacgaacaaaacctgatataaagaatgagcttctccctgtttcacctaaaacagcatctccaactaaaaggcgaaggagctctagaacacgggaattatcttcctcaacaaatgcagtttacctagatctgaccaaagaaactaatctgggctcaccctggacagacaaaagccccacaaaaagtccaataataaatacccggaccgataccgaaagagacacagcaattgacgatgaggtgctaatagataattgaaactgtgcgcctaatagaaacactgaaaaaactcagtcagagtactattttttgaatagatatcatagatacaagcaagcttacgttttgaatagtgctaatctaaaaaggtatcatcaattcaccagtagctataaccccgtacaaggtagatagatgaggtagcaatcaaatgcgaagaatataaactgtaataaaacaagaaaaacaaaacgaaaaaagagggtcaacagactctgctgatctcagtatattgggtataagtgggagcgtttagtaaaacacaagtttggcactaccagaggtaacagtgacagtacaaccatcagttgaactaccaacgaagataccgttctcgtatttacaatcaccgttgatggaggacccatcagtagcaacgatcttgacgttgaagttgggagccttcttgttgtttgggttggggatcaaagataggtaagttaaaccacctgtagatccggcacccaaaactagaggagcccagtttccgacaccactactttcgtcaccccaaatacaaccgtcttcaacgctgacaccagcgttgttgacgtagtattgggcactggtcttgagaccttgccattcgtagtagttgtcttcatcgacaacggtcaaagtgttggagtttccagcatcgacccaggtgggaacacacatgttttcggaaccagggtagtcagttctgcagatagagatacctttggaaacattgttctctacggaagcggtacccttacctggaacacagagggtgtcaaaagcagtgttggatcggtatagcaaaccgtccttacacaacaaaccacctacggatcttccatcggatggctgattggaaggccactgggtcttggagtagccggcttcacatgcgtatgagcagtagtagccgttctcacaagattcagaagtcccaccttggagattcatgatggaagaccatcctccaaatcctaaccaactgacggagacgacaccgtcgccggatgggaactctgaacatttgatggtaccatctttgaagcttgagagatcgccagaggcgccactggtataagaggaagaggaggaagaagccgatgctgctgcagaggaagcgaccgatgctggcgcagcagaggaggtgacaacggcctgggcagagccagcagcagcggtttgacctgctgcaacagtaacggtttgtgtcaccacagctctcttttcatgtttgtgatgttgttgttggtgttctaaaggagcggaggccaccagagaggcaagagccataaagataagttgagatttcatattgagaagcacggttaaaaaatgaatgtaaggaaagactgaacaaaaagaacttggaatgaatgtaagtacctataaggcagtgagtaggcaagtttctcttgtagttggagtgatcaaaggtttgtttctaacgaacgtcagatcgagctggatttgttaaactatatattcgggcgagcaagagtctgaagaaaaagtttcatgataaatctagatttattgccgcatctggcaatctcagattaacataaataccgatctacatactagcaacattgatccgatcaagtgggactggcgatgagggccttctcaggaggcagagatggaaacctccagtgcaattgagggccgtcagtgtgcagcagtgccgcctacacaaggccaataacgcgtggcttagcgtttgagtccttgaaggttcgttttagattctccttgtgagaaacacccacattccatacattccgtctttaacacacagtcgtgcacttaccacgttaccggtgttcaaggcaacatggtgcaagtagttacacttccctttttggccatatcgcataggcgataggtacctaatttaattcatacactctattaataaagaattatatccctgccaaaacactagaacacctccggtaagcgattaaaccgcgtgtgcacacatggcgcccaaaagaccagctcttgagggtgaatggctcctccttgcctacaatgtgtcgccgtctatctcctctctctctctaagctagcttgaagtaggagctacacccgccgtctggagcatggcacaattctagctgctggaacttttcagagtacttgtggaaatatagcccgctaattgatccagttagttggctgaaacatacgtagtaaaatccagcaaacgatgccccctttatatctctaactttggcatctggaatcaaaaacatttccttccatctcatgtagatgaactcgttgtttaggtagttatcatagatgtgactgttgagtacgtcattcccagagttgaaatttagacttcgaaaactggggaaccgagaccagtgctggatatcagtacgggaatcagaaccccagctatctttattagtgaagaaggagaatttggggccaacaatttctccttggaaaagggtaataatttcgggatgcgactctgtaagacctttaattgtgagaaatccagtcaatgtggactttttgagatcgacctgtttcaaatcaacttttacttcatacgtagatcttcctgactgctgagacccgatgaacgaagcatttggcttcaaaaatgatgatgtgagaggctgtactcctttgtgccaagatttggttgaggccaaagagggagtaaattccatggagatatacttgtcctcgctgacattatttgctgaaccggtatgcaagtcgtatgattcagtcttgttgtttaatttggatccttctggctgccaaccttttacctcttgctcatcgatgttggcgtgagcatcatcacctgttaacgcatccttgagatgtctttcattgtttactttatctttggctgtctttataggatcctcttctttaagaaaggatgaattgtcagtcacacaactattggaaggcatctgtgtatgctatgagtcaatcaagggtaaaaaaaaaacgacacacaaaagaaacaaagggtattatatatcgtgctctattaagatgactcaaatggttggtccttagttccggaacaaagctgatgtttactttctccactggtaggcctcctctttttcgatttctgtcgaatgggaccctgaggaatgattcaaagctcccgttaggctatcttattaggtgcggttaagtgggaggattgcaggggagcacggaatcaaaaatactcttcgcggaccgctaggcccgattgataacgtatcgaaacatgtgatgacgtaatcaccctggtttctcgtgttatctagcaaacacactttgaagatcagtggcagagtttggggttgacactgaaaaatggggctgctagacaaactgaaagagaaaagtagggctaagtctggtggagcttcaaactatgagaatagtgagcaccagtcccaaactcatttgcgatattccagacccccggcaccattgcccaagtcatctaatagctctgccaatctcttctctaaaaactttcttcttaaccaagatgtgactacgttatttccggttgctgatcggtatccggtacccttacctgcaggatactcaagagcctcaagtccacttcctaccaattccttttacgaaacgttattgttggaagatcactcttgtccagtatggacccatccctactcattatggatccctcctaaagacatgaaccggccaggtcttgccttgaaccacgtagatgaacacatgaaagtttttggacctgacaataccttggagcatccccagttctttttcagccctgttgccattttgtcgttgtgtttatcggcaatggaatttggttcaagcccagttcaagtgtctgttaccaataccaaaaagttgtactgtcatttaagcttgtccaatggttacggatccaacataactgttccaataattcaggggatggcatttgttagtgccatttacgagaattgccagccaaggttgtattctaatgtcgggttccgtgaattgactgcagttggaactctcaacaatggaatgagaaaatatcgggccactttgaacgataatacgatatggtctttgtacgtatctactcactgtgatctgcaattcaattctccggaagaaatcacctcatgttcccaaggtccatttcaaggccaaactttggtccaagttgcgaaattagattccccccattacgatgagatatgcgggaatgttgtcactggaatgcacttgtacggggactcctctttggtgcagaatgaaaccactcagacaggcacttatggatttaactttgacctcttacaatccaatgggcccagtgacctcgcaatgtggacgttaccccatcaatacactgttctttcttgcgggaaggttacagatttatctctgaattccaccgtcaaagggccgatgagattagtgcgtacttccggaaaatctgtattaatgacagaacagcttccccctcatgagctccagtttgctccatggacttcgttacaccaaagtaacactagccatgctatatcaaagaaagcccaccaggaaatctgtcgtgttgccagatcagagtttgcagctgatcgaatagtagaatggagttgcacagactctatgtatacctcaggaaagatattggacaaggcagcataccaactatatgtcttagcttatgaagtccgtgatagagagctgactttagaggctttaagaagattagaggctgctttatcaagatttgttaacaacaagcaacctcagccactgtattatgatccgttttggaagggaatcgtgtctggtgctggccttgatggtaatattttcgtagattacgggaatacacattacaatgatcatcatttccattatgaataccatatacacgcagcagcattgctggtcaaggtggacaaggattttgattccggccagagagagcgatggattagaccctgggttgaagcactcttatcggatgttgcaacccctattgaagaccacagccaattcccccagtttcgatcttttgactggtttcacggccattcttgggctaccggtctttttgcacggggggacggtaaagatgaagagagttccagtgaagattacaatatgagttacgctctctattgctggggtctcgcagttgataataagcacttagtagcgatgggcaaactcatgctgggagttcaaagacatgctgttaacagctacatgctatactcggacgataatcaaataatgccgagacaatttgtgggaaacaaagtgagtggaatattgtttgaaaacaaaatagatcacactacttactttggccaacgtccagagtacatccatggaatccacatgcttcccctaactcctatttccagcttcattcgaaatcccaagttctgcaaggaagaatggaatcaaagactaggaaaagaatttgtgtcagcaattcccgaaggaggttggaaaggtctactgacgttatctactgtcttatttgagccagaatttgcatacgatttttttgtgcgtaaggattttgatcctttgaatctggacaacggaatgtctcaaagctggtctttgctccttgcagctcatgctgcccaaaaataaactacagtccaacgtccaccaacgtcccttgagaccctttggaccctagtgaatcgagtaaagccgtatatccagagtgccgctcctgcgcgaactattcatggttatcaagttataaagcacaactttgtcgcaatctcaacacacaatttattttgtattcaatgatcccagaagatccagacaccaacagaacggctaaagatcttactgctggaagtatcggtggtattgcacaggttttgaccggtcaaccgtttgatatcgtcaaggtgcggcttcagagtgctcctcctggaagattttcaggtgctttggatgtcgttcgtcaaatattctacaaggaagggcctctcgcattttacaagggaacattgactcctttgctaggagtgggagcttgtgtgtctgtccaattcagcgtcaatgaggctatgaaaagattttatgcctctcagggtgtcgctctgggcaatgctcagtattatacatgtggactatttgctggtgttgccaacggtttccttgcatctccaatagaacacgttcgtatcagacttcaaacccaaactaataaagcctacaaaggaccattggatgtggctactaaattgctcaaaactggaggtatcacgtcattgatgagaggtcttgggccaacgttgataagagagggccagggaatgggtgtttatttcatgacctttgaatctctcgttgagagaactatgaagcacgatggtattgccagaaaagacattccagggtggaagctatgcgtttttggtggtcttgctggttactccatgtggtttgcagtctacccggtagatgtgatcaaatcaagactgcaaactgataatatttccaaccctgaatttcgtaacggttttagcgtagccaaacatatttataaggtggatggagtgaagggcttttttagaggatttgccccaaccattctccgtgcagctcctgccaatgcagctactttcttggcctttgagtccgccatgagattacttgattaaaggtagaaggtaaataagaactatacatacatagaaagaacgccacaatagattttaccacaagctgttggataatagtctgttcatcagctgagtcttgcgttgagggtcttgagcttctgcttcgtcgtcatctcctaaccttctaagcagatattcaacctccaccttcttggtcagaggtataactacctctttgtatatcttagcaattgcctctggctgtacttttgattgagggttctgcgaatacctaagcgtggggtccgtaccataggcatgacctttggcaattaaacgttccaaaatcttagcttcaactgcggaatctgtaatagcttcttcaatgcccttaatgtccttgttgcggatcaaattagtgtagcgggccatttcattttggaacttagcttctgcgacaaattttccaaaatgcactcgacgactcaaagcctgcaaacaatcaacatctgcacaggctgtggatccaatattctcatcttgatcacctttcttagctgcaatttggggaactatcttttcaatgtacacagttctgatttcgtcatttacgttcacctcatcggcgtagtcagccaaaattggagggtagtttagacttggaagaaacgattcttccagttgatcagggaaaaagggggtctcgtctggagactcgtaacgcctgacaagcgagtgggtcttctcgttttgcaagagcaaccagtccaagaaagaacctgaaaagttggggatcttgtacttattgggggcgtacacggatggagattcgtagaactgggacctttcgatgaagctgaacaccacggtgtcttccattcggaccaaggcctgtctgatattggccagattcagcactgttgcgggtttcttgaactccattctgagtgggtgaaggtaagaagaagcggaggaaagatatgaaaagggaggaacgcagagacgaggggacaaatcgagaagcttcttttctatgaacagtcgataaagaccagccagataacaagtttaagccagataacagagaacctggggtgtggggtagagggccacaaacataaacaaaccagagcaatgggcccgattggttggtactttcaaaaatcaaaattggagcaacggactatggcttagtcacttttccttgcatgctaaattagcctatttatgctcatcgtctactatcttccgcgctggtggaggcgcccgattgggaggtagccgcgacaaaatctgtgttgtaatccatcaagcgatcagtacttaaggcaacgggctgaatatgcattggatttatgttccccatgattaattcgttaagtttacggagccagagaaatcgatttattcgtgtcactttgttctgctcaaacccgtaattagtgtaacacctctcaagatccgagagacatttttcgtgaacctctgtggtttgcgcttcaatttcatctagtcctccaacggaccaagctagccacaaaattgatacagccgctgccattgataaggctccagtaagaaaaatgcgattcagttcttccctttctctccgcgctaccccaggatcctgctgagcccgcatcctagcaaaatcttcccatgtaccagcataaaagaattcatgatccgaaactccagctccaccaaatcggttggtggatgcctgcgtggaatgcctggatcttccggggccgtgtggtgtaacccatcctcttcctgaaatgtcatattctctccgggctttagtatctcttagcatttgataagcagctgagatccgtcggaagcgttcttctagctccttccgggatatgcaaacgcgatgtccatgtgtatcggtaaaggtgacctgtgtggtattggtgtgcaagtcaggatgatatattttggccagctggtggtacctctgtttcacgtctttagcgattgctccgttcggtagttgaagggagctgtacggcgtgtccgggttccaggttaacagtgcttttatatgagattcatttgtaattatgcggtcactgagattggaatacctccttacaaacgagatcattggaggggtataagaaggaaggtaagagagaaatgataaggggtttgcttttgacatttcccaaaacccgcgatttcggttgatcccaggtattccaaacctctatgcattggtaaagaccgacagaaccccagacagtacctgaccataaaatttaaacataacttaatctactctactctatttcagatgaatcctatttctcaccggttccaataccccagttattgatgttacggtacattttcaccccgttttctccatcaacaaactgacatgaacgtccactcttccaaagagagacccacatgttttcaccactgtagcgataatgctcccccataactttcttaataccttcactggcctctcgggcgttgtagaaaggaattctactcacatagtgatgcaagacgtgagtttcgatgatatcgtgaaagaagaaaggtccaatgaatccaaattcacggtcgatggtagcggcagctcctctggcaaacgtccattgttcagcctcgtagtgaggcatcgttggatcagagtgttgcaggaatgtgatgaacaccagccaatggttggtgagaacataaggcaggaaccagtaaataaataagttccagtttcccatttgttgtctccacacatacaaaaccatcaactgtgccaagatacccaggtcactcagaatgataaaccagtagtcctttttttcgaaaattggagatgagggaacaaagtggttctgcatccatttaggggtgttggggtagggttgaccagtaacgttggtgaacaaatacaaaatccagcctcccaattgttgggctaccaactgatataatgtgaaaatgggagcatcttctcccagttcgccaagtttgctggcgtttctcttttccaagaacttctcctttgtggcaggtacaaacaccatgtctctagtcaagtggccagtagccttgtgatgtttaccatgactgtatttccaagaaaaatatgggactaacaggtaagaatgcaaaatccatcccacggtgtcgttgacccaaccataatcggagaaagcttgatgaccgcactcgtgggccaaaacccacaaaccagtgtactcaacagataagagaaaaaccaaagcggcgtaagcagcgcctctaaggaaaacattctcaatcatgggaatgaacgaccccatgaacatggtacaaccaatgaggaatatgtccctgaacacgtagtagaacgacgtggttagcctgcgttcatagcagtgctttggaatagcatccaagatttgcttgattgtaaaatcagggactttgaagacgttaccccaggtgtctatggcagtcaaacctttggattggctgaaggaggaaacattgcctgtacgttttgtggtggtggtggtgttacttcttgaagcatcaccattattacctgtaactgtgacggcagacattgtggaattggtgggttgaaatgcacagctctctaagtagtatcacacaaagagtaccctacttttattaacagtaatctcctcaaaaactgaagggaatgatttaaatatttggctgttaaaatataaaagtggaatgggaaaaaaattgtggaataaatcacctagatcttcctttcttatttttcgagcatagcgtttgttgggtatctttggcaagtaatgtacggaggaacaaaataaaaccgcgtagcttcatccccggagaccccgggcacgggggccagtgcaggtaccagggttgcgtcaaggaggaatggtagtttaccacctcctggcacgttggcttgtttgcgtacagctgtcatcttctacgcatgctgatcatttgattgtgttaacctgctatcgggaccaaataatccgggggattaatcatgtaacggctagacatctcacccaatgagagaggtacggagtaagaaatcatttcgtggccaaggttaacgcgggatcagtgttccttaatactattaaactactctgcgccgtcgcctagcaaactaccctattccttgaactcatctccaaagattacctatcagtctgacatgcaaatcgttttgtataccattcatcaacctaagtttcaagtacaaataggtatagtatcatcatttaggcaaacaaatatatcagagaacgagtaagaaacgataggcgtatcccatcagacagtcaaccaatactaaaggaatcgcctgaccccaattagcattgatcgggttgtaaagtagtcagcagcacggcttgtcacagccgaggatcatcaaacgattaacttaacatggttaatctacagtagaccgtcgtgattgtgcaaatcatcatttacttcacaaatcccgtatcaatgagctccacctatctgctataaacatcctcttctcctgagatgacataattcaatacaccacgttgcaataacaagatgaaagcatcagacataaaaggtttctcttcttaatgaatcagacatatgcttgtctttgtctttgtttgtctcatcctctgccccgtatctttttcatttgacaacgtctataacagttagttttcaaaacattcaaaaatatttttgaaggtagagagagaaagcaccaccgaccatttctcattgggatcggtatcagaaatgcatgaatggtaaaaaaaggttgtatcgtcatcgtgaaacacgaaatctgactcgtcatctaagagtatcatctttttgctttctcatatctgccaattagtttaattgcgaatacttacagttctattgaattccatcaccatttctcctgaaatatgaaaagaaaaatttaagcatccgcttcggtttacattttgaatcagtcacggagggcatcttacctccccccttaaagcattgtcactcatggaaatcagtgcccagtgctgtgtatcctcatataacaaaatgataaactcggactagttatgaataaaacgatatcaaaacccttttctttgttagtaatcccatatgaggaagataacttgatgtcaaaccaataccaaaaaatcagtagtaattgcaaaaacttatcaacagtatatattctgccagtaattccagctttgtttttgtgaaaatcatcctttagttgatctatggtttaacagtgaagaataaaaacatacctttacctaaagagcctcaataattattctcatgaaaacgataacaacaatggttctatcctcagttagtaaaactatcacttgtgatacaaaagacattcctattctagcaatccttcagaaaaatgattaacgttctgatcattccgtggtcacagactctagtttttgaaatatgttaattcgagtcatcatgatggctttgttagaaaatgtctgtcaaagacacatacacttcaaacccagtagttgtaatgaaagaacagggaaaaatactatgtgagaaaaaattttccttaaatatagtggacaaatattcttgagtagtgcacttatctggtttccctagggttacactgaatagttgcggagttcaatcagcttgctaaatgcctggtttgataagctcatcgatgaccaaccaattaattgcaaatgatcctcaattgtgggtggaatgaaatagttctcttatcagagtcaattctataggtggatgagtctcatcaaccagatctcccagatcgtcaactagctacgcgtttccaccaagtactccgttgaaaagtgaattcgaataggctctcagctatacgtcacttcttgtgcaacttaggctctcacgtaaggttttaatcttctagactcctctctcttgaaagctaacttccttccatgggccagctactttatgcttggtaagatattgttcaatgcacgccattcatactttttctatcgaaccctcatcgtcttgaagaataaacaacacgccaaagctcaccgtaaatggctcagagtataggaagtttggctaatatttatataaggccaaatgacaatttgccagtctacagtatcgatataccgttggagcattatactttgtccgatgaagtcaaatcatcctttgaccccgaagataagttcaagagacaagttacagtagttggcggttttcttgagattgacaacgttgtacataaactgaactaccgaattcatcaatctttggactcttttgagctggtccctatcacactaaatcaaacaattactaattacgattttcaggctctaagatttcaacttcctcaagatatcacaatacaagaaaaatgctttagtattcaatacggtggaggtgaaatattggtggatttcctctccagcaagaacaccataatttcattgaatatatcgctccaaaatttcataaaagacaagtctgaactcacgtcgttgaacttccacacatgggggtttatatctgcaccatactcattcgaagtaaggaatccatttcttctacgacctttgactgaaaatgaattgattttgtcattgaaagatgggggtctactacagctttcaaggtccaaagagcttaaaacatttcacgttactatcttcaatgatacatcgtatcttgactcattaaaactgaagctttttagaaggggtaagttttggaatgaaaatctgtcaccaaaggccataatatccattttacccttgacagaaacttacttagctacgctatccattgataaaatattgcgtatatggaacctgaacacaagaggtgttgtacttgagaggagtttgtcgaacgaacttcctgactcactagcaaaggattatttggacagcagcgtcgcaaacctactgcaaaagaaattttttggtaacacagtatatctttcagtttcactccctctttcagagaatatcataatactctattcagtcacattgagtgacgatactgtttctttatcaaatttagaaaaccatgaaattttgcccatcaagccagatacaggaaatctctggctacttcaagattatgcatttctgatcactggtgccacatctgctaagttttggtttttatggagatctaatagcttcagtgtaatccaccagtatgattttagtcttgataatggggagttatcaatcaaaagtgcccttgatttgacgacgcctaaaagctccattaaggaagacttcaacggaaaagttgatcaaatcgacgcgcactatgtcacaagaattttcaatctctatgacctagcaattatttcaacagtgtatgagatattcgaacgactttattacgttgacaattttgtttttgaaaaagagcttgctaaaagttccacatattctctaaaggaccggattgttaacttgttgcatagtcatctcactagcaaggacaataacttgtatgatctcggtagtcaatgggtaaaatttgagactacttgcaaggagctatgggacactaacaatgaatcactgtctatcaacttagatttagaaaacaacctgctttatgttttgaatggtttgaattactctattgttcgagacgctacaatttttgaactaatactatctgccaatcctattacaagttcacagaacattactaaaaccagtattgaggatctaaatcagctatcagctttgcttagtgactacagttctagttttccccaatcagtactgtctgaagtggctgaaaaattattgactatatcagacaatgaaagaaacaagacaacattggtgatgaacgagctatttcagaaatatctgcagtcatacatttctaagcagcaaatcacagaactcttatcaggactgagcagcatcgaacatgtcatagaatcggtagagtttttgatttcgtatccagaatcttcgtatgattttgaagaatatagtgaatcttcagtttccagacgaactgaatggggtgaagagattttattcagggaatttcaatccagggctctggtccataaagtagtttttttgaatctcattctggtcatgattacggtcgataattcaaatgagataattgtcacattgtttgaaaaacttttaaaaagcttcaaacacaatcaactggtacttgaagcaatgaaaagaacttctgaaaaacctccaatatttgcctcaatcttcaaatttttatttcctaaacctcacaatatcaatggaaatagtattgcatcattgttttcccgattgctcaaagaggtagcggatggttcttttataaaagctaccgtatctcatttactaaaccagaatgactacacgttgctaggtcctgaattgatggttcatctgcagaaggctacgcctgtcgatgtttttttaagagcaatggtagcgattgatgtcaaacctgaagatgctaaggaaatttttcaaagaaatgatacattaatatccaaacatactttgacccaacatgaatcttggctcctaaacccaatcgagcgtctaaccgttttattcaatgtttctctaaccgagtattataatcacctaactgagtttttttctactagacaactgcacagtattgcactttctatggctttacgtgccatagagagttctgctcctggtgaggatgatcatatccaacaatggaactgcttcacacttgcactatcagtagaaaactatgagttggcgtactctgcaactcaaaacttgaagccagagttcaggaagaatgctctaaaacagtttatcttggctttaatgaagaatgggttgttgctcaaattcatcaactacgactttactggaagtcttgagcttatcaacgaagtccttcaagaatttattgacacaacaccgaatctggaggccactttgaagttccataaacttgcatattcctggcgactgaaggtcggtgattatcgtggagcatgcgagtcgctgtaccagtttattgataagcaaaggagcagagaaacaagaatgacagagaatgagagcattgttttggtggaattctacctgatcatcatcaatctactgttcaccttttctaacgccgatgacagatggattttggcaaagcaaaaagctggcaacaaaatactgaccttaccatccctacaagaagaataccaagatctcatttcgagtatctcatagctgatatcataaatagatgaataaatagaacaaagatctttaaatgccactgagggtagccgaatctttgaatgcattctggacacagtcagggatccccacaccatcaccaaatgccatgcctccaaaacttatttggtcgttgaactctttggaggctgcattctgaacctttctcttgagatcaagatacccaacttcatattggggaatgcagttggggatcttggtgatttccatcttgaagtctggcaaagatgcaaactcatctagatcaatattcaggtgatttgacagaatcgccttgacagcatgtttactctctgcggaaccgggcatgtctgcctccgacttgagataatgacctccaagcattagcgtcaacttggtgtatttagggagatcattattgacgaattggtcagaaaacttttggagttgcttgggagatgcagagttactgtttatcgccgtaatgttggcctctgtaaaattaggagtcattgcagtctcgatgtctgagtcaaatatgacaccgagaagtttggatgcctgagaagacattgatcgaggaaccaagtatccaaatccggtgatagattttgagacgtgcttaggtatataaatgttgcacattagtatatttgtatagtgtagccagctcaaacatttgaccagccctgggccattcgctttggatttgaaaacggattttttcttagtagaacttggaacaacgggtgaaatgattttggccaattcgttggtattaatggtagatctcacatggtcaacaagataaacctgatcatggtcagtcaatgccaccttaccgctctccaaagcaatgtttttgattttgctgtcaaaatgaaacttgatgttttcaatctgtgataaatggttcttcaatgagatgggaagtttctgtagtccaccctgaaaactcagcatgggaaagtttttcagaaacaaagaaatatttttgaaactcaaagatgtaccgatcaatttttcataatctgccaaaaaagggtcaactttttgtttgacgttcttttttgtcctgtattgggcgatcatataccttataatagagccactttcctgttccatctcagggagcctagggaagatggctttcacacttaacttcttcacgtcgcccgcatagattccatgcacaattgcgctgacgatattctctgatagtttggtagcaaatcttctgttgaaaaaatggtcaaccgactcatctgaatactttaattttggttgccatggttctttcaaaagaccgagaatgagatccttagacaacgggtcaaacatgaactttacaaaagagctgaaatcctgtggcacttgaagaagctttgcgttgtttccgtgaacatctgagaacggggacaacagatactttttattagcaagagaatctttgtgcagtcccaggaccttgtcatttgctcctatcttggtaagaagatccaacaacatcaaggtacccgtatttgtgcctctcaaagttctgggtcccttttcaaaatgaaaagtttcatgctcttctgatctgatccatcctccaacctgcttggatttttcaaagatatggatcttaacatcgggacgcaaccgattcaaaaaaaagctgaaagtcaatccagatatccctgaacctaaaacggcaattgaggaatttggtgcaagacttttcagcatctattgtaccactagctctcagcacccaagtggatcatcgcaccatcctatcaaatggatgggtcggctttggaggatcgggtgagattttaatcacgtggacacccctaccagccatccgacaccaaagggctttgacagaagcgaaattctcgtttagttttgcgacactacatctgattatgagaacagagctgtcaacagagaacagccacaacagttccatgtcatatccccgtgatggatgaggaggttgtcctgacccagcattccgcaatgcgataccagagaggttattgaacggatatccgagggcagataccacggaatcagcctcctactaatccacgccggttttacgatcgtatttccacggtctcggtatgcatctcgtatcataaaataaatttcataaaccccttaccttcctctcaagccgcggaacgacatatacgaaacgagtcgggatgccgtaaagggctatgtttctctagggtgcgcgtctttacgtccgaaagtaaacgtctaaggtcacgtgaacgatctggtaagtggcatgatttgataatctggttttaggtatataaggttatagataggaaggttttttttgaacaagaattcaacttcggctatttcatctccaatgttcaagtcaatctcttataagcaagtttctgccagcaatcagctttccaaggttgtcaccctctcatatttggcattggggatatccattcctttcatctactcgattaacaggaaacaatactacgaccaatctcctcaaagaggaaacatcacctttagaagtttcatcagaatataaatactctgcaagaagaaatacagttgctggtcatagtattttctgatgtgtatcggcatgggtctatcagtaaaaatatctagttcttttgggtttgtgtggtgacgtttggtaaacgtactttttagtctaataatattctctactcttattttgactgactgtaaatctggcctaatctgatatttctatagtctgagaacgtgaaagctgggagtagtgacataacaaatgtggagtgcattgcccttccagggaccctgaaccttagagattctcaactgacgaaaagtaaacacagtaaattcaggaacaaaagaggctgtctgaggtggaggggtatattaagcttatcttggcgatggcttgatcagccgttgagacttgacttttttttctttttttgtttatgactcggcaatccacttcctaatcgagaatggctgtggctatcagtagtcatcctacgggttgactaaattcgggattgggtgtattttgcatagaaagcaaaatatcggctagtcttcgtattccttccccacactaatgaactagtttttgtacgacggaactggttagctccaccttccgatccaacatgattgaatgactacattcttttaattcggttaaaccaacttgatgattttttcccctcaagtattctgccgtccttcggcttgcacttggaggtgtgactttatcatttgatcccacaaaaatgtcaatgcttttgacatcgatgttatccaagtcattgagttgattcaatttcaaactctggatataccttagatatgcagtgctatccgtatccaagttccatcgaaactgcttcaactgtttaaacaatgtccccaaatcaggagagttccccgtccagatgtagcgattcaaagaggttgaattcaatccatcgagtctatcaatggatctaaacaaatggaacaggattggaaaccaaataaacacagttaaccatctactgcgatgatcaattcctgtgaaactggggggtgataacaaaatccattcattaattttaactttctttaggagtttgttggcgatatgtgttccataagagtgcgaaacgattgatacttcgttgatagatagcttttgcaacactagctcaataattcgactcagagtgtctggagtgggacgaatcttttggagaaaagcactcacactgctctcaacttggatcatggtttcatttgagtgtgattctttgaaatagtttttatagctagcattgaattttcttttcgagttgccaaaccctgggaggtcgattgagatcaactctatatctttaccaatcaagtcctttaatatgtattcgaattgcgtggtttggcctgccagtccatgcacaaatagaatggttttccggattttcgaaggagcgtaatggaaatagcttagagtcaactcatggccctcatcgtatataattttgataggcttgctgtatttgctgataaaatctgagtcgttggcaattcttgtcaccaattgtctttcaaaatcagacaagaacacacgatgtaggataagattcttaaacactgccaatagctgtctccacttggggagcgatgaaacctgatcatttatactggacaattctttcaaaagcgagggagacgtctcgtcctcatactcgttagacatctttgaggccacaacttaatatgaactgtggttcgcactgtaataagagtcaagtcgcacccaccccgaaccgaatgcgatatttgatatccgatcgtgatacgtaattacataatcaatcatcatctattattgttttcctttccgtgatagaagacaatcgaatgtctgatctgaatttctcagatattgtgaatagttcccctcgcagtgaaagtagaaagagggtcaaaagtaatccagccaatgaaaattcacagataatcgaattgggagacgagaaagaccagcttatggcaaagaggaaggagctaaagaggaagatacttctcaataaagaacagctaaaagagctacaaggagtgaaggaaaacttggcatcctccaaatatggcattgaaaatgataatgagactgaagacataataataccccattctgggttgctccaattgttcatgaaatataatacttacccttctcacgacatggaaagtagactgaaatacctgcgaagagtctttcccaacctgaagttggaagtcagctccgagcttactaaacaggttttagtagatgttcaaattcagaggttgaacgcgtttcccagactggtctctaatttcaaaataagaatgactattgataagaaggaagagaaacttgatgattggtcgttggttgagcatgactttgacattgaagacccacgttttgttcaaaaacttaatggtaaggacccatccaagttcctgtttggacttcatgagtatttcgaattctacaatgaacgattcgatacgttccacagaattatcaggaattttaaggatgagctacaactgataggatttgatactttcaactctggccagcaggagttgaaactactgctacatcttatagatgaaaaatcaatcacaatcacagattccacgctaaatctacagatcaactggcgaatattatttgatgatcttgaagagacgttctatgactcaatttcatgtaatgtgaccaaaaagaatgagatattcacagattcaggtctcgatgaaacacttcaaacattgctgcattacaaatctagctatgaatcgttgtctattatagttaaatcactcttccaactgtaacatatcaaaatcgataccccatttcgacaccttcaattttcataccacatttttcataaaatctcacgtttttttcatcgcaatccagaatcaccttatagcagccttcagtctgtgcaatttgtatcaagtttcgaatcataatcaatcccaactttttaccctgttctgaagggttaacggaaatatcctcgatgtggcctaccttacctccgccgtggatcaacttgtgctccacaaaaagcattcctgttgcaataatgacattttctgcattagtgatcaccattgggttgtagatctcttttctatcattccaatactcaataagggcatggaattttggctccgggatatcgcctacagttgttaagattgagagtgtcttgaacaggttcttatcctggaagtcctctttgccgacccttcgcaagttgtacccttgaggcaaggcaggtacagaaactggctgcatttgtttcttctaagtggacagtataggctagatgagagggtgcctcatacactcgaataatctatgggttaaattacaaaaataaacataattacgtaatgctatgtatcatcgtcagctattgcctggttaaagaaaaccaagaagcggtcagtgtctggcagcttgcgggcttcatactcgtcaacaattctgccctgaattctttctatcaaagactcggtaatcttctcatcttcaatgtttgtagaaattgacgttgttaggtgggatatctgatatgtgagagtgtctaacatgttttgagggtcgatatcttggataatcttcgtggcataatccacaatgaattcattgataattttgtgtagcacgaggctcaattctgtgaatgagtcagtgtcttgagtcagaactgtaggcaggaaccaaagacgaaggtcttttcttgatttgttggtcttagttgaatcaaactcaacgtaatgttcaaaaaccgggttactcttatgaaataaatggcgaatgacgcttgtaattgaggtgttcttggatgcggttccgaaatcgataaatgcatatttggtttgaagctcatttttaaggtgcaacagactcttgatcacaaacaactttctagctatgacttgcttatcaactttgtgattcagttcacctccataattttttagtatcgacaatatgctaatgtgaaccaaagtgtttgccaaatggtcaaaagaagctttggagataagcaactgggattcttccaaaatggcggacacctcaaggatgggtgggtaaactggcagagttgcggcactcaacttcagctctttcggcgacggctcataattaatgatggaatcagttactctttgacggatctgtgcgagatattgattatcaaaatcgttgataacaggttcgaaaaatttgttcaagttcaactcctcttcttcgtctccactcattgacgtgtttctgtattgctgaagttcggttagcaatttcttcaactcttctacatcgtgaactttggcgatctctcctttcaaaatttcgtgtaaagggctgattacttgggcaagccattggctcaattgttgagtttgcaaatcatttctaccagtgaagaaagattccagcaaattcttttcgtcactaatcaatccataccaggagtcaaaatgtttcaaagcgacatctagtgagttttccttgatttcaagcaataggggttcaacgagaaaatggaccagtttccatctcaacctaaagtattgagcatagatatccttcaacaggttagatatttcctcatcatctgcactgtatctttcattcaaataggaaatcaattgaatgatatttttctcccccaaatcttccgtgaatacttcgtttgttactagcttcttttggagaaaacttaggtccgactcttcagccaatttagcaacgattatgggctcgtactccttgaaagtttctataacataatttctaatcagtgttaaagctcttatcaaacactgcctgaaccttgtcttgtatttggcatactctttgaactctcttcgttcgtctgtttctaaaaattgcatacaaaagtccaatttggtaaggatctctgcaaaggaagcatcgttaaccataccagaactcgatgtagtatttagtttgtgaatgataggatctaattgattgaagacatccaaaatctccattactccgttgtagagctgcctatcctcattggtctccgtgataagcttattggatgtctcatggaactctttggtctgatttatgattgactcattgattaattgaaggtcgttcaattggtcaataatatcctgtgtctcctgaagtaacgaaccgttgacatcatgtacatgagtgaaataatcaagagtttcgtccaacacgtcagccgtttcggtgtcaagtgtttggtaggattcaaaatctagaacttcattgatatgaggatacaaaagctcagacttaacgtactctgtgtattctctattttcttcgttcgttagtggccacaatagtagatctttttttcttgactgttcctccaatgtgtgcaagtgggtggttgagacattctttttcagatcatttctatccgtttcatgcttcaagtgatggtactcaactgtgggaggatccactattactagggagttctttcgatgccttctggcccctatggtggcagatctttgccttgtcatggtgaacagtcaaaaacagattgaacctgtatatgcctgggtggagaatagcgagggttgattcagacactaagaatcgataatagagtggtcctgagaggtgattcgaaaaattggaccaccacgttatatggataatgggtgtagatgtatataagcttatagatgatagtacgcaaagcagcgtctgtttgccttcgttggcgcaacttttcacgatgagaacgttattacattcaatagatcactggaatacccaaatgccctcggcaaaaacaccataaacattacaaaacttctaaaacctttcacatatggtcacacaaaccacttcaattcattctaatgttaaatatactcactctcaatctctttctttaattgaaagttcagcttcatgcttcgtcttcatccaagggattataggaattttgtgctaagattcgggccaattcagctttgacaaacggtatcctgttctgatctactactaagtgggtatcatcaagttcttctatgacaatgtcatggctctcagcatcaatcttcaatattagtgctctaattgatggatcgcttggattggttagttgctgatcttgcaaaacaaaaaaaagaccgtattgtctgtccaaccattcttaccatttaacgagagcacctttgattgctctgggcatttaagaacaatcttaccgtccagattcagagtctgggtcaggtaaaattcactctaggtgtttcactaggcaagttaaggatcagcgaataatcagttatcagaaaccctacaccaggaacaaaactgaattgggtgccagtttgaatcagtcactgctcaatcaacttaatgaagtactaaatggttgaaaatacagaaaattcagaaaagagctcaattgatctcagcacatctgatagagctagtcaaaaaccagaattacctgaagcagttttggttgatggcaataatgagttggcaaaagttgacgatagtggagaagaagaacggggcaaaaaagaacaagaacaacaagaagacaaggaaggagaagaggacatacagcaacgagaagctaatggtcgataagacatccgaaagcaaaacgaagagaatggggccgcggtcagtgtcatgaggcatcgtccaaggtagtagacgaaacattagatgaacagaagaggggcagaatggcgtggacaagacaacagaggcaagcaacaaagtagcacagcagcaacttgatgcatccgataacctagattctttagattcttctacctcagacctatccgatgaactccaatctcaatcggacgtcaatgataatcccgatgcagagctaccacagtttacattccataggataagccagttgcccccttcatttatgaagcatgatcctatatctgcttcctatattcatgaaaagttttttttatttgctactcacaacggctttattcacatttccgataataattttcaagagataagaacttttagagctcacagagcctccattctatcccttcatacagatggggaatactttgcatctgcttctatggatggaacagttgtagtcggttctattcttaacgacaaggatatagtagcttatgacttcaaacgtcctgtgcatgctgtgattattgatcggcagtacaaggtgaccaagtctttcatttccggaggaatgtcaggagaggttatcttgtcaacgagaaattggctgggccaacgagctgatacagtactagaaacagagcacggccctatcacttctatcaaatgtgtcgacgatttgataatttggactaatgacaagggcatcacattttatcaaacatctacccgaactatgcttttgaacacacctttgcccaaaggctttaacaggcctgatatttactggcctaagtactccttccctgaaacggatcggctcattgttggatggaatgatcatgtctggttctataaactaactattcctcaaactgttcagacactacaagctgccaattttctcagtacagcggcttctagctttaggataggcgctgtagagaaaagcgttgaacttgaatctcatgttcatttgccagatactatcattggtggaatttcctccataaatgacaatttaattgttttgaattacctagcacctgttgaagacaaaagcaacaattcaagaaggccaaaaatgaaatcggctcctcctgaactgcaagttatcgatccttggacgaaagaggaattgtcagtggatattattgaacctaaagattatgcaacgttgggggtaaacgattatcatcttgaaaaatcaattggcgaaatggtcagatggttcctaatctcacccaatgacgctatccttatcaaggaattctcgcttcatgaccagctagagtggtatattgaacacaagatgtatcagaaggcttggagtatttctgaatatattcttccaccattagagagaattactctaggggtgcagcaggtgcatgaatatatcaatagtgaaaaatggagcgaagcaggcgagcttcttaccaaagtgctagctcacagtgatgatacttcaaaagaacatcaagaatacattaaaggggaatgggcaaattttttagacctatttttgaaaaaggacatcaggaccaaatcgttgattgcatccccaaggtgtatttcccgaactcagcagtgaatattgaccccaagatatacgggaaatatttggaacattatctaactgactggaaaaatatacccaagtttttacagttgtatcatgactgggatcacagattactggatttgagatatttccagttcttgttggacaatactttgaatagcaatcaaaatgaatctaacaataaaatgccaatggtcgataagattcgctttttgtttattgaattgtgtctagaaattgatgatcctcagccagcagttaaacatttaatcataatgagggatcctggaactctacagttcttgataagcaatcacatacttggaaagtttgtcgatagacttccagagattttaacgttggagttgaatgatgaagaattacagtatgctactgtagactttattagagaaaagctgaccacaaatattgagctacttgccagcaagcacagggaaataatgccatcaaaaatcattgaattgaatgaaagggcaggattatctgtaatcaattacctgtatttggaaaaactttcccagctagataagctattgaccaaagattttgaagatgagatggttatgctttacgccaaatttaacgtttctttactttacaactttctttcaaagcacaacaattacaacatagattcagcaatagagatttgcgaagagatgcattgctataaagaactagtttatttatggggcaagattggtaaaaacaagaaggctgtcactctgattatagataaactggaagacccagatttggctattcaatttgttgcaactaacaatgattctgagctatgggactacctgttagaatattccatggataaacccaaatttatcaaggcgctgattacagctgctaacagttcgcagtatttcaataacatggacgacccgtttgtgctgaagattgaccccatttcaattgttaagcgaatcccagaaagaatcgagattgaagggctaaagcgtgccttgatgaatattacttacgataactatctggagttgaccatcaacaaaattatcttacaaatcattcaagaagagacacttgagattggaaatttttacaggaaagagagactaaaaggggcaactttggaaccaagacaaaattcaaaatttttgaaagagacggtgatcatgtactcggatcctgcaaagccactagtaacagagactgaagttgttggtgaaggaaatgagtggaagcaagtcgtgaatgaagatgataatgccactatagacatttccaccaagataagtcatttgaactacatcaggcagaaactggttttattaagattgagaagtgaaaacggtcgtacctgaaaattttctgatcgcgctatattgttccacccctcgtatccgtcgtacgcgcctattttttgtacgataacaagctaaattctaaaaactggcgttgtttccaacactcaactcgagaatatgtctaaaacgaagacggatggcaccaaagttggtaaacaggctgagcctatagagaacaacatagataagagctcccatttggtggattcatctggaaccagccgatttctcgcagataaggaaattgaatacgacttcggtgggccaattggtgtcactgctatgatgcttgggtttcctttgctgatgtactacatgtggattagtgccgagttttaccacggggctcttgcttggcctgaaccagaccagtcatggccacaatttctggctcatttgtatcagctatttcttgatcatggtaagccaagtcctagagcttggagaattttcctcacattctttttcacacaaatgttgttctacgtgactcttccaggaatctggactaagggtcagccactgaaccatctcaatagaaaacagctaccttattactgtaatgctttggcgtctttctatacgagtatcgccattgctgtggtgttgcatttaacaggtttattcaaaatttatactatcgttgacatgttcggtgaaatcatgacatgtgctatcactttgggtttcaccatatccatcgctttgtacgtctatacgttaaccgtgtcaggggattaccacaggatgactggaaatcacgtttacgatatgttcatgggtgcacctttgaatcctcgtgtcggtatcattgacttaaagatgttcttcgaggttaggttaccatggtacacattgtttttcttgactttaggtctttgtgctaagcaatatgaggaatacggctatgtgtccacccaagcatggtttatgctattggcccattggttatatgcgaatgcctgttcaaagggtgaggagttgatagttcctacctgggatatggcatacgagaagtttggattcatgttgatcttttggaatattgctggagtgccatatacctactctcaatgtactctgtttcttttctaccatgatcctcaagaatataactggtccactggctacaacgtacttcttttcactgttctgttagctgcttattacttctttgacactggaaatgctcaaaagaatgcttttagaaaacaaatgggtggagatgttcatattagaaaaagtttccctttcctcccttaccagattttgaagaaccccaaatatttgaagtgttccaatggatctgtgctgctgatagatggctggtataagtatgcaagaaagatacattatactgccgattacatccaatgtctgacctgggctttagcttgtggtggggcttctgtctttccatggtttttccctgtatttttcctgataaccctattacatagggctgatagggacaacgccaagtgcaaaaagaaatatggagctgattgggataaatacctaaaagaatgcccataccaatttttaccctggatttactagttacaaaatagaatcaaagttccaaatttatttactacttattcaatacatatgcggtgaaatccacctgcttcatcttggaatgatttgaattgttggtagtcaatgactgcagagtgtttcatttttgatttcacaaagtagggaaaacttctttctagaattcttagttgaaagtcgaaatcaagttccggtacaagcgtgctaatatctccaagtgtatctaacgggtctgataatatttgttcaattgcgcaagtcaagcagagtttaatcttttcagcttcatcgtcagtgatatttctcagcccacagaccaagtcaactttggaatctaacaaccttgttcttacaatgttagaactcttaagtcgcatgccatgatcttcaagctgaattttgtgaaggaggtcaaaccccacaatggcatctagttgtttagaatacatgccttcgacaagtgtttgagtgtccaaaatcaagagctcaaaattattgaatttgtctgccaataacgccgtaaattgattagtgtccagcccaccaacaataggagcacctatagttaatttttcagataaatttaagttatcaaggtaaaggagctctaagtttaccccttccaacagggttatttgagaactcaataaattgttgaattcaaaaccaattgtctttgaattctccactggagcttccttgctgaaattgattttgataccattggcatcaaagagacccgtatgataactccataaaaaggggagatgataggccttaaattcatcgttaatctgcaaatttattcctgacatgtctttgtaaatagttatagttcagaaactggaattgagctcaaaaaactggaatcgagcggatatttgaagattgatgccttactcatgaattgattgataagagctccgtgattcactctgtcaatgattacccctctcctacccgatttgggactttttcttcagtcttggggactttttttcatatgacttgaccttgctttcccaatagggaaggactcacccatggatgattaagtttggattactcgtttaggaaatagtagccatgaatcaatttgaatcataccatcatgaaatagggttaggctgtaaatgcctcaaaaatggctcttgaggctggatttttgggtattggaatgttggtagcaattggtataaaaggccatttgtatttcacttttttgtccttcatactttactcttctcaactttggaaacttcaataaatcatcatgtctactaacaagatcactttctgtcttaactggcaagctgccccataccatgccccaatctacctggcccaaaaattgggctacttcaaggatgagggtcttgatattgctatcttggaaccaggtaacccatctgatgtcactgaactaattggctctggaaaggttgacatgggtcttaaggctatgattcatactttggctgccaaggctcgtggtttccccgttacatctgtcggttctcttttggatgagcccttcaccggaattttgtatctcgagagctccggtatcactgatttccaatccctcaagggaaagagaattggttacgttggtgaattcggaaaaattcaattagatgagctgaccaagcattatggaatgactcctgatgactacactgctgttagaagcgggatgaacgttgctagagagataatcaacggtaacattgatgctggtattggtattgaatgtgttcagcaagttgagttggaggagtatctgagatcccaaggaaaggacgttgatggggctaaaatgctcagaattgacaagctggccgagctaggatgctgctgtttctgtaccgtcttgtacattgtcaacgacaagttcttggctgctaacccagataaggtcagaaagtttatgagtgctgttaagagagctactgactatgttattcaaaagccagctgaggcatacgctgatttcattgagattaagccacttatgggaactcctctgaactacaagattttccaaagaagttatgcctacttttctgagtctctttacaacgtccacagagactggaacaaggtcaatgcctacggtaagagattgatggttttgccagaagactttaaggccaattataccaacgagtacctatcttggccagaacccaaggaagtctcggatccactggaggctcaaagaagaatgaacatccaccaagaacaatgcaagtgtaatccatctttcaaaagactggctctcactggtctttaggagaggaacaacttagttaaatgatctagtttaaaatatgttctttttttttcattctgctaaattgcaactttgcccattcattaatactaacaaagtcaggaaagcgataatcaatatcatccagatttacttgataaggtaaccttctatggtcacgtctattttcgactctttcttttaaactaatcttgctcagctataaacaccagacgttcatcaatttcatccgaagacaacgatctgaagccgtctttggtggctacggctacttccaagtcatcctttctaaactccatccctagagtattactcaactgtatgattgcaaactctaccactctctcccatgatccttccactagaacactggcattcctcttcttcttgtaagacttctctaacttagtcagtatctcttgctgcttgggtcctgtagcggtagctttgtagcttgtgtagtatccagcaggatctgttttgaaaagagatggtccatgctcatcatcgacagcggcaaacatgagagagacacccaatggtcgcatgtatgctcgctgggtatatatctgtgctatattagcaattctctttgctaaagcatcagctggcatttcatagccatatttgtacttgaactctgtggcctctgctctagccctaagtgcttgggccctagcgtcagggattgatcctgtagccagcattccaacactgttggaaattttgaacatgtatgaaatagtacttggatctagtaatttatctgggatcttcttttgagagatcaacactactgaatcttctccacaaattcccatggcattgatattttcaacgttaatggccttgaaggcatactcaacttggtagagccttccctcaggcgaaaagatagtgatatgcctatcaaatccagctgatcctaaaactgttagcaacttaagtcctaagcgcttgaggtgcttaatcggctagcgctacttacctgacattatagttcaatggcttgggctttcaaaggacgatagggtggtatcctaggaagtggcgactttccaaagacatgtcttacaaatattggttggtacacaaaataagatgattatgtaagatatatgaggagggaaagaaagacgtggtaagctatttacatgatttttccgatgcctatttactcagtatttcttaaactgccttctttcctttggtttcttttctaattccattgaatgggctaccgataattggtagagagactcttctagggatttgggcgcctcttgcaaggcatttctagctgtttgctttctcagtttcagttcctgtctagattgttgcctgttagcgaccttcatatcagattgtttcttctcaatcttttccctgaaatggtcgtacgacgtgtttgctgggattgcacttttggcacctccaattgcccataaatctccagcttgaagctttctagcatcatgataaatctgttttccacctgaacccttagaaagataccacttctctataagacccgatggtccgcacatttctgctaggataagccccttgcgctttaatggattcttcatgacacgaggccagttgtcgatggagtcaccttcataacccaagatattcgttctattcttagtggattcttgtaaccgagccaatttagacagtgttggcgcatcactgggtgaccgttccagaataagataactgaaagatgccagttcattgtttctaccgtttcttctcccatttccagcgggagcttgtccctttattccaatacctgaagtcttatcagtccatttagtggctaatagaagaccctttttcaactccattgaaaacttgggtctcaatacttgagtctggaaatggcagaagtttagctttttaccatactttggtagagaaaacacgtctgggtttaatgtttgcaaaggacatacgccatggtgtgcacaaggggcaacaactttgaggtagtagtctctaaccgtagaatttgcatggtctattatttcaaaatgttcttttaattcaggttctaattctgcgtcatcctgtagttgtcggtctgtcttgaaatttcccttttgatatggacgtggaattttaaggttggatgaatggttttctggtcgtatagctacttgtcttgcctttgcaattgtctcaaagcctaatggagtacctctttcaacaatcaccagatgtcctccaggtgccaacttctgcaaataggcatccatgctttcctcgacttgagccgggtatgaagctttattgagcaacaattggtggtttagtattatcaagtcatattttttcgagttgccaataggcaatgagctcagtaaattggtttttatcgtaattcttttggtatctatcctggcaacttttctttttagttctgcttcaactggttctgatggtccagactcgttgtctagttcaaattcgtcttgggccacagcagtgtattctgctagttgtctactaagtataatctttgctttttgcttcatctcatatgatcccacaactacggcatctttcaccgtgggattgaaatcggagcccattagttcattgagtgcaaccattcctgtagctggcccaaatccaacgtccaacactctctgagggttaaaagactcaccaacacgtttctttaattcggataaaacttgatatatagaggcgtagttttgaacgaataaccccgcaatgtgagcatccgcctctagctcagactgaaccggcttatgggtcccattagtacccagatcaacaaatgtctgagcagcttttattcgcaaatgccgagggttattcagcaacagtatgtggttattgattgtttcagaaacttcttcgttgagtttaatctctgttctattgaccctaccttgaatagtcagagggtgtaacctggaatcttgacttgaaatcctttccaaaccttcctcagattcactatttctaatttcagctatttcattttctagctgatcagcgtcaataacgttgaccttcttagaaggttcgtcattatcgactagttggccaaagatttcacttcttcttctgcgagcataagatatgggtgaaacaatgacgggctcatcttgcggtttttgaaatctttctaaggaagcactgtaaaatcttaggcctgatctctgcctcggtatcttatagagcaatctgcttgactttgaaagtatcatcgtacttgattgtaaagctgattgaataccagaaaattttactttacgtaattctgtatttctcgattattttttttctaccagataacgagtcaagttccacatccagcatcttagggagagtccgcagatgatccctccaccatcatggatagtgagttgagatttcagaggctggtatttacaaaaaggaagccgacaagattaacatctaaagagcttcttaccgccaagaatgaatcaaagaaaaccgggataacaactacagtaggcagcaggaccagatccaaggctggacataatctattcaaaaagcacaagcatgagcatgtggcgaatactgcaagcaaagttgggaataattccacttttgaggaaagattggaaaaacagaatgtctacgatgcggaagaatctcgggccaagcccttcactcatacgcctgccaacaatactgtaaatctcggtgaaaagtataaggaatggggtccctccatcaatggatacagatttttagacaaagaggaaaaggtcaatgattacaatgttccaaatgttgaaggccaagattcatacggtttatcatatccagaggatgcagaaccattgacaaaacatttgcaaacctacgacgaatatatccaaaattggagggagaacacaagattatattggcccaacgaagaaaacttgtggacttgtgtcagttacgacagtataaagcaatttttgcgtggcagtcaaaatctagccgctttcaagaaaagactgaaagtcgaaagaatacgatggcatcctgacaagatgaagcagaatattgactgtaatgagaaagatttaatactggttactgaaactttccagctgatcaacaagttatgggaggattttttcaaagtaaaacatagttagcatacatcattaaatgacaggttggttggcatattatacaggtttagcaaatactattttctattatttcactcttatcaatcatcgactttactttcttggactgtgggttgcgattcaccatcctctgctgcttcgtcttctccagcactttcgtcttcggctccttctccgtcaactccttcttcagctccatcttcaactccttcctcgtcggtgtcagcgtttgcatcttcctcctcttctatgtcttcgtcgtcctcttcagcttctagatcttcctcgatatcttcttcctccgcctcaagctcttctgcttcttcctcttcctcttcctcttcctgattctcaatttttcgcttcttagaaggagagtctccgtctgctgcttcatcctcagttgggataaggtcagcttcagcgtcattcccattgtcttcgtttccgttgatttcaccctcaccttctccatcagcgatgtcttcggtgaccctgctaacagaaccttcaacctcctcttccaattcgtcggcagcataatcttcctcgtcgtcctcttcaagatcaacgtcgggttgttctggtgggaattcatctggattttcattctcgttgtcccatacaatgttaaaccgcgttactcgaggtttctcagccaatatattacgaacaatatgatcaacttgaaccttggcaggtgggttctccctcaactcttcagagtcgtactcattattaacatagtagcccactcgaacgaactctttctccttgtaagagcatgagagcaatatgactgtaacggagactaattcagatgacggtattagttctggacttggaggatcagctgtgaaaaggaacttgttgaccccaactggaaccggacccactaagatggaatccagctcttggtcgtgatccaatgattttgaagacccgacatacgtgagtttccactctaaatcttcctttaaaggctccagacactcaaacgtaatctcgaactcataagcatccgtgaacttggcagggttattcaatacatttactccaagtaaggatacaagcgacatttcaattggattatactggtattgtctgtgaccgtgacttatagaggtccggtgtagtgtggtgcgtccgtaatgtatcttaagtcgccttgaataattctgacgcgttagctaacagtctttctcgaatccagatgtcagatgtactaccagcactttatctttatcgagctttccccatagggaaattgataaatagcttcttttctgatccgtatctaacatttgctacactccttccccaagagttttttttttttgatcgttaattctatagcattttagtttcactgttgttattgcggcaaatcacccaccttgagaggcttcttttaatgcaaagcccgagtaaagccaacatcaatttaagtggaactgatccgttagatggaatcttgaaaacaacaactgatccgtctaactggcggttcacggagtcatccctgatccaagcattaatcctgaagaaggaacaagagcgtacaaaacaggaatattatcgcgtggaatcgttgaatcgaacattagaaattttgaggctggcctgtcatgcccgaattccacctcatttgattcctactctgatttcaggtaacccaggggcagcaactcaatcaacaatggctgctgctggtgcttcagcttcagaaaaagtatccccaaagggcgatgaagtagccagatctcagtacaagtttggaaactccagtcagattccgatgccaagagggccaaatctaggcgcagttcctctgaaagatgtaccaaatcaccagagaaagttatccccagcaagggtgggcagagatgccgtagcctcattagggattaacgatccagggcgcgtcaatggaatacatcctcgccaagatatctctcaccagaaatcatcctcactgcctcctaaagtgagcattccggaactttcgacagtagatttccataatcaagagaatctccgcaacaagttgataaactccaatggaaaagagcagggcatggtatccacccaccaactgattcaatttcatcattggaccccagataaagacaccgaggctgaaataacccccaacaaacgtagaagatcatcactggtttttgaatctcctgatagtacaatagccgacagggatgaatacagcttcttaggtgagacgccaagtaaaggagcaacttccattcagagaacatcatccttgaatcccaagaagttcaacagacaacatcatacaagaaccagatcggatacatctataatacgtcaaatcaaacaggaagagaagaacgagaacattttaaatgccaatggagtttccccagatggcacttctacacgttcttcttctatatccaccactgccagttcaataaattttccaccgactacgaaaggagcaaacaatagaccaactccccgatttcctaataatattctaagcggtacatgatctacgtattcacagattcctttgcaaattgctcaatttcgtctatggagatcggttctagttcatcgctctgagggtcaagcgtcttctcaaagacaatctcgcccttacttaactgtgatacctgctttttgagctcatgggctatatttctcaacacaaactcatcacagatatcggataaagcccaattactcaaatcatcaagccagatcattttatacacatagtacacgtcatgaaatcgaaatagttctctgattgccagtagatatttcaacacttgacgcttgccgcttctgagaacatagtaaacatcatcccatgtcttcaatatcaggtcataatttcgatgtaatggatagcacaaagctctgcggatgcttgttaacacgacgactttcaacatatttgtttcggtccaattattggactgaattaattgagtatctagacaacttaattgaggagatagtttgccaattgtccaggcactttctatattgatttcacctagattctctcgcaattcgaaacaataggcgaatagcagggatagagtagtgtagtatataggcctagggtcactgatcaagtaagaccgtctgggaaggtcgattgtctgttcctgctctttctgggaaagttgtagttgcattatattttctattggttgtccattgcgcttcgcctcctgttgcttcttattccaacgaaggaaacttttcgttacgggagagacccaggcaagggcatcttttaatccagaatcttcttcttccgagttcaaagtattggccaacataaaattggatgcgtaatattcaatatcaaacttgatgttctctttgatcagcctttccattattctatcatcggcattcattgtatcggggtctgacagttcgttaatatcattcccgttcgccaacgacgcagccatagcattttcatattggttgttgaacccgtatttcattgagctgacctgaactttggtatctggagttggcattttctgttcaatctcaaaatcaaattgttccatagttgggggagttacagaagagccaccgatctcttgaattaggggaccttttggattagctttcaccgtcgattcctcttgcgcttttgaaggaattgttcccgtaacaacagtattcacttccttcaataacgcgttatcgttatcatttggattagaattagtattagcagtgtgttcgttgactcttgccagtaacttggcactcaagtctaaatctttgaagtcttcctttgggttgagtttggggatcttgatagcaatcttttcatctttggatacgaattcagctttggcccgttcatcatcaactaaagaccctggtagtctcaatctaagataatatggttggagagagaagatgaacagattgtcatccactaccatttctatgttctgagatttgaacctaatgtttgatattttaatatcaatgaaaacgaactcatcatcttgcgtcactgtgaaaaatggggtaatcatggtgctgtctctactgagaagacctttggctttatcagaataaatcttatatggtgagaaaaaaaaaaaaaaaactagatagatagaaacatttctaatcagatgccagacattaaaccaagaagaagatttggtgggaagaaaagtctggagggagcttctgtgaagcctgaagagccaacctctggtttggtgaagaaaagaaaaccgaaaacagttggtcgaattatgaatcagattccagaagacattctgaacaacgaagacctcaacaactccatcaagctgttaccatctaactacaattttgaaatccacaaaacggtctggaatattaagaaacaaaacgccaaacgagtggctttgcaaatgcctgaagggttgttgatatactctctcattattgctgatatccttgaacaattctgtgattgtgaaatactggtaatgggggatgtctcctatggagcctgttgcatagacgattacactgcaagatccttggactgcgattttattgtacactacgcccattcatgcttggttcctattgatatcacagcgattaaagttttgtatgtgtttgtaactatcaccattgatgaaaaacacttggaatctaccatcaggaggaatttcgaacacggaactcgattggccgtgtttggtaccattcaattcaatccggccatacatgcgctgaagggtaagctgttggaacaaaaatatgataccggtaacgaatgcgattcgaagatcatatacgccattcctccacagaccatgccattatcgaagggtgaagtgctgggttgtacttctgccaggttgaacaaggaacaatatgacggaatgatttatgtcggagatggaagatttcacctggagagtgctatgattcacaatccagagatacctgcttacagatatgacccatattctcgtaagtttaccagagagtattatgaccaacaagaaatgaatagagtgagagaagatgcgataaacgttgccgcaagagctaaaacaatcggactgatactaggagctttaggaagacagggatcccctcaaacgttagccacattggaggaaaaactcaaagccaagggtttgacggtggtcaaaataattctttcagagatttttcccttgaaattagccatgtttgatggaattgatgcgttcgtccaagtggcatgtcccagattaagcatagactggggctatgcgttcagtcgtccactgctaactccctatgaatgcatggtgatgcttgaacaggacaagatgtggaaatcaaattattatcccatggactattatcataaagacggctatgggagaggaaaagttcccgaccattcagatttatagtgttcttatttatttattaattatatcatgactcttcaatatccggcttttgctttatgtaggcactctcgcaactaagtaaggtagcaacctccatgtcatcccatctgagacatccttcactggctttcaaatattccttcacgatcaacgataatttgaaataaaagttgacaaaatccacagaggagttttgaatgatagagttaacaagcgtgggaggtaatagatacaacaatcgctcctcttggtaatcaattaatgcaattggaagaaaatcttgaaggcgatctgatatttctttgaatttgtcaccattgaatagtgagttctccgtaattggttcataaacggagacgtcaaagaaatcttccctagttgaggatatcatgttgacaaggttgtgaatatcatataaccctgattgtttgagaagataagtgtactgaatttcggtcaattttgattcgcattcctttatcattacctctaatcgatccagtttctccttaaagatgttcagggtcacaattttggaataaacaaaatcgtaacagtttgatttgaaaatcaatatctctctagcatcattcaatttattctgagctatttgtttctcgataagttgaatgatttgttcaaaacagtatttgagtaaatcctcatacagttctttggcatttgtcaccttttcattatcaaagatgggaagtacgtcaccatagaaattgatcaaccaatcaggcacagctagctcaggtgtgatttcttcaatgtaatgagtttctgaaacaaagttgtggtttgtaccatctagttgttcatcttcattataatatgacatgctctcattggcagtccgctctatgtttttaagtttaatgttgattgaactttgaatcttacccaaagccgaaacttttaaagagttgattgtactcaaaagggcattcttagaacctaaagttttttcaagcatcatggaataaagtgagagcaggtcataaaaagcttggatcgctgtcagcttagactcatttctgatgatctgttcaatctttaaattcaggggggtagctagagattcgatgttctttgaaacaattgactctacgagtgttgtcaaaacgatattatctttctcctcatcttgcaaactgaacaagctttcgacggtttctctttcattaacaattgtgccatgaatataagcaagtaaatctccgagaaacctttctgaatcatatgcggaaaggaacaatggtttattaacatccctttcgtttcttgatgctgaatctgcataaccattcaattgtatttggaactcgtcaagcaaagactttgaccttgattcgactatttggttggtgattccagagagctgctccgggtatctttcggaaatgaagagtatagatcttttcaggaatgccttatcctctatggaggcggaggtattgttggacgaacttaacctagaaaaatgtttggtgacaaatgtcgacaatctgtcgatggcattattggaaagctttttcatgtcgttcataatattaatacccacagtagcattctccatggttaacaaaattgaacaatcatcatgaattgactcagcttttttcagtatttctagaaaggaatcgtcaatttcaccaaactctaattgatgtgcttcgaaatgggagagagtatagcggttctggaaattctgcaaaagcttctttttgatggaaataatcttggaagttgcatgcaactcgtgtatggaattatccaacctagtggtatcttcaactctagaggacaacttttcagtgatttgattgttgagctcgttcatttcattcaagtcactttcaatctggcccaaggtctttcttaagggttgcaattgtttcaagaaattgaagttggcatctacaacatcatgttcaatgtcgttacgcaactttcttctagcaaggtttccaacaaaacttgggtcagtaactttgtcgtattcatgcgccgtatcttcttttattttcttctccacaatggagagtagttccttggttgaagggtcgtaattagtattattgagcactctgctcagtctgttgctcaaaacagtggacaccgaaggttgttcatcgctggtggttctgattgatttattagtggtgtgctggttaaccagatccagagactgattggcgtatttataagccctctgcccgtcattggagatcgattgtgagtcgtcgacatcgtcaactgaattggtgtcatttttcagacttttcagaatgctcattttggagaattttttagtcaaatcatctttgtacgagtttaagtttgacaaattgaatggtggttcgggctctgcaggcaatgggtcatcaaatgtgccactaggggtagcatctgagtactcatatacaaagtccatgttggttgagtgaagattgaaggcgcgagcatagtaaagtacatcagcgctcgcaggtgcaagggcaagtcggagagtgcgatggggtggaaggaccaaaacgcagttcacaagtcggaccaggaatttccaagatggtccttgaagagcgggagaagaattctggctcttgttcgtgttcttgttgcggtgtgtgggtttgcatggtggtaataaatttgtatactggtaaattggctgtaggccccaattcagtcacagttatttggtgaaattttcccaattatttgctccatctcatgaaatgcaccatcccaaataggattaggcccggtggtgctgcattgttcactcggacgcattttggtgattagagtttactatctcatgattaccaactgatttgctgagaatgcgtcttgacccttgatgatcctcgcagttgaatcccgcctagccgcatccacggacgccgaacgaattaaattgtctccttaactatctcccggtctgcttcggtctctttctggcactgatatgtaatcttattctccgcattttgtcgccaaacaaaaactgaaaaattaccacgaacgcactaaacaaccacatcgctcaccaacgctagacaccctcatccctggtggtattcactcaccctctgccggaccacaggctcagtttgacgtgtctcatgtcggactaaaccgatctattgtgttgcctgattcatatctccgtcttgccctattcagactgtggttttccctacatatacagattatgcaatagaataatatatccaaaaaagaaaatacaaacaagcagattaaggatgcgccgcaccaggtgcggtaattgaaaaactctaaacaaacataagcacgtgcgcgttgtattgtaatacttgctgcccacgagctcacagcctccatgcctcagcgattcactgactctcggattcatcccctcagcaatagtgcaactaagaccagcctagcaaacttgctaacaggtttcacatagccctggtcatcatcggaaagtggccctattatctcccaatttcaaagctctttgttatgacgtagtgtaagcagtccttatctatctatgtacagtttcgcacctacatcgcctatcccacaacatctcgtgactttggaaaaaaaacaatcatattaatacacagatatcacactcttgctctcttttctcttacctgcttattcatccagttctacccattcacaccaaccctaactagtccgatttatggcttctttgtcggtctctgaaatcaccttccttaccttccaagcagtcgtacaggttgttttaatttgttcctccggttactgggcttcgaaagttggtctgctgggagaaaatggtcagaaagttctttccaggctgaacgtggatctgttcacgccgtgtttgatctttaccaaacttgcttcttcactgtcggtgaaaaagctgattcagatcatcgtcatccccatcttttacgcagtcaccactttagtgtcttttgtatgctccaaagtggcttgccgggctttccgtttcaacggtcctgaatctggcttcgttacggcaatgtcggtgtttggtaactcaaactccttaccggtgtcactgaccgtggcactggcctacacgttgcccaatctcagctgggatgacattgaagatgatactccagataaaattgcctccagaggaatcttgtatcttttgattttccagcagctgggacagatgctcagatggtcctggggctacaataagttattgcgaaagaggtctccggaagagctggaacactcagatttcgataaagccggtgatgaagagcaacgttctttaatggatgttgttacatccactatcagtaatggaatgtacgcggccacagacaactatgtaattgatgatgatgataacgataatgataccaaaacgaactacctccataccgtcgtgtctgagagtccctgttcatcatcttctgtttccaacaagacccaggttgaaacgatatccattttgaataagtcgtttactttgaaagaaaaacttgtatattacacaggtgtattcaccggtttcatgaatcctccattatatgctatgctgctagcagttttcgtggcatcgacgccgccaattagagacgaattatatgagaataatggatttgttcaaaataccttgggttctgccgtgaggcagttaggatctatttccatccctttaatattggttgttctgggttccaatcttaacccttcttccaatgttgcgcctccctcaaggaactacggaaagatgatatttgcttccttattgtgtcgtatgattctaccttcgttgatactgttgccattgatcgcaatctgtgtcaagtatttgggagtatccgtcttgggagatcctgtatttcttatcgtttcgttcattctaaccgtttcccctccagccattcaattatctcaaatttgtcaactgaatgagttatatgaaatggaaatggcgggggttctgttttggggttatgttattctgactttaccatctaccatcttgatcgtagttggtagcttaaaagtcttggagtggtcccaataaattgcatttcatactatctttattaatatgatattctgaactgacttttcgtcaatttgtagacccatctgggcagtgtagtcgctctactttcgctaattgtttttgcagggcgcaccttgaacatcgcttcgtctcaactgaacatcccccatatccctccacccatcatcatgtcattatttttcaaagtacccctggatatagaggtcaggttggatggagaggactccagagaaaccgtagaggtaaagtctgccaaaggccggaaagaaaaactgccagtctacaaagatggagaaactgtcaagggccaagtgtccgtcagactaaaggacaacaagcgagtggaacatctgggaatcaaggttcagttgctagggtctatagaaaccaaagttgatggtatcaaaaatgatgaatttctttcaatggctcacgagctggccagtccaggtgatttgcgacacccagaaacatatcatttcgaatttcgtaacgtggaaaaacaatatgagtcctacagagggaaaaacgtcaggctgcggtactatatcaaggttaccctgggccgcaagtccgcagatgttattagagaaagagagttgtgggttttccaaaagaatcaattgccattgggagccaccaagccagatgccagcatcaagatggatgttggtattgaagactgtttacacattgaattcgaatactcacggaatagattctcgttgaaggatgtgattgtgggacggatatatttcctgctggtacgtttaaagatcaagcatatggaactgtcattgatcaggagagagtcctgtggggcacccccaaatcaggttaatgacagtgaaacactggtgcgattcgaaatcatggatggtgcaccagtgagaggtgaaacgattccaattagattgtttttgggaggatttgatttgactccaacatacagggatgttaataagaaattctccacgagaaccttcctgagtttagttctgatcgacgaggatgccaggcggtatttcaagcaaagcgagatctttttatatagagaatgatgacagacaatataagttcattacttgtcacttgcttaggctatgacattattttgtctggtagggagttactttgtctgcggatgcagttactacgttctaaagtctatataaacagtgcctccggacagaatctcgttgagtgatggcttcttttacttacctaccaggctcatctattggcaccaggcaccagaaccaaatgagattcgatcgtttaactcgatgggagcgacaatgcgacctcaggattgagcgtccaggaaacggtgcttcggtcataaaggttctaacgggtgtggaggggttggatctgaccagcactcagattcaattgctcaatggtatggaagaattgaacaatcgctgtaaattatccggactctcttcaacgcatgcaattcagttcgccaaaaagaacctggatgctagtcttagagcgaaggagacccactacaacttgcccatattctgccaagggcgcagccacaaggcaaagagtaaatatctgcgtagtgaccatcgatactataccgactactataaccttgtcggaacggatctggtacctttgttggactgtttcgaacaacttcaccagtcagtgttgcagatccactaccaccgggacagagagtctcagaaacaattggctgtagaagcactcaaagagtacttgcccgaattcttcgccatttcaaagaagtttacagagaaactggagaggcttgagcttcggactctgtccagaaaccgatgcctgttagagtacatgggtgacatagctgattcgagcgatgcgcctatccatgttctgaagaaaaccaagaagataacacccctccacaagaccgtcatcttcaacaagttgagccacgggcgatacagtgatgacgtttgtaagaaaatatagagagcatttaatcgtatgacctgttttaggtgatctgtaaaagcctaggaaaccaagatatgagccgcatgaaaatagtttctgtcgctctgtttgcctccttttccttaggggatatcaaccgcccacttgtgtagtctgccacacggcacactgccacgtctcgaactaaacccgcaccgcgcgcttgcacgatcaaagattgccctgtctgcctttctcgctccatagaattcccgttcagacagctcgaaacaacgtcatctcagctggggaggaaagcgaagcctaaacaaaaagtaaccctagtttagcttctctcttattcaagcgtcatatttccacacctcccgtccccactcaatagtatcatccccctttattaattttcaggctacaggttgtcatatcagaggattttgaccaagtaaaatcgagaactactgactgctgaaccaatctgaacatccagcacagttcaatcagatcgcctcagtaatagaggtttttttctgtgcttttttcttattttatcgttgcataggtttttttgcggccttttactgtcttgaaccagactctcgccaaaaagaactagatcacccaaaggttattaagtctcttcttctgaagatcgactcctgtcaactactcattaatcgttctgtcaactagggaagcagcctaaaccttactccatttcctttcggctgttgctattggagcctctgatcagctaagatgccttacacgcctccacagagaagtgcagccaagcattctgccaaccctagatccagtccaattagctccatcatattaggttcacaaccatcaagcagcaccagctctcgcaattccaaccagagctctgagtcccttttagatgcacatctaggcgccactttgagcggcccccagcctatgcctcatccaatggtgcagagtacttccagtttcttcatatttgactccgatagtgatgctgacgaagatgaggcaagttccatcggagatgttagtaacaccaacgaaaatgaaaaccgcacacagatcccaaagactaactcacgccataccccaagccctccgagaaaggcagccaatggcatgtcactgcttcaaaagagcaggagcgccaactcatcaactttattactgcgaagggccataaatagcaggtccaacttgtcaggtatgagtgttcccaataggcagaaggtcctagatcaaaggacgagtactttgaaagttagttctgttcccccaacagagtttgaaaggaagcaatcagctgctaatgctccgcttctagaagatgtcctaaagttccccaaagtttctacgcaggcttattcgtatgcaagattgtctgcaaactcactagctttgaggctcaatgttttgaaacgatctctggaaattctttctgatcgacctgatttagtgatttccagaagttccacaagttataatgagcctcaatcagtagagaccaagccttacagtagagatggtagtgaagaacgtattaacctgagaggcaatgcttcatacgctgcattaagtgcattgttcatgtccaatcagcgttccagagatacatcacctaattcacagaacagagagcattatttcgaatcaagagacaaagatgttggttcaaccatggatctcaaacaagagctgaagccaatcattgctctactagaaaaagcagacacagatatgatccatgaccatgagaaggatgtggctttgaaacttcacgatctctctctttctggagttactacagaaaagtactttaagaagaatctgctctatgcattggcaactcccttcctggaatcatccaatcacactcttccaatacaaactgcaccatcgtcacttgcattgtcaaccctccccacttcaatcggatcttccaaaccacggaactcccatgcacaacggccctaccatggtatactctcgacaaagaatgtgagtccacaggccgtgttcacctgtcaactagactctccttggtcattaaaagctgctaatgatctagcatgcttgatgtttggtgttactcgaaattccatccgggcactggccctgcttgatctaattgctccaaggtctagggatttcgttctccaaaagctttacaaaagaacctcagaaattgttttcagtggtgagattatagctgtggtaaaacccaataacacaatggcatggacttcattgtggtcaaaacggaaagatgatatgatgattttgatctttgatcaaatcccttgcgactcgtttgacctaaccatttcgaaacctctagcacacgataccgattctgaatactatattcatgcattcaaagaacatacaggatctttattggagtttgctactttcgaacaaggtgatccattatcttttttcattccctcattagcgatggaacttgcatctcttgttgatcgtcacaatgaatccgaactgccaatcaacctacaagactctgctcatatcaatgatattagatactatacactacgatttcatgacaaccacatcccttgtgctataactagtataccattggataacgaaaatgaaagcgataaggagtcggtgattaggatgaacattcattgtcttccatatattgctggaacgtttgtggtttcgtctagttcatacaaaatcttagcccataacgatgctatctcaaaaaatttgttcggtacttcgaatattttgaacttagattttgatcaactaattcctgattttagaaaacttgttgaaacggccaagattagagaaagaagcttaaagaacagtgaacctaaccttgttctgcctgaacactatttccgaaaattgaaggcagatttagcggggcattcttcgtctgaaagagaagagctattcttgaatggtaaaggactggatgctatacatagggatggaacaagaactagggtggatattcaactgagagttcccaatgcagaatgctacatactatggatcacctactctagaacagtccagttcaacgatctgaggaaagacagaaggcattcagtagttgagcctctcgaccttcatcatactttatctcactcttcgaatgaggatagaagcatggcattgccttcccaactacagttgttaagggatcatgaaactgacctagtctcctgtagtggtgattcctccgatgagttgagcagaagtaatagtttactcagggataaccccattggccgtagtgaaagttttaacaacattggcaatagagctaacaactatggcatgaagccattttctgccagagagctagaaaaggttaatagtgagcctcttgtaacggttatccccaacaagattaagactgaatcgatggatgggctgctcccgacggagtcatcagctttgaagtacgagaaagacgtgatagcaaaggaatctcacgaactcaaagtgttctctgaggataagttactcagcatcgaaaacgaggagatggctaatattcaagcaaaatcagcactttggcccaagcaagttggactaaagagacgagaaaagaagatcacggagtttatcaggttgaagaatatgggtgaaggtgcctacggaaaggtgtctctctgcgtgaataaagaagatcctggctacaaggtaatcatcaagtcaattatcaaggagagaattctggttgatacatgggttagagatcgaaaactaggtaccattccctcagagatacaaattatggcattcatgaaccatgatccacaccccaacattatgagaatcgttgattttttcgaagatagtaattactactatttggagaccccagcacacggtgaccccacagggattgatttattcgatctcattgagatcaaaacaaacatgtcagaagaagagtgcaaatatatttatagacaatgctgctctgcggttgcacatttgcacaagcacggagttgtccatcgtgatatcaaggatgagaatattattgtcgattctaacagcgtcgtcaaactgattgactttggttcagctgcgtatgttaagaacggaccattcgatgtctttgttggcaccattgactattcagctcctgaggtcttgcatggtgccccttatgaaggtaaaccccaagatgtttgggccatgggcattctcttatacacactagtttacaaggagaacccgttttacaatgtggacgatattattgagggtgaactgagattgcctcctgtttttagcaacgagtgcaccgacctaataaagaagatcttggtaagagatgtcgagaaaagacctaccatgggagagatcatggaacattcgtggctaaagtccaaggcttgaatagatgtattggatacagaagtttctcaaagattttttatgatatagtttacagtatatagatgcttaacagatttttatatcattaagtaaatggtggtaggaagtttggattgtaaagtacaaaaaaataaacttttccatttcagctaaataaggttactcacatcatagaaatgacaactgggctacatttcgatacttggtttagggcatttaagaatttttaatcttgtccacatagattgacggattatagattattcccaatcaatgccatgtcgaaagtaggacgtgtggccgagaggtctaaggcgctagcttcaggaaatttgagtatgctagtctcttcggaggcgtgagttcgaacctcaccgcgttcaatatttattttgaaaattattttgtttttgttttgtagggtaatttgccactattgaggtaataccttgtgcattcactgacatggaactaagcaaagccaccacaagcgagaaactagataaggctcaaacctttacacccgtgaaagtgtcatgacgaggattatagaggggattgtttaggctcccgaaatttgtagacgttatgcgagtgtgagcgtttttcttggactggcccttaaaaggatcccctgagctcctttttcaatgttgttcctggctgagccaagaatgtccctggttgagaaatagtgggtatgcactatttgcttcttcaactaagtttgccaagaataaaaccaatttttgcccaaaagagaaaaaccggaagaaaaggtcacacgatccgaaattatttctacacgtggccctggtaaccaagcagtcccaaacaatagcgttgtttatctagccagcaagacccttcatctttgacgtaccgcgacaggcgttgtaatccatcctgcaccacgtgcacaacgtggtcaaaatcttgggtaccatatatagccaaacgggggcacgttagagaaggctgacgagcctttaaaccagttgaggcattccacgtgtgccaaagttgcagtttgcttataacagaccaaatttgagctgtttgatacctctctctttcaaccctccccttccaagtagacctccagtattgccagtcatttatcaccgtaggaacaatttagacatctaagcctccaaaatgtccaacaacaacatacccccacctcccatgttcaaatcttcgaatttcataacaatgaaccgggcttcaatatccaacggaaccctgactacttcgagccatgaaactgactacaaagcgcgaggtacagacacaggaagtagatcttcttctgtcagtggaaccagtgctaaacggcgtcgtagatcgactttgacggagtccaaagaagaaattgccaaaaagaagaaagagctcaaagcagcccattctatcattgagaagaagcgccgcataaagatgaatagggaattcgaagccctgaaatatatgataccggcatgtagatcttctgtgtactctttgatgagtaacagtgtgggaacatacccagctcaagatagcgcaaacatgcacaaactgacaatcttgcaatccacagttgagtacataaagtacttgcatcaatgtatacggctgatgaggagtgaaattcaaagtgtttgtcccaacagtgaatggttgacggcaaacaacattgacttttgcgactacgagctggatctggaaaaatatagaaacattgagtcagagtttgacttccaaacggaggttttcaacaagcttctagagaacaatgggaacccaatttcctttccacacctggaggaaacgaatagcagcaaggaaaacataaatgaaagcgaggatgacgaagatgacgacactagtacaaacaatgactctggacgcgatcctgaggattttaacgattcaaactcaatcagcgacaaagatcccatctctccattgatagctgctgagaactatggtagctcgagtagcctccgatccagtagttcatatcaaagtccccttttctctcctgagaccccattcaacaacagtacaaatattagagccaaagcagcaccttgtgagttgcccccgttaaaaaagatctcatctttccagttaccatcgccggcgatgacgggattgtccaatgcagaattggaggaagaggatgcttctaaagccctacttctgatgaagcagaagaccagcattcatagtctgctaaattgataggatatagttagaataaatgaaattgttcgtgtaaaataggtccttgggttggtagatggcggatgggcgcgatatcgtaagagtagcgggagcgagacaacaacatcttgctaacttgggtttccctataaacttgatacaatgggaggggattactctttacgaaagagtagagcgcccaaaggagattggaagcagtatgagcctgatgcttctcttccgtatcataagggtcaagatcagggggcgacgaatgaacttcgtaagatatccaccaatgccagtaccagagtacaaaggaggttgagtgttaaactaaattctactccgatgaccacgttcaccccacacaatgctcctagcctgcctggaaatatgcatgatctgtggactaatgatgtagctgccgtgacgaatgataatttgttgacggtaccgcatacgactaaacctcgtagaagaggttttagtaacctgtcagctcgtagttttgactttgatgccgacccagaagctgcacagactcttcccaacctgttagctcaatctgattttgattgtgttgaatatgtgagaaaggaattagccaatgctgatgctcaaaagattgacgagtttgccaataacttgctacatctccaaaagaaagctgaagccgactttaagatttcagttgccaaaagtgaacatgagatcgtacaaataaaagatgatatacttgaaacgaaacatcaactgaaagatcttggctcgtcgatcaacgaactgtatctaatatcgggtcaattgcaatcaattgcattgaagaaactacacgaggaagaagccaataaccaacaatctacccaacataatacttcacctactaagaacttttctcgcacaggctctgtgctgaacaggaagcgtgacagatccagcatcttgatggtagagaagttatggcaagtgcaaatgaatgaattgttcaaacaaattgagggcattcagaaattcttatcttttaacccaggtagacacattatagctgaaagcagccggtggtttgaactgaactcggccactatgaaacctttgcagccagctcatttattcatactcaacgaccatgtacttatagcaacgagaaagaaactaaaaactaaaataaatgaaactggaaaccaggttggtaacaagagtctcaaacagctgattgcaactcaatgctggccgatccgtgatttgagtgtgaaaaaattggaattgaaaaagttcacagatgcaaagacgttcaccattgctttagaatataaaaagatgtctttcatttaccaaactgatagacaagagcctttagatttgatagttggttcatttaggagaacgaaggatgatctgagtgattttatagaacaacaaaggcaaaacaccgagtctttaagaaactccatgtcgagattatcgatttccgaagattctattagaagacattcaagcaagctgcatgacctgagtcataaggtccattcaaggaatcggagcatggagcatggatcacaagacaagattaagctatcgtcttcaatgggaaacatgggacaagatgagcttgattttagaacagaaggtctgttaccttctcctagccacagtaaagccattatagagaaattaacaggtttggaagatacgttggatgaggttgatatccatcttgttcatcagcaatttccagatgcggtagattcacttaaacagctaagttcccagttgaatagcatattaccgacaatcaatctcaatgacaagttaagcgagggcacagtactgtttgatttactgaaagtcaaattgacgatgagacaagaatctataatcaaaagtttgaattttgagctgaatcggccttcaatatctgatgaaaaggtctatcaaatagtccaactgctttcatccttggatctggaaaaaattgccagagactcactgtttgaatcaaaagctaatcttatcgaaaaactcaatcggtccgtcgtgtttgaaggagacattcccagttacgtttcacagctcaccattatcagatttcagactctaaaagcaacttgtcagctttatcgcagatgctttcccaataaagagatgaactgctacctgattgagtttgtgacgaatcaaatcaaccaacacgcagatattctgaaacgacaactgaaaggtgtcgacgaaaaatcttcctcctacatagattgtctcgaaattacaaagagccagagcaacgaactgaaggaaattggggttaacgtcgactttttaatggaagatacatacgctttctaagtagaaagataggaaatgaaaacatgtaacatttgacatcgcctttgtttttcgaggcctcttattatcgataagctaagatggattggaaccctgcacactaatgaaacaggtcatcgaccgttacatccctaaagatatactataaagatgtcccttacttggaaacacgaagttttggaagctttgaaggaacgagacaggaaggagtcaagaagcaaagaaatatatgaatcatgtgagtatttgccctaccccattccctgcactcttatcaatactaacaattcgatagttcaattcagtgtggacaagttccaagaattgaagcgtcaattcgaatcgatagagaaaaaggattctcaaattcaattggaaaagacaatcagtcagttgaaggttcaaacagaatcattggactcaacgcagcggagactacgacaggcccaagataaaaagaatgagctggaaaaagctaattcggaacttacaaaggctctaaatgctgcagaagatcgattgaaacaaagtgtcaataaattgatggttttgaaagaggagtcgcaaaccaagaacgccagccttgaacttgttaatgacgaacttttatcgttacatatacaaaataatttgatgaatgataagattgagtcgcttacaagtgaaaatgacaaattagtgcagagatggatggaaaaagttactaaggatgcggaactactgaatgaagcaaacaaatatgcttcacgaggaagaaattgaatcattataaatacattacattataatcatacaaaaagctaatcaactgtcattgtcagaggaactggaaaaccgtttgaactcttcatcttctacctcttcgattggtatcttatttggtttttttattttgggagctttcgttgaggatgattcagcagatagtgttgcagggaatgagatggaatatggagatggacgtctctttaaaatttcaggttcttccataaactgagaattatccgaatcctcttcgtcttcatccattggttctattgcttcctcgatatcaccatcatcagagaaaccctcaaaatcagaaaactgttctgtttcatattcagcatcctgcgtattcgggttttcttcaacatcctgcatgtctgcctctttttcaacgtcgttcacatttggctgttcttcaacatcagtcttggatgccttgggtgccttggtgggaatgacttcattactttcatcgacatgattcactggaattcgtatcacattaggtttggcagttacctggttagtagcagattcagcgttggattcctgctcgtccttctgcttgctttccagtcgataggtgaagaaaggcgagaatgcagattgcagtgatttttcaaagtattccctttgagctgcgagctgctgctcttccagggctcgtagtcttctattacgttccatggcagcttttctttgaagttctcttctttccagctcttctctctcttttctctcctggtttgcaatagattggagacgcttttgcacaatgttcagtacaacgtcaggtctagagatctttgggatctgaatcagcaagaatcgcccattgcgagcgaccttcgcccggataccttcatattgaactgcactgttggggtacttgaagtgtctctttacattatctgatgttgagtaaacccaaacatgggtgaacttttgatcctggtagactttgacaccataatcactaaaatctccagactttttggacattttcacgtagtatgaacgctgatcttcagttggttttatctttggtggcggtggacttgtgtaattatgtctttgtaatgcgctcaagaccgtgtccaagttattttcaaagaaacatggagtaactgcagatgactgatagccatactcgtgccttgaagggctgagcaaagctggtgtgctcacgtagtagcttggttgaaatgatatcatagataaatgagataaattgataattgatcaatgataagcttcaggcaactcggtgtctttttatacaacattttgccatcgtggggttgaatcttctagaagaccttagtaatagataagatcgcgataagtgatggaaaaatttccagaagattccagaaaaactggaacattctggatgttgccagaagataactaacgataagaggtgatacgggagcaatcgttcaatatccgaatagatctgattgagtgctgtaagatgtgccaaagcagcacttaaaatagataattctgggtgtacgactacgtctgttggccatattatataatcatcttgtattattcaatcactatcgtatactagtcattataacatgggtaaactaagggcctgatgactaatatgagaccttcatcaagcaataaccaacttcctttaattctttcaccaatgtctgcctgttcccttccgcttactgagagggacgtcctgctaacggttaccgatttaggctcgatttgatctttcacttactctccactcatcaggatcaccaaccgcaaatcatgtttacgggaatagtggaaatcattggaagtaagtactcatctatgaaatgagttgctactagtgtactaaccgtcagctgtactggagtatcaggaacttgatgtctcagcttcaggagggaatggcgtctctttaaccataaccgatgcctccaagattctctctgatgtgcatattggagactccattgcaatcaacggtacctgtctcacagtcacagaatttactaataatgatttcaaagtgggaattgcgcctgaaaccttgaagaagacaaatctgggatcgctgaagaagggatcaaaggtcaacttggaaagagcaatgactggcgaaaccagattcggaggacatatggtgcaaggccacgtagatacagttgcagagattgtcagcagtgttccagaaggaaatgcaatcgtctacacgtttaagttaagagatccagaatttattaagtacgttgttcacaaaggcttcatatgtgtggacggcacatcattaacagtgaccaatgtgaacgatgatgctgcagagttctctatcatgatgattaaacatacgcaggaaaatgttgtcttacctttgaaaaaattgggggactttgtcaatatagaggtagatttagctggaaagctaattgaaaagcaagttcaagtggccttggataacgaaattaacagtgacaattcgcctctaatcaacttgatcacccgtatagtacagaaggttgttaaagaacaacttgcttgaaataagcaatgcgtttcttgctccattttatatctaactagggatatcaaataccaacgaaacgccgtcatctccggctgtaatcacagtgagtgggtccttagtctgtagagcaaagtctaagactcccatgtagtggccaacacatacatgcagctcagcaccagttctagcgtcccacttgtatacctttccattcatggacgatccaaacaaaaatggagtgttctcaacaaatatcagtttggttactgcatcacttagcttgatggatcttctgggtttccaagtattgatatcgaataaaatgacatcaccactaaccaagcctgctgcaagtatagattgacttctgttccaggccaatgcttcaatcgaagcatcaaattcatcatcgttttctccgatctcaatcgcttgaagaatgtttaagacggatccatttccggggttgattattgctatctgaccatttctactaccaacagcggcgatattggacacaggatctatggaaatagtgacccaagctgtgattataccttttagttgttcagcctcaatcttaaagttttgctgacctgtgaaacaattccaaccaacgattgtgccatcctcacttgtagtcagtaagctagcactatcctggttttgtaaatcataaaactctccggtggtacattccaaagaatgtgaaaatccagtcatcaaaatgtcaacaccttggtcggtaatggcatacgaccagacagaaccgtctctagcaccaaatgcaaacagatcctgggttggatgggctctgacccaaacaacttcctcgacctcttctagacttgtgaggaggtcccatttttgtcctcttttggtggacttgaaaatttgaactttaccggccatatcaccggtgatcagatagctgccatttccagcaaatcctcctgaaatgacggattccttgtgtccttctaattctgtaactactttaggaacttgagtgtgtgtagtccataggtaagcagtgtcatcacctccgccagtaacaacaagaggcaaagtaggatgggtgaacactgtgaaaatcgaatctttatgggtatcaaaaaaggttctggagttattggacagatctaattcaatgtttccttcttggttgacacttaagtcgtggctctcatcttcatcatcgtcttctattggttcagcatcgttctcatcttccggcacaatctcatcaacctcattaattgtaacgtactccccttcctcctcagcagcaggttgctctatctctgggtctctaatcggttcagacatagttgcctttgaaaataggtagtattactaagactgaatattttccatgtagaatatttgtattgctatattaagtcacgtggcgaagtttatggaaatgtcaaaatgaaaacctctcgtcctacagaagaagtttatgtttagtgaaagcgtcacatcaggggttgacctgttggaaaaaaggaccaagaagctctttggagtagatactgatccaagtcagatctttgttgatgatgacgcttcttcgctctactcacaaacgataatcgaaaagcagtataggaacacacagagcttgcctgaatatttggaggccgaaatagatcgtgaaaagtacggtgaatcatccataataacctcattgaaggagaaagcactacctgatatcaatcgttcatctcagcaggctcaactggttttgagaaagaacacccaggatatacaagcgcaacagctgataaaggctcaagctcaaacggcgggattatattctcatatggagaaaccagaatggcatgcaccctggaaactaatgagagtcattgttggccatacggggtgggttcgaagcgttgctgttgagccggaaaataaatggttcgccactggaagcgccgacagaaccattaaagtctgggacttggtttctggcaagctaaaattgaccttgactggtcatatcatggcagtgagaggcctggtcatttcagatagacatccttatttattttcagggtccgaggacaaaactgtcaaatgttgggacttggagaaaaatcagatcatcagggactatcatggtcacctcagttctgtgtattctgtggatcttcaccccaccattgatataatagctactgcaggaagggattcggtggtaagagtgtgggatattcggtctcgtacaccaatacatacgttaactggccatacatcgacaataaccaatgttaagtgtttacctaccgacccccaaattatttcaacttctatggacggtacggtgagattgtacgaccttgtcgccggaaaatgcatgaagacccttactcatcacagaaaggctgttagagggatgtgtgtccatcctcaggaatacgcttttgctaccgcatcttctgatagcattcgtcaatggaaattacccgaggcgcaattgttaaataattgtgcccctgtggagtctaacaaaataatcaacaccctcagtgtgaaccagaaaggtgtattgttcagtggcgctgatgatgggactttgggattctttgattggcgtactggacaccaatttcaggcggctaagaatgaacctaccccaggttctcttgactctgaatcagcggtattggcatcaacttttgacaattccggtttgagattaatcacatgcacagcagacaaaaccattaagatttggaaggaggacgaaatgtccacaccagagacagatcctggtcttccatgggatcccacaactcgcataattgactaaataattcatagtaattgtaatatagaagtaacttccatccaacatcgcgaacttcgttaccatcagatcctctgtctttgatataagctccacaaccacatttgaccacccagaaatgaccgcgtctcctgagccaatagaaattcaggaagcaaagctggtggttcctgaacagtatagtgaggaacagtttgcgccaggtgagctcaaagttggatgtactgtgagcgcattcaaagatggggaagtaagactagcagaagttctttccatacagcaaaaaaagaacagactagttttctacgttcattaccaagatttcaataagcgtctagatgaatggattgagaaagacagaattgattacaagagacccgttttttggcccaaaccaaaatctgagaagaaagacaagacgaaatccaataaagggaagaacaataaacagataaagtctaacaagggcgacagcacagtgaaacaagaggacacaagtgttgacctgtcaggaaaggatagcgcaggccaggatgttatggatttggataatcttaacgtccaaggattggttaaggagggcgaggagctgaccagggaggatgaaatcaaaaaattaagaacagggggatcaatgattcagagtcataatgaagtttccaaagtcagaaatttttcgaaagtcataatcggaaaacatattgttgaaccttggtatttttctccataccctgtagagcttacagaagaagacgagatttacatctgtgattttacgttgagtttctttggatcccgtaaacagttcgagaggttcagaataaaaaacactttgaggcatccaccaggaaatgaaatttacagagatgacgtcgtttcgttttttgagattgatggaagacgtcaaaggacgtggtgcagaaatctatgtctcctatcgaagttgttcctggatcataagacgttatattatgacgtggatccgtttctgttttactgtatgacaatcagagatgaccttggccaccatttagtagggtacttttccaaagagaaggaaagtgcggacaattacaacgtggcatgtattttaacacttccccaatatcaaagacatggatacggtaagcttctaattcaattctcatatgaattaagcaaaacagaaggaaaagtcggatctccagaaaagccattatccgatttaggtttgttatcatacagagcttactgggctgatacgattgttaaactacttatggaaaacgggaccgagactaccatcgatgagatttctgcccagacatcgatgacaaccacagacattctacatacactgcagacattgaacatgcttaagtattacaaaggccagcatattatatgtctgacggatcaagttgtcaaacaatacgacagactaatcaaaaggaaacgtcatgttttagatcccgctaaattatcctggaagcctcctgtatttactgcctcacaattgcgtttcgggtggtagtctgaatctaatcaaatggtatagttttcgtgtgttgctgcatttcttttgcagcaaaggggctaggaattgcaataccacagcaatctccccaagtgtgctgatgtccatgttcattatcagcgctttctgatggatctgataagttttctggcgcttttaagatgctaccaaagtagaaatgttggatgataggtagcttacacagaacttcggctttatacattttttgcataccctctgaaacttttgaccacttacgtactccactgatatcgtccaacattggagaatgccacctcaatgatccagaacctggaccagtcttcacttggttgataaagtcaatgcattggtagtagaaatacttgtctttgtacatgtccacgatatctttattgtgaatagaagatggtcgggacctggtcataggactcaattgagctgctccgaataaaaagggcaggaaatgataatcatccaaaccccaaactccatgcgatccagctggctctagccaatagagtttctggatctttctcatgacctgtaggtatttggagaatatcttaagcacaatagtttgagaatcgtttagggttaaaactttcagttttaataaacataacaaaaatgcaagaaagttcaattcatggcctgatccgtagtcgatcctgatgcgatccccccaagagttattgaaatatgtggttagttctatcagcgattgctcattatttgtggccaaaggggcaagtaatttttcggaattagcctcaatatcatcataaaaatctctgaactcaacttttccaaacctggagctgcctttgtcctgtaccactggatatttgtcgacaatttccgaaaccgtttctagaatatctagaagggtttgagctgaaggagtgatactggtgggcgatccaagctctttaccctccacagaagacgccagagtttctatggtatccacgatgtaactgtatgtttcacagtgcttccattgttccaaatcggattctgtgaagattctctttattggtttgaagtaaggcatttgaagtttggagaagccgggtttttctggaggcaagagttcctcttccccacgaccaaaatatcatcgcgagcccactaacgagcgcatagaagtgttagttgatagtggcaactaaacaataagaaaacaccagaaagctccagtcttgaccaataaattggaatattacactctacctggatccatcattaaaagagtatttatgtacaagtatacttaagaaaaccggatactggaaaccactaatctccattccactagtcctcttcaccttgctcagttccgtaccgtttatcatgataattagccaacattactcgtttccttcctcttttcacgtctctggtcttgaacttgtcatccaagttcgataaaacatccttcttgtgaggtgcgacatcggacgttctataatgtgtagttgaggagttactgaatgtatatcttctagaattttggtaatcaagtcttctggatagttcctctggatcgttgtcatcaaaaagctccatgttatcatcttctaattcaacataaaatactgcatttggttgctttttcttggatggaggcttcaatggcatcgtgatgggcttgtaacctgagaaaaatgcctccagcatcaatgcccgtggattcagtgttatgggtgccatcttgggcaatgtgctgaaccctttgcgaggtttctgggtggacttgccgtcgtcattcaatttcagtgtctgatttgtacctatggttgctttctttgttttgtttttcgatgcagtggggattactggtttgattttttttaataattccttctttggggtggaggattgcaagcgtgtgccatgacgcgcaatcatccatggtgtctttgcaaacatttgcgtgagtgtggtgatgtaggttcagaagaagaaaagagaggatgggtgagggaaccaggaaaacctgatgtaccatgcatttgcgcgaaatcatctatcgctctccatcactctgctatgcatttatttgagttcaagctttctcgtcctctaatacatggtgggaataatcaaccaagtaaagcttcacaaaccagatgttgccgtaaaattacctaaaaaggacggcaatgggttttccactttagaagacatcataaacacctacattcccgagtttcaggacggaaaacaaagctggttttatccaccactcttcaacggtcatcttcaaactatgtgggcagctgcaggatctttcgaacaggttgaccagatctactacggtagaagggttctaaattatccagacgggggatctggaaccgcagatttcgttatctccaagaagcagtttgaagaagaagaagccggcattccaccgaaatcacagtgtgttcaagcagacaatggggagctggtagaacctgttttaccacctcggactagatttatgaacgagggtgagctaaagaaccaggcctctgatgatacacgccccatgctggttgtattgcatggattatccggtggtagtcatgaagcatatgttagatgtctgttgaaggaagttaccgaagaacatgatttcgacgcggttgtgctgaatgcccgtggatgtgcgcaatcgcaattgtcaactcctcaactgttcaatggattttggactgaggatttgagattcttggtgaatcacttagccacatggtttcctgaaaggacacttttcgctgtaggtgcctccttgggagcttctattctatctaactacattggacaggagggtgatgagtgtcgctttgcagcagctgcagttctaggaaatccatgggatctagcggcctcatcttatctgctacatcgatcatggattggcaggtacatttattcccctgcaatgactcaatcgctaatgaacttagtagatcgtcacgatgacattcttcgtggtagtgacttgtacagtcagaatagagagagataccacgaaggcatcaaattactgtatgactttgacaacaggtacacggcacctttgttcaagtttaatactgcatatgagtattatagagtgggttcatcggttaacaggctccctgctgttagaacacctctattaattatcaacgctttggatgacccaattgttggttctgaagctcttccgttccaggaatgcaaatccaacccattcacattaatgttaacgacatccttaggtggtcacctggcatggtttcaatcaccgacaaaacgttggtatgtacgtccgttagcatcattctttcaaaagttctacgatacgatagacaccaaatcacaacctgaaattgaccctaaggcacttccacataagcatcaagcaacagatggccgtcttcggggaccgtttcagtaaatagactggaaaaattcatatagctctgtaaatagtttgaatcaataatccttaaaagtttgttttcggtcttgagattccaatagtaagttaggtagactctctatgcatcttcttatggcatcgtttatcgcctcctttttacattttgacaacgcctgggcccgccctgaagcattctgagtcctgcctgtacccgtagcactgcaagtagtcccatctttcaatatcagtttcactgtggtaagcactttcatcttaaatctgccatcctcctcagcacactccgacatttcaaagctcccatccaaaactgaagaccagccattgaacccaaacacttggttcgcagttgagatcagtttttgattttccaactccctcttgagatatctcctctgcactgagttacggcttctatgtagccgatcgatcttcgtttggagccagccaattcttgtaatcgcccattctgaaggcttgataatagaaaagtcatcaaaaagatcaaatttcaactccttgggaaatagctcactttgacaagcatccaacgactctgaatcgctactgtccatgtggaaacccccagatgaagatcagctggaatcgttggaactgatacgacgcgcgcgagtaggaaaatatcctggagatatcaaatcataatattgggcaggaacgatcaactagaaaagtacacgtctctcgtcaaaaccttcgatttcccctccaaagacggctatgttctctggtcttaggagcaaaaaaacagaggttgacccagagggggtcattgagacgatttgtgaccgtctttccaacgcaaccctcctcactgatcgccgagccgctgttctttcgttgaagaatttcagtagagattacagggaatcagttattggtaatggtttgaaaggtttagtttccaccctacacaaggatatacaggatattgacgtcgtaaaggcagttttagagactttgttaatactattcatcagaggtgaatctgatgaagaccaaactagaagtttgatatcggaacaatcacgagctcaaaatggtaaatacccctctcccagccttctagcaggtgaagtaagaatggaccagttctccttgctagttgctgacgaattaacccaggcccctgagaatttcgaccttttattaaagatattagatagtgagattggccatgatttttatatcaagatctacaccatacagatactagaggctctggtgtcgtgtagaccatcaagatcaaaagaatgcattgtatcatcaccattgggaacgcctttattggtgtctttgctagacgaccctaatgagccaattcgaaacgagatcattttgctgcttatgggcttggtcaatcagaataataatattcaaaagctggtggtatttcaaaattgctttgataaactttttgaaattattgaattggagggaggaatcaggggctcaattgtggttcaagattgtctgactttgatttgcaaccttctagaatataatgcctccaaccaaaaaacttttcttgaaaccaactgcattccaaaattacaatccgttctttcttttccgttagtagaggagattgtctggaatccacaacgactgagtaatcatgttactacattggaaataattcgaatcttccttcagggcggcggtgatgagctcagagaatttcaatcaaagctggctgctgctgatattctgctaatagggttgaaacttgtctttataaaagacattcctaataaaattagaggtgttgcgcttttgactatttcagatcttatccgtggaaactcagaaattcagtatcaattttctcagatagacgttccatatatcgatcccagtttcccttcacaacttcaaaaatttgatcaagtaattcctgttacaatcgcactgctaaactggtgtcttcacagcaactctgtgcacatttttgacattcgtgttgcagcttaccagtgcttagaggcctactttcaggacaacgaggaggctatagttgccttcactgaggatcaagttgaaagtttcaagcatcaaaggttttactactcagatacggtaccaatgtcagaagatgactcccgagacaacgacgctactcttattgaaaatggaaatgcaaacaccttaatacggagaaaagattctccaaaggcaacccctacacctcaaggaaacattttccaaacattgttgacttatgatgctactgtgaatctgaatccttacagaatatggtttgcatcttatatattgatggcgttgataaatggttccgaacaaacgatgtccaccctccttgatcttactgttggagatgcttctgagggtgatgaggttgtgtttgccatccagactatgctagagctattagttaccaacttaccgcatgcagattccaggatcattgttgcttatctgatgctattgatatacatcttttatgaaaattttgaagctgtggacggtttcttggaagaaacttcaaacacaacaagtttattggactatctttcacgcccttccaacgaggatttgttggtgcaaggtcttattcatatgctacttggggtcatctatgaattcagtagaaaagagtctccaatttgccgaaaagatttactgacattactttccaagcatgtcagtgtcaatgcatattgcttgaagataacagagctgaatcttcaaattttttccaagtattctccggatattatcttcgatccaccgactggtgataatggactaccagaggtttatctgaatccattctttgttgatctggttaaagaaaaccttccaagaataagaaatgcgcttagtcacgaccctaactcaaaccctgttctcaggttggattacgaatcctatgaaactttggagaacgattttcaggaactctcttctgcatttgaaatctacaagaatgagtatgaagatatttctgaaaagtacaaggtactcacagagtccaatagtttgttggaagaagagtatgagagtttaaagtctaaattcagtaatgttgatactaaatttgcagaggtctggaacagtaacgaatcattggagaaagaacattctgaattgctagtctctttcaacgaatgcaagaagacgttacaggagttagaacagacaagcaaacagctggctgaagcaaagactaaattagaagaggaaaaaagtgaagattacgaacaaattaagaaaatggccaagaatctgttcaccattggaaaggagaatgaagaatataaaaagataaaaaaagagcaagagaagctagataagaaacacgaagcagaattagatacactacacaaagacatagaggttagagattctgttatcaaggagtttcaaacccaattgtcaggtttgaggagccaagtgaaggagaaggattctgcttatgctaaccttatgcagaaactgagagagtcagcttcgctaattaaacgtcttcagtctgaaaacagcagtttgaaagatggaatggccgcattgagacaggaagtgtcttccagtcgtaataattcctcagactatcgtaaagagtcagacgagactattagaaagttgcaagaaaaagtgcaagacatggagcaaggaatgcgaaactctggcactttgaatgtgcaatctcaggataaggatgagtctttggaaaccaatattgcaactcaatcgcctagtccaaaaattgaaagatctgagttgaacaaagaaatggaagactctcaagggttgcaagacccaagccaagaacataagaatgttcttgtgctttcagcctcttcgactgtgccccctgaccaacaaattgaagaagaaatttctaacggaaaggaaccagattctcaggcagttgtacgagagttggaggaaaaattggctcagaccactaaacatcttcttgagcttaaacttaaagttgatggggctggtgctgatgaggcaccaattaagatcgagcaactgactacagctttagaaactaccaaagatcaattaatgactgtcaccatggagtataatgagaaacttgatgaaatgaagggtgaaaaaaatgcgctacaatcttcaatttttactttgaatggaagaagagaggagatggaacaggagctaaaggaatcaaaagaacacaccatcgaacttgaggagttaatcaatgcccaaaaggaatccaataaagagcttgagtcaaagcttcaggagtcaactgattccttgaaacgacaatctgagatccttgttgagcttgataaagagaagcaattgttagaagaaaggattaacaatcttgaaagccagttggcagaaatatcttccgaccatgagaccctagtaccagaagacgaagaacatggaagattattgcacctcaaagacaaagaaattgaggaattgaagactaaagtagacggacttgaggatgaaaagtcaaagctttccaccgaattaaacctgatacaagaagacatctatgaagtgaaaaggtcgctgcaggatcaaatcagagaacttgcagaagaaaagttcaacctccagaactcactgaattcgattgaatccgaaaaaagaaacctgaaactgatcttttagaacagattaaattactcaaaggtcaactagatgaaaaagatagattgatccagacacttgaacagggacaggatgaagaagaattgcaaaagaaacccgaatcaggaaatgaagaaagcctcaagttaaagtccattgttcatgatttagaaactgagttacaggagaaccagtctcaacttgatgacttgatgcttgtcatgcttgatctagaagcaaaaaaggcacactacaaaaaactagccatggaacatggtgaaacaatatctgaagacgagagtgaagaaaatgagtcataaataaatagaaataggtcgttagtctaattagcaacaccttcattcattacagccatcctgctttccttataccttttcagttgtttgttaagcctttggcgatcatttgagcttgttcctgttggaattgcacgatcattactggcttctgagttgaatgaaaagcttcttcccaatccagagtttatcaaggcatagctcttgtaatttttattttcgtctgctgcaacttgtttatggggatcagtctctgtcttctcggtttctttcttcctacgaacactcgaaggtagacggcatagagaactttgacgtgaaatagagcccatgcgatctagccatagttggtcttctgacacgtctttaattctaagacttgcgacttcttcaacaaactcgtcttcactagattgttcattagtactaagaacttcgatatctggcacctggattgcatccatgtgagaaacttggaatgttttggcactgttgatagaagtaacatcggtgtttatcgatctagaatcagagtctgaaagaacatagtctcttttctcaaactcttggataatggcacttagaacactattccttggcttgtgtttgatggttggatcttgttgttgtgtttctttatgacttgccaatgatgtcgtttgtatgtgttgagactgtgtttgggaatttatggaattggtaacagactttacttcggtcttcgtaacctcttctatctccaacttcatttcaatccttcgtttgaccacggtcccaagataatttctccagagtttgtaaagttgaataacttcatcgtctgtttcctcctgctccacatcgtgtgacaatggggatcttctctgggtcccttttctcactggagaagatactctgaactcttgcctgggggaagttggggcaccattgaatggtagcaccatttcttcaaattcgctttgcgaactttgatcatagtcggcactatcgcaagtttctaatttgaaattactacgatacaggccaagtgaggcactaaaacacctctcccctctatcaaatttgtcttcctcctctagtgacatcttgtatttttcttgctgttcttccagatatagattcaatttttgcaacttttcggtgctggttccattggcgttgttccccagaatctcttcaaactttaaattagtaagttccttttgtttaatgacatccctgttgtagcttgtttccctttgttttcggaccaaaactccaccatgagatggaacgttattgagagatcttgatactgttttaagccttgaaaggttcactggattctgtaatttcattagtgcttccatattgaacttgttcttgcggcctttattcgacctgatagatctgtttctcctcaacgagtcacatgaggcattgataatggtgacattgctggaacgcttatgttttcttgtaaatcttccaaatgcctttctggtgactattattctccaccttctcaactttttacgtagcttaactccggataggaggaatgctgaaatccatcctgctttctttttcatggcttttgatctttgtaagctggaagacgagttcctataggactgacgagaagaaggatctctcgagacagactgttgaataagactagctagctctggatttgtcttcaatatagttcttgaccttctcaaagttggagtggaattgaaacttgatgaagaagtcaaccgttgatatacaggagcttgagcgaggtttggcaccgtttgtttaacaacgggaagtggtttatccaagtttgcttccggaaggacaacattttgcactaccgtatccagtatatgcttagaaatagaggaaacttctgactctaaagcctgtgacgaggacataatctcagtttgtgcttcctctgctagggattccctggctaaccttaattgagtctctttaaagatcgatactccgttattgttaaaggactgaattctactcggaggtgcactatcttcttgactacccagcggcacttggtaggctgatgatatgatgctgaggttatcatcttcagctacgtcttcctcaatatcggtattcccgttctcgttcttctttgctgagcccagcgttgtgtcagttgaaccgcacctactttcgactctaactgcactaagatgttgaaatcccaccggattttctctaaagactgggtcccttttaatgtaattttgtagctcagtttctgtctcagtttctgtttcacgggagacaccaccaagcgaagtttgtcgttctggcgacgggatgttcatctgggggaatttgaactccatcttggccccgtcataggataggtttcttggacttggggatgctctttcagccattaaacaatcaattggataactagattagaagttaacattaactccacatagaaaagctctgatcccatgtttacgtttatcccaaaacggaaacttcaatttacttcctaaaagggaacactacgtagttgtatgtgactagcatctaaccataaggactggcttgggacgtaccaaacggtttcgactcgttggctggtgagccatatttgtatttggagagaggataaatgtataggtatgcttgtaatccagaatctcacaacttcaatgtaggttccattttttttctcgttaccaaatctcacatatttttcacttgcaatcctaaaactacttgacatcatcaatatgggaaaacggagacgaaccgatacgaacaatccacttccttctcacatttccaagttctggaaccaaaggtacacgttgttcagcaaatttgatgacggaattcaactgaatgaagagttatggtactctgtaaccccagaagagatggctatgtacttggctaaatttttcagacatatttttcccgatgcaagaactatactggacatatgttctggaggtggcggaaacacaatacaatttgcaagatactttcctaactcaaagatatttggcatagacaatacacaggcgaacatcgactgcgccgtagttaactctgcagtgtacaatgttgaaagtcgcataacttatctcttgagagattgggaaaactaccatttattcattaatgaattgaaagaactgataggtccagttgacgttgcattttgttctcctccgtggggaggaccatcgtatttgagtcaggaagtttacgactcggaaaatataaaacctttaggtttggaacgattattggagtcaatgtttcaattgaccgaaaatgttgtattatttcttccccgaaacacagataaaacacagctaagtgacgtgactagaaaattaaagggaccttctgccaaatgtagagtggtggaagcctatgtaaataagagaccaaaaggtattttgtgtttttggggtgagaaattcacaaattaccagcccaacaaggatctgacagatgaagaagactagagaaaaactttgcatggtgatagagtcaccaattatacaatcgcttcagaccattattataacactcatttatgtagttaatgccaatttcatgtgaataacttttatataaatttcgctatctcatcaacatactcgattgggtttcttgtaaacattggctctttctagagatgttttctgctctttccgcaatcaacccttactgtgatcatggccagattagctgactggagcagagatactccttcaagaatgaatggaagggttgcaagaccacaaggccatctgcgaccgccttcatctgcgtcttcctcttcatcacagatgtccacttcgtcgtatgatagcacaaaaccaagagctcaatcagccctatcaggaagaaccccaactcgcagaccgatgaccccgttgtccaacaaattgcaaccaggcctggccactccaatgaggccagcaagttctttgagaaaacgtccgtctactccaactctcaactcctataagggcaaaatcaacgtcagcgttcgtccaagacctctgttaagtgtttcccatggtaataccaacaatccttggtttattgagaatgacaataacactattgcacatgacgaagccggagagtttcaatatgataacgtgtttgatcctttggtaaacaacagacaggtatatgatcaggtggtcaagccagtagttgaaaaggcaatggatggattcaacgggaccatattcgcttatggaatgactggaagtggtaagacctactctatgcagggcagtgagtttgaagatggtcttatccaattggctgttaatcaaatatttgatacagttcgctcagatccatcctcacagtatactatcagttgctcattcttggaaatttataatgaaaggatatttgacttgttgaatcctgagtctgctaacgcattaaggaacttcaactttggatcaattggcacctcttccaaggatgagttaaagatcagggatgatcccatctttgggactaaggttattggattgcacgaggagatcgtcaccacaccagacgacctaattcacttgatccacagaggtgatcagattaggaaaactggaggcacagattataattctcgttcctctagatcccatgctattgtttccatcaagatcaagaagcttacaaatagtcaagagttctttgcaacattaagtctctgcgacttggcaggatctgaaaaagcaacgacacagatagaaaggcgcaaagagggatcatttatcaacaaatctcttcttgctcttggtacagttatatccaaattgtcccagaatcaaggctccttgcatattccctacagagattctaagctgacccgattcttacagccttcattgagtggagagtctgtagtatctatcttgtgtactattcacctatcccagatcacggttggagaaactttgaacaccttgaggtttgcttccagagccaaaaacatcgctatagctgctgcaagaaatggcagtaatgttcaggataatttcaggttagaatcattggctaaagagttggtggaaacgaagagacaattgatggaactgcaattgagctctaccaagatatctgataccgatgatgagcaactgcaacgattaagagctgaaaaccggatactttccgaacaagttgagcattttagacggatgagcgatctaggaagagcagatcgggtcaacctgagtaatgacatagtgtcattattgggagagctacgagaaagtgactccaatagagatacggtaatccagaaaattgagagtttcaataaacaccaacagttggacttggaagagatgaagtcatatatctctcatcttgaacatatgatgaaaacgggcgaaaagtttcaagttaatccgcaaataaacgcaagctcaaaaaagcaaaaaacgtacgaagaactattcgtaggatccgaagggctttctctcaagagtttagttaaggatcaagaagaggaaataatggaactcaaagaaatgctgaaggagaaagattctataatcaaggcactcagaacggccaaacgtgcgagggacagtgtcttaaatattggttccaataatacaagcgatcttgaaaatgaatatgaagattacacaagcgcaaaggacaacctgcaatatggcaaagctataaaaacggttacagaaagagtacaattaagatctattgaaaatgagatatgacgaatgcgtaaactcaaaaactaccatactttggcgagctatcttcctctaaatgtacattcatgtcgtaatcgttgtgtatcagagatgtggaacctgtgggaactgcagtattatctagaggtggactgttaggatgggcttcaaaagatttcggaaccttgatgactttaaatgactttttcttgttgagatgagtcgagtgaccacgatcccatttgaagaattgaaacaacaccaatatgtcaaatgaaacagttcctatagctcctaagaaatagcttagttctctttcccaaaactcgctataaatgtccaaaatatttgaagggatagaatccggtgagttttccttgactaaaagtttcagctggtaaaaattggccaacagagatatcgaatagaagaggttacccaacaatgcgctaataaatagcttaatggagattccagatgtagttttcaatttgtagtttgtaatcagctgagggatccgggatgagaggtaacagcttgtacatgcccaagcaaggatagggccccaattcaagcttgaacttgcagtaaacattagttcgtcaggaatgggcatggcttgcactttattgaaggaggtgacaaagctggccgtgaaaaacgatgaccaactgttcttgatacttaacgaagaactgccaggcttagtcactggaatggaaatatgctccggtggcaattgaattgaagtagttgccgccaactcatcaggcgtgcttttgatagtggttaatctattggttttcttcaatggatgctgatgatgctgattatggtggtgatgatgatgaagtctgtacatatgcgtatagtagtagaactggccagccagaatcaggtctatcatgcaataataaccacttaagagaatttggaatgccatcgcgtcattcaaaagacagctggtaaagttaagaaagtcacccacaaaccataccaaaaggaatgctagagagacaccctccaagcttttcgtgttgtatatctttataacttggggcaactgagcaaacaaccaagaaatgatggagagatagcctgcgacgacggatattcttcccagcatgtttgtcaaaaacgtcgactccatcgacgtttccagcgtgttcagagttgcaagcgccagcgtgggtccaaatccatagcctgaaattcccgtatctcgagagttatcagacatacacggtgactttgaggttctattgagagatatcttgttgatcaagaaggaggaaacttgtcattaattgattagggtcatcttatcagtgagtggtgcacgtcatcatgccaaagaagcatctgacgcccgaggaaaaaagaaactctggatggaacaacgaaaaaataactcgccgcgcgccaatgtagcttacataagcaagagcgcgaaggatgccaatccactgtgggtgactggcagagccttcaggggagcaaaaattaaaaagaaagtcgttctaaatataaaccacccaatccatcaggaccctattatatttcttattgtataatcttttcttcagtacatcgaaaccgttgacgcacaccacctttagaatcgacaatgggtagaaggaaaatagagataaatccgatcttggataaccgtaatagaagcgtcacatttatgaagaggaaagctgggctttttaagaaagcttacgaactgagtattctgtgccaagtcgatcttaccgtcatcatcaaagggtccaatgacaagttctatgagttctcttcaatggataccaatgatctgattgcgcaataccagtccgcgggcgctgtcaaggacgaggagaaagagccatcttcgtatgggagacacgagaagaagcaacgagtcttcggtgatcgcagcggtaattctggaatcacacatcacgctcgttcttctgccgaggatcacagtttcgacgacgaagaagatgaggatgacgaggaagaagactccacaatcaataacgagaatgaacttccgagccgaaaacggttgagaagttcgaacgcatcttcggttcccaccagaactactagaagtcagtcatcacagtattcaccagtaagcaatggaactcaaatggctgggactgcttctcatccaataaacaattcgatgggtagttcacaaaggttaccgtttgtgcatccgatgacttcgcctgtgatgcaaggtaacatgacaacgaattcaggacctcagaacaatgactactccaatactccatctttgagaccagttttgcgtgtcaccatccctcaggaagctgacgaccaaaaagaaactaaggttgatcaagataacggctctagagaaagcgtacctcgagatcaaggtccaggacagagcaacagtaacggcaacggtaacaatcttccaccctccagacttcctatgctgaagtatagtcagccttctctttctgctctttacaaatcgaacactccttcttccttatccagaatgttcccgcaccaccatccggggagcacagttccacccgagacaagttcaaaaactcccactgaggagtcagacaacagtgcccgatctactcctgtgtcgggtggaacttcgtttttcatgataccccagcagggtgggtcgcctacaaataatattagcggcgggctgttgccttacaatagtaatcttaggtccaattctcttacaaatgccaagaatatggaaactcagacccctggcagcggtcttccatcaaagtatgtcaacgatctttttccatctccttcgacttacttctccaacgattacaatatcacttttggaacgggaaacactccattagccccgtctactgctcaatctttccagccctcggcaacttcagggaacaacgtaacaaatccaaacccgaacagaagccctagtgaagctaagaggttgcacattcaaaccaacatacctacaagtacctcctctagatcaggaagcttaaacaatggagtactactaccgagtccatcacagctattggatcgaaacagtatgcatgactcgagatttccaagcagtgtgactaagaagagctgataacgactcatgataatgtaagaactatatgtaaaatacgataactctatgattagaacataatcagcgtgaaatgcatagtgtgcatacacgtcttgaatttacatctgataatgcgcacgtgatagaaatcagggcagggccctgaatagtctcaaacagtcctcgaattctttattgagcatgcaaaaaaagcagagtttcgcaccatccattccgtctagtgaggttgcagtggcaggagcggctggaaggagatttccccttagcgaggtttttttttcatctattgtgaaaaataataaccaattcaaacttcaactcttaagcgttatcttgcaccatgaaggtaagtgactaatcgatagttaggagaaaggcagccttttggtgaagtgcccgactctactgcgttccagagatactaacaacactctagctcaatattgcttttccagctaacggaactcagaaatgtattgaaatcgacgacgagcacaaattgcaagccttctacgagaaacgtatgggccaagaggttgagggtgactctgtatctgatgagttcaagggttacgtcttcagaatcactggtggtaacgacaagcagggttttccaatgaagcagggagttatgcacccaaccagagtcagacttttgctttctaagggccactcatgttacagaccaagaagagccggtgaacgtaagagaaagtctgtcagaggttgcattgttgctgctgacttgtctgttttgtctttggttgttattaagcaaggtgaacaggagattgagggtctgaccgatgctcaagttccaaagaagttgggtcctaagagagctaacaacattagaaagttcttcggtttgaccaaggaagatgatgttagacaatttgtcattagacgtgagattgtcaagggtgacaagacttacaccaaggctccaaagattcaaagattgatcactccagaacgtattgccagaaagcaacgtctaagagagttgaagtatgagaatgctagaaaacagaaggatgctgccgctgagtacgccaaactattggccgagaagattcatcaacgtaacgctgagaaggctgagatcaagaagagaagagcttcctccctcaaggcttgaagggcttcacttataaattagacagtaataaaattattgttatatcgtttgaaagaatgaatcactgtggtttatgagatcctatacggttcaagctttcttttcttcgtctcttttgctcctcgatttcctccgcagagtacatttgctttgcctgtttcttaatggtttgagtactagcactataaccatcccattgtagaggtcttttgcgattgctgtcttcggtgtttaattgactctgggattgttttgcttcccgaatctttcttgcattagccaaaatactcacattgttaagtacttcgtcagttgtgaggttgctcttggaaaccttagcttcatatcttgccctctcctctttgtacttagggtcgcgtaacagaacgttaatgtggtcttgaaatttagattcgggcaccaattcgccagttaggggacacttgattaatttttccttgggttcattcatcctgcctaatctggtttctcctgctgcccgaattttcatacctttcggtaccttccttcggggtacattttctatctttggttcttctgtttcttgaaaatcaggtggggcctcttcgatcaaaagacccgaactcttttcctcaagacttctgtattgtaactctgatagattcagcggttgagatagctcggaatgaaaatcctcctccgtgaattcaatcacttggactagtgtaaagtcctgccaatcgatagaagcaaactctaacatcatagcttcatctttggcttttttatgctcttctttcatcttttcttgttgaaggtattccgctctggaaaatgatttatccaaaaaagaatgaacagagttgcatccaagttcaatcttagcaaaaatatcagatttctctttgtctttcatcaacctcaggagcaaggtgtactgattcacgtattggttgaatatggagttcaaggagtgtgtaggatctaagaatccaaattgagcattttttccaccaaaagattgttcaaatttcttcctaaaaactccatcgcctgtggttttatcaactgccacataaagtgcagttaatttgataatatcatgatcaagactactcatgggcttaaaatcaacgagaaattccagatcctttggtctggaaatctcctgaactttagattcacgatcctgaaattgctcgttagaggcagtgtctatagtttggttgtttttcagttgctccagcttccatttgtagaaagcattgtatggatcctcatcaatcagaaactgaaacttattattgtgtaattctttctctttgattctcgtttcaaaactcgctccattcctgtgaacatagcccgctgttttgttgatgatctcctgaactgctggaggaggaagaataacaccctctggaatgtcctccgggatgtcgtcttgcaccatgatgagtggataaaggagcaggccaagctgttagcgaaaaacttgccttctgataaaagttgacagaagggtgtaggaggcgtatgacagtgaatggaatcgcaaaggaccgccccaaaataaggctacctgtagtcaaccaaaagattcctcgtgattgaactcctcattgaacttcgacgaaacccccctgcatcaaggtatccctgacgtcttaatcatccccttcttacataatccatcttcacctatggaaaactgcccaatattgcgccaatcctaccccgtaacctgacattcatatgcccaaattcggttcaaaacaaaccaaccacctcctatccccaaaaataccccagggctcattttgagtctcttctttagtcttttcctgagaagtttctacaacgctctccattcctagtccaggtcgaaatgccaacccccttacttgttttccctacacgcgagctatctaaatacatggatccccctaaagatccggccccattcgatagatttcgttggcccccttgttcttctaattcacagagtaccaagatctaattcacctttgggaacaagcaccttcaattgacctttatttgaaactatttaggttttaaccttttaagtttctgtttgtgtttcaaatgaagctgttcgtctcaaccccggaccttcaaaacaccctatcaggtaggtaatcagttattttacaatcttgagtcttgattagtactaacattgaactgccagttgctgtatttaccccaaagtgttcgattccatacaaactgaaatgtaaaatcgatgttccccagtcagagatgtctagtacggaatacatccagaacatgcttcacgtcaaaatcaagggacgaccctgtatactgttggcccgaaagggtggcattattgagttgcgtggatctgaaagtcccaacgagcttttatattcttggaacgaatctacagtcgatgacagtgactttgttgttgggatggcttatgtaaatgaggtattgtactcttgttcgaacagaggtttgctcctgttacgagatttatcgaacataaatcgagggaaacactgtccagaaactgcgaactctgataggaaatccgacttgcttgagcattatcaaggcaatgcagtttcttggactataaatgaacccataagcttcttcaaggtgcatccgatccatagcgagatatgcttagtcggaggatacaacaatgaggtagaaatccttgatattaccagcaacttgaatttacttactggttctgtattaattgaaggtttggaccgcaactctaagttcaagctgaaaattgccaaatacgctgcctccattcagccaatatggaaagcaaaagtccatactcatcccaagagaggagattcagtatacatcaaggaagagttctcatggccccaagacgccgttttccttgacccagaaagaaagaaatgctctggcttcaaaatatgttgcggctcaaggtttggaaaacttatggtctacgacacaagtttatcacgatatgccatttctcagttaaccgtatccaatcattcaattaccaatgtcaaactgcttgtgaatgacagcttagtgatgtttgtggactcgtgtcaaactgtaggaattgtaaacttggtgattgaagagattgttaactactaccgaataccgatgggatcaatatcctcgtgcgaatgcctagtattagaagatcccaaagcggcattagtgaacaaatctttaacattcactaatccaattctgtttatagttggtggcattgataagaaattgagagtttatagactcgacaacaataaccagtgcacattgataggatgcgccaaaacatcttccataatgccatcaatttgtctagcgttagacaatccggttgataaagaagctgtacataaacttctgttgaaagatttccatatcgatcgatctcatgatgatacctacgacgactactacttcaagtcaaaatttcataaccataggaaaaacgttactgcggcttacaaactacgcaaggtctaatactatatatctgttacctctccatatgtacattataaccaaagtgcctatgacttcatgttacaaaaatacatttcgatggtcaattaactattcttaaatcaggaatatgggtatactgagtcgtcagagcagagagtacaaaaatttccgcttggactggtgcacagcgtaattctcatcacttaaaagaataatttcagttgttcatcaaaaatctcctcttagccttaaaacgtagatctttgtgaaagaacaggaggtagcatcactgcgtagtagcgtggaaggattacttgggagaaaatgtttctcactgaaaaattctattctttttgagtggtcaagtggtgcaaggatgaacgtcccctttagggttctcatcaattacaattttgatatacttatcatcgcattactttctatgtacaaagcgtatgagaagcaggctatttcttgctattggccataatatcaacgtaacctgaccttggccctcgtttctttgctctaggagcagtcctagaacttgctatcgccattatatcatctaaccctgcatttggtttcaaagttccatttcctgcaggattgacaggagatggagccgtttgttgtccggatggaggtaatgttttctgaaccgacgattgttcttcattttttgatgattcattaggcatactgggtggaagggttccaattgtatttatattcgatgcagaaggatcatttccgttcttcttgaatgagggtggaggtggaggaggggcagtggcttccaactgctcctccaggggctttgaagtatcaatgtatctcttgaggttttcatcgtatcgtaatgtcgatttttctcccaatttagcccgatacaccttcttactgttgtcactacctgatctcaaccatcctagccatctaccactatcttccttaccagttttggtttccttttgctgttgttcactcttgttggtactgtgacgtcttctagtacttgcctcctttgtatcctcgtcatcgctatcacttacctctccgtcaaaatcagagacctcatccccaaatgtttcgtcatccttaacacttgtattgtcatcaaacgttggaattgataaaggactaaaacctgaattctcaccgggaggtctgaaagctggaatcacgttctggtccagctgcgacttgacctcaggttccacgatggcccttactggcgcaatacctgcaacgtcctcggtgtgagcaggcttaaacaccgatatatcgccttgattggaaggctccgaactgtcagtactagttttgagattctcctcaacatcaagtttggtctccacgggctctttgggcttttgtttagcttctggcaccgaatagccaggatagctaaaactgttcgcatctgcctcatccatgagttcttggatgcttgttgcctcattgtcaatagaagtttctgctggcagataggatgtatgggtagcgttgggagcatacctgttagatgctgctcttctggttctacgggcttttgttggctttccggctgaaatattttgtgttacaactgggggagactttacagtggtagagttttcagtctgaggttgagttgaaggtgagtcctgagtcatttcagttggtgtgacagagacttccacaatgtcttcattgactttggaatactctgatgacctctctgtatctttagagatattattagcagctgtatcggtaccgagctcatcctttgagttcctttcgtgtggtatttcagcatcatcagtttgggccggtggtgcctcgtttgtaggcgattgcaatgcttcagcaacaattggttctgaaacatgagccgacagttgagaaccatctgcaacatcaggttggggcccagcaactggagtagcagcatcagggaccgtttgagcatgcccttgctcttggattgagcctgtagaaggtgaagtgttttgctgttccaacactggttcatttgagctcccctgcaaagtgcctcgtaagtgagagtccgtgttatgggtggctatctgacctttatctcctactaactctaccgtatcattcttgggctccgatacctccaaatctgggtgattttcgtgagtttcaacttgttctgattggaatgagtcggcaacaattggattttgaattgacaggttttcctgttgctcaactttctgaacttgctcatgctgagccggtggtggttgaacctgctgctgctgagctggtggtggctgaacctgttgttgttgaactggtggtggctgaacctgctgctgttgaactggtggtggctgaacctgctgttgctgaactggtggtggctgaacctgctgttgctgaactggtggtggctgaacctgctgttgctgaactggtggtggctgaacctgctgttgctgaaccggtggtggttgaacctgctgttgcggaagctgctgacgtgtttcggaacttattacttcatgactgttgtcatacggaataaagttcgaagaaacggccttctcgttaggtgggttgcttactggactttgatgggccgtattaatggattccttctgagcacttgacgttgtatcatggaagacgtgtccttttgcatcaataggtgcgtatctcgaagatctattggacaaaggtaatcttaaaggtggtccattttttgaagggggtaatgcagctgaggaagaagcaccatgattagtgaaagcattacttggaacctgctcgttcaaattttcttcagttctttgtaaggaatttgaacgactgcttttgaaatcatttcctgaacctagtgggttgtggcccagtgtattaatctgattgagtgatgatcctgggtttggcatctgggcaattatatgtggaggaagtggcaaacgatgcggtgaatctccgttcaatgaaggcgtggaaattttaggtgtagcgtttgtagacccagcatgagagtggagttcggaaacatcaccttcgttaggttgctgattgggcatggaattagatggaaggtaaccaccttgagcaggcatattgacagctgaaacatttcttgggtgatcaatacttatactgctaggagcacggtattgcatatgcggatttcctcttgatccaggatcagatggattctgggtagtgctgtgatcgacatatcttgagcttgcttttgtattggaagttgcataattatttgctaatggaacctgtgacagttgcctattgactgcctctttaccatatccaacctgaggaggaagacttctgttgttagcatcaacatggccattgttaacagcatcaaaatgggatgcaccagatccattagaaacatgagccgctgtatagtcgggggaagtattggtggacatagtggctggctgataaaggctaggactgagataatttgaggatccttgggtggtaaacgcaggcagttgctgatgtacttggggttgatcgaccttcgcagtgttggaggaagaattgaacgttaaaacgtctgcaccagccttattgtcctctgctagatgttcgccagcaacaaacttactgaaacttttatcaagttgtccccatactttatccaaattggttttcgaaagacccccaaaccatgtattcatagatgaaccagcctctgataacaacaaagatagtgattgaagctcgtgtagcaaaacttgatttgaaataacagttttagtgttctttagagattggagtgcataattacagtacttttctgcttctgccactgcaccaatatctgaaagtatgcttgcatgaattgccttcattacaaccaattgtggaattccattgacaaacgcgctgttaggcttattttgaattatccattcataaacttcgttgaatatgatactttcaatatctctagtggccacatgcgattcattggggatgagcggcacccccgacattgcaaaaacaatctgtgcatacgtgaaaaacccaacttctgtcaaagtgttaccaataagtaacagaatgttctcaggattaggtttattgtttaaaataaatgtcagcaagctctcaaaatttttgataatgaaagttgagtggtgcttgagatcttcagcatccgctaggtttgatagaccaaggaaaaaagtcaatttcttgctaacaggatcatgttcattgaaattgtatttcaaaaaaagttttactgttgacgcatactgttctggagcaattaaggaagacagcaataaagacatagcccagtcacgattgaatatagaatacgaaagagctctttgcttctctccagtttgcagcaagccgtaaagatacgtcaattcggtaggatccaatgcagaagcatttgcccttctgtgagttgcagtctcaagagattttgtcagtgcattgtagtcaataggctcatccgggctcacttgtgtctgtgggtccaatagctggacaagatttttgttgaatacttcaggattttcatctagcttctgaacagaataaagtaaaactttccacagaagagatttttgttcgcttagaacatcgcttgattcattataagaagcaatcttctgttctatccacttagttaattccttctgctttgctttaccctttgtgagaggaccagggaaacttataataagaggatcaatctttatgacatctttattcgaaacaatgttgatctccaccttactttgaccgtaagtatcaaatttgggtagcattgaaagcgctttaccacctcggcaccaatggaaaattgggaattgtgtgcgattgtatacttctggatttctcaccacaggggcagtctgctgcgtaatcggaggcaaggctgatattttgcggttatgtgatttcactcgaggcgccattccagtactgacagaagagcgggctcttctgccacggttatttgatgcagcaaacgtagcattcggagaacgagggcttaatccaatttgtggagaaacctgtgatcccattccagtctgcaaatgcaatggctgcatcccaaattgactaacggaaggctgatcggatgcaggatgaccagcttgagaaatcatagtttgcgggataccttgggctaacatgactggagcatttgaggaattgaactgttgtcctattgagggtgcatagttggaggaatttggaggagcaaactgctgtgcaggttggggagcatagctggaaacatttggcgcatacctgtttgttgttgttgaatgaggcggaacatctgttactctagacggttggggattcaagccattggatggaggtgcaaactggttctgagtgtgagtacttggcgaagcataaccagtgtgttgtgtaatcgcaggagggggcgcaaacatattatttggtggggggacaggaacagtttgtgggttcaaatcaggggtttgcaattgagctttgttaaccggagcatagggattaactggtggaggagggacatgatttatgttggtagatctgacagtggaagatctacttctattgtgataagcaatggattctatttcggcataaggatcctttgcatgaacagatggtttgtttcttgtgagattgttgattggaagttcagagtaaaaactttgcttcttttttacagctcttttcgggggctgggcatcaatattgttgaaagaaatgtctgtacctacggtcgaaatactggccgctctaagagggggataaccagcggaagtataattttgagagactgtctgaaggtttttgttggatggttgaagccttgttttcaacatatctggtggaaaatcataagcatctgttttctttttagcttgttccaatgcatccagcttggggtgaccagcgaactcttgagcaggagaaaggatatttgggtagatcatagtacggtcaggtaccggagtcgaaagcccagcatggttattacctcctggattatatcgatcagatggcatagattttctaatgggccttctaataacagtttgggtggagacgtcagcagataggttataatccaatctagattgatcccttggctgaggtggctgattctgccggtaagttgtacctccaccatattctgaatacggagctgccatttggccaacagaatctccatactgacggtaaacaggttcactggtaatggagtgagtatattgttgaggctggtatggttggacatcatctgcctcaagaatttcatcatcgtcctccaaaaaagaaaacttattctcaaacgagttctcaggtaagcgtgtagattcttgagcattagagatcctgtcattttgaactgactcaggtttgtcgagtgtctgggtcatttcttgcttgagtaactcggcaaagtcagcactttctccctccgaaaatacggacgacttgtgaaaaggactatgagctgtttgatgagcatctgccgttcctttatcggggtactcgtcatgacctatttcaaacacctgcccaactgattcggacacgagccaatctggctcatgattagactctgtattccatactggttccgcttcttgcagttcaggagcttggcgaggtgatgactgggcaaaagagttgtttcgttcaatatgccatgcattaggctgttctggatgatagggagaaacttcagattgtagatgctctttgccagttgaatcttgaaatctgccagcttcaataaatattggtacttgctcagcattgttttgaaccggctggtgtgatcgttcctccaccataggctggttactataaggttcctgctctaaagcatggagggcatgctgatcaagtttatgttgctgagggtactgatcagaagccttattgtctgcattctgctgggcttgaccctggaaatgattgtttgtaacaggatcttgaactacgttctcttcagtcttatcccaaggaagtttttgttcatcagaagactgttgaggattgaaatgagaaggggtttggctatgatggcctatttcaggctcttgttgaagatctttatgagtatcccaatcatctagttcttcggacccaaattgttcgttatcccagggaagttcatcatcatttactgcaggactttgttgtctgtcagtatcccagtttgaattatttccagaacgctcagtccttatttcttgcgcagggggttggtagcgagtatcagtatcctgatcccaagaatcttcagcgttctgcgtatcccattgtaagtgttgaggctgctgctgaaagcttgagtctacggctggctcctgaggagctgaagtagagtcattctgatgatagttaccttcgttattatccgcttcccaatggggcttccgcaactcttgctgagtctgttgattattccaagaattctggtgatcactagaaggattccaggcaaaactatcactctcataagcctgagattgaagagattggtcatttccccctcgatgaagggagtgaggcgaagctccgtatgtcgaacgatgaaaactgttgtactgggattgaacctgttcagcagtctgattactcccgacagtccaagtgtttggaccattttggctttgatagcttgaaggattatccattgcagtatcatcagtattctggaagctgagaccaactgccttgtgagtaggctcagcaaattctggttgactaggtatactagcatccttttgagcagttacagctttaaagtgatgatcaaactgacttccgtcaatttgagcaggagccctgtatttcctttgtttctgagtgcgctttcttaccccctccttagctgtggaaccaatgttagtattctgctgggaaacaggaggtggaggagcagagccagtttggggaagtagaggtggcaattgcgacatttttgatggatgcaattgattctaaatctaattacagtcactcagctggtgttgcgatgatagcagttcttgccaatgaatcctgaaaggaaatatagttggaagatgatacacgtaagtgacttgagtgatcaacgagcgaaaactgaactacggaaagcatgtcgaacgcgagaagacgctcgaaaatcctatagaggagatgtgatgaggttggtgaagctgaaaagttacaagtacatctatactttgagaggtaagtcaatgaggcgatatagcaattcatccaaagatcacacatttatacatagactttgtagtctttcccccaatgatttacgcctactcgtcaccataattgatccgtctcttcgacttatcattctctatcgcgaatgtatgaattttttttgaaaaaaaaattctagtactcctctctcttatcttacacttcactaagtttcctctttagagaccatggctgtgggaatgcaagtcacaaagtccaaacaaaaaatggctccagaaaaggagcggttcttgcaatgctgtggtgacatttctatggaactggtggcttctcttaagaactcaaaagatattcatttgaatggtttgataaccagatactctaaaaaatacaaattgaaacaacaaccaagactcacggacattatctcatccattccagatcaatacaagaagtatctaattcctaaattgaaggccaaacctgttagaactgcctccggtattgctgtcgttgcagtaatgtgcaaacctcatcgctgtcctcatattgcttacactggtaacatttgtgtttactgtcctggtggtccggattctgactttgaatacagtacacaatcatacacaggttacgagccaacatcaatgagggccatcagagctcgttatgatccatacgagcaggctcgtggtagaatcgaacagttacgtcagctaggacactcgatagacaaagttgagtatattataatgggaggtactttcatgtccttacctgtagattacagagagggatttataacccaactacataatgctcttacgggctacaatgggaaggatatcgacgaggcaataaagttttcacagcaatcacttaccaaatgtgtggggattacaattgaaaccagaccagactactgtacagaaacccatcttagcgacatgttaaaatacgggtgcacccgtttggagattggtgttcaatctgtttatgaagatgttgcacgcgatactaacagaggtcacaccgtcaaagctgtatgtgaaaccttcggttactccaaagatgctgggtataaggttgtcagccatatgatgcctgatctgcccaacgtcggcatggaaagagatttagaacagttcaaagagtactttgaaagcccagcttttaggacggatgggcttaagctgtatccaactttggtcattcggggaactggtctctatgaactttggaagactggacgttacagatcttacaacgccaatgcccttattgatctagtggctaggattatggcattagttcctccttggacccgtatttacagagttcaaagagatattcctatgcctttggtgacgagtggtgttgagaatggaaatcttcgtgaattggctcttgctcgtatgaaagactttggtacttcatgtcgtgatgtcagaacgagagaagtcggaatacaggaagtgcatcataaagtgcagccagatcaagtggaattaataagaagagattactacgccaatggaggttgggaaactttccttagttacgaggacccaaagcaagatattcttattggtttactgagattaagaaagtgctctaagaagtacaccttcagaaaagagtttaccagtcaaccaacgtctgttgtcagagagctgcatgtctatgggtctgtagtcccgctacattcaagagacccaagaaagttccaacatcagggtttcggcactctgctgatggaagaggcagcacgtattgccaaagaggaacacggttctgaaaagctcagtgttattagtggagtcggcgttagaaactactacgctcgtctaggttacactttggatggcccatatatgtccaaatcattgatagactaattatttatgagaactaccctaaattctttctatattcatcccaagcagcacaaatggtattgataaagttcgttttatccgtttctggatctcctcctgtctggaaagtgaatgcaaactgttcactatcgattcgaagttcaccctcaatgtttctggcttttgtagaaggtttatattcatcttcgattgctctggactctacatcaccatcaccctcttcttctttatcctctttctcgttggaatcactattgtccttttctaccaaattttcattctccccaaaaaaagcaaatgtctcttgctgagcgcttaacggctgggaggttaacggagcaactttcttggtatcgtttgaaaatacatccgtcacatgcggtgactcttgttgcacctgcattttaatatgacgcatcggtgcctgccttgcgctagtgtatacctgctgaggttgctggtttcccattggcggttgtctactttgcttcacgactcccggtgccacattattgggaactatgcaaccctgcgccattagtgcgctgtgaggaacaatataatgaggttctggtccatagactgggaaaggcatcggtgcgaaccctgctgtaggctgcgcttgcgggaagggataacttctaaatccgccctgaggaacagatgttaatggtggttgtccgctaaaaggcagtctacgtttccggaatctctcgggacctgctccttgtccctgttgcgtgtagtgcaaattggttcggattggagcggatctgatagaggggttggatatatggttcccattggctatgttcaaaggaggcggcgcattacgacgcttcaaagacttgttgggcaaacgagtggctgatcttggttgttgcggtttatcagcaaggtcttctcctactgaatcgagtggtggaaacgattcttggtcagcacgttcagagacaccctgttctctcttagcgatgagatctttttgctgctcttctattgttttactacgtgccaacgcctcttcaaacactggctttaataacggtagtcctggtgagaggatctgaatggcgatggactcaatttgttgtttgttgctattgtttctcctatctgggttagcgtctgcgttctcggacttagcagtggtctctttagagcctctctcggtttcctgtacgggctcatcgtgtttcttggagtcggtgtcgttaacagcagtcattattccacaagtatggctattcgaacctggtattggagccaggagagttgttggtccactgattcagttgggaattaagtctaagaacctactatgtgtttcaaatgcgaactatgaaaccgcggcacgtgacgcgaatgtatgcgtatggggttcaatggatgtgaaaaatgttacataataattatacaacggctttaaatattatacaatgaatggggctgcgaagacgttaagctcctttgcccgcgctcgtggtgactcccgaaatattcttcgacactttggatggaatcttagactgtttaacgggagacttggtgttattaatttggttgactaccttattggtgtttgatttagggttttgctgctgtgcctgctgctgctgctgctgctgttgttgtagcttttgttgaaccttctggcgttgttgcaatagtttctgctgttgcttctgctgatgctgctgctgctccaaaaataacttttgcttggcttgatgaacctgttcatatgcctttgtcaagagcatacaaccaaatcttatcgactgtgtttgagaactaatttggttcaattcgctaggatcgacggggttgaacaatggaacatcacgatcaaacgaaaatctacttcgcaatcgactatttgcatcatcaacggagtcgtatacattcattccctgctgactcttggcgctgtttcgatcggtaatgtcagcatccaaagatttctcgaaagttgaaaaatccaggaactcatccagcggttcatctacagtcattttgcggtctatccatagtccacgacgacccatcctttttctaactttgcaaatgggtgcagttacatccagtttattattagaagcaacctcgtaaatagatggtggtagtggcgtggtgagagcattgtctttgaaacacagggtccgaggtaaaggtttcttgtcttttatcagctgagtgatttccggatcaaaataattggattgatccacttcaaaaagtgcagcagcaatggatgaatatggaaaatgtcctttctctaagatgctatctgggtttgtgaattgcaaaaaggggttgaacgggtcatctgttaagttaacccatcctctatctgattctttccgttgacgtagtttttcagccacagctctattgatagcttcgtccttttcattcaaaactgtagagacggtaatcaagtccatatcaggaatcctagacatgggtaacttgacgtatggctggatcgatacagggttgagaccagatttagatatctgctgctgctgtagctgctgttgctgttgttgagcttgagcttggttccggttggggtagtttccagagttgtatcctttgcggtatttacgatcttcatccgtcgtaggtacaaccttctttctcttgtgcgcaacaaggtcttcctcttcacctttaacaccaagatctctcttcaaagttttaacgctacatctcaactggaagacttcatgtccaacttcaatagcttccttgcgtttgacctctctctgagcaacagcaagcagcaaatctcgagtctgcttgagttctcgatgaagtttgcgcagcctttcggagccttgagtatcagtccgtcttgttttcctagcttgacggaactctcgtcttctgaaacaaacatatggatcgctgtcatccttttcagatgagtcctcaaaccttaattgagctgttataggtctcccatgtctggcaatacgtctttgcttccagtgatcgtagattttttgaccaaaaattcttagtagctccgccagttttctatgtgatagttgagatctttggccatcaaggagagtgcgaaatggatgcaaacctaattgtttctccaagcttaattctatttcctcaattgaattaggatcaacaaccaatgctgcggaatgaagttcttcaaacgtcaaaatctgtgatgggtccatggcgagaaaaggctgtttcttatctattacgacttcgaaacgctgcaatacaatttccagttccgtctcggtgcaaggctttatgccattggctagatttttgttcaaaacttccttcaagaagctttcatcttcttcatctaaattgtatatgcaaccagtggtctcttccactgtggcactaaatcgaatataagtgcctggaggctgaaatttgtcacgataatacttatcataatctttccatacttgtgatgcatctggagttgggatataggctttttcaaccttacctccagaaataacagcagcctgtgcggcattgataactcgttgtaaatgctcttcttcttcttctcccttctcaacaccagtttcaatcttttgtaattctctctgctgatcttcagtctccaggtcagcgatgtcagactgcttgaagacctgtagggtctgcttcacggaaatcttcctctgacggaatctggcaccagccgcagatggtaaaaccataataatcttagaggtctggggattgttatttacaacagagaccttgtggtgttgtgtgctccttggacggatttactcgaagattggacgaggaggagctaacaacaaaggcctacggggtgatggtagtggcacttgccctgggatcgatgaaaagtggtgatttccaattgggtgtagactggcgactgagcttacctctgatttttggaaagatggattgtcgaatttgatcttcagtgtgtcttggtgtgttctcctaacaaaagggttattcgtgaaaattcttcggaaggttgcgcttacactatcaaaacattgaaaaccaaaacagtctccggattacttctgaaaagcctgggtattggattgggcagatcaatctggtgatgatcaatgtttttgtcgggagacactgctcgtggtagcgtgtcgtaccgtgttagactttgaggtagtagggaggtggtgtcgacctttgcttagtatggagtggcaaaaagtttccctattgggcttcgcggcactaagaactacatctattcgcgactggaatatcgagcaccgggaaaggagcgacgagcgaagagcgaggaggtggagtgacagtctgggggcgggcgaaaccaaatacgtaagccctctggaagatccggggtagatcagggaattgttttcatgtggaacatcttacaaagctcccattgctatgatctaatcttccaatggcttgccgttgtagtttactggtgacaggcctcaatctcccgtatatgatacttttctaaagtcttggaaggaaccatgctgggactctctgtaacagggtctcgtcctttttggttcttggggaatgcaattacatcacggatacttgtggaccctaaaagcattgcacagagtctgtcaaacccaatagcaaagccagcatggggaggacatccagattcgaaagcccccaacaaatgtccaaacaaccgatggggatcttggatcccgagaatctctttgaaaatatactgttgtagattagagtcatgaattcttcttgaacctcctccaacttcaactccgttgacaaccagatcgtaatgctcaccatgtaccgccaaaggatcggttgagagaagatcgtaatctgcaggtgaacacatggtgaacgggtgatgggtagactcatattggttctttttgtaaagtggatagctttgctttccgcttagttggtcttcttctacgggattgaacagcgggaaatcaactacccaagtagcaacactcaagtcttttaaagtgtcttcttcactgttagccactgttcttctccattttgtagggaattgttcaatggcaagttgtctaaaacgtcccaggggagttggattctcatatggcagaatggctctatcagctccggtaattatatcaccaggttgaagattgagcttggccgtaagctcttcaagtttagaggaatcgatatcagcatactcagagaaatgctggtgccaattgttcaagtcagtggtggatttaatggcaaacattgctggtctcctagatttataattatcgggttgtatgagcaagtcaggaatcgtataatgcgatccttcaaatgcttgtttcaaaacacacacttcgaaaacagggaaatcagggttggcaactcttgttgtgaattcagatatatcgtgaaatcgtaatgatgaccttaaatcaggtttatcaatcccatataactctagaactgatttgtatgacatcaatgggaattcgttggacctaactagctggtcagttccaaaaggaacatagagtggagactttttgacatctaaccagacattattgacaacttgttccaccgcgtgtctgacttgttttccgtctgcaaagctcatctctatatctatctgtgtgaattcaggttggcggtcagcccttaagtcttcatctcggaaacagcgagcaacttgatagtatgatttgacgccacttgccatcaagagctgtttgtattgctgtggagattgcggaagtgcatagaaataagactttcgtctggtgggaaccaagaactcattggcgccctccggagtagatttgaaaaggagaggtgtttcaatctcggtgaatgaaagggaatctaaagtggatctgacacgttgcaaagcctttgcccgcagcttaagagcatcttgaaaaaacttcgatctgagttgtaagtaacggtattcaggtgggtaatcgggtgacgctacgtctagtgatttcaactgagatgggacaagattcgaacggtttaggatttgtaattttataacgtttaaatcccatagttttcccacagactcctcgctttggtccttcttgggtcttctccttgatatcgtgccggtgactgcaatagcgtcttccaattgtagctgtaaagatatcatctcttcatcagctatgacaatttgagtgatatcaccgttgtaatctctcaattcaccaaacgctagccgttttgaaacttttctgggcttgctgttcatccatccatgcagggtaatttctttgcccaagtacttctccaacgacagtgctacgctaccaatggtatgcgtagtagagggaaacacaaacttggccacggtagtttccctgtcagggagctgcactcgggaagacaggccccttctccaaatacaaacactgcacctcctagaaatgtacttggtctgtctcagcatgcttctaggaagggaacagggtgagacaaagatctaatccgattactgattggaaaagagagtgtaatttttcatgtacaataggtattatgtaagcaattttgaagggtttgggtcgggtgatcctaacatcctctgtccagctccgccgaaattgcctcaactggtttgtggttcttctcacaccatctgtggatgcgtgtgtgcagttcccatagtctggtcagtacacacccaattatttccacgactcaccgtttgaaagcttcaaatttttttgccaaagctccttcttttcttctcttcctaactttgttacaaattaaacgacatgtctcaaggaacccttttcattactgaacaaacccgtggagttgttccaaagggattagttcaatacttcaagttggacgttaagatctccaacaaagaagacgagcaattcaagaagtacttcccattgaactatatccctgccttcgttggtcctaagggattgaagttgacagaggtttctgctgtcattgagcactgtaagtaaattttaacattacatttttgcattctgttgttttgttttgcttcatttttcctttgattgtgcattgtccttctgaatcggattctcctttttcacgttccgagaatttcagtgatgagaaatattatcatttaaacagttatccctgtcttaaaatccgtgtcgagattatttaactctgaagaaacatttcgtagaagggctattcacaatcaaatcaaggacgaagcaatcagaattcagaaatctttttgaacttgttttctaacaatttagtactgaacttggccggtgagaagaaattgaagggaactaccgaacttgagcaggttcaagtcaacaagtggatttcctttttcaacactgaggtcatttcaaccagtgctagaatcttcctacctttgttgggtaaggctccatacaacaagaaggacattgatgctgccactgagagattggatactattattcaaataattgaggcaagattgtctgaatttacttacttggtcggtgaaagaatcaccgttgctgatctgttcgccgctactgttattggaagaagtctggagactattttcgacaaggcatggatttccaagcaccaggacatcttcagatggttcagcactgtgtcagcccacccagttctgtcttggagatacgttgacttcaagccaagagacaagcctgtcgaatacgtccctcctaagaaggaaaagaaagaaaagaagaaggaggagaaaccaaagcaagagaagaagcctgctcctgctgctgctgagcaatctgatgagccacctgttgagaagaaggcaaaacacccattggaagctcttggaaaaccaaagttggccattgacgaatggaagagattctactccaatgaggagaccagagagtctgcaattccatggttctgggaacactttgacgccgatgaatggtccttgtggaaggtcacttacaaatacaatgatgaattgaccttgaccttcatgtcaaacaacttgattggaggtttctttgccagattgaccggttcgatcaagtacatgttcggatgtgctgtagtgtacggagagaacaacaacaacggtatcatcggtggtttcatggtcagaggacaagactacaagccagcttttgaggtcgctccagactgggagtcttactcttacgagaagttggaccctaacagtgaggaagaccgtgagttcttcaacaacatgttggcttgggataagccaattgttgtcaacggtgaagagaaggagattgctgatggtaaggttttgaaataggataagttagcttagtaattttaaggtaaacgaggccccagtgatactggtattaattggtactttctttcctggtagtctggtagcccgtccaagtttttcttgtcggcggcggagaacggttttttttttatcttttcacccactctgatcggctcttcttaagctttttttttctcctttcgcgactaccgaggaattagtttcaatcaaaatgcctgaggttcagcgtgttgtttcctcccactcactagaccattccaatgttggtgcccaataaaaaccatttgttccaccagatcagaaggaagccgtcgcaaatagtggcgcccatcttgtttttggtcctcgttgtgtatttactatttggaatcgggcaatcttcgtccaagaagccaaagtattcatacaaagataaaacacaaggatggctattgtcaagcaaaatccctcctgggccggacgaaatggccaaaaatcacattatgcattataatatgaacttacttgagactactgtcatgcctgcgttcaacaaagaacaagtcttggtgctgactcccatgtccaagttttatcccgaatattgggataatttattggccctctcctatccaagagaactaatggagctaggatttattgttccacgtggaaaggctggtgatgaagtcgtcaagaaattggaaaccgcagtcaaggccgttcagagatcttccaccgaatcggcaagattcgctcgtgtaaccatactcagacaggatagtgaatccgtggaatcacagttagagaaagatagacacgctttaaaggctcaaaaagaacgtcgatcaaagatggctttggcaagaaattcgttattgttctcaaccttaggccccttcacttcgtgggtgttatggctcgatgctgacgttgtagaaacgccaaaaactctgattcaagatttagccacccacaacaaagcagtgatagctgctaactgttaccaaagatattacaacgaggagaccaagaaaaatgacattagaccctacgattacaacaactgggtagaatcagaggagggtctacggttggcttctactttgggaccagatgaaatcatcgtagaaggctacgcagagcttcccaccttcagagcattgatggcacatttctatgatccacatggagatttgagtacagaaatgcaactggatggtgttggaggtactgcagtgctagttaaagcagaagtgcatagagatggtgccatgttcccaagtttcccattttaccatcttattgagactgaaggatttgctaagatggccaaacgtctgggctaccaagtctttggtcttccaaactacctggtttaccactataacgagtagatggggcagtagtgttaagtatcgcgacacttgcagcatcaaagtcgtgcttcttatcaatcattaatcctctttcatactgataaggagtagttatccctacccacttcttaggcaacaatagagcaaggccttatcaataagtatcgcaaaatagtagaataaatccaatctataaagatagttccttcacctttcatggcaaagtctcccgaaacaagaatgcggcctcccctggaggcttcatttcactcctcctccacaagacggtttagcgggcctaaaaatagtcttgccgagtccaccagcggattggcctccccattggctaccaaagagcttaaaatttcgaccagcaaacaaaatcagactccagtgaccatcagcaacgatatgctgaacataaatcctaatctcaagtcaattgtggagggtggaacgtctcctatagcagaatcgaatgtcggtgtggcagcgtttgcagctacagcaacggcagcatctttacaactgagtggctccaactcctctaaaagtcccacatcaaggaatttgtcgcatgttccctgcaaattctaccgtcaaggggcctgtcaagctggttcttcatgtcccttttcccacactttaacccaaacaagccaggcagcaacttgcaaatattttcagaaaggaacatgcaaattcggatcgaaatgtgcactggtgcatatttctccggagggaaaaaaggttaatctgaaggctctaaatcaagcttatcaggtgccaaaacatgaacgatctctgtcctcttcccagggtttaagtcagcagatacacaaagatccagaaacatctgatgatcaagcttccagcatgtcctctcctactcgaacagtaacatcacagatggcatcgtctcccttcagcaatacaaactccatttggtcaggcacaggttcaaaggaaaggcgattgtctggaccatctttttcgacagggtctttctctagaggttcgttttccagaggctctttttctaatcacacagtgtccaaagctgaactaaatcaactaatatctgggtgtgctatttcggacgacgaagttgatggtgccgaaaatatgaatgccctgggtgcagaggactttctgcccagcagtctctctgacctgctaacaccccaagaactaaaacggaaaaactcaaagtctggtagtagagccaacttgcgccatctcttcgatgctccactacatggaagacaaaacgaggctggaactcgtattgacgaagacactcaattttggatcgactattgatcgacatatagacatcaaaaagcgactatatatagttcctatggatttttttaaattacaaaaaaatgactaaattcccatcactttaactaataacaactaacggcggtcagtcttaccgttaccacgcttacctgcaatcaggtgcttaggcaaactagcagtatcagctctgtcaccttcaccctttctagtatgtctgtttctctcacgcagatgcatcttagctactctgtcaaccttggaacgaagagatccatcgctaacaccgtcacttcgtctgtctctttggagcaacatagtgtgaggacgtttagtatcagcagaagcctcttttctgacaatctcagatccacggctctgctgggcactggctctcttcacgcttgcgttcaaaccagaagtctcgtgtcccaatttatacatgtgatccttcaaattagcaacagagtgggtaaccttagttctaggcatgacagatctactgttgttcttcttcatcttggcatcgttgatcatcatcttctgtttgttgcggatccatctggccttttccttgatgtcttcgacttcctcatcctcaatctccgaatctgagtcgtagaatccttccttggacaattgctcttcttcctcttccaaagcttgcaatttggcagcgatgtcaggatccaagaaatcgtaaacgttacgaccatccaatatttctggcataatgtcattcttccactcgtcatcctccaacatgtacttgtctttaaggttgatgttgaatacaccagcacctccattctcagcctcaatgtccctggccagctttctacggttggggtcttcgggatcatatttcttaagagtcttgacagcgtctggaatgtatgcagcacggtcgacgtcgtctctggcctgtggtttagcaacgtggatcttgttaagaacattggagatacgggatgatcccttcagcttctgctcaattctggaagtcaacaatttttcacaggcagagtttctgaccttcataacgttgtcctcttcgtaacaagaggtttgcataatctcaacaccactgactttctcaatactggacagcagctctcttctctcagggtctagatcctcaatactgatgatatccgtcttgttaaccacgaccaacacagtcttgttggcaaacaatggcttaatggagtggaacaaacgcacttgggcttcgactgaaaacccacactgctctgagagatccatgaagtacaaaacacaggatctcagatgtgcaatggcataaatagactgcatttcaatgttgttcatctcttcagtgggtctgtcaagaataccaggggtatcaattgcctggaatcgcaaatatttgtagtcgaagtgtccgacatacaatgacttggtggtgaaggcataaggttgaacctcgacatcagccttggtgatacaacgcaagaaagaggactttccgacgttaggataaccacagatcaatagtgttctggtgttagggtcgatggatggaagacgacccaaatgctgtctaacttgctccagataaaccataggatccttcaatttcttcacgatagtggccattctacctaaggcagctctcttcaactgcttacattggaacagcgactgaccaaacttcaaaagtctgacataatctctggcgacctgttcgatcatagcctttgccctggaaatggctgatagagacactttgtaatggtttttctcgtacaaggtatccataagatctctgtggaagggatgaacatcgtctatattggggaaaccttgcagcaagtcggtgaacttctcggcaaaaccttctgctgtatatcttacctttctcatgtagaaagctctaatacgagtgatagcaaaacctggtctgatcaccgttggggtttttctctgtgtcctgttaagaacaatgtccaacatgtcatttgacgttggcactgtcggaatatccttccaagttaattgcatggttactgtgaatgaaggagaacactagagagaagcctaagttttttgctctaattttttttttccttaaaaaaaattttcagggaaaagaaagaaaaagaattgattacgtaaggttgggagatgagattgtaacggtacaacagagaagtgttgcatgcatttgactggaagagaagctggggtagggcaggtcctgtagacacaaagcccccgcagcatgtttgcgtattagctttgtgtagtggtcggccggaaatttatcacctgaacgaacaactgagaatgacagttgaagcgatgaacaagacggatctaaagtcaaacagtgtaatcagcacagtcatcgaacaggacgaggacgactcaagcctggcacctttggctattgacgaaatcgcagaaggaattgaggtaattgtaagtggattagatgtctagataaacgttatctaactggtgatagacaatagaggaggaggcatcttccccagagagtagcaaagcagaggaagatcagaaacaaaatccattgaaaagaggaaactctagattcaagcatttttatttcaaaagagtatgtactattccacagtctgttgtcaatcccttctaacacaatcgtttaggagcaccagaaggagaatcaaccggtagagaaagagaaagtacttcgggagccaagcagcagactcagcttacttcgcaatcataagaatgtatgtgtaaaagttactatggttcctacgttcctactaacaaccccagaagccaaaggaaacctcagacgatgcccaactaaagattttgattacaaaacgacgacattatcaggctaagcggtatcttcagctaaagaataatcatggggagaaagaacagcctgtaaaagaccaggtcaagaaagagataaccgcagaaactgaacctcaatcggaaaagccccataacccataaccaatttgaccggcaattctggaatgcacaaaagctgggacagctcactaaattgactgtctggttcactcctactactcacctaaataaatattctcgatacggttctattagtacatgctgtttcgttagttacatagtttaatcttgggtcttttgagtaccacgcaacaaaccggttcttctggcggcaatcaaaccaaccttttgaccagcaacagcatttctggagatggtggaggccttaccaatatgttgatggttaccaccaccgtgagggtggtcgacagggttcatggcaacacctctggttcttggccaagagtttctcttaactctgtacttgtggaaagctctaccagccttcaacaatggcttgtcgattcttcctccaccggcaacaacaccaatgacacctctggagttggaagaaatgatcttcttagcaccggaaggcagcttaactctggtcttgttctcctcaacgttgtgtccaatgacaataacgtagtttccggaagttctaccgatggtacccttgtcacctggcttggcctcaacattggagataatagtaccttctggaagggctcccaaaggcaggatgttaccaacattcaaagaagcatccttaccagcatagatgaattgaccagtgtacaaaccctcattggcaataaaagtctcctcacgcaaacccttcttggttgggtcacggaagataaccttggccaaaggagcacctctaccagggtcgtgaatgatctgcttaacatatccacggatctgtccttcacgttcggaagagtccaaagctctaagcttggcagctccctttctcagacgagtgtgagcggtgaagatggaaccagcaccctttctttgagcacgaataactctacccatgttgtgttaatgtttcttgctgtaagaggacttgaaattttttattggttttttttttggggagtatgagggttcttgtgttcgcgggttaaccctagtgctggtcacgtgccttattgggcaagctgtgtgaggtatcataaggtggtagttgaaaggtaccttatggaagacttcgttaggaaggtgtctgtatgattagagtggcgtagggtgaatgatttaattcttcttcggtctattttgaagtgccagggagagttacattatcgtattatcagacttccaacatctttacactaatttatatattgaattgattatactccagtatgtcatgacactctgaaatacttcttaattataacctccaaggggctcaaaaggtccactttcagaaataatccatctaattgacttctaatttggattttgacctatatactaaaaatttttacctataaatactaaaactcgtcagagtttggaacatgtctgttgttggaaaacatacgtcctacacgggtgccagtaaagctttgtaaaactgactgaaagtctctggattcgttcttcttaacacccttcaatgcaaataaagcaataaagaataaaacgttaaatagagctaacagaataaatggaccatgcatgaaccagtcaccaaaccaacctccaaacttattaacaattaagactccaacacatccaaataatgagtagacaccaactaatgatcccttgttcttgtagtattcttggttggaggaaatgttagataacatggtcattgaaatgattatgaacccaatttgtgagactcctaacattgttgcgaacagaaagatgagtgctgaagaatctggtgtcttaatgaaggttacaccaacagcacttaacagactcagagtgttcacaatcaaaagtaagtgagcatgattgttgaatttgtcaatgagaacaccaaaaataggtgcaaatataagggcagccatgtttgagattccagtgagaatagaagccaggatgtatgagtctggacagtgaaccttgtcagtgctttcagtagaacactttccagacttgtagaagtaatggttaatgtaaaatgggatgaatactgtaaccgtgattgtgagacatcttgccatgaagccaccaaggaaagcaagtagaatcatgggattttgtacagatagttgaaacccgtacttgatagactccagataagatttgtgagaggaatgagaggttcccaaaaacaactcggcttcttcgacatcgtcgtccaagtcactgtcagcatcatgaatgttcaagtcatcaaacagttcatcaatatcgtccttgaatattttctttttatcgtccttgtatagagagaaaaacagcaatacggcaaccaaaatggcaataataccgacaaccagataggatttcttcaatgcaacgccggcaggatttctagtaccaaaccatactggcattcttaagaatacagaaacagagaaaatggcacccaaaccggatgcaattcccaccaaggaaactctttttccttcacctcctttggatttgttgacctcgttcacttgctgcacatcattaagctcgccttcgtcaatgatatcgctattcgtaccagtgtatgcacgagtctctccggtagcctctagactctcggctgcttgcgataaagtgtcgtccaatgtgctctgagtttcagcatccaattgaatagattttccaaagaaattttggctgaaaaattcagaaaccttgaaatcagaattgttcagctcgatcagcataactgtgatgatactcatgatggaggcacttcccacggagaaaaccaatctccagaaaagcattccggggtaaacagtttcattgacgaaaactgcatagcccatgaaacttgcaccgacaatcaataaacctccgaactctataggtctggagccgattctatcgcacagggctccaataaaggggaccacaatgatagccagcagctcgtcaaaaaaccctaaacttcccacataggcacccacattctggccaattcccaagacatcggtgatgaaataagtctgggtggaagtcaaaaagactgcaaaggagatgttaacgaaacaggccgacagaaaggcaacgaagttcagtgaggtgtagttgtcaatcttccgggaagacctggcggcgttccgtgcggcaattggagactcttctgacatttttcctcaaagcaaagaaattgaaagaggagaaaaaaattcaaaattagaagggtaaatagaaaagttggccccagaaattggcctgttgcagatgcccgtgcgtttttcttgtccccgatttctccttatctggagcatctagtaatttttcctgtttggtaggattatgtaatcttttgcggtcggtacatatgtcccggttctgtgccctggacacacagctcatcttccgccgcctaacaataataaatacacgaaacaaacagagtaaacatacacgataagggtttgatctagtgtgctttctttgaaactccgtcttctaccccgtcctcctgaagacgctcttcactgcaaatgaaggtagaggagttgattattgacgggttcaagtcttacgccacaagaacggttatttctgggtgggactcgcagttcaatgcgatcactgggctgaatgggtccggtaaatcgaacattttggacgccatttgctttgttttgggtatatcaagtatgaccacggtgagagcgtccaatttgcaggatctgatctacaaaaggggtcaggccggtgtgacaaaagcaagcgtgactatagtgtttgacaactctgacactgacaaatctccaattgggttcgagaagctccccagtatcagtgtgaccaggcagatcgtgctgggaggcacttccaaataccttatcaatggtcacagagcacagcagcaaactgtattgcaactttttcaaagcgttcagctgaacatcaataaccccaatttcttgattatgcagggtaagattaccaaggtgttgaatatgaagccaacagagattctttcgctcattgaagaggcagctggaaccaaaatgtatgaagatcgtagagaaaaggcggagaaaaccatgtccaagaaggatgtcaagctacgagagattcgatctcttttggaggaggaaattaccccaaagcttgataaattggccaatgaaagaagagttttcctggaatttcagcaaattcaaacagatctggagaaattgacgcgggtagttgctgctcacgattataaagactcttcaaagaaatacgatcatcaacgcagactcctcgataagcaaaaaggtttattgggagagctggagtcaagtattgaacaattggagaaagaatcaaagtccatccacgaagaaataaatcgcatcaaagaaaagagaaaaaccgagctctccaacaatgcatctgtaaaagaattggaaaaacaggaaactatcatctccaatgagttggctcggttggtaacgtcacatcagataaagctagatactataaaatcaacgaactcgttgaaacaaaagcacaaatcgcaaatcaagcagatggaaacgacaattgaaaagttgaaagaaaaaactacattacttgaaaaagaataccaaaattccaaagactcgttaacgaaactgaagcaaaaccactcaaagagggaggatttgctttcttcattatctacaggaatatcgtcacaaggtatttcgactactggatacgcttcccagttacgagacgcaaagaagaaacactctgatgctttactgtctcaagagcagctaaacatgcagtccttacacctacaaaaggaaattgaaactgaaaaaaccgcagttcttgaagcagaaaaagaaaacaaagttttgacggatgaattagaacgtaaggggcaagagtactgtacaataactcaaaaattaaatgagctgggatttcatccctctaatataaccaatcttcaacagcagaagagcaaaattgaacagcaaatatataaagctacaaatgagttggaaaactctaaacgaagagtagctaacttagatttccattttgccaatccatccccacaatttgaccgaagatctgtcaagggcactgttgctcagttattcactgttgacgaaaagaatatgaaatctgtgtctgcacttgaagtatgtgcgggtggtaaactctataatgttgttgttgatactcaagaaactgccagtcaacttttgaagggggggcagctaaagaagcgagtaactttcattccgttaaacaagatttctgcatactgcattgatccacgaaaagttcagcaagccaaagaactctgtcctggaaaagttgaactagcattgaatctcattacgtatgacaaagatgtagaggcggcaatgaagtttacgtttggtgggcgtcttgtttgtgacgatgccgatactgcaaaaaaaattacatttcatccccaaataagggcaagaacagtgacgttgaatggtgatacttatgatcctgagggcacattaacaggtggttcaagaaacaacgtcggtgtgatgttgaccactgtacaaaaatgcaaaaacattgagagagaaattgctaacatgaagaaagagcttttagaaatgaatgagaaacagaaacaacaacaggggattgtgaagcagacggagtctttacaacagaaagcaaacaagttgaaacatgagatatcattaggtaaaaagaaccaagagtctcatcactccaccataacgatacggaaaaatgcacagaatattagtcagctggaagaaataaacgaaaagttgaacaaccaaaacactatagttttaaaattgacggaagaaattgctcaaattgaaaaggatatccaagaatttggctctgataaatcttcgaagttgaaacaattagcagatgaggtaaaatctctagcatcccagataccaaaagctgaagagaccatgaacttaaagtattcagactatcaacagtctttgcttgatttagagaaaatgaaaggtgaccttgatgatctgaattctggtgttcaggagaaagacgtttctcagttgaatgctgaatgcgatgaaataaaacagcaaatgacgaatcaagaacaagaacttgataaagtaagaggcaagttagaggatgaaaggcaaaagcttctgaatctcaatgatgagttagatgatctcaataacgaattgagcaccaagcacaagcttataaatgagaataaactggagacccagaagttatcccatgaaattgaaaaggtcaagtccgtctgcaaggcatataaacaaacggttgaaaacttgattaaagaaaatgagtgggtttcggactccaatatcgtggaaaagttaattgaagagaatcctagtattaatgttcatgaatgctacgaacgaatagatcagctaaagggtgtatttcagggtatgaaacggaaagtgaattcaaacattatgtctattattgaaaacgtggaaaagaaagagggatctttgaagcagatgattcgaactatcgaaaaagataaagccaaaatcgaagagacgatcaacaagttgaatgaatataaaaaaatcacactgattgaaacttggaagaaagtgtcagaggattttggaaacatcttcagagatctattgcccaattcttttgctaaactggtgccacccgagaacaaagatgttacagatggattagaagttaaggttatgctgggtaaggtgtggaaggagtcattagtggaactctctggaggtcaaaggtcgttgattgcattatcattaattttggcattgttgcaatttaaaccagctccaatgtacattctcgatgaagtggacgcagctttggatctaagtcacactcaaaatattggacatttaatcaaaacaaggtttaaaggctcgcagttcattgttgtatctttgaaagaaggaatgttcaccaatgccaacagagtgtttagaacaagatttcaagatggtacttcagtagttagcgccacctagagatcttctattctcaatattaatagaaccatagtcgtctaattcatcatttcgtagagacttgtaacattcatagtaggtcatgccgtcaaacgagtcctctttccattctctttcgaccgaaaaatttccccgtagcggccaccaataatagagtatgaaccaacaaaagctgagaagaagtaacgctccaacaccaataaaggcaaaactagcatctttgaatgaattctttgagctggaaatgaatggtgatagcacaactgaaagacttcccaaaagacaaatgaaaacaacgaaggttggtgctcttgttggggctataacgttgggaaattttcgtctaattcgaaatagtaatccgaggcatacgatagcatgaaatacctgattggggtagaactggagagagatgatataactgtaaactctattccttggaatgattatgaccaacgatgagaggattccatgagttatcaatgcagccaatggggtatgaaagggcctgtttgatcttagtatggaggaaaatgggaccaatccctctcgtgcaacttcaacgacgagtcttgaatctacgaaaacgaccaccagtaagttccctaaagaagcaagcgctatgaatagagagaataatacatgtccgtagtatgggccaaacaatttggtgaaaaaaagggctccaactaattgcccaccaaattgaatatccttatgaggtacgactttcagataggcaaggttcatggttatataaagagcaatgattgagaccaaggaaatcatcgccgccaatcggagagtttgaatgggtttctttatttcgttttggacggcgaaagcactggtccaacctccaaaactgtgtatagcttttaaagttgctgtcgcataagagacactggaaaacgttgaaggaagagaagtaaagtcttttaaatgaagatggttctcaatgcctgtcaaagattctggaaagagaaaaacgtaaatacaggtcaaaaaaagcatcgatatttgtatgatctttatcaacccaatgaaattctgaactgctaatccgacgttacgggagtatccatgagcacaaaccacagcagtgatggctgtaatggccaggtatttaatagcagattcctgataggagtaaccaagagcatatctaatgtattcggcaaacactaaagcattggtagaactgaaattgaataatattgtaaaagcaccaaagatgaaacttgtgtagtaaaggggataaggatacatgaattccaaaaagattttggtagcaccattaacgggcaggtaagatcccaattccagatacacacaggtaccagacaaggcgataacaccgcctataacccaagtaaccatgaataatagcacagatccctggcagtccgccagtatccctcctggggttgcaaagatacctgatcccaccattctggataagaacaatacaattacagactggagtctcaatgttcttatcccggggatcgaatcatcttgcttgatcaaagaacttctgtatggtggtaaatcagggtcatgtatcgtgctgaaaatatgctttccagatgaatcactatgagccatgattcattagaggtgggtaagaggggagtaggtctccgatgtgttgtgggtcttgcagattagatctgatggaatagggtgttgcattgtaacaaaacaaaaggatacagtgcaggaatggatgacttggcgggattcttgactctgttattgacataaagggattaaagtctaaatgggaacattgggtagtatcttagccaggcaagaattgtgtctgattttgaccctgcaaaaatgatattcgcgcaattcggtaactttagtttgacttctcgatgtgacttctctctgactcgttaactctaatcttcggagtcaccccccaaagcttaaaaacttacacctgttgcacaatgcctgtcatttagactttattttccctatctaatctatctgttactacatgcccaccatagaatcaccaaaataacgactattccttactccctttacaaacaggatcattctgaaagatgagtaatacagcgagagccaatgggatttcctggaagtgaatgggcgcatatttttcagccgaaaactgggttctgattgggcaatagataagtatttggtagacacacgacaagctccactgaggggaccgtagttttccagtcgtgtatggatcaaaataagataaagagatgccagaagttcagcataaatcaagtgaaaatttcatgaatcgatagcaattgagaggataaaaccggctaatcctatctcttgtctgaaaaagatgcctccatttgccagttgaagtttgaaacatgttttgaaatcacttaatcgtaaatagctacacttgttcctaggtcccagtatgactgaacttttccaattatgagtaaagccgcgagccttatccaaaaaagaaaagttgagcatatataaggcactgtccacgaacactatttgtctggaaacctatctcttcctcttcctttccagctaagaaatactgaagaagcttcatcaccaattatgacaaaggaagattttccctgtgcaaatgaatttagaagtgacaccttcacagtgcctactgcctcaatgatccaatctgtggcactggcttctgtcggtgactcggtgtatgctgaagatttggacaccttgaacttggaggagaaggtcgctcaaatggccgacaaggaggcaggtttgttttgtgtctctggtacattgtctaatcaaatcggattgcgcagtcatctgatgcaacctcctcatcgtatcctctgtgattcccgtgctcacgtttatatgcatgaagctggtggattagccactctatctcaagcaatggtcactccggtcacaccacgcaatggactatatctgacattggaggatgtggttgataactatattcctgacgatggcgatatccatatggcccctaccaaggtggtctccttagagaacacgatccatggaataatcaccccactagaggagatcgctcgcatctctgaatggtgtcgtgaaaacgatgttcgtctgcattgtgacggtgccagattatggaacgcctctgttgagacgaatactccattgagcgagtacggaaagctgttcgactctatctcattgtgtctgtccaagtcattgggaagccctatgggatctgttttggttggtgacagaaagttcattgacaaggccaaccacttcaagaagcagaatggtggtggtatacggcagagtggattcatcgccagaatggcctctatcgctattgatgagaacctgggaaagctgcggcaatctcacgagtacgccaaagatgtggcccgcttcttgcaggacaatggcgtgccactggaatgcccaactcataccaattttgtttttgttgaccaaaagaaagcccgcattgacccagatcatctagtagccatgggtgagaaatacaacgtaaacatcatgggaaccagattcgctttccatttccagaattccaaagaagctgttgagcgtttaaagcaagctataatggagacctttaagtactcccaggaacatccatacgtttctacaggagccaagcgtttatacaccagcaagagtcgatctaattctccagttttgaaaaactaacatccgacatcctatgctcacattccactatatatttaattaatttcatggatagtgcgacaatcaccgagtagcccctaagcttccctgttctaagaaccctgtagatgtccgtcgggaaatcttgcaaggtcatccactgcgattgcatttattaacctgaatatccctcccctcttgaacagtcatcctgagaattgcatcgactcaccccccgttttcgcaccccttctccactctgatagactaaacatttcacctccaaccgctagccaaatttactatatatacttccaggagatcccctgcaattcttcacccagttaatatttatagagcagattaagagaactaatgacacaatccgaatctgcacagtccgaatccacccaggctgttaaagcgcaagagttgccactcactttgtcaaatgagttcttacctgagcattatgatttgaacttggatatcctaccgaaaaaacctaatttcactggaacaaacggtattcggatggttaagaacaggagatacgtgccgccggccgcaattgaggaaggcgaacaaaaattggaagtcgttttgcactctttagaattgttcgtcacagatgcgtttttcatagttaaggatggtgattcattcctcaaggaaaaggtcgccgttaaacacaataaggcggttcacacggtgactttcactttgaccggtgacaaagttgagctttatagaaacgctcccttctttcaatgtagtgttttctatatgggagtgatcaccaactgccgatccacggaagacaaaactagaggtgtctttagatccaattacgcctggtccgatgaggagggaaaacagttcccaggtcagatatttgctacgcactgtcagccaacctttgcacgccaaatattcccatgtatcgacgatgtcactcacaaggtcactatccaattgtccattcaaacagacgctgatcttacttgcatttccaacactgctgtagaggcaggagagttactaccagatgagaaaaacgaagatgatggagtcacaagaaaaatggtattgtttgaaaagtctcccccaacactggtatctctctttgcgtttgtcgttggagatttggagttcaccgagaaagtagtgaaggttgctggtcaagaacttccacttcgagtttacgtccagaagggagatgccaaactcactgaatatgccttggacgtcgcgtctaaatcgttccctttgatggccacaaaatttggcttgtctccatgtccgtttaagaaactagattttgccgctttaccatatctcaccgatggtggtatggaaaattcaggcttaattaccattgctgcacctcatttgttggtggaacctgacactacaactgaccctgagtacgcatcccacctgactaaagttcgacaagtgattgtacatgaaatggtccatcaatggatgggcaatttcgtatccttcgacgattggagccacatgtggttcaatgaggcatttgctacctggcttgctcttgtggttcttgaagaaattaacgaataccccgatgataaagacatttggctcagccaagccaatctggaaatgtatcaaatgatgagaagggatgctaccaagttcgtcgttccaatctacagggaagagcgaaagaaggttcaatcaatccaagacgcattcaacgaacatgcttaccagaagggggtatttgttcttagaatgctaacaaacttgttcaattcttctaatgacgattcaaataatgatttttttgctatcgtctcccagttcttggcagattataagtacttgtccatcaagccatcagattttttcaagtacgttactgattcagagttgaacaagaagaaaattgatgctgctgccatcatgtattcctgggtacgtactcctgggttcccaattgtgtcagctacagttaattcgcaaggaaaagttcatctggaacagcatagattcctcttcagaacaaggatcgaagaaacagaccttgaagatgtcccatatcatgtccctgtctccatcagactcaaagatggaacaatcgcacgacagatgctcaccgatagatcaatagatttagacttgaaggttgaagacgttgtcgttttaaatgccaattatacaaacccaatgatctaccaatactctttggaatattacgataacattgccactgcaatcaaggagaataagttatcggctatcgaactgacttctctctatacagatctttcctccattctcatggaaaagtatcaaggtgacgatgatataattggtttgttgaagactgtagaagcattcggagaggattctgcaaagcttcaattccttccactcaatactgctttgaacttattggaggctgttcagaatgcccttgagacttatactgtcaagaacagcaaagaagcaagacgacgcatagaatcatttgtttcaagaattagtgctaaactgtttgacaagctagaatgggaatctgttgactattcgaccctaccacctactgagttgtacactagaaacactattctttcaatggcaggtaaatcggaacatgaaccagcagtaaagactgtgaaacaattttataaaaagctaacacatggtccaaaaaaatcagttcctaaacaatttttggcagctgtgttaattgttactgcacggagatgtgaccagaaggagtacaaggagatcgcctcattagcaaagaatgctgaaattaatgttcagaacctagtcagcggcagtcaagtcgatattcagactagtgccatgtctgcacttggtcatgtcaagaatgtccaacttataaaaaaaaccctcaaccacgttgcttcgaacatcacaagtaagcttatcgaaatttgtcttctgggattcaagagtaatgtcgatgcccgtggtgaactgtttcagtggttttccctgaactatgaaaactggttagttaaggccggtactgataccacggaagcaggtaagcaaatgagaataacattacacaatttaacaaagattgtatttgaagtaatgatgttcgacgaaagtgggcttgaacagattgactcgtttactaagcgcatcgaagcaagattccccaagtttgaaccactgaaacaagcattcaagcaagccgaatcaattgtagaagataaaaaggttctgaaccaatcaaatgaagaagttattgcctatctaaactagtgagctcagattgttaatacatgcacgatgttatgataaatgctattgcttatattcttataagttactatgttttagttttatgcctaggtcggtcaataccttgtctccgtagataggtctcacccttgcaatcaagttgtggagtaagatttggtctattttcccttcatcactgttgctgagctggtttaataggccgaggcatatcctgcccgcagcaattcttcgcagataaatggtaagtagaattcgcagtttggagtactgatcaacagcttcccgacctgataataccacaaactctttgaggttttcgcctggaaattgatacatcctatcaggcaaaatgacgtcctggaaaaatgttgaaaaatgaaaggtcacctctgggttttgatcaatgtatgataatagctgtagagtggaggttgcatgcaatcgaaaaagtctagcttgaaacacttcaaacgaatcttcattttggatccagaaatgagaatggggaacttgtttcaagagccttcgtcggggcgtaaaagcaggttctggagagggtggaggggtgattaaagctggatcgataaagttggaggcttttggaacacctgggctgtacatcatcatttcttcacttccactggtttggggggagggataattaagtattttctggtacttttccaagtttgcctcatgagagtcaacagaaagaacagcaacttggtttttatcaaagctgagttgtttaaccttttttttcagtttcggattaggttgaacaattgatttataggcttccgtttcgtactgtagaatgcaagcaggtgcagtactgggtccatgtggcgagaaaattgctagctgcctatccttcaggttgagtcgttcaatgactcgatacaattgttccttggtggaaaaattgggatgcgttgttggtttctttgagtgtttgcgccatgatggctcgtagttgtgtaatggtttcctcctagaaactttataagaataaccggatgccttggagcctgtggagaaattcctattcaattctgaggctgctttctttgatttccgccgcctcagattagtatcagagttgtgtctttggaaatcattattatcgaacgacatggaagtttgatctttactagaaagacttcgatgctctattacgtgactttgtgtaccatggagaaatgttgattgatattggatgacatttgctagggatagcgggtctactagctgttccttcccgacctcatgtgagctattcaacgaggggattgagacagggtacatgtcatatcagggaggaaatcaaatggttcacttcaaaaagaaaagaaaataaaaatggaaagagtagaagcagggaataaactcaagagggacttttgacctccttccatggtggatcaatttgttttttgcgtttcttttgttgatcccattatctctgaaaaagatggctggtttttctgttaccctggggaaggtgcatttctattgataccctggaacatgccatccaacatccaacttagcctcaacacaggtatacctccatacatcacaaaaacctcttagatcaacggttctcgatggttaacctgaaacccttcccagtaaacacaccccaacagtaaaagatggataaacttaaggaagtaagtcaccctcaatgacagacaaaatgaccttttaatgatgctaacatagtaagaaaatcaacaagctcaaattggacgctgagacctggcaagaaaagcacgatgatgtcaacagtaagatcaaagtgcttgaacaagaggccctagagaaagaccaccagatccaagcgctcacccgcaagaacgacgttttggaagagcaggtggagaagttggaggagcaattgagcaccagcaaggaaactgtcaacgaatctcactccctcaagaccaacaatgaaaacatcacgaagaagaaccaattgctcgaggaggaattggaagctgccgataagaacttgaaggagaccactgagaagctaagagacaccgatatcaaggccgaagctttggagaagaaggtcacctctctggagaacgagagagaagaatgggagagaaagtttgaggagttgcaagagaagtacaacgccaccagagaggaattggatgccatctccgagcaattggagaatttgtgaatggatgacgatgataccaataaccctgatccaccatccagatcagtattttccacgactcttcttatagtggtgttagttgtctcattggctactgctcgtatgtacgtttaatatactcgtgtcctatttgaagaattgtttacgtaatggggcaacaacagaaatctcgaaacacctgtcatgcaaaaaaatataatatgcccgctccagacaaggttcaaaagaatctaaaccgcaagcaatatcgattacggcaacctcatatgaacatcgatgagtttcactcctacagaggaacccataccgtcatatgaaaggtctcagctgttacaccgaaccgcgtctagccggagaatggctcggaatagcagtcattccctgtcaaatttgaacatatccaagattgtatcagaggacatcaagaaacagcaagagtccctcaggattatgggactggcgattctgagttctagacaacatttggcactttccttttgcaaagacattcctttgattatcattgccattgatttatatggctgtttgaaaaactgttggactccacggacccaccagcacagcatcacgtctgccaagtcctcagagtatgttctcggaggcatctggtgtcttgtatcgggctatttgacatattcgatactggatgggctgatggtacgctggattgtgacttattccagctggggcgcaatagtccggatgttgtccatgtcattattgattgttattgtcattcagttactatcgattgtgtgcaaccctgatggactatattatttgcctgcttgggtactgatatcgtgcctgctcacagtaatatacattatacaaagttatgtgacctccaacttaaggatcaaaagtcatctggaggagccatatgcggagggagtaatttccctgcccattattcctagaccagatgataaggtcaaaagaacagtggacatctacaacattgccgtgtttgcggttgtccccattgggatagccagttttgtcacgatggtgggtctaataagaatactgctaatcatgcgctttgatgttggttctgtgactaacacggtttctaatattgctattccccaataggcaccgacaccctccttttcttctggccactaataacgcatttgcccagacattttacttcacccatactgtataattagtcttattctcatattgctcgaaaaaaaatttcagatatctaactttctcttctgtaacataatgaataaattctcctctgatagcagcagaaccactgctcaatcgacaataaataagctgttagtgaacctcatacccggatctcagctcaatgatgcaaaagtggccaaaaaggcaaagaaaagctccagtgctaaaattatcagtgatcagataggttccagaatggaatttaaaagaaatgaagagaaaaggaggaagtttctgaagcaaaataaccttaagaagagaaagatgaaaaggaagagcaaggatttagaagcccagctagaaagaatcgccaggctctcaaatatcaaagagcttcagcaaatgtctgaagattccaacgatcctctgctggatcaagtcattgataaaaagatcaccgcattgctatcttggaccacagacaactctgagttgggaactgagatagaaaaattaaagaaagacattttgaacaccgataatgaggaggttagaagaaggaagagctaccgtgatgaggaaagagaagaggcagaatttagatcagaggttgagaagggctccatcgcctatccaggtttgactcctggtttggctccagtcggattgagcgatgatgaggatgatgaggaggaggatgagtctgatggatttgataaagaggaagaggaagatcaattttcagaataagtcactacaaacagcgtaaatttttaatattgtataataatagtttctattcttagctctgttccaattcataatagatctgccttacatctgcggctaatttcctaacttttctctttttgtgactcaagactgcaactgtttggttgatgatagtggttcggaaaggttgtaattgactgagaggaatcttactaataccaatctccttcaagcatagtaacgcattgatttggccgttcaggtcactgttgtccttggtgatagccaacaatcttgaaataattgaatgtagatgaggctttataagcatacagttggattcaatagttagatttaatatctccaggcctgaatttctggatttagcattgtcactttgaataatttgaagaatcagtggtaagatattctccaggtgagatagaatgatttctctttgatgaacatggttcaagatcaacgataataaaagtagatatgtttcttttgatgcctgctcacaattcctataaccttcaatgattttcggaagcatgatgttgtagaacttttgtttgtacagtaaacgaacattgagatttatgatttttttgtcacgtttattcacttccaattcactgacttctgcgattagaacctccaacaacttcggcgaaaccgatgcaactgatgggatttcaaggagtgaaaagaagtattcttgatacttcattgccaatggactgtttgatagaactaaggactttgtaatccatgccataacttccaatgttcccaaactatcagaagattgaaggtctatcgtttccgataactcattcaaaattttctccaaatccgaatcggaaatgtatttgttagccaaaaggcagataagctcaaggaaacccattctctcgaaaagcgattcgaagtgtttcgaatctcttgtgatctcaactaatgaacttaacacatccaaaggctcaatcttgagaggacagtccttagatactgcacttaaaaatttgttgaataaactcaccaatgtagggggcttagaaactagggaaatttctaatcctaaacttgttgaaaacaggggagaatccgatcctagcaaaaatgtatcaactgcatcatcaaggattttctgatgatgtatcagttcaagtttacaaataattagtctgattatcttcccacattgatctaatatcctttcatttaaataaacaggagactctttggagagccggtagttgactatagtcaaagaagttatctgaggaatgactcggtctgcgtagtcttttgacagcagctctggataattggaaagtaataagtaaatggagttcaacaaaaaataatagtaatccatggtaacaaccctcccattcaacagtctttcatatacgctcaatagtctcacgattatcgagtccaataatagtttgctatgggaaatgttcactacaacgttcaagacgtttcgaactagttccaaatcaatctcagaagatgattcgtttggaagtttagataataataatggaagagttgtctctaaaacaacattcggcattgtagcagagatatttgtaaatgcattcagagtctcttggaaaattggatccttctcatttttcatagttgaaagaagtagctccgacaaattagaaataactgacgcaacttcctgtgtatccaaaatgaatgacaaattaactagtgaacggatgcagatgcatttcagtgttgtttccacgttagatgaagacattaaaccttttgataatactaccaagatgtcatccttgtactgggaaagctttgactctgggtaatctggattaataaaaaagtttaaggctgtggccaaattcttttcgtctacaacggtagacggctcatccgttagcaaaacaggtagcacttcgccaacaatgtggttatacacggaaagtttagacgtagccatgactgagaggagtaaaactgtttgtttgaagtatttgtgagaaatgtggagatattccttaagctcttccagcatgatctgaaggtttttgatgatttgctcatctgtgaattttttagggagatttttgaatagggcaatgacttctttgaacaccaagtcatcttcagtgctcaatttctctatatcggccaactcaacaatatttgctaaatcattgtacaaaacctcaaacttgagggcattgtacaaagtaagccagtactcttgaatggtgtcattgtcgtacgtatccagacacagattcaaagtttgaagaacatccaacttcactgctggagacgttgaggttaatttctccaagatattgggaaacaaatcctttgcaaacaacggtgtggctgcaaagacctgtctgaggcctgttttcaagtcatgactggcgatgctatagggactatttggagggggtttaaatgagactgggaagtaacaaaatgcattatcaaacaaatcctcggcgaaattttccacctgtaatgttgaggatatctgcttgttcaaactgaaagagattagtaggtttctaggatccttttcattggtagaaatgtgaatgaacaccttaacaaaaagatcgttgaggttggccaggatgaaatccaaatgcttctgatatattgtttccaaaagtagaaaggactggtatcttgtagcagccaaaaagcttgccggttcatatttctcttgcactgaagttagcacggattctaacagagcaggattgaaattcttcaaagatgtcaaagccctaagaccaaccaatgtgttactcatcacatcattgtcgtccaatttcccaatataaaacttagcaataacctctatatcagcccggttcagtcgctcaatcttggccaaggtattgctcaaacatccaacagccgtacttcttatatggggtgtttcgtcagtgagatgtgatccaagggtttttattaattgcaaaagacttattcgcttttctatgacggcctttgcaatttcttcgcaaggtggatcattttctgaggccataaactggcttacccattggcttagctgaaggtccatttatctcgagtagttgtagttacgctatcagcaggttacctctgatctttagtcccccaaaaagtaagttgaatggcgtcgcgaactattgtcagtcaggtgaccttcaataggcataatggatttcatcgtttggagagaggatcgtattcaactatcattgtttggaggaaggaactgttacagagtacctatttaggcctacctaaaccatgaatgatccaggaatgaatagttattcctttccgcctcaaaataatgatgacaatagtgaagttctacctgattctccaggtgaaaccaacaatgtttaccagaatcaatcaatagatttatctttggaagaccaaagggaacagagtgggttctctgataatcacggtgatgtgttacctattttgagtaatatcaatgattcttatgagaatttctcttcaaacgttttaaataaagaaatcaggcaatctgctcaacttccaaccttgcctccagacattcttgcctctaaagaatcagtgaacatttcgaaattacctcaattgtccccaaacggcgtcgaaactggcagtcatgggttaggattgaatcaggttactctcgatgatccatcaactaaacatactgcaaacatcagtctggaacatcaacaacagactaaggataactatatttatgaatcacagaatactttggaccttagaaggaacctggcaacggaatttaaaactccagctgattatgctttgcatatactattcacacagtttgtcagatatgcggaaagaaaacttcatttatgtctagaccaatttgctttagacgatgaattgggagtggtcaattttctttctgaagctgatcccacttttgacaaaataattgactcccttggtaacatagcaaagaaaaaccctaaaccgattattgattcagtgatgttctggagaaagagcaaggccgaagtagcgctaattgcctctcaagaggtggatagaaatattgaattgttcaagaaagagcgttcccatttgaacaaattaaaggaggaaaatcaagacacgactgttgcttccgtcaggctttctgatttggagattttggtaaatgattccaaagagacggctcttcaggctgatagaaaatctttggtaagcacatttcttgtctgtcgagtcctaatagatgttgtcaagaagactccaacaaaatcatttactggagatttagaagagaagcttgaagatacctgctattcacaacttaagtcagctgatcctttacttttgagaacgagtataattcgtacatccaattggaacctttttgctgagctaataagttgtctttcggcaaagcgctttatcagcgtcagcgacagatttattgcagatttggaaaaatatccaacaggctatgtagcatcgtctgagaaaaatttatcagaagttcaacttagtttcattattcacgggtcgagataccttaagctgaagacaattccattggagtcgtttgaggatagtgcagactttatgaaaagttttggaaaattcttttcaatgtgtcaaaatccgaatttactcattgtctactgtcaagttctgagccatcttctttactcggtaagtgatgttatcaccgctgaagtgaatcaccccacttgggttgaagccatcaatttgatttttcaaaaggctcagacgctaaacagtgctgcttcttctattccttggattcatgtcatacaactaaccacagctgctttatgttcttcaacagaagcaatcttcaaggatcattgggtttctttaattgacgatctcgccgcaaatctcaactcaaagacccctattcgaaacaaagtcgtcattatgagatgtatttgcagactatgttgggtatatctttacagaaacacagaatcgtttaacttaacggttaagaaaattcgatacgtccatctgttacttcaaccaaatggccagacaacagcgaactcatccaagaagaatgttcattggctagtttccgacgatgagcttgttgcctctgtgatttacttttttagattgtcatctttcaagcttttggattctgaaatggaaaataatctgcttcctgtgatgcactctaatttttttggtaactcaatcggttcaccgatgctattgaccactaccattaggtgttacgtacatgtgcttaaggattctggttctacggagagacccccttttccaactgacgaggttataaacacttttgaatctgagttggatcaaacgcctgcaggacggattccgttcaaagaaaacacatctgcatacattaaccatgaagagttctcccatatcataggtgaattgatcttacaccttgatcaggtgtatggagcaagttctcaaaaagccgcctcgtcagataagctgtcgcataagtctagcgcttcattttcctctttgtcatctgcttcgtcgttcaagaacgcatttacgttcatgaagtcaaataccgattcccagaagaaggacaaagaacaatactcattactgtttgcatcggttattgaagtaattccgtggtgctttttcaacaaggtaataagcttcagaaagctcgtcgaattattggtacgaaatgcttctcatcctgatgtcctgattgcaagtgaggcaatatccggtcttaaagtgttcatggtaagcggaaagcaaagtattttattgaacacctttacaaattatgctttcaagcttgaagataaaaacaatcacaactctctgaaccaccagtaccttaactcgaatgagtaccttcattatcttaacatttaccatgaacttctagaaagctggctcgactctctcaagaagagaaatgaaaagaaatcagcaagggtggaacccctgcagtcaggggatgccttacatttaccaaccgagattatgccgttagatatggctgacacaagtgtaagcaaagaacaagaggttattgaacaactggaattgaagagcattgcagctattattgatgagttcgaagggaacgcaatgttttttctttgtagccatagtattgatgtgagaacgttgggagtcaaactgcttaaattggttgttgaatttgacaattttttcaacgaagcaccacaagcgggatcaaatgataatgaaggaaatggccatatcagagcaacttctaaatttgctgcagaatttggaacaagagttattcaggttttagaaacgattgactttttcgaattgatgacaggcaacctgaaacgtaatgaactgagttacccagaaaagtccagactcagcaaactccaattaaaatcaagaaaggatactttaattaaacttgcagaaagtaattatggtgttgattcggccctctggtttagggtcttcccatctattctttcaatttttgttgagcgctgccctatccccattgcaatttgtaggacttacagctgcgttcggatggtccaactatatgatcaactgttagacactatcaataatgataaggatatgggccagagttactccattatcaaggagtacaaaatttatcttatgattgcatgtgcttctttaacttcaacgagtgaacagagaatgcatatacctcgccttttgggaagcaatacaagtgagaaccatttggcaatgacgaaatcacattctagaaagaagtctcaacaaatgtttactctgcaacatagaacgattactagcgtaaaatccatcttcaaaatggttattcctctcctaggtacaaattcagtggcactgaaggacactgtagtgtccggtttgagttgtcttaatgtcaatattttcacgtcttttttagaaagcattaaaccatattttcagactttcgccgacgatactgtaacaagttcaattaccacagggccagaaaatctgattcgaattgagctaagtcagattttatacaaattaactggttcttacctgaaacctgagttcatcaactatgtttatgccgatcaaactattttatcacaactgttaacatatatcaaagaactaaaatcttttctttctgaaaatactattcaacaaagtttagaatttcaaccactaagaagttatttcacaggaatattggagaatgtctatcagggaattctacaaagcgatgaggacatagataaatggctaccttttgaagctcgagtggggtgtttttcctttttggaagagtggagtagctatggccgatgtgttcccatttctacacgtagatacgaagtaatgcaaaagaaagctgccgcgtctaaagatgccgtgtccgaatgtgccaatctagaaatggaaaaaacgaagctacaaagattggtgaattcatgtatggtatctctgtgcacgagccccattacagaatctgtaaacgaagatggtttatctgttgtcatgtcttttgatataaacagcttgatgacatggatcgaatcattgtgcaggtcaaaagataaacaagcacatgcgcaggggaaagaagcattactcaacgtcttagtaatgaatgacaatcttcagtcaataatcgatatgataatccgaaattgctattgctaccatgagagctctgcatcgtcagaaatatatttcaccgttctcgttcaggcattcattcagaaacctaactttcccattaaactatttgaatgcatttccttgggactttttggttcaggttctgagaactttaatatcaggtcgcatgccactaaatttttagtcgaaagtgagaagaggttcttccattcttccgttagtgaaaggtttacagagagtatcagaagtaggaccagagttatctacaagagggcaatgtttaacttggccacatactttgcttctagataccaagaagaacatatgaaggtaatcagtgagctaacaatgatatttcatttagttgggcctgagcaaaggagggatgtcttggtatccttgattccatgggttcaaattgttaaacttgaattggatccggagaacccaaattatgcgtactctaatatggtgatccagaacttctttgaaataactataaaatttagcgacaagatacaaaatgaagttgaggccctgtggattgcattggcaaatggtagtcatcctcaaaatgctcatgaaattgcaaaattcataatggacaatagtattgaaagaaaaaatcccatatttgttggtatatcaagacaggttttcgtttacttatcggcctcttctgccggaccagatcttgtgaaccaactaatcacaaacttggagcctaaatgtatggttcctcagcaaccaaagacattgtccaatccaccaattgcacttgatctgccatatgttgcaaatatctggaaagggcttcagttcaactacaaagtggatgcggttttctccctaggtcaattatcgatgatatttctagttgacctactggcaatctcgccaagtatactgagaaccaaattggctctgcttcttcatgcttctttcgttctgttggaccattatcttcgggttgttcaggatcaagcatgtgttttgttgatccacttacttcatgagctagcaattgataatgataaggcaaaagaaattttcacatttcttagacagcctgattattctaaaaagttatgggtgtacgataatcttcgaaccaatagaaatggtaccagaactcccagaaatatggataaattgattagagaggttttgcagatattcacaccaatttttcctggactccaagaagaatggagtagaacagcattgaagtgggctactagttgtgccgtacgtcacatagcatgccgatccttccaaatattcagatcgctactttatttcttggaccagaggatgttaaaggagatgcttcataggttatcaaatactatttctgatggaactccagatattcaagggttttcgatgcagatattgatgactttgaacgctgtgacagctgagttgagctctgaaacattgattgacttcccccaattgttttggtccagtgttgcgtgtttgagtacaatccacgaacaagaatttatagaggttctttcatcactttctaaatttatttcgaagatcgatttggactctgaagatactgtcaattgtttgatctccacgtttcctcccaaatgggaaggaaaattcgaaggattgcagccaataattatggtgggcttgaggtcaagtaatgcatatgaaccgtcattaagattactgaaccgcttgaatttgttgaaagacagcaagattttaggcacaggtgatcttcggttgctttacgccttactagctaacctgcccagtttcttgcatgctagcactgaaaataatttccctgaagatgtgataaatgctggtaaagttatctctcaaatggctgatgccaacgacaaacccgcactttcagctatcattgattcattattaaaggataagttcagaaggaaaaacgacttcctgagtcaattttgttcggtcctaagacaatatttcttaccattgtacgaagctcagattctcgtatttttgttgggattgctaccaaataagataggctggatcaagatagaagtaatggatcttttgaagtttattttcccaattgtcaacttggaaagcagtcagtttaccggagttggagcagaccttatagctcctttattgaggctattgttgacagattatgcagaccaagcgctgagtgttttggaaactaatgttctgatctcaggatcccaactggaccaagatgttctacgcatgagtttgggcaatgagcatatcaagaaagagtatgaaaagactgctactctatttggagtacctgaaccaagcggttgggccattccaatgcctgcaataacagccgctacaactcgaaataatatacacgcagttttttctacgtgtgttgtcgcttccaacactgaagctgaattggctcacaacaatgaagagatacagtttcactcggaagagtatcctccttatcaaccaattgctcaaccaacagaggatgcatactcggtggttaataacaatactggagaatggggactgaacaatatgcttgaaacattaaataacttggattcattctttaccaatgacgaaccaagaactttcttcgatggaggtgaccacaagtacaataattcgatagacaccaaggctagtggaatggaaacaatcactcaaatggaatcagcacctcaagtttatgataagaaagcatcgatgatcttgaacagaagtcttgcaaggtcaccttcgaatgcatcttttaagagtccacttatggatgcctttaaccaacaatcagggcatactttcaggaagcacgatgaactgaacgccgagggcacaaataacgaggagaacaaatcttcagtatacccagctagcgagattcccctgaacatggaaaaatcctcatatctgttatttaggggtagtagaggttctgtaaggaaaccgtttgctggggatagtcgatttgcaggccacacagccagtgaagccacgaggcgtcagcaggaaaaaataccagagagaagggagcagtttgataagactccacctttgggacccaccagctcaggatctcaaataagttctgagttgcttcaaaacgaaccaacatctggcagggtaaaccttgaggaaacacattttcgattcgaaggattgctgagaacgaaacggaaacaaaacaggtttagtgtaaactcaggaaatgtcacgtcaagcaatgataatctgcatacgcctgttctcactcgtaattcattccctgccaggtcaccttcgtctggtagtagtggaggattgagtcctgtattcaaccctgctacagctccttcaaatggtccaagcggacccagaggaagagatgtgcgctcctctgtttttggccgcaaccacaggaaatcatctccaaagtcataattacatataaaactacatcagcaatatcaagtaacgttttacgggtcattagtaggcaggcgaatctgacttccgcacatagaggagttaatggaatctttaatctcgcgaacaccctcaggacagcttcttatccaccaagcataagccctccctcactttccactacaacaaaaatgcctgagaaactggaagaatgggagataaaaaagtactgggagatatttagtggtctgaagcctgttgacaacaagctttccggcgacagagtctccgtggtgttcaagaactctcaactgaatacggaccaactggccctgatttgggacttgtcagatatcgaccaagatggtgaactagacttcgaagagttctgtattgcaatgcgtcttatatttgaccttgtaaatggcacgattgcagagcttccatcaaccttgcctaattggctggttccaggtagtaaggctcatctggttcaagccaactcggccgtatcgcaaggatcgaattattctgccaacacgcaggtggacgatgatgatgaagatgcaaagttgagctccgattttgaatggtacatctcacccgctgacaaatcgtcgtatgagagtatctataccgcgtccagtgatcagtatggaaggatcaagttcaacgacctccaagaattgtatgagactttggtcaaagtacctcaaaccgatatcagttctgcctggaatttagtgaatccaaaacaagcggaaacaattgataaggatcagtgtttggtctttctgcatatcctgaaccaaagatcaaatggcaaaagggttcctaggggtgttccagcgtccttaagggctacgttctcaaaagaaactccaacatacgatctaaaatcttcccaagcccaagtcaccaagccctcttcggcccctggtcatgaatctaggaaacattcttttgctgatagttatctctctaagattggagcaagtcaaaactcaagtgcagaggtaggaacagatttcagtgccactaaggatacggattgggaagaggttagacttaccagacaattacaagatcttgaagaactgatttcaaaagtggaaaaagatagatctcagagattggatcccgatcctgctgtcaacgcatcatctatgaccaagtatgaactagagcaactgttaaagtacaaagaggacaaattaacttcattgaaatcgtccaatggagcgtctagtggaagtctttcctccatcaaagctgatgtagatttgattgaaagtcaagttcaaacccttcaggagtatctacaatctaagaaggaagagctgaagcagttacagtcaacactgaaaacatagggaaacagcgattacaggaataatccccaaggaataaataataaataaaaatatatgtctctctatttcttcttgtcagcttctggttctggatcaggtgctggagtaggcagcttgaaagattctggtgtaaagtcttttccatctccaacttgttcccaaacagaagaaccaactgtgaagtttctccatgcttgagtcaactctaatggctcatataccacacgtcttttctctgcgtcgtatctaacttcggtgtaaccggttgtagggaaatcctttctcaaaggatggccttgaaatccataatcggtcataattcgtctcaaatcagggtgtccctcaaaaaagataccaaacaggtcataggtttctctttcaaaccagttggcaccttggaatagaggaacaacagaaggtacaggagagacttctgaggcataggtcttgattctaatacgagagttgtgacgaacagaaagaaggttgtaaacaacatcaaaacgatttgttcgggttggataatctgcagctgtgacatccatacatgccttgaattgcgctgaagtgtggtccttcaagaaagtagccacttgagtcaatgcgcttggtgcgacataaattaccagttcgtctttccaaacactgaactgttgaacaaatttgggcaagcatcccattatgtaacgaccaaacttgtgcaactcttcgatctgctctttgtacttctctgcagggttataaactggagcatggagctcaccatattctggccggggaaggtcacgcagtacgggaaggggctcttcatcggcttttcttgacattgaggatttggagaaccccctgaaagagttcgtggtcaataccacagctcttacagctaaaggtttcgttccaatagctctttgtatagacctagctgcgatcataactcaatgctaatgctgactttggatattttcacgatttcattggttaggcagtcgtgttcggcccaatcgcgaagacaaacctaggtaactttgtatattatgtaagcttactttggtatgtataaaatgttagagtctatctgatgctacccagttcaacgattacggtcggcagtgcgtggcttggctctgatgatattgtccactctcagcaacacctcagcagcctcactagcagagtttaccacagctctcttcaatttgtatgattccataactcctaactgacgcatgtctccaactgtcccgttagatagattcagacctgatgtagtcaatccgctataaattgccgatcgtagtcttgctaccaactcacttgaatcataaccagcattgtcggctaagattgtaggtaattgtctcagagctcttgcaaaagcctcaacagccaattgtttttttccctcttgattttgggcttgagtgtcaacagcatttgacattatcatctcggaacatccgccacctaaaacagtacgagtctcttttgtcgtctgtgataataccgataaagcatcgtgcagtgatctttcagcctcgtcaagaacctgttcggtggctccacgaagaatgatagtacaggcagctccttcggacacacctgaaaaccgcgtcatgacctcttctccaatgatgacttcttcaatcaaatcacattttcccaatttgaccttccctggatagtcaaatgttgacaccacctcaccaccggtaactaatgccaatctttccacaccatcaaaatcagcatgttcgatggtattgatgttactatcagccaacaattgttcaggccagtcatatatcaattgtctgttcacaaaacagttaatgttgaagttcttgattttttccactttagccttcatcttgtctttttcagctttttccaactgagccaacttgctggtagaatctaccttgaatttggctccaaagattttaaccttatcagtgtccatggatgtgttagcaattaagatgctggcatcctttatcttctttggctgatcaagtccaaacttcttatttaaaatgaaaccatcgtccaagtatgaatcagaaagctgtccgccaataatcttgatcaattgaattctttccaaacttgttgatccgcgcagtcttagaatggcactaacggctatttcagcaaatttatctctatcttgagccagaatcttcgacgaaagcgtggtctttgcaatattgatcaaatcttttctaaaagcagcatcatcatgtgaattgtctacggcgactttatccaaagcttcaagagcggccttagatgctatgcgaaaaccttcaataatagtttgaggatgaatcttcctgtctactaacttttcagcctctcttagcagttccgaagctagaactgtgacactggtggttccatcaccaacctcatcatcttgaactttcgacaagtttaccaaaaccttggcagctgggttatcaagaggaatggatttcaaaatagtggcaccatcgttggtaacgattgactgtccagaactggcagatgtcaacagtttgtccataccttttgggcccaaagtggttttgaccaagtcgccgacggctatagctcccacaaacgccgacaaacgagcattttcggctctttcctctgagacttgatctcctagaatgttaacagacatgtgtaaagggtgagctataagggtactatgatttttgcctcttcgtgattttatttctctctgtcgaccgcgatacctactgaagtccgggtaagacaaataaaataatattggatgagacagagttaaaacagagatgaaattttgtgctagagagagataaaaaaagtgtatttttacaagatcggttaagttaactatgatgtttccatttgggcccttatcaaagttactctggttgatgtgagtcgtagagacactgccaagcagctcatcgggtgaaataaagtttgcttatgtaatcgatatggagatctgacctttctctcgcttacaactggtgcacccagaaaaccctataaaatctcctctcttagttatacttgtgtcttcaaacttgcgtccgttgtaccgataataatccctcgtttcttttaggattttgcatttatgctctacccataatgatctccgtcgataatcaagctcgggttcccgatgcccagatggaatcgtctgaagccagagatcggcgctataagcaattgttcgaacggctagacatccagcattcgggggccatttctttaagtgggttcagaaaatcagtgaaagatctggaccatcccatcaaggattccaaagatgctgtggaggaaatttttcaatctttggacaatcataacctcaatgcggttgactttgactcgttcaaagagtatttaattcgtgcagaaacccaaataatcaagggttttcacaacttggataaggaccaagacggaattatcaatcaaaatgatgtgaaaaattacctagagggcctaggagtggaggccaatgataagcaagttgaacaatttttcaacaggctagatacaaagcatgatggtgtaattacatatgacgagttcagagacaccctgctgttgatgccacggcttagtggttctagagttaagacagcttacaaatttataagttcagacttggaaaatgtttcttcggatggtgatttcactgttggcgaagatattctgaacagtattggatattttttagcaggtggtctatctggggtagtctccagaacttgtacggctccatttgacagagtgaaagtctttttaattgccagaacagacttgacctctactttactacattcaaaaaaagagataacgtccagcgttggagaactgaaacaccaaaagatccctattgacaagatcaagtctccaattcttaaagctgcaaccagtatttatagacaaggtggtttgcggggcttttatgtgggtaacggcctcaacgttttaaaagtttttccagagagtgctatgaagtttggttcttttgaagccgcaaaaaggttcatgtgcactgtggaaggagttagtgatccgactcaattatcaaaagtttccacatttgcagctggaggatttggtggtgtttgtgctcagatgactgtttaccccatagatacgcttaagtatcgtcttcaatgtgccaagctagactctgacatccgtggcaacagacttctatggaccactgccaaacaaatgtataaagaaggcggtctaaggatcttttatcgaggactgtatgttggaataattggtatgtttccttatgctgccattgacttgggaacattttctactttgaaaaaatggtactttcaaaaagaggccgttcttcaaaattgtgcaccagaagacgtgaaacttcctaattacattgtgctttcaatgggtgcgttgagtggaacgattggtgcttccatggtttatcctgttaatctcattagaaccagactccaagcacagggtacgtatgcgcatcctcataggtataatggattctttgatgctgccaggaagacaatggtgaaagaaggtgttcctggtttgttcaaaggtctgctacccaacttggcgaaggttgctccagccgtgtccataagctatctaatgtatgaaaatctcaaagatcttttccaactggaataacatctttagattcatcatgtcatgcacattattgcgtctgtattatagaatatttatccatatgtacttatcgaattaaaggtaaccaaaaacaatataaaagtaaaagagaagtgaacgtgcttgaagaaccacagcttcaagcctaaaaatgaaggtcttccgaagtcctatcacccttgataaacctggggcttccctctgtgtcagtggtaaaacactcatcctttgccgtcatgatcgtgaaactcttagagacggcagtggtatcatcactataagtagagggagagtatctattcttccaagcaaacgaaccagtagaggtgggaatattagaattgtttgctgtggcagcccacatggatgaaaaaggtaaagacaccacaattaacaggaaacccaaggatgctaaggagtctctgtctctagtacctgtatatcccagcacaatcaatatgcttggaataatcagagtctgactgaacatgatggctagtatatggaacgtatcaaactgtctaagtcccaagcttcttcttactttgatggcaaagaacaatttcaagctaaggagcagacaagcccaattgacggaactggcaaaaagtatcaatggaacgttcgaagcccaacgagggaagtcaacatttgaattatacatggatacggattgaagtgtcgtaacgtaaaagtttattgcgacaactgctgcggcaaataatgcagtgaaaatggtcactatccatctgagtgagttttcgtaaacccctttaaagataacgaacacctggtagatcaaggatatttcaatggacagtatcagcaaagcatacaaggtgttggtgactacatttatcctcaagtccacaccggcatgggtttcattgggaattctggtgaacatgtaggtaagacttgagaattggttggtcaagtagtggatgtaaaacccagagtggattatcagcagtattagtgaactttggttcagcacgaagattggagtcttccagcttttggagaccacaaataacatcaaggtacaaaacatcccaacaccgatacgggcaccatatacgatggcatatttgacgacgtaaaaatgataatcgtctagttcagcaaaagtcgcatctgtctcaccatagagcgaggtgaaatttaatagctgttgggaagggtcgaaactgtctgaatattcttccattttctcctcagctcaatccgatttagagtcagagtacaacctgactagtgtattatatagacattgaaatctggttgcatcgccaaagacttgaaactccacgtttggagttcactgtttgacagtctgaagacagcttcccttttgggattatgacaacgtacaggtttcgtgcagtaaatgttgtgcatatgtgtgatgtgatcggtgcactaccagggctacctctcaacaagcgtagaacgacaccagaaaaaaaaaattcaaaagccgttgaaaaaaaaattcaggaaatatcctgagcaggcaataatcaaacggcctctacggtaaaagttgaatagaaaaattcgttaaaaactatttaatggccgacacacaacattgggagattctacaagatcctaacaacgttgccattgttagagaaacttgtcagacagcctcttgcgcccaccctaagagtccctccctaaagagtacacaacaaagggtcaagatcatcgctcctttaaggagagttacaagtaactctcacgaactaaaggcaaaaaagtgatagatgaccagaccgctaaggatccggacaagctagtaaacttctcactcttgggcacaagggtatctacctcatcaaccaagttggaaacagtggctcttttttaaaagagtcaaagggacgtgtcctatagaaatgatcctatgaagtacgtcgacgaagaaaagaaaaatagaacagggcgatttgcatctgtttaaatacccaagtccatggttgtgagcgcgtgtcttttttcagtgatgcacgattctgcacatactagtaaaagattagggctattactatcaaaatcggtcgaaccaagtggaatattcttagggcctaaacaatataatcatcttggaacggtttcaaatcgctcagctcaataaggtgtctcatagtgggtcttccatgagggcaattccagggcttatctaatccactcaaatggtggactaccctagtcatcgttttcatagatagtgatttcccaatcatgatacttgccctacaagccctcatggcgaacatggatcgtatcttggatggcctcacgtgtgctaatagattctctttgctgatcccttgattttctttaagtagatggaccagctcatgaaaatctgctatgtcaaatactgttccttttgacattggaatggaaagtaattgaatccttttccctgcctcattttcctcttgaaacttaatagaaaatccgttcttgctgaagatttcgatgttgtcttgaactaatacttcatctagaagatttaactcaatgaactgtggcaccaccagcggctggcttagaaactgtgtgttcttctgaaagttttcaaaattatatttctcgtcagatgcatgttggtctacaataaaaaggtcttgcttcccttctgtcgactttttagtaacgatgatgaatccaagattgaactgaccgactaccttcattttcaaaaagtctgtcttggaaactctcattgtcaaggcttcttctgctacttctttgtcagtgatgtcatctttggcaacttctaaagaagtcttttcggaatcaactgcgttgatcagtctggaagtattggaggcaaattgttgtgcaattttttggctttctattgcaactgttccgacgtatctttgtgagttcaggcgtttggctcgggaaaagtttaaaatagggacagttgatgagtaggaagctagtaggtctatctccgaagttgcattgttttgcttacttggttcttgaaatatttctgttactagttgagggcgattctttgggatctgtctagtagtcggggaattgtactctattatgtccgcatggtctgatccgtcttcttcatcaatgatttctgcattaactagttcagaatcattactcggctcttggttttttatcccattctctactatgttttcttcatcaattgacttttcagtagcctttgatctaccaaaaccacctctcccctcgccaatatgcttttcatcgattattactacatcgtccggcccttggtgatcattatcttcaacagagtacactctggtgattgataaattattagaatcatcattgggagtactcgttccctggtcatccacttcatcttcttctgaatagtcactcttagaactttcttcttccttcctttgattcgaagaattatctctttcgtccaatcgataatttcgtactgtctttactgtccttggaggggataaggtcgtcaaaactactcccacgtcgtttccgatatcttgatctggctcagtggcaccagtatgttcctcagaatcttcacgaacaaagagagagagctcagttgtcgtattgttcgtatcttcaacatgtaaactagcatccttcagcctcttcgtcctctcgttgattgtggagtaaatatcgctacgtttcctttgtctaaagctggtatctcctgtaggtctctgaagcatactagagtctaccagagtagatgtttcttgctttggaataatgtgtgattgagaattaaactcgttaattaatgcatcaatcaaagactctagaacctggtcttcatggtgaatcattatagtccgcttgtcaggggtaacgtttatatccagatagtttggatccaacttcaagttgagtacaaccattggatactgcagatgattgaacgtcttgtatgcttcattgatcttcttggataattgtgccagatctaccggccttccattaatgaaaaataattgtctatcagaagatgctcttccctgaccaaaagagcaatttgaaatgtaaccttctaccgacagttcaaactcttcggagtacttagcggatatgctcaactgtatgttaataggaatcaatccgttcagtgctcctgcaccaaacacattgacaaggtttcctttcaaagaggcgccttgtgttgccaacatctgattctttttaccctttgctgttatatgattgaccataatacgtctctgtgtattgatcacagcgtagctttgaagtactgtcatcaatttgtaaaaatctctcttggcatgcttgacgagctcctttctgcgaacaggcaagttttcaaaaatgtttgatatggtgacttctgtgcctttcttggctgagatcgaagaacttttgatcagtttgcccgaatggtcatactccagcttgctagctgcgacatctggatcaggacatgtaacaatggtaacattgcttatattgcacaatgaactcattgcctctcccctaaagcccaaagtactgacggcttgcaaatcctcaaaacttgaaagttttgaagtgtaataaggagagcatacaaatggatgatcttccactgaaattccaaccccatcgtcagacacttgaatggaatccagaccgtagtctttgatggtaatctgaatctgggaactgttggcatcaatagcattctctaccagctccttcacagcagctgtgagatcaatgatcaactgacccgatgatagcttatgggcatctttttcacttatctgggtgatcatgggtgacgcgtacacctcaaacacgaaatgattagataaagaaaccgcgaacttatctcatatggaggataggttcggaacttcaactttgaagccttaaacttaccataagactatgataacctcttcgggtaggaactaaacgattctagcggtatgaatttgcaaacaggcactgacagtaagactgcaaatgcctcgaatgcgccaccagaagatgaattagtacgattgcctcaaatataccaaatgacgatagactacatactcatctggatagaactgatatggtactataggggattgtatccagcagaatctttcaaagccaaacaggcattttacactaaggtttatcagaatagacatccagatttacaggcgtaccttgatgatttgagaggagatttgatggaccttctccagaacgggcaactttgtaaaatccatctaagaatctttgaacacaacaaggttattgaaagttacaccatcaacgtgattaactctcccatcctttatgaatcgtttgcccttgaagaggatgttatcatatctaacgaagactatccacttgctatgatatatgctgagttccaggcatcactcaattcacttatttcagagctatcaggtatatcgaaccaatatcctgtcagtcaaacccaagaagatgacaattacaagttcaagatatatatatccccaaatgcgggtaccaatgatctctattcgaagctggtagtgaacgctaattggacgttgacttcacggagacctcaaaatgccccagttcatttgaaccgagcacgagctgttgatctgggcttcttaaatatccagacaacttttaacataagaagttaaatctggtcctgatcacacttagagttttttccagtttatgtgggataatccatctgaagcagatcctaatcttctcgaactaaatatctgtatagaaatctcatctcatccttagcatcaaagcctaatgggaggagaatcattgtcaatagaagaaacaaacaaacttcgaaaacaattgggcctggctctattgcccgtagaaccatctgtatcaaatgtgtctgccaaagactcgatatccgttgaaaagaccaacaagcttaggacatctattggtttgaagccaataccagaatccacgccagatagtgaaacaaaaaattatgaagagtacaaaagagaacaagaaaaacaattgaaagagaaggagatagaacaaaggctggaacgactgagaaataaggcttccaatgataaactccgtaaacagggtacactattggattctgaggattccgcaaattggttggagaatttgggcaaagccgaaacggataccgctgttgagagcagcaaagcccactctgctgattacactgagcatgatttgaagggaaccaaagtggcgcacgatctgaaagatattgtagatgttgggcaagacattgtgcttactttgaaagatggtagtgtgttagatgatgaggatgaactagaggcaaatgttctcgtcaaaatgaaacaacttgaagaaaatatacgaaacaaacttggagaagaaaagtatgatgagcttgatcacggccctggattaacaggtggttcattcagacttggtgatgctgtgccaactgagggtgaaagacagaagcaccaagttagacctaacatgaaattggttcaattcagcgacgatgagtttgaaggtgaagtgaagattggcagtgattacaagaagcccgtaaagatgaaaaaattgaagaaaaagacccagaataagcgaaagaaacttgatgatgatgaagagattaatacttttaaggttattaaactggatatctcagatgaatacaatgaagaggatgaatattccaaacaactttcagccgccaaagcgaatagaaaacctatcagagacaccgcagagtttttggcggaaaaagttgaacagaataaagtcgagaccattccactaacagtatcaaccatgtttgtagatgagactgatgagtttttgacatcattgaaggatgctgttgaaagagatattgaagagaaaaaagatgaagaaaataagattgaagaggtgaaagtagagaagccagttttccgaaagagaaaagggattagcagtcaacgaaaagaaacacaagaaacagatgaacctgtgccagagaatcagccggttgatacggttgaaaaagatgagactaaagaaaaaataattcatgagatcgaagacaagaaagtagccgatcaactatctacggcggaaccagaaaatggccaggagaccactaaagagaccaatccaatagcagctactccgactcagcttaattcatccgagtctttaggcgcaggtctgggagctactttaaagtatttgaaagttaaaccttcgattgatgctcaaagggcagaattgcaaaacaaacagctgttgaaagaacgagagagacaacttgctgttattgagagacaaattaacgaaagattgagagaacaggcattatatgggggatcaggtacccaattagagtatactaatctctcgaagaaagaaaaagaaaggttatctcaattggagaaagaaagagaacaactactcaaagatacattccaagaggaaaaactaaaaaactacaacccaaaggtgaatttggtttacacagatgaaaaaggtaataagttatcgactaaagatgctttcaaatatatgtctcataaattccacgggaccttcaagaaaaataataaatgatttattaagactgctccttgacgtattctttcatcagaagcttcaggatatgcaagtttttatagaaatacgtatagcacaataaattgcttcgtttcttatgctgactgtaggatgtgaggattgattttccttcaaccacgaaggtagtttcaaattgatcgtttagtttgacacatttgagttcagtttgtagattccatttactaaacaggaacattatcaatcctttatgttctggaattacacctgaattttcaggtactctcaatgggaacgacacattcttaacgtttttgctcatctttattttctcgatcaagtcatcaacttccttttgtagttcagaatcttcaggtgctttaactagcgattcttctcttaaggtggtggacctcatggtgttatactttcttatggcattatgattctctagggctgccatagcagctctagttcgggcatccttaacactgccaccaattccttttcctatgatttctccctccatttctacctgaaccaaccactcatcccgagctggaccattatctaaggtgacgtatttgggagcggacttggctgagccaataagagcatagagtttctctttggcactcttgttcagatacgatttatctcttttcattttcatggcttctatcacaggccgtgctaactttcccagccactcttgaatcattgtgaggtcgttgttgttttgaacgtataatgcaccgatgtaagcttcaaaaatgtcagcatatatcttaccattgttcttatcagtttcttctttactcattaacgagctgagtttttccggaaacccatacaactttgaatagttttccaaattagaattgctgacgatttgttgtctgcaaacagacagatggccttctgatgaggcaggaaattccttcataacaatagacgtcacagctagctcgagaacagcatctcccaagtactctaagcgttcataggaagagttagctgcttctatgctatcctcctcagcctgagtaacagctgatttgtgagtgaacacttttgatctcaaaactggatcggtcaaaggtagaagtgggggaggatactgttcgacaccctttggccttacctcttttccctcctcatcttcattactcggcttattgatgtccttctttccacttttattatcgcttttctttttgttgtacttcgattcaaggtcttcaaactctgcgaacaccttagggtcattgaaatttagtattaggttcaagaagtcaagtttcccatgcttatacaaagtcttcaatttgctcgcatgtaccaatttgggacctcttgtcaatgcaagcaccaccgcagcctcgtaatcacccaaattatccaatgctttggccacctccctgtagcttggtgagacttctagaacctccttcaaggaacttgtgagcttattaaccgcatactcagtctccaaacattgaaccaagctgatttttgttttctttttacttttcttttcctcaccagacgccttgtcagttttctgtcgtttccttttcccttcttcgtcactcatttggcgggaagttctgaatcagagttttttttttttttcgtttataatttttcagttcgctctatttattattctacaatataaaggtttataatagtaaaacacaaaaacaccatctacaaggatttctgtttcttgttggtcactgattctggctccactgatggctctaatgaagtctccttagataaattgtttctctttctcttggtggccagcggcccgtcgatttccctgataattgcaagcagtagagtattacatcttctagcgagctcttgaggggtacgagacctgaagtaccagtcaaacttgaataattcgcattggcagatctctcgtttaatgatgtcataaagattgtctctgttcaagccgtgtttattaagcattgttaaaaggtatcggtcttcgaggtctgtgtaaactttcttggaattgttgggaggatactgaattaccaattcccttaaaggtgatttgcattgtctaatcttctcagccagcagttcgtgttgaagtctgagtttatgggccttttgttctcccaattcgatttcttgaatatatttctcataaccttgaacctgtttgtagttggcccaaaaagcctttgaatatgcctctacctcttcgaaagttttgttcttcatctgcttggctatcatggtaaggttttctctaccgtgattagcgcaagcatgaatgaaattggtaaaatctcttctactccactttgaaaacccctcgccaagatacttgtccttcaaggcctgttcttcctcagtgagttcaactgcgttgtcgattttgttttgctccttcactttacgaatttctctagcatgttcttcaccttcggacataactaggtcctcatcatcacttccaccaagttctttcaacgtaacctgatgtccgattttcctcttgaaggctagttgttccctttctaacagctctgctagtccgggaggaaaaaactgaaaatcatgaatgattatatgcttaggtggtctgggaccccgggattgtttacccccaggaagaagcatatcatcgtagtacttgtcaatgtcgtattgtagctctttacgttccctcttggctagagaaatgtagctccttcctactctgttatttttctgagcaaagtttttaccgttccattcgtaagcagaagatgcttctgatgtgaaattttgaaggtcgtccaatcctagatttgaaaatttggcattcaaagaagcagttttttcctcaccttttctcaagattgaatcaatatcatcatctccaacagtggaacccttcgtctcaaacatttgttgggcaccgtgttgaatcatatctagaagttcatcctttgagttaccaatggtttggttcttattggaagatgctcttccttgttgaataaccagttggtccagccttagtttctgggccgccctttccaagactttttcctctatggcattttcagtaacaaaccgaaaaacctgaacctgcttcttttgtccaattctatgggctctgtccattgcttgaagatcggcctggggattccaatccgaatcgtacagaacaacaatgtccgcagatgtcaaattgatacccaaaccaccagcacgcgtagtcaacaagaaaatgaatttctttgaatcgggtttattgtactcatcaatcgcattgatacgatcttcatgggcagttgatccatcaattcgacagtattcgtattcacggaaaaaacagtagtcttctaatatatccaacagacgactcatctgcgaaaaaatcaagacacgagatccttgttctttcattttcttcagtaacttatccaaaacaatcattttggcagaattatagaccaaatgttcatctgtagtaaatgggggccctggttcgacaccttcaaaaagatacggatgattgcaacactttcttagctgcattacgatgttaagcagtcttgtttttccttctcttttaccgaatccacaattgacagcatctatatctttctctagaaggtttctgtacaacttgatctgcatctcagtcattcccacgtaaaggttgacttcttttttcggcaacaatgatttttccacgtctgatttcacccttctcaggagaaatggagagagaaccttgtgcagtttttgaaccacttcgtcttggtcctgcgattgtgactcgaaccattcatcaaagacgtcgctttctccaaacacatcgggtagaataaaattcaaaagagcccaaagctcgtgcaggttgttctgcagaggtgttcctgtgataagtagcctgtttctggaatagaataaacgaatgatttgcgataaggcactttcttcgttttttattctgtgggcttcatcgatgacaatgtattgccatctgatcttgccaagctttgccttttctctaatgaccatttcgaatgaggtgatacaaacatcaaaatcggcctccattaacttatccttcaacagcaaagctctttcttccttggttccttgtagtaccagtgtattcacatctggagtccattttgcaaattcacgtctccaattgtccagcgttgatttgggaacaattacaatgtgcggaccatcaattcctttattatatcggagatgacccaaaaatgcaatagtttggagagttttacccaatcccatctcgtcggccagaatacccgacaagcaattttcatgtagggaaataagccagttgagtccttgaatctgataatctctcagtgtaccatggataaatgacggcgattccgttatacaggttgtctcttcctcaaattcttcatcatatatcaactctgcatcttcttctttttctgactttctacgatgacggccattaccaactgctgatcttgaggacgatttgttgtgtttctttgtgtcgatggtgcggaccaactttagcagttgtttatcctttgacgcgccaagatctatgaagtgacgaaagagatcactgaggttcaagaggtacttgaatctcttggagactgaggcaaagtcctttcgcatttcctccttcggtgtgccctgcagaaggaatcgacgtctcctctcgtcttgggtctctgagtttggtgttgctagtttctgtgtcatttaatgaggacgctgtataaaaagtgtcaatcaataaaagggtaagaagaacaatcttctttatagtctcaacagttgttgccttggcaagtacggaagtcaaacgtgttgttggattggcacgtgtaaatctaccttttgaagttggaagtgggatagttgagttgcgactgataaaatttgtcttgggctagacaaatgcactgatgcctccaagtatgcattacgtaatatagtagtttttcagggtgatgatctgcgttacctgaatgcgcgtgattgctggaagcgtaattcatctaagatcatcgcgtatcaaaaacaaaaaagacgcctaccaggaagcgttctgacgggaatcaccgaatctccaacgtccgatgtctgaaccattgaagaggtcttccagaccgggtactccgcataggctgtcgtctcgttcatctcttttgtcgtcgtcttccccaagaggtgggaaccattatgacatagacccaaacaaaactccgttggatgaagttctttgctccaacacaggccagggtgaaacgtcttccagtcttttaagcgagctaaacgactctttgactacattggatgctaatatgacaaaggtcaacagcgttcacgagtctttgaccaacttcaatgagagcttttcagcgtttctctacgggttaagtatgaatgcttggtgcgtagagtactcagaggccccaactaaagaaaattttgaaaacaggtccaaattaaacaatttgaaagccaaaataaaagagacagagcaaattctagagcagtacagcagaaagaggaaagacacagcaaaaattacaaagccagcaaaatatgcaaaacaatccaatcctaaaccttcaacaacgttgagtataccgcaaccaactccagctaaacagcaagttagtagcactgactcttcatttgaaatagaggaagaaactgaacggtcgtcaagaattggggcgattgggaagtcccgcataccgtataaaagcgacagcaaaagaagtatgatgaggctaaagtctttgcctccaagaagacctccattccgataaggctatatgtatatttcaattaatgtagatttattacttgacatttagcaaaaaagtatgcgaattctgtggatcgaacacaggaccttcagattattgagaccgaagttttcttcagtctgacgctctcccaactgagctaaatccgcaattacaagtacaaaacttctcttgtctcttacacctgccaaataggagattatttgtaaccaaagtgcatttattacttttacactttgctaaatacttctctcctaccagagcggtctaattaaattgcgaaagaattatctttattaatgactgtgcaactcgaaccttttagtaatagtagtcaattatatcgcagtcaagcatctatagaaatgaagtcgatgagttccatccatatgcgctcgttataccctcaatcttgatcgcctccatccaaagttgctgattgtgaacgcccactttccatagacttctagttaaattgattgtggacatttcctcgtcattttgcagattttgtgtgtggagtgcttctgacatccagtgcctgtctctctcaaaattatttattctcgcaggaacatcattatcaattcgtgtcaacattgtcagctttcccgaatcttttgccagatcctcgtaattttgcaattgtccatagattaatggtgctgaagtgaacttgccaaataacttgtctaatctcacggctagggatggggctaaaattagttcgtaggattgattatccaaagtagcaactaaagaggcctctgctgtcgatatttgcatcaccaactccctcggatacttatcgacatatggccgttggtacatcaaatatccaactgttgactcgaccgtttggctgaccaatccctttggtgagatgtatttacaatcaatcacaatctcttcacagcagcggataacgttcgttcttatattgtgtttgatcagcttttgttctagcgcttgaaacctatagtatttgcattcattgattaaatcatgccgcagagaatcgtcaatagaatcaacgctctctccttgcaaatacctcacgatcatggcaaacaaatgtggacttctattgctaaccgtaagaggtgcctgaggaggaggacgaattaagttccgttggtggatgaccttggctgggttctgaagtaaggtatcatatgccaatgtgaaataatttggagagttgccctcaacattcagcaaacctctctccagtacgaagggacgtgagccgataaccacgtagtaattcatctcacgaacaacttttgtcagcctggacaagttaaagtagctagcgtcttcaaagaggtgtatgtactcagaaggatcgtctatgctgatatgatagccttgcaagtgcttttgaataatctcaaaaacgacaggagatctgtcgatgaacaagactttgccctcattttcattcttttggaagaaattggtgaaataggaaggtccatcggaagataatgaggccccactaatagcaaataatctatcaccaacttgaatactgtacatgcgctcatggggaagcaacttcgggatggaagggtcgaactcgttcaccgactggatcggtttatctgcattgttcaacccttccttgtcgaagcatatcaacaattgatcttcgtaattctccataggtaaggctgtgtaaaatgtgatgtgtacattgaggtgcgtttatgctagagaaaaagttaggcagcgaacccatacacatgggtccgaataacacctcaagacttcaattagattcttacctaccccagattatcctataagtaatacgaaaccacgaccgatgcccatatggctgccacagcagaaggttgcggtaataaatttaaacctatatatatgatacaaaacgtaaaacaaaggataaaattatgcttttatcggtttcttttaaaagttgatgggaacgggcatggtgtattgttggaaggggatagagtcacaggtgaattagaatttcattaagtgtggtctgtcacctcttctcaaagagaaaggagcggcgaggtactcctcaaggtgagctaccttggaaacctcagccagcaaagccttgtcgacgaccttttggtcctcgatctgctctggggaaacagtcttcttttcagccttgtcaccgaagaagtcagcctcagacttgtcttcctcgttacctgacttttcagagttgaagtaggcaaggtcgaacttggccaggtccaaaccctcaacagagattctggtggaagtagcaataacgtagctgtcgtgaactcttctcaatggaacaccgttgaccttgaatggtccagaaaccagcaaagtgttgtcttccaagttcttcaggtagataactctctttccacggaaacgtccagccaacaggatcaagacggtaccaggaaccagggactttctcagctttccttgagtaggagcctgcaaagctgggtcatgtggagtttcaatagccatttttttctgttgtactgtaagattaaaaccttggttggaaacgattaaaaaaatatctttaaagaggacttttagtcatattggcgcgcgattagagactatcttgaaagagtcgcaccgtcacgtgcataatagggttgacagccctagagcaacatagatggtgtaaggattctcatgcctgatctcagatgttcagcctgtggagtacggctaggtcctgatctttccctgtgaaatcgaacagtctgttgacggggatgatgtcgacggaatattcctgtggaatggtttccagcttgcttgcctgccccttgtttaaaattaccgtgttgtgtgctgtggctgataggcctggggcgaatgtcaagctaacgtagccgtcttgaaatgtgaccgattgtccctgtaattctagcgaggacaagttgttggcaatctgtgtggactcatcttcattttctgacgaatcaccgtagtaatcatcgtagtttggtgtctcttgatacactgacccgctccattcgattggagctgatttggggagttgtgtcacttgagcgaataccaccggtactttagaagaaggttcataaagtttccaagcttctatggcaattgggaggtactctaggtctttgaaataacagatagcaaaagcattctggtcaagtgagatgagcttctttacactgtcgaaatgctgaagcgataaggcaacattgagtaatctgtcgttagggtcagctaagaccatggattgggggatcagagggatttgtccacttatcaatgcaaccgtagttctctgctgtttatgcaaaatagactgtgagtatggtcctatgttatggggcgcccagtaactaattcctctgacgtgaactcctgatttgtctttcaaattgggaatgacaatggctgataacaaagcttgattcttctcgggtagcaacgtttgcacacatacccgagatgagggaaggggtttggtaaaatactgttgataaatggcattaaccttggcaaagtcgtccatatcacgtaggaacagctggacactttgaatgtgttcatatgaaagaccatgagtgttgagaatgtctgtcaactgagtgaaaatgctagtgatctgtgattcaatttcgtcctcccgggatgacaaattggagatataaagtagattaccgacttgtttcgatgtaacttcaaattcaacgagtgcggattgggcttctttctctactaaggggatcttgaacttagttgaacttaattgatcataaatgctttccatctcttcattcagcagtggcggagcactcaaaaattttgtagcatctccgtcttccttgcttttctcttgagtcgtaaaacccaaggaaagatgataaacttcatcattggatggcttaataacctcttggtgagtgattgataatttttttagaaagaatggagcgtcaaaaaccaaggtctcaaattcaccaccttcaccgcaaatatgaacatcatacatgtcattgagttttataagtttggggtacatttcaataagagatttccccaaatcattctcatcgagaccaattgcagcaacttttataattcttgcatccatgcctgattggcacatctctcccataagccctagttgattcatctgccacaggtaagagagtgctaccagattcagtctcgcacagacatcttctactctagtcctctgatacgatgaaagaatggctccgacactgacagcttccaattctggatgagattccttgacatcgctcaagagttgatacaagtcttctatttcatcatcctctgtcttttcgtactcaagttgctgattctttgacgttccagcaattactcttcggtgcattggaactccaatacattcttcataatgttccaatgcctgataaccgaccgtttggtacatgaacgagtccaattcctcggagccctctgggggaggatacaaattggctaaggctatgagttcatgtccctggctcaagcaatgccatatgttaaaacatgaatcttttcctcctgaaaccagagccacaaacttcatgaatcgttacttaaaggtctatcttcatgcagaatgctcatatctctcgaattttttttgatcctacctttgatatctgatcatcactcttaagcccatcctatggcatgataatatgagtagcacaggaacgccagcggaaacaccaacccatgaagactcaggtttgttaatagacgtggaaaaagaaactaggaagttagttaggttgagaaataaggctctcgtcaaagctgccacttcctcagacccagatacaatacgacgatatgaacgtcttagaaatgatagaatcctcagaagtgaaagatataagcaggaccaaatagcacaatggaaagaaaagggaagggtagatcttataccgaaggatgataattttggtagaatggcaaaccgattagcacaggcgaaaactggaaattcagacatcactagacaacataatgcaaggtcccgatacgtcttacaattaaagaaaattaggggatccgggggattcaaggattcggtaactccatatgggtttcagaaattatccaacgagggacagaacttagaaatcgaaccaatatcccctgtcatccagaaacctgagaattctgaatctactgtacaacatttgcccacaccgggccatcattcgttggcaccaccaccaccaccaccaacatcacagcatttttcttctattaatcctacaatccaatctaattctggtcctaaccaaaccttcgtacccccattccagttgtcatttgcatttcccctttcagcaccaccaccacctcctcctccgccattaccaccaccgccgcaacccgtggctgtaggagtgatacagcctaaaaataaccgtagaaaggctaggaaaagacccaagattgaatattaatttcgataagagtacattctatttccaaaatttcttcagcttatccctttttcgatgcttttctttatcatttgtaggaggctcgtgggattgcgatgtggtggacgccaaactagcagaagaatcaacaggaccacctatagaaggacgatgatgactctcctgttcaaacaaaacttttggagcagactctcccgctgctcttcttcgatcatagaatagcgataatgaggctctatcagacgtcaagtcaataacattattcacaaacatcctcggagtgatgacctcatcacttccaataaaaacatctttattcaataaacatccagcgtcatatccagccttcatttcagagtatgttataccgcctgcagaatatactactattctctgcttaggcggactataactgctaccctttctgctccaagcagctctataccttggatttttgagagaagttgccgaatcagggtttgtttcactaacttccaaaggcttatcctttatgtaaggaaatgaagcttcatccaggattccctttgatgctagttctacgatagcctggattgctggtttatatctggatgtgtttagaacagcattactatctatcttgtgccaaaactgtttcttgaaacttttgtcttttggatgagctttcaaaagctgaaatccaagtaaagaaaaattctcaaacaatgtcatgacgtgttcctcagcagaagctaatcccgcaaattttaccagctttgatacatctgctctaatcagtccacctctgtagatggcgtaaatcaggattaaacgtatcttatcggaagtggtaaaatagtctaaagagatccatgaaagtaaaaaagatgccatgtctttgattttttcgccatcataagaaactccaaatgcagcacagttttgctcaaaatcagcacactctgccaaatgacgttcattatttattaccaacagctcttcagtcaatttcttgtgtaacattatcttcctgcgctcttcgtcaaatccatgcaagtgagcaacaatgaaaagaaaatctcttgttcctgaggctttatctctatcaaccatcatagggttattagttatcagcttattcaatttcacatctaattgattgctggcatctaaaatatgcatatttctcaactcttcccagtagtcatcaatggggggttttaatgaagcttctctatccaataactctccattttcattctccacagaataacgatacgtattgggataatcaccgtcaacattttcagcgaactcaagtagatcaaaacacattgcctcataggtaaaatcatgcatcaatggtgccagcaggtccattgttctatcggtgatgataaaaattgaccggggccttgggttatcaccagggaaatcttgcttaattctgcaataatcatccagtgtgctttgaaactcctgtgcaatcattcggggcaataccgaggacttattaatgggattctggggagaatagtacctaactaaaggatactctccagttataatgcaaagattcattaaagtttgcacagctcgagacgcttgatatcgaatcaagtccaaacagttctcattgtacaaggttgggagagaatcgggagcatccgaaaggaagacatgactttccaaaggcagcaaagtaaaatctacggtccttcgcgtaattgtgtttgcctccaactgtttgtttcccataattagattcgtcaactctcttgctaacggagataaaaacaacaaatgagcttttttgtatcgagtgggattgatctggaagtctgccagaaggcaattaactgaaaactttgtaggtccaattaaatagactccttccattgagagccgtattttccgcttcttatctattctttccaccgtggtaacatacctcagcaaagtgttgctgtcgattaagctattgactaacctctctgaattggcgtccaggacaagacacttgaggccattggacgtttccacactccctattagtttcagtaaataatctctttggaggttaatcagatcagaagccattattgctcatagttttgcttcaagtaccctggttgtcttttctagcggtaaatattgggattacaggagcgggtcttcaaaaaagattacataagatacagaaaattcgaggaaaacgttgccctgcaaggcaccagcaaagaataacaggagaacaacaaatgcgctgttgcatgcgtattatagttctgtgcaacagggactaatcggatggattcagatacaaagccgacttcctcttccttcttcttttttctccagcggtttctcttcctcatctccagtcatcgtcttgtgccacagtgaattcacatgtctgacacctccggtaatcttttccaaccagttgcaacttccacgccaactaggttccctttagctccttcccctgtaggtcttcctgcaggtctatcacgtaacttaagagaacctttgactgcggtgcagactaataatttctacgggaatattcttcttggtgatcagacaactccaatctacaccaatccgtatgcattgtggtattccaaaaatactggggacggattcaatggattggcgatctcccaaaccagcatcagccaacgtcatttcgctgatggtaatcctccacagttcttctattctccagttggaatcaagtatttcgtaatgagtgcaagagagtttgaatccaacattgatatcgatctggatactccacgaaagttctctatcaatgttaatctcacctcggggtcctcgtttatacaattccctgttgtacaaggaatgggattcatcactggtgtatactataacttgatcccttactttcactctgctgtgggtattagatcggtcgctggagacatcgccccaagaaatggtattgacaaatacagaattgagctctttgacgactctgtttggactttatacgtcaatagtccccaaagaattcagtttgcaagaagaggttccaattctatcattggttcaaattctgtccatggagccgttattcagctgatccgtggatctcatagtgatatggatcaagctgcaggctgctatcccacagctgcatccgttgcaggctctgttttgggaagtgatgggatatactcaatcaactatgccaccacggggaactctaacagcggcaatccgctgatcttggccttgcctcatcatgtcaacacttttacggactccactaacgatgccagaactggtatcaggttagatgatcaaactcacggtacaatggttggggttctaaccaagaaactggaaatgaggtcaacattgcctaccaatgtctcttttgagccatggtctcaaatacctgggttctcaacaccgtcgtactcacaaacagcactaactgcaatcaggacagccgctgtaaatgagggaaacaatgacatagccgcagaatcaaaccttgactccatgtatttcagtggaaaagttcttagtaagtacgccctcgtattgtggtctgcatactatgtcgtgggagacagacaacttgcggagaatattctttccaaaatgaaggcagccattgagagattttcaaacaataatcagatcaacggtctggcatatgacacaacctggaaaggagttgtttcgagcggtggtctcggaggacatcccgaagtagattttggtaacacttactacaacgatcaccatttccattatgggtatcatgtacacgctgcagcagtaactgcacatgttgacaaggctttaggaggaaactgggtcgattccatcaaagattgggttaatacccttatccgtgattacgctaacccttcgtctgatgaccctcatttccctgttttcagggcatttgattggtatgttggacactcttgggcaaagggaatcattgaaagtactgatggtaaagatgaggagtcctccagtgaagattaccactcctattatggaattaagctgtgggctaaggtcattggagactccgccatggaagacagaagtaatctgatgcttggtattctaaacacatcgttgaactcatacatgttatatcgctcagataacacaattatgccgtcaaacttcatcccaaacaaagtatgtggtatcttcttcagcaataaggttgaccatacaacatggttcagtaacgaattggttcacatccaaggtattcacatgctgccgatcacttcattgtcttcctttgttcgtgatccgcaattcacacgtgaagaatgggagactaagttacaggcaattgtagacagtgtcgatagtggctggaggggaattctgatgctgaacttggctcttttcaatcctagagcctcgtttgattttttcaacaatcccgacttaccagtcagatttcttgatgacggaatgactaagacatggagtttagtttactctgctggagtaggaggctctccggcttaaatagggtaaataggagcgtatttttagtagggtggttgaatctgtcttatcaggttcacaccatccccttatgtgtccaaccggccatacatcccaacaccaagttggctggatctctagtgttattgttctggtccctcaaaaaagtagctcattattctggttcacactgcttactcccaatacacgatcgacctaaattgcaacatggacggtgaactactgggttgtatagtaagactaaagaatgctctggaaagggaaaaatccggaaataccttcaattcagattacgactacgaagacacggaagactaccctataaacgacccgcaatttagtggatcgtttggaaaaagaaccaaccgtggtaacaagctctttgactcatattcaaaggtggatagaacgagattgggctctgagtttgagtttttccgttctggagtgaccaaaagtttaggcgttcatgggtcgaagatcgtctttaccaataacttgaaacgaaagcactataaggatgaaagcgatgaaatatcacaaaagagaaggacacaagctaaacaaatttccaacggtaataaaaagtctaaaggagaagaagctgagaatgaaagtgaagactccgaagatgatacggacgataatccattcaacttgattaatgtgggggaaattctggaaccaatccaggaccctacagatatagctacaagacctacgatacgaaggacctatgaccccaagacgagtaaaaatcttcagaacttgagtctgcaaactatccagttgatcgaaaaggaacaggagacggtggtacaactattcaagctcatggattttttccttggcgatgactacaacaattttcaccctgaccacatgaaattacctgaatacgatcaccatctatcgtttgatgatttagatagacaacttgaatctgctaatattcgatgcaaaaccaccgttgacaacagcacatcaacgacttctcaagcctcgagtattgaggcaaacaaagagccgcctgtgtacgctgaagccaaagacaagcgtataacaagatctcaggcaaatgagggagttactgtgacagaccccttctttcaaactccagagtttgtgaaggatcccaactttggtatatctgacccaaaggacgcggaatccactagacaattgctacaaatcactttacagaggaatgaagagttcattcgatgtttgaccactatacggaacggaatggttcgaacggaaagaatgaagaacagcatatttaaatggtgtcgggagatgaacggtgagaccgatattaatattgaaggcaagcccatgaccaaggatgacattagaaaagaaaagtgacaaacagagcaaatgaaaaatctatttcttcaatgtaatttttatagaaatacagttgactattattcagcttaagctaccggtattagtgtccaataccttgtgcatgagagggtttttcttcttggaatctggaaagtaaaacggggagatgcattgatccacaatcccctcaaagagctggtaaattatctgcttcaaatcgtctcccgtttgcttgaaatcggggtaggagttgacttctagaagtgaacattcgaaattttcatccaccaaaaagtcaatcccaaaaacttcaaatgcattacttaatggttgaaagttgattctgtctacagataatgcagctttgaaaagctctttgacgatctccttaacttgaccaaataacttttgcttttggttttcagttaacttggagctccacagttcaacgacattggtgttagcatctgtgatttcatcggtgatgactgtcttctgagcgcatgtatttgttaaatggccattcaaaataaagactccatcttcatctttttcagtcttctcgggagaaacatagggatcatttgcaaacaacaacagcattttttcgaatacgtaaacctcaaggtccccattggcaacaatgtacgttctaatgtgtagcttcctattattatattggggcagaagcaagggtttgtcaacatactcttgaacaataaagtgacgcaattgagagatgattatgcgattgtctgaggcagcatcgttagtctcttcggcctcttcctcggcatcagacgcttcatcttcgaatgaatcaaaaattgcctgtaattcgtcaatagttctgaaaattcgaatgccctgagccttatcgctcatacttggtttcagaatataagttttgtgacagcctgaagactcattctcttccaattcctctctcaaatctaaatactcgtccaaggcatcatccaaaaactctgcatagtctaattccaattggtacgataagggtacatgggtagccaaaatagactcagggtgcttcgttttgtaaaccttaacagtgttagctagatagtgctttctaatcagcgcctttctatagatataagaacaaaccttgtatgagggctcactcactatcttgtcaaagttcagtccctcataatcgccgtaatgaactagtttgtggtacttctcaggaaaagtacttactactggcaccttgggaagttttctttccatggcattgatcaaagggtcgaagatgtaagagtttttgtcataggtgaccaatagtaccgatttatcttcggtctggtcgtcagttctagggtgttagaggaagaaataaaaaagctgtagaccgaattatacacttactggaaatcaatttcaccctcaatggagtcaacacccttgtaaactgctttaagtggagtgacactaaattgttagtagacaatactctgaagaaaggcaaaatagttacatacctgatattaccttgctcaacgactttaccatcattcagaccaacactttcctttacgctggtatggacggaatcaaagtcgggagtccatttgaaagtggttttatgcgcaacagtttcatcaacaatatcggatacttctgggaggtcctttttcgattcaatgactttggtgaagacggagccccatctattttctaagattggggcaaatatggcctttgtatcaggacctaaggagtctttcaagggaacattgatggaatacaattcagcttcaggatgccagttgttatagaggtatttaatcaacttgagactcagttcggaagcaatttttaacactttagcatcatgatctctggtataaaaagaataacttaaaccgatagctcttttcccggtcaatgccccttccagagcacctcctaatgtcccacttgccattatatacagagcagtcgagttccttccgtaattaggcccactgagaaccaaatcaacagggggtttatctttgtacagatgatgaacaccaatatcggtacatgatgctggtgttccgtctataagtacccattcctgaagattcttatcctcacgataacgagataccggactggcaaatgggccatgagatgagtcatccataggacaattcaaagcagagtacaagtactgagcggttaactccttgcctgcaaaatgagccttaccgatccaagatctctgttgcgagggcaccacaatgctcagttcccagtctgtatgattcctaatagcatccactaaaaacttggcgtatggagaggacattagattgggaggcccatcatcgtttattagaagaacatgcattctgagacggttattcaagtattgtacgagacgttgaagaatgaattttcactatccttaggcggatggatatgtcttcgcgcggctagagatccggtcctagtaaagctcttccctccataatctacgactcatcttgggatgtctatctattactatgggtagcctacacaactctcactttaggcagaatgtcaaccaaaagatcatctacttttaagtgacttgggtcgttggacttttggcggtactcagccaacaaatcaaagtacttgtcaaacaggtaacttgagtccaagggtccacctttagcctcagggtgaaactgagtggagaagataggacgagaatcatggatcagcccttcattggattgatcgttcaaattaatgaagtattccttaaagtcggaaggtagagtcgaggcatcgacagcgtatccgtgattttgggacgtgatgtgacatttaccagtagtcaagtccaaagctggaatgttgtgggccctgttaccgtacttcaatttgatggtcttagctccactagccaatgccaacaactggtggcccagacaaataccaaagactggtagatccagattctgttgcatcagttctctcaagttttgaacagtgctagcgcaatgggttgggtcacctgggccattagagataaaaactccgtcaaatttgctggcaactttttgaattgggtagtcatatggcaaaacggtaatcgaagctcctctggaaaccagggatctcaagatgttctccttgacaccacaatcaattacagcaacatggtacttggcattaggagatgggacgtggaacggagccttggtggtgaccttgtggaccaagttgaccgatccaggatcttcgaaagcagcgtcttcatcagcatcatactcttcaccaacggtcaatctagctaacgaagaaccctgttctctcaggtaggtgaccaatgctcgggtgtcaactccagtaattgcagcgaccccctctcttttacaccattgactcaaactttcgacagctgtccaatgagaatactgcaaggcaacatcactaacgataataccgatacattgaatacgaggagattcaaagtacttcagcagattgaactcatctctggtttttcccgatgggacaccgtagtttccaatcaggggttgagtgaagcagatcatttgtcccttataggacggatcagtcatcgactctgggtaaccaaccaaggaggtggtgaagacagcttctccactgatattcttgttggcaccaaaagagtaaccgtcaaagacggggccgtttctaatggtaagagtggccctgtccagtctggcggatgatgacaatctggtctgttgaaagaccaacgacttgaggaaatgacgattatttcttaagatattcatggtgaggttttccaaatgtgatctgaaatgtaatcttggcaagtttggttcataaaacgtcaaaagaccacctgaagataaaaaataaagtggaaggagaagaaaaagaggtttttttccagatgagtctatgactaagatttctcttcaaagaattttttcaaggtttgagagggatgaaagcgaggctgctgcacgattatcgatgtcattcaatagggaggtagaagagaactgagggagaaaaggctacaactgaacctaaaactaactgaatttggaatgaagcctattacacgagaggtgtggcgcctttccaaagtcatcaggttcaagttattgctttctggagcaataaatgatgtcaatcccatacggggtctccacccttatagaattacttatctaccggctaggtgttgcatcgcggaccagcccaatcgggtaattttagttgaaaaggtttttagcgcgagtctagttattacccggatagtctaatgctgaaaatttctcggacatttttgatccgtacgtatatttcagtacggagaatcatcaacaagaatctttcaatgccaccaaaaaaaaagacatttttcaccatcgcgcattcacagtagcttgaaaaaaaaaacttcaccttcacccattctcttctcctccacctttttaccctttactaaatttgtataatgtctcacagaaagtttgaagctccacgtcacggttcccttggtttcttgccaaagaagagagcctcttctccaagagccagatgtaaggctttccctaaggacgacaagtccaagccagtcgctttgaccgccttcatgggttacaaggctggtatgtccaccatcgtgagagacttggaccgtccaggttccaagatgcacaagcgtgaggttgttgaggccgtctccattgttgacactccacctctcgttgttgtcggtgtcgttggttacgttgagaccaccagcggtcttaagtctttgaccaccgtctgggctgagcacttgtctgatgatgttagaagaagattctacaagaactggtacaagtccaagaaggtcgctttcagcaagtactctgccaagtacgccaacgacccagcctctatcgagactgagttggccagaatcaagaagtacgcttctgttgtcagagtcctcgtccacacccagatcagaaagacccctttgaaccaaaagagagctcacttggctgagatccaaatcaacggtggttccatttctgagaaggtcgactgggccagagaccacttcgagcagaccattgctgttgacaccgtctttgagcagaacgagaacattgacgttatcgctgtcaccaagggtcacggtttcgaaggtgtcacccacagatggggaaccaagaagcttccaagaaagacccacagaggtttgagaaaggttgcttgtattggtgcttggcatccagcccacgttatgtggactgttgccagagccggtcaaaacggtttccaccacagaacctctatcaaccacaagatttacagagttggtaagggtgatgatgagtccaacggttctaccgagtatgacagaaccaagaagaccgttactcctcttggtggttttgtcagatacggtgagatcagaaacgacttcgtcatgatcaagggttccatcccaggtccagtcaagagagttgtcaccttgagaaagtctttgtacactcaaacctccagaaaggccaccgagcaagtcacccttaagtggatcgacactgcttccaaattcggtaagggtagattccaaaccccagccgagaaggccgccttcttgggtacccttaagaaggacttgcagtaaataccttataccatacgtaataatatagtataaagagtatatactcttttttcttttagctctttcaaacttagttagactctactaatgagtatatacatataatatcaccactgcaaatacaccactgcaaacaaaaagatatcttctttattttccataactccttccactacccactaaaattaaaaaagaaacaccataatcaagcaccacaactgagaaacaaataatatacaaacaaaattaataatattatcagtgtagatccacttgctgtactttaacacaacgataaattcacacagaaaaacgtatgctaatcaaacaatcaatagaaaaaccaagaaaaatcaaatgagaagatgctgaataaacatgatgactgtgatgagcggttggaaagtggaatccaaccgcaaaaactggattccagcagggtcatgctccctgttggtccaaaactatttgatacctttataaattgataccaacaaaaaacgaaaagcaatcaaaaaatgcctagcgacagcatcctgtgtgtgactgactggtggtttaccaccaatcagaaccagacgattgttgagtagtgttgctgcttggagcactaccgtagaagttagaaccaccgaagtaaccacttcctccattagccctaccataagtttgggaacttggctgaggcgggtagttagaagatcttctgaaatcttttccgtaagcgtttcttccgcctcttccacctctggctccgcctctacccatagtagcttctctggaaagggcgctcaggaattgaggaacttcttggttagcctcggttaacagttcaattaaacccttgatcaggttcttgttaccgcggttaacgaatgcagtggcaataccaacattaccagcacgaccggtacgaccaatacgatggacgtaatcgtcaatgtcagctggtagatcgtagttgacaacgtgtgtgacatttggaatgtctaaacctctggcggcaactgcagtggcaaccaaaattggagcagcaccagatttaaataagtgaagagcatgctctctctcttgttgtgttctgtcaccatgaatggaggtggcagggaagtttcttgtgactaagaagtgggacaaagtgtctgccattctctttgtttcaacaaagataagggtcagaccttcctttatgtcgtctgaagaggacaaaatgtccagcaagacggatttcttttcgtcgtcttcgacagaaagaactctttgtgtaatgttctcggatgtggaaccaacacgaccgactgaaaggaaaatgtagtccttcaggaagtccttggccaataactgaatatctctagggaaagtagcagagaacatgagggtgtgtctctcattgacagaaggcatatcacaaccttggacaatgtgtctaatctgtggttcgaaacccatatccaacattctgtcagcctcatccaaaatgaggtatttaatcttagcaagcgatatctttccacgttctaaaagatcactcaatctaccaggagtggcgaccaaaagatcacaaccgaggattaagtcttccatttggtcacggatgttagcaccaccatatactacgcaaggtctcatccatgatctgtaggcaaacttcttagcctcatcgtagatctgggagaccagctctcttgttggagccatgactaaaatagttggataggctctgtgcttgcggaaaacggtctccgactcgacttcgataggtgctgggcctgtttggaaacactcagataaaacggggaataagaatccaccagtcttaccggaaccggtctgggcacaagccataagatctctgtgattagaaacgattgggacggagtatttttgcactggagtaggcttagtaaacctggaaagtttaatgttttccaataacagctcgtccaaaggagggctggtgaattgggtgattggttcagggacgtcttcaccggtggcttcgactgggatatcgtcgtagttgtcaaagttcaaaccggacgactggaaggatggatcctctggagttccaaacatctttaattccagttcttcgtcttttggagcagggacgtgtttaccttgaacccaacggccttggcctcttgtgggccctcttcctctgccgcctctgaagttcatcccgtttctgccgccgccacggccagcagagaagttatctcttcctctgccaccgaaaccgccaccacgggatccattgtttgcaaaagccgaggacccttgaccgtttcttctgtgtggtgggacgtagttgctcttggactgacggccaccttcgttaacatttaagttgttcattgaatcttctaattcagacatattgtaaatatttctttatgatatattatatggacaagactagagtttttttttcttttcctttcatagagagctgaaaaaaaagaaatcagagaaaaattttacttcgtgcactacacataaacacacgagcaacgttacccgggtagttctagagggttcggcgaagttttggagggctgcagatggatagaagttacgattatctggtgacacgggaacaaggcacaaaatccggaaaacaccaaggagatttgaaccaattgggagacaagtaataacttgacctggacgttatggggagcagctatgaatagtctttcgcgctgcactgttcccagtggcaagtaggtaataggtcagcagacggaaacgacgcgggtgggagagtggtgttactattaggaaaactgttctcgcgaggaaccttattgtgtgctatggtacatctgagatcgtttgcgtagaccatattgataccatctcatctcttggaagtttcacgattttccaatgtcccaacagtactctggttatggacagcagcaacagcagcagaggcagaacctcttccaggtctggatgggtgatcttctcccatcgtgggaagaagacacaatcaggcagatctggctatctgtagacccatctctatctgaaaagatacattccataagggtgataaaggataaaactcccaaccttgcaaagctcaacaataacccaggctattgttttttgaggttcacggactatgacaccgccaatgagcttataactaattatcaaggtaaacctatacccaaccataaagataaatttttcaaactcaactgggcctcctctcacacgcagaaccagcaacaacaacaaggatatcagaatacacaggatagctccaacaggactcaggaaaactcgatatttgtaggcgatcttgctcaaggagtcacggatacaatgctgctggatgccttcaagaaaaattatccctccgcattttctgcccgtatcatgatagattcacagacaggaaagacaagaggatttggattcgttaaattcagagacattcaagagctcaacaaggcattgatagaaatgcagggatttgtgcttaacggccgtcccatcagagtttccactgccggtagaagcaccagtaacactaatgggggtcagctcaaacaatcagtacaacaatcatctacagctccatcctcatcggggtcccaatcctacggctttggaaataggcttgtcattccgccgctaccattggctccacctttaaacccagcttctgaccctaacaatacggcattaagtgtaaccaatattgatgaattaaccgagcaaaaagaactttgggagtattttcaaccttttggcaaaattgttcttttcaaacaaacatccaaggaaagtgctattgttgtgtatgctgatagattaggcgcagaattggccgtcagagagatgaatggttgtcaagtagggttttcacgcatagtcgttaaatggggtgaatctcctgtcaaaccacctgaaaacaactctgactacccattgaccaaagataacgttcaaaacgagttccaattgaacgagaatttcctaaaaaatcgtaattatgatttaatattgtaaaggcagcaaatgtataatatatgaataaaaaaataaataatcaagactgaacaattcgttagatgctcttgtcaatcttggcagcatacaacagagtgtcctcttcagacgacgcaccaaggtctttggcaagtccactgaagggataatttcttgggttagctggcttctcggggtacaacccaccaatataaatgacactactgaacactgccaataccccgaagaaagttccaaaccatttcaaggcaatagaatcttgtacgaaatcaaaatggtcaggggcccacatgtctagatcgtcttgctgtggatgtaaaggttcgttaaagtttctcttattggcttggtcatcatatttcaagtatggatctcttttctgtaggttctctggttttagtcttgggtagtcaccataggaataattctttggaatgaagtgaggcaaaaaggacttgtttctaatgaaaacactgctacttgtaatgctgtttgtcttgcctgccaacctgtatgcttgtctcaacatgttgtgctgtagggtggaatctcctcttggtgctttaacctaatccgtttttcctattgggtgtgtgggtgacgagcgagaaggtgaagttgagtcgtgtccaaacaaaataatgtttctcctatggtgtgcgccactcaaactcattgctcgtctcaacttctacacgcatcgacatcaacatcaaatcacacactcttgggttcaattcggaagtcttcaaaagaacatcacgaacttgtatttcatttattgaacacgtgttccatttgaaatgcctagaagtttagcaaggctgcgttccacagataacttgccaactcgcagctcctcaccagatacggattctcctggtgcaaatggtggaaagataagggcaatatctgaggtacaatctgataacgaaagtgctgcgactaaaagaaggcgaactaggcttcggtcaagagattctcccgttaattattcattaaaaagttataaaagggttagtgctcgccctaatgacgcacatcctagttacctgaaggaatctgataaacctttagaatcagtattgaaacacattgaccagaacttaccaaaggaacaagcagacaagttgcacaaggagaacttgtgcgatattttacaagcacaggaaaaaactttggatgagcttttcgtattgcaaaactttacatttttgactgattttgatcagatcaatagatcgagtgaaatttaccgtgcattgatagatgaaaataatctctggaacacattagcacccgagaacgtcaatggtcgtggtacaaaaagggtacattctcgacgaagagctacaagcaatttatcagggcaagagagtaagctaatagaagaagttcaagacatgctacttgaacgacggaggcgattgaaaactagtgctggaaaaacaaatggcatttctcaaactcacccaaagaaaacaaataagcatcaagtatttgagactagtatttcaaagaaagcagttgtttccagaccaacgtctgtgtcggagcacagaggaaagaaagcacgcaaacacatggaagaaaaagttcacgcccaacaacaagagagcgatgaacaatcgggttctgatgacacaatgcagcatggagaggatagtgaaacagttagttcactcagtgactctccagttgagcaatcatctttaggccatctaccaaaaaaggttcatttaaattttacaattcctaagcaaatagtgacacatcctgatcacttaactaagccagaatatggtggcaatttagggaacctactagcctctttttattccttagacgacgacatggagccttcccaatttcaagactatatcagtctgcaaagggatttggtcgaacgaattcgcaaaggtgtcaatgacaagttcctcaaaattgattacagcgagaatgttaataaacctcacgttcagggtacaactcgagaaccaacaatgattaagctgaactcggtgcatcatagatacaaggaccctttcagaacacaactttttccacatttgcattatgaccatcttctagctcatggagttttctactctaagttactacatgataggagagtttctcgtattcaaaaggcaaaaaaagtcgctaatatgatcgatagtcatttcaagaaactctctcaatcaaaagaaagggaagagaaagaaaaccagattcgagtcataaaattagctcgaagggtggccaaactggtaaagaatagatggctacaagcggagaaggtttttaggatattagaagacagagaaaaggagaaagagagaatcaaggagagcaaacaacatttgtctaagattttggaacactccacccaacttcttgaggcgcaaatgaaccgtgcaacttcagcaagtgcttcagaattgccatcagcttcaggttcagatattggaagctctactaatacagatgatgagaacatgagcacatctaacgatgaagaagaagaagatgcgaatgatgagaaacatatgaaagtagactcctcacaagatgattcgaatcttactgttgaggagttaagagagaaatacaagcatttgagccatgtcaataacgaagaggagatcgttgaagaccaaaacattgagctcactgctgaagaaaaaagactgttggacgaagaaacgaaaaaagtaaatcctttatttgacagtgacgatgaatctgagtctgaaatttccgaagattctgaggacatgagtatggaatcgattactgacgaggatgatcaaaacggaggtactgatctcaatggttcttcggggctagcttcattatttggccaagttaaagaagaagaagattccgatgacgaatcggttaaaagtgatattgaagaatcggatcaggaagaaaaaatcaaagtagaaaagcacaatattctgtcttccaactctgactctgttgttaccaaaaaatcaaaaagtgaagcatctgatgagtttacgaacgagcaagtcaattcggttatcgatgttcccgttcctcatctcttacgtggtactctcagagtataccagaaacagggtctcaattggttggcatccttgtacaataacaatactaatggtattctcgcagatgaaatgggccttggtaaaacgatacagacaattgcactcttatcctatcttgcatgcgaaaagcatgtatggggacctcatttgattattgtccccacttcagtgatgcttaattgggagatggagttcaagagatttgctccaggtttcaaagtcatgacatattatggaaaccctcagcaaagaaaagaaaagagaagaggatggaacaaaccagattctttccacatgtgtatcacatcgtatcaacttgttatccaggatcactttgtgtttagaagaaaaaagtggaaatatatgattcttgatgaagctcacaatattaaaaactttcgttcgcagaggtggcaggcattattgaacttcaacacagaacatagacttttacttactggtactccattgcagaataacattatggagttgtggtctttgctgtactttttgatgccttcaagcaaagctgacaacaaacaatccatgccagcaggatttgccaatctggatgattttcaaagatggtttggaaagccagtggacaaaatgatcgaagcaggagacgcattggctgatcaggagacaaaagcaactgtttcaaaactgcatcaagttttgcgaccatacttactgagaaggctcaaagcagatgttgaaaagcaaatgccagcaaagtatgaacacatagtttactgcagactttcaaagaggcaacgattcttgtatgatgatttcatgtcccgagctcagacaaaggagactttggcatcaggaaattttctctctatcattaactgtttgatgcaattacgaaaagtttgtaatcatccagatctgtttgaggttcgcccagtggttacgtcctgggtcttggagaaagctgtggctactgactttgagccaaaagatttgctcatcagaaggaaattacgagatcgggatgcagttgatttgcaagtattgaatttactaccttcacataacgatttgaatctctcaactcacacggtcgcttctacggcgcatttgaacgccaatgctcatctttcgaatcacattcgggaaatcgaaaaggtagtaaaaactcccgttccagagaactattatgatttccaaagttattacaggtatctcaagtacaaagaacaacaagatgctttggaccattcaactcacgcactgtatttgaaccgactaagatgcgaaagacgtcctatttatggaaagaacactctagacctcttaaaagtggtcaatcacacagataaacccctcaaaatgacggatgacagggtcctgagcgaggcctttgacgacatgtttactacaatagaagaacgatccataaagatgaaagacatttttgagaagtacgcttttgttactccaccagttgtttgcctcaatatgaatgatgttgctattaattctggactgaatggctatctgcgtactgttgataatggaataagtaatcctttccaccagctccagaccaagttgtcaattgcatttccagataaaagcttactacaatacgattgtggtaagctacaaaaattggcatctttgttactggaactaaaatcaaatggacatcgggctctgatattcactcagatgaccaaagtcttggatattttggaacaatttttgaacattcaggggtatagatatatgcgacttgacggagctactaagattgaagacagacaggttcttaccgaaaggttcaataaggatgatagaataacctgtttcattttgtctacgcggtccggagggctggggattaatttgactggtgctgacactgttatcttctatgattcggattggaacccagcgatggataagcaatgccaagacaggtgtcatagaatcggtcagactagggacgttcatatctacagattcgtttctgagtacactattgaatctaacattttgaaaaaagccaatcagaaacggcaactcgacaacgtcattattcaagagggtgatttcactacagattactttggtaaactctcctataaagacctgcttggtgaagaggtcagcaatgaagatgattcacctttactcatatcaggagtcgatgagaattcgaagagcttcacaaaagtactgacccaggctgaagatgcagacgacgcagctgctgcaaatgaagccatgaaggaagttgaattagataacgaagactttgtggaagctgatccttcgaggcaagaatcagtctcgaagtcgaatacacctcagctagaggaagatgctgtcagtattgagccagcgtctagcacattgactatggaggaagacgaatacgaggaaggccatattgatgagtatatgataagatatatagcatccggcatgtattgggactaatgaatatatgatgacataaatttagtacttctctaatatttattcatctttttaaagaaggaactaaaaacggaggaagtttttcgacgtagagagaaacttgattcgccatcataagagcaaacggtataccgtttagttaaaagtgagtttggaacacttgctgtaactggtttttttgagcctggttgtctttctgtagtaagaaattctttactcttaaaatttggtgttgaactgggtctgctgagatcggaaatgtgaggtctgttgctaagtcgaatactctttaaattaatggtactccttatattatttctaaattcagacattgtatccttttttgttaatggaagttgtggtgaccaaaagagtcccaattgggtttcaaaatgcactcgctgagatctacggattagaatagtttggcaattgttggagggaaaaaaggatagatctctggtggcataatctgaattcaagtcgttgatatctttgaaatgcgcaacgctaaagtatgtgacgcttctgaaatagcattcagttctctgttcttcagttgaattatctaaatccagatcatatgggattatcaaggatggataatagctcattagggaaacattatcgtttcgggccatatgggaaactctataatcaaacggatagggaccgttaacgtggaatattagcagctctaactgttccagccataaatcatattcctcttggttcatgcagatgaaaagaacctcatagagagagaaatcatgttccactatcaacttgagataaaacggataatcagttgaaaggccttcttgaacgatgttggtttcaggagtcaacagcctacaaacggacaggggtatgatgaagctgatcttgaaactgatgttcttctctggtttgattaggattaaatgagacttaaacaggacgcagcccaaatagccagcttttaaccccagtttagtattataaatggcatataaccctccacacattatcaatcttccaaatactttcattatgtttcccatagtatcgtacttcaggggtatattcatcttctcattgtttccacgagttctattcaagacttgagtcaaagaactagtcaggtccatatcgttttcaagaataaatccgttattcaggtcatttaaagcatccttaatttcagaaaatattatgtttagttcgtctagaccgcttgtatctcttgggaacgttaaaagaatgttctcaagaatgagcctatattttcccaaccttgccacaggtttgtggagcaaggagttggcagaaagatctgagcacagtagcttgttgtcaggaatggtaagcaggttacttatatcattttggagtgaactttcaaaggttgaaagatcaaactgattcagaagggaagaaaccattgggaagagagtgaagaaatcatggtacagaggtttacaaatggcttgagataaaatcacttgtaacagtctggatatattgtcggtacttaaagcctctgtgattaattcctcattgacgtagggtccagctgagtacctctgagggaagccaaacaattctgattcttcataaaaagagattggatagattttccttaaagattccagacataccgaatgctgattgattatcaagtttaacaaacggttcaagttatagaagggaggagaatcagggatctttgtcataataggggtggaaaagtattcgaagaatagtttcagatacaccacataggccgtttctgttaaaatcaactcttctacgcagttgagccgtttcaccaaatgagagtctaacgggagaggatttttccaaacttcaggagttttttgaatacttgaaggactactatgtttatctaatgaaaatttgctgagtaaaggggacaaagagctgatggaattaagcaagtagccatgtgtagtatcctctaggaataatggtgagttatctgagctactgtccatctgatcataactgtgaaggtcttaaatagccataataaggaggagataaacaaaaagcaatattggtgttgttgtacctcactcaggtgacacaaagtgggaacaaaatgataacgtcccataccctttacagagagaaagtaacgagaaacaaattttttaaataaacatttcatgttaagaatagtcctaaatttttgatccctgtacaattgatccactgcttgtacatctttacacaaatattgcttaactattggaccttcttgcgagttcgtaaatgtcgtgatcaagcttctccaccacggacttatcaaagtggtacatctgggagattgtagactgtcttttcaaaacttgcaagtctttttgggccttcaagaggaattccggaatgtctttctcttcaatgcttctgttggctctaaacgaatcctttgtcttccttataaagtagttcctaaagttgtagttctcaaagttgtttgagtatcgaaggaatgtcctatacaggttgaggacttgtgcttgagattctttgaccattataaatatgttttcttgcgttgatgaacggagtaagttagaggtgaaagctaaaggcaaagagtttttctccttatgacaaattcgctgtccgaaacccgaaatcttataggatgcttaagacctatggggtacttcctgctggtaaggactttgtgattccggtgaggaaattgtcctgttatggtattgaggacataggctatcatccatccatctttatctcaacttgccacaaaatatcttcttccccaggatagtggcattctatctctgctatttccgtttcgctaactagaaccataaacactgtttacaaataaatatcttattgccccccattaactttaagctggactaattcaatcgcaatgtcttttgaaagtgctagttacaacgatcaattccaatatgttctgctgcagatcctgacacgtctttcaatctacttaaggcatgtctcctactggggatacaaagcttcagtcgaacaccctcaaattgtaagcgtgattataactcttttgggactgttcattaccttctttttgatcaaaaaactagtccagttgatcattaataccactgtatttgtattgaaattgtggattgcaattgctctcgttttcttggtttacaaattgttcgatagaggtactcttttcttcacagaggatctcaattatttttaccataatttggaaatctctcagaattggtctggatcgattcgttccatagacacgctgatcactaaagttatcaatcaagcaagattcttattgaagctactgctatctacctatttaaaggataacgagttcttgacattcttcagagactaagtatgtgagcttcattctcctctaacaatttcaggaaaagaccagatgcatattcatagtcgcttagctcgttgtatatttgagctgaaaaacgtacccatagcttaccattgtggaaaatacttggcagcaaagtgttatgctcttttaacattaaagggtcaaccgtttttctcaatttaacaatatttttcttatccttcttcaggaactgcagcaactgatcattcaccggtacctccacattggacatggttgtggaaagagtgcctttggcattttccagaatcgaagtgttccattgtttggcaatgtggttagctgcatctttggctagtttaaagcaataatcattaatcttttcttctccgccacaaactgttcttctaaactccaaagcagctgggatgcagtcaatgcccgcgtatgaaaaagttccatagaatgcgaatctgtcaacaagtctagtcttttccaactcttcactcaatacttcctcatcatccaaatagctatgggaaactggaaatgtatgaatgtttctgtggtgcttgggatccacgtacaggaagctgcaacctttaggaacataaagccacttgtgcaagttcgacaaaaagaaatctggtttccatttcttgaggtccagaggaagaataccaatagcatgggctccatcgactaaagataatacattgtgctttctgcaaacctctatcaatctttcaaagggcaaacgtattcctggcatcgaaacaataacatcaaataaagccaatttcggtttctcttcctttaacgtagcttcaaacttttcaacgatctcatcatcctccaaaggaagcttcagctcaactgttaccacttctatcccctgtctcttggataaaaacttgacagtgttagcacatgctccatatgtaatgtcgaacatggcaattttatcacccttcacaaatggataagatctcaaaactgtattaaccgaagtcgtggcattcattgtaaagacaatgttattcacatcagaattgacaaactcagcgacttgtgcagttgcctcctttaaggttccagggagtttatagagcagatatctatcagaaaactcatggtctaaatcaatggcttctttatacttctgcaacactgtagtgggaacactaccgaacgatccgttgtttacttggacaacattcttgccaaaagaaaactgctcttccttgaatttatgtccaaacatattttagttgaattatatcaggagcatgccctggtctttaatagaggactatgactaatcggtaataatgaaatatactactaaacacgggttgttgtggcatttttttctcgattcggatgtaatcgcagatatatcaaattgattagatatgtgaaattaaagaaacgcctccttacctagctaatactatactgactcataatgacaataccttgaggccgctagctggattcaaggtcttggaacaagtcctctacggcagacgtgaaccgcctgaatgcttctttcaattggccatggtcaatagcagatgcaatggtcaacctgacataatggcagttatccttcgtaaagtcagggatcggggataatgtctggtagggaacaacggtgaccccatgttgtgcagttttctcactgagtttactcattagttccagacaattcgaacctggtgggaaattaagagagacagaaatgaacatccctgctttgggctcaaatacgatgagctggtctttcttcgcacaggaggattgcaatagctgtttcatggcagcttgctttctagaccagtactcgtttctaaccttgatagcccacttaaaccatccatcaagacctccaagtgcagtgatggtattgttgatcaagatctgagatggcccactggggaaaccagtggccagtacagagtagttcgtgataggttcaataaagtctttgtgagctactataaatcccaatctggaaccgggggcaaagactttgctgaaagattcaattctcaacaccctagagtgtttgtcaacggagaggtaagacgtaggaagagatttgaggtattcttccacatcatcgaacggtttatcggtagctaactccaggtaaccataaggatcatcttcaataatgaaaatatcattctgcacacatatatcgtaaattttctgctttgatttcaaatcagtgacaaatcctgtagggttttgtccattaggaatggtataaagtactttggggaaacgtttcccagggtataatgattcccaattttccaaaacgtaggccaagtattcaatatccagaccggattgtgattggaagtcaaatttcaagggaaccacagttgcaccgatgtttttgacactgcctaaaattggcacaaacgtgtactcttcaatcaaaacagtatcaccttcgtccaacaagagatcaaaacatttgtcaattccatttgcgccccctgcagtgataacggtatcccatctgtcattggcgggagaatgaatcctttcaatgatttctcttgtatatttcaacaaggacggatgtccgtacggactagcgtattgcaagccagttttcagatcaatttcctgtctattggcagtttctctgggtacttcaaaagaagagtcttggaggttgacctggaggcttttgatgggaaaaaaagactgatctggcattccataacccaagttaatgggagcgacgcccttatcgtgggctttaccgaatcctacggagttaaaggcggggtcaatggctctggcacgagcccttttggagatgaagttggttacgtttgagtctggaaaggtcattgtggtatgaaggttgccaatcaaggatagttgaagggtttaaatagagatagggatttgtattgagtcatacatagtaaggcatttatatgctctttttatcaatgtgtccggtgatagccatgtttatccgcgtttttcctttttttcgaatgccgtttgatctaatctaggggtataattcaaagcccatctcatttctccgcttaagtgagattccgtcgtttcagctcttattccggggccgcatgtaggcaaatccaatttttggttactctatattcagatcgtcatctggattatctacatcagaatcttccacgtatgacatcgtcttgctggcactgtattcatcgatgaggttcaaaaccaactggtaactctcatcgagctcttccttaatatccatattaagctcaagagcagactcctcgtagtttgctataaaagcattcttagccctaagtctattatagtttgacaacaatgattcaaaaaggcccgttatctctgtggaattcttcaccatcattccggtaacattcgtgttttgaaatttaggtggtctcgctgccaaagcaagatgaatggtcgacccagtccacggcacaaactgtatcctttgttgtgcttttactaacgccttttgaacgtcggtggccttgacatctccgcggatgaaatctagaacggaaaggttcatgttgtttgttgtgtttcttgacctaatcatttgtaattttgggtccaataattccagaatgatatcatacccggtagttttgcgaaattgtttgggatggctaataaaatcttgtgtaaacggcgtgtacgatggtattaaaaagtgcaaatcgggtgtcggtattagggtggaaaggatgcttgttgtcgaattgtatgagtagcttgggaatcttatcgtggacgatagagttgaaataacggttgaaattaactgattagtctctttgatcgaaacatcatcgatatctaggttgctgttagctatcgacatcagtgcaggattatcaaagaccatggtggcatccgcttcctgtatcaatcgtttcaacgtcaagacaacattgtaaggttgtacaacaacatctgaagtctttgtatctgggaatatggagtgagtttgtagtaattttttgctatatctgtccgatagagtttccaagagaaaagatcctagtcctgaccctgttcctccagaaacggaatgaattaattggaaactttccagagaatcacagaaatccaattccttatcaatcatatccagaaattcatccacatgcctagtagcatgctcaaacccttgtgtccatatatttcctgcaccccttccctcgggggatatgtagcaatttcttggattgaatagattatcatttctagaccttacaccattaactacacttggttccatatcgatcaataaagctcttggggtaaatctgctattgcctgattttctaaagaagacttgtggtatcccatttgtagactcgtcagtttccaatgttccattagatgatataccatgttctttgcagagttgattccaatattgttctcccacttgattaccacattggcctagacgtggttagagttgaaattgcagtagcagaaatttccaaagaaacatacctgcgcttatggtgagtatttctccaggcattgcggagattatcagatctgattcacttgttgtcgtgaggtattgtttagagatattacaggttctgtcgcgtctccatagtcgtgtgttcaccgtaattttcagtacattagtagatgggaattgaaagagggcaagttagtagggtgaataactaacaaagaacacttgtagggttttggtatggtatcaagattatagaacgactactggtgagattagagaattttttcctggaattttttgtcaagtttctcatgattttttcggccaaatcaagttagaattctgaatacttctagaagcgtaggagtcgtccagtatttatacctatgtttctatctagcttccaactctctcatctcacacctcttcatgtgttatttctcgcaagcaggttgcaaaatcatatgaacaccacaccgccttgcactcctaatcaaccaaagtctctaacaattcccctggatggtgggcaaactaaaaactagcctttgatctgtctacttcccatttttctggttgcctctctagtatgttgtcctcccacaattccctttgaaacacaactgccctcaaccctcaacgctctaatacggttgggttctaccccctaggtgcaaacgacactcgaatttgaaaaaaaacccaacctaacagtgcaaagactcttcatcgatatggacaataacgttgttgtattcactgctatattggtagtggtgtccattgctgcctacattctactgtttagcaattctgatagaaaagttttgaagaaagacgaatttcaacccttccctctcattcaaagaacacaactgactcacaacacggccattttcagatttggattgccccgtcctactgatgtcttgggtctgcctattggtcaacatatctcaattgctgcttctattgggggaaaagaagttttgagatcttatacacccacttctaccgacgatgccaagggatacttcgacctgttgatcaaggtctatgaacagggaaatatcaccaagtatgtagacaatctcaaactaggggagtctattcgtgttagaggtcctaagggaaactttacttacactcctaacatggttaaagaattgaacatgattgcaggaggaaccggtatcactcccatgtatcaaatcattacagcaattgctagaaacccggaagacaaaactcgagtcaacttgatttacggtaaccaaaaagaggaagatattcttttgagagaggagctcgagagtattagtgttttgaacccaaatatcaaaatttttcagactttagacgctcctcctgctaactgggaaggtggggttggtttcgtcactgaagaaatgatgagaaccgtgctctctgaggctaatgattctaacaaattgcttatttgtggacctcctcccatggtgtcgtcatgcaaaaagaacgctgtccttttaggttatccaaaggccaagccggttaccaagttggctgatcaagtatttgtcttttagaagcatcttttttctttttcttttttctatatataactagtaactagtatctctaatattgatctaaccttagttcagaaacttttgaagtcaactcaatggctaaattactcttaaaaggatcagtgatgatcttcgaatggatagcatttaaagccttgactgtatcattcttattgatcacacacgaaatgttaatctcgttagctccttgactgatcatctcaatatttatcctttcgtcggctaaagtcttgaacattgctccagcaataccaattaactgtttcatgtggattcctacaagcgatacaatagccatatcatgggtcacttcaacttctccaaaccgcttaagctcctcaacagtgcttcgaagtagtttcctatcagtctttgtgacatacagagccattgacacatacacttcagaagttgagatcaaatcaacaactagtctgtatttgtccagagtagagaagatatgggctaagaagccgtgggaaagtgtctttttgttggaatggatgttgactacaacgatatcacttttcgccgtgactgcagtcgctgtcttaatcttgttataaattgaagatggtagcctctccactgcagtaggaggatgcggtggagtagcctcacccttgcggccgacattctgaggataaatgatggttccttcacctgcagggttttccacattctttatacgaattggaatcctggccttgatgacttgctccattgtaaatggatgaataacttccgaaccataatacgttaactcagaagcttcctctggcgtcactgattgcaataaacgagcatcagttaccttacgtggatcagcagtaaatataccatccacttccttccagatttgaagttcatcggcatcaacaccaacggccactaaggcagcgcacagatcagtgtatccacggccaaccccgttcaacaatccaccaggaatggttccaaagtatccagtgacgacaggaacctttgaagagtcaatagcagagataatctcatgtaacctggaagctaaagaacgataaaaagtagcatctaaaaccgttccaaaatctttggttactacgtttgaaagatccacatactcagcaggaattcctctgtcgttcaataaggcggccataaaaagacaactcaacttttcaccgcacgacatgatgcaatccaatgtcttcggagaaacttctccaatgatttgagaggcatataataactttctggcctcttcgatttcgtgatgtgtgtcttcaattaacttggcctgaattttcttcgattgaatcatttccattgcattttctacgtgatcgatagtgatcttttctaaaaagtgcaagtactggttgtcatcgtcggcatccaagactacgtccgcactggccagaagcctggacgtggttccttccgtcttggtgtgggaagaacgagcactacaaactacggcaaccctgttggattcattccaaaccttcacaacatcatcagcaatcttatcgggaaactttcccacacttgttcctccgaatttttgaataacccatcctcttctgggagtcaaagctggactgctcatgtttgatttagttgaagactcaaggttgtaattatggttgagtcagtaatcacgtgacattggaaaacttttcaaatttcacagtttgttggatgttggatgtacgttaggcaacttgattgagagaagacctggggatgaagaagtgttctaatgttcatatggggcactgattggcgatactagaagaattgctattcccagaataatagcgtataagggctttcaacaccacgacaaaaagtagcggaatgtgtgaaactccacccgtactgacgcacttgaggtaatgtggccaatcttagcccggatggggtgcgattgattttcgtttgggttcattaactgacgtatgacatggcgtggacagcaagtcgtccaaaaataactaggcagctgcgacattttttcgtagagctagtttcattcgaacctgaatttcggtatgcatggcatggcgaacgtaaacaaaaacctttgcctctgttgaaattaaccaccaaaaattgatggtctcatgatgtggaactcacgatatttgttctagcccctcccccgtggtaatcacaagtcgaagtgtgcccactttttcagtgtaagtattgtgcctaacatatatcattattctatgtgataaacgccacaagtcaaaaagactgacacgatgatactctccagggtcctgttgactctactccttacaaccctcagggaccagagcagttctcggtaactactgtgacgtgagcagagtcgaacaagaccgaacgtgggaccagtaaaatgcaatctgcatgcacagaaacgaccgtgattgtgtccaatgtaagaagctggaattgtgcatgccatgactaggttttgaggctagtaccaaatggaaaagtacacaccaccaactgggttggtggtgacagtcagagatccagaaccattgcaggcagtttccagactctgctgagtcactttcgtgttcaatgaaagtaaatggaagtaaatcccttacaaattgtccaattgagaaataacatcttcaaactgctgttcgcatttgccgagaaaaagcttccctatttgggttctattcaaaggaaaacatcaatgcctgatttaccctggcaatgatgtgttcttatgtatgatcttatgcacacccctgtccagaaagatccacaaaaatcctattccattctgggtcgaacctaatcccaagccatccaaaaatggctaataagagatttaaaaatagtagatatcacggtatataaacagccaattagtcctttaattggcttgaagataattaatataactaccgttcaataatgctaaccaaggttatttcactcgctattttaactgcttcagcctttgctgattctggagagttcactctttggaacttgtcacccggtgacccttacgactcaactttctggggggtatctgaaggtttaatcgtccctgtagaacctggtgtgacttttgttatcactgatgacctacagcttaagactactgatgatcaattcgttactgttggtgaggactccgctctaggtttaggagctgaaggttcggtagaattcagcatcatcaacgaggatggcattacctctctttactacaacggtgagcttgttactgcttacatttgtgagggtgcagaaccccagatttatctcacaggttcagaggaggaccccgaatgtgtttcttacactgtcgctgtgataggcgtagacggcgaagccccaccaactttcccagaggaagacgacgagacaacaacaaccgatgatccaaccgatgagccaaccgatgagccaactgatgagccaactgatgagccaactgatgagccaaccgatgagccaactgatgagccaaccgatgagccaactgatgaaccaactgatgagccaactgatgagccaactgatgagccaaccgatgagccaactgatgagccaaccgatgagccaaccgatgagccaactgaagagccaactgaagagccaactgaagagccaaccgatgaaccaactccacctcctcctcattggggaaatgaaactgtaactgctactaagactgagtatgaaactacaaaagttactatcacttcctgtgaggaaaccaaatgctatgagactacttctgatgcttgggtttctacttgcaccacagaaattggcggaaaggtaactaaaattgttacttggtgcccaatcccatctactccaggtcctaaaccacctaagcctaccaagccaaccgaaactaagccaaccactgttcctgcaccaaccactaagaagccagaaacaccaactactaagaagccagaaacgccagcccctgagaagccagaaaagacaaccactgttattcctccaccaaccactgagaagccatccactttgtctaccagtagtgttactggaagtgttaccattccaactataactgccactggcggtgctggttccaatttcaacttgggtggattaaccgtcggagttgctggtattgcaatggctttgtttgtgtaaattgcttattattaacactgtattctattgtttctcattgtagccacattgcacagctctgttcttattattgccaatctgaaagttaagcctaagtccgtttttaagctattgatgtacaacatctttcacgtgatacagatgctgtctgcccatgcatgcctaaatctaatccctaatatactacatttcgcttattttaccctcactacttctcctagattatcggtgaataaaatgctgcggctagataaaatccgccaatctgctaacactgactattttggctaggttcgtctgtgtttatctttaaccaggttattgttcatctgtgttatttttgtattgtgttttgcaccatgcgcgtcattgcgcataccaagcattgagtaacaaagagagattcaatcatgaacaataagcaaaacctagttacaataagggagtagtataacagcttatgcgttatgcattaatcgactaaaaactcagcaaaccatatattatgtagaatacgacagctccattctctgctagttgaccagttttcgcaaacaagatacatagtacatatgaatctctgaagctccttagctttgtatagtatcggccgactctaaatattttgacctccatgaccaaaatctacttcctccacttcagctgggaacgctttaacatttgctttacaatatactttcatatgtcaccactagtggccaaaagcaaaggccagagacgggaattattaggaagaacgtcctattgttaattgaaagctctgtaaatttcatctttagcgaagatgagtaagctcatacttgcgaaatgaacccagtttcgtcaatgtctttttgatttaacaagagtaagtaatggttctttattcgttgccttattactgatgtgggaattaaaagtttcactgatgatagacctaaagagcatagcaaactcttctgaagtttaacaacgataccagttcgttgtctaataaaacagcttaaactacaaaggtccagcagcttcaatgtgatgaagttttttgctcctgccctctcccccctcgtaatcttagaacatacgctttactggtaaacgatcttcaagttgtctcaaaattcatccattgatgtagttgaaaaagttgaccttctaagatctcaaaaacctaagtacttcatttgaatataactctgcacctaaatttacacctaactctctatctaggctctagatttgatagattctatagcctttggtttgttatagtgttcaccaactggatgtcctaacgaaatggttctgtggtctagttggttatggcatatgcttaacacgcataacgtccccagttcgatcctgggcagaatcattattttttgaccgaattctttttttcagaccatatgaccggtccatcttctacggggggattatctatgctttgacctctatcttgattcttttatgattcaaatcacttttacgttatttattacttactggttatttacttagcgccttttctgaaaaacatttactaaaaatcatacatcggcactctcaaacacgacagattgtgatcaagaagcagagacaatcaccactaaggttgcacatttgagccagtaggctcctaatagaggttcgatacttattttgataatacgacatattgtcttacctctgaatgtgtcaatactctctcgttcttcgtctcgtcagctaaaaatataacacttcgagtaagatacgcccaattgaaggctacgagataccagactatcactagtagaactttgacatctgctaaagcagatcaaatatccatttatccagaatcaattaccttcctttagcttgtcgaaggcatgaaaaagctacatgaaaatccccatccttgaagttttgtcagcttaaaggactccatttcctaaaatttcaagcagtcctctcaactaaatttttttccattcctctgcacccagccctcttcatcaaccgtccagccttctcaaaagtccaatgtaagtagcctgcaaattcaggttacaacccctcaattttccatccaagggcgatccttacaaagttaatatcgaacagcagagactaagcgagtcatcatcaccacccaacgatggtgaaaaactttaagcatagattgatggagggtgtatggcacttggcggctgcattagagtttgaaactatggggtaatacatcacatccggaactgatccgactccgagatcatatgcaaagcacgtgatgtaccccgtaaactgctcggattatcgttgcaattcatcgtcttaaacagtacaagaaactttattcatgggtcattggactctgatgaggggcacatttccccaatgattttttgggaaagaaagccgtaagaggacagttaagcgaaagagacaagacaacgaacagcaaaagtgacagctgtcagctacctagtggacagttgggagtttccaattggttggttttgaatttttacccatgttgagttgtccttgcttctccttgcaaacaatgcaagttgataagacatcaccttccaagataggctatttttgtcgcataaatttttgtctcggagtgaaaaccccttttatgtgaacagattacagaagcgtcctacccttcaccggttgagatggggagaaaattaagcgatgaggagacgattattggtataaaagaagcaaccaaaatcccttattgtccttttctgatcagcatcaaagaatattgtcttaaaacgggcttttaactacattgttcttacacattgcaaacctcttccttctatttcggatcaactgtattgactacattgatcttttttaacgaagtttacgacttactaaatccccacaaacaaatcaactgagaaaaatggccattcctgaagaattcgatattcttgtcctgggtggtggatccagtggatcctgtattgccggaagattggccaacttggaccactccttgaaagttggtcttatcgaggctggtgagaacaatcttaacaacccatgggtctaccttccaggtatttacccaagaaacatgaagttggactccaaaactgcttctttctacacctccaacccttctcctcatttgaatggtagaagagctattgtcccatgtgccaacatcttgggtggtggttcttcgatcaacttcatgatgtacaccagaggttccgcttctgattacgatgactttgaagctgagggatggaagaccaaggatttgcttcctttgatgaagaagactgagacttaccaaagagcttgcaacaaccctgaaattcacggttttgaaggtccaatcaaggtttctttcggtaactacacttacccagtttgtcaagacttcttgagagcaactgaatcccaaggtattccatacgttgacgacttggaagacttggtgactgctcatggtgctgaacactggctgaaatggatcaacagagacactggtcgtcgttccgactctgctcatgccttcgttcattctacgatgagaaaccacgacaatctgtacttgatctgcaacaccaaagttgacaagattattgttgaagacggaagagctgctgctgtcagaaccgttccaagtaaacctttgaacgcaaagaagccaactcacaaggtttatcgtgctagaaagcaaatcgttttgtcttgtggtaccatctcttctcctctggttctgcaaagatccggttttggtgacccaatcaaattgagagccgctggtgttaagcctttggtcaacttgccaggtgttggaagaaacttccaagaccactactgcttcttctctccttacagaattaagccccaatacgagtctttcgatgacttcgtacgtggtgacgctaacattcaaaagaaggtattcgaccaatggtacgctaacggtactggtccattggccaccaacggtattgaagccggtgtcaagattagaccaactccagaagaattatctcagatggacgagtccttccaagagggttacagagagtacttcgaagacaaaccagacaagccagttatgcactattccatcattgctggtttcttcggtgaccacaccaagattccacctggaaagtacatgaccatgttccacttcttggagtacccattctccagaggttctatccacatcacctctccagacccatacgcaactccagactttgacccaggtttcatgaacgatgaaagagacatggctcctatggtctggtcttacaagaagtccagagagactgccagaaaaatggaccactttgctggtgaggttacttcccaccaccctctgttcccatactcatccgaggccagagcttacgagatggatttggagacctccaacgcctacggtggaccactgaacttgactgctggtcttgctcacggttcttggactcagcctttgaagaagcctgctggaagaaacgaaggacatgttacttccaaccaagtcgagcttcatccagacattgagtacgatgaggaggatgataaggccattgagaactacattcgtgagcacactgagaccacatggcactgtctgggaacctgttccattggtccaagagagggttccaagatcgtcaaatggggtggtgttttggatcacagatctaacgtttacggagtcaagggcctgaaggttggtgacttgtccgtctgtccagacaatgttggttgtaacacctacaccaccgctcttttgatcggtgaaaagactgccaccttggttggtgaagacttaggatacacaggtgaggccttagacatgactgtacctcagttcaagttgggcacttacgagaagactggtcttgctagattctagtttatgttgtatctatgaatatttttttacatggtggatttgttccaatctagttgttagttatttgtcgttatagtcactaatacagttaccatcggaatcttttcatttctttttatacgtacgtatatgtactagatgaagaatgcgacaaggccgaccaacagcaatggtgcttggtaccaaagtttggaaggtgctaccgaattggccgatgatattgaagtggagttgtcattctcctcattggttgctccagtagtggtaaaattaacggggatatcttcggtggaagtgtcaatatcaccgttccaacaataattctcaaaacatcttctacattgctctgtttgtgttgcattggatctctcctgctgtctacgaatgattgcacatccaacacaagtacgccattcttcatcaatagtcatgttcaaacgagacgacacttcaaaaccgttttggatcattcctctcttctcggattcagagtagtctaacttgaaagttgaagtgttactccaatacgagaaaggtctattggccagataaacaaccaggggaggaatgtgatccgtgccttcaacaatgtctgtcaaatttctagcatcacaaccaaagaaggttggcttactcgaaagattcaagtttaggaaagtggtggtatcaggtacataagggaacgttgttccatttgcttgagaagaaaactgtctcatgtaggtgttgactaatgatgaaccgtttggccaagagaggtcagtgtctgcactgttgtcaaacgcaaagatgatatcaacgtcacgctccttttgaagtagaggctgcagagggacgttttggttatcctctccaccatcaaccaagtaaagggtgtcattttccgcaatggcacctactcctgcatacgtacttttgtagaaagggttgggggaatagatagcaatgtcgtcttcgtcttcgctaagtccagtcagaaaatgctcaatgatttggtaaattgctcctgaaagatcactcgtattcagttgcagaataaactgattaaacaacgaggatgaagttcccagcacgaaaccagtgttgtcaaatccagcaatgcaaccacgctcatcatctgcgttatttggaacaccattggtaacgttagtaccaagatatgtcaaatcagtaaacccgtacactgaaggatcccatgagcccatctcaaatgcgttgaactcgaaaactgtcgaatttagagaaataatttgactcccaggagttcttcctactgcaacatggatagggaatgggatctcttgattagtgaactcggggaaactctgtagcgtagagaacgtaagtccagcaccaaaacttgggtaactagggaagaactgtcttgacaaagctctaccccaaggatcagtcaaagaattttcaaatccggcatcttccttttcatccaactgatcggaaacatcgtcccagaatattgaagtttccaagacattccatccacctggattgtaaagtgggttctcaagatcccaaatatcaccaccactgaggatatcctctatggaagtccaattgttgaacaccacagttcctagcatccaatttccaccggaaagtcctgtaatataagtggtagactcaatgagtccacctagaccatactcccatgctccagtagttctgttatccagggcagatagttgacctgcaccggacaacatggctcggtaaccacctcctgaaaaggcaacacctatcgtgatagagtggtcggaagatgacaggaactgctcaacgtcaaagtcagagaggttcgcatggttcaaaaagtcttttagattttcatctgtgatcttgtgtcgggcttcaacccaatcttgttctctttcggatagtgaggaaccatctcggatcaatgaggaaacgtcgggacactcaacttctcctggagcatatcctccagtgggagaccatgcagaaacaatttccaagccaagagctatgagtaaagttgccacaataggaagggccatcttcaagtgttaagaatgttaagaatgcttagatgggcagactgcacccatttattccctgcaggagttggcattggaggggggtcccgaaatttcagtcacttcgcctattcagaatcagctaagcaagtgaccctgaatcgcgcgactgatggacaaaaaaagaagctgtgcattgtgaggcataattattccttagggcaggttaggaaagctgacctcatgtttgaagaggctacttttcgtaatgagtccccaggtgatatggggctgcggctgaagctagttgcacggcagcatgccttgaagcggctcataaaacatcagaagagtaccgatacgttgatgacttgtaagataccaccatctgagagaatcgacagttatgatgcttttgaggtttggataaaaccgaggcccaaaggttcacattctaaatcgaaggtaagatcaagtactccaccgttcaaagtctgtactgatgatgaagtagaggctgcaaacaccaagattagagaatatatacggaaagtggacaacactatcaagaagccaattagcacgtctcttaatcgacatttgaaagtcttatcctcgggatatgaaatactccccaaaaagtctttaatcctgaagagtgattcgttatcctatgagccatacatgaagtaccatgttggtcgattgagcaatttgttgcatcttttggtactaaggcaagattggaaacgtgcctataaatgcttttcacttctgataagacagaggaatatagatttacgttccatatggggaattggcgttgaaatactaactagactaaatgagctaaagtttacagaccatttacaagaatttggtgaagattttcacttggatgagtatgatatccgactgttgagtgtcctacgaaataaagacctgattcctgatcagaatctacggggtagtttattagatttcactcccgatagccggttagataaatttttgacttggatgcatgtttattacggagtcaaatatttctacagttataatgatcaaagttgggagctgaaacattatctttacggtgccgaacttgaggagaatgagtctgcaccagaagatactgaaaatgaacccaataataagcaccctaagaaaaattctgataaacttagcatggcttggagattaccgccggctttccgaacaggatccaaaacgcataccccattatacgtaaccactatggtttggcacttaattatatcattggaccttgacagggcagaggaagttttgagcgagctacttttggaaccaccgttcaacagcgatggaatgtacttttatctgactgggttagtgaaatttctgaaaattcaggtagctcttgattctaatggccctgtcgaccctattaaaggatgggctcaggaatgtcgaggtctatgggataaagcgcaatcaaacaagttggagttccccttagcagaactcttgaagcatttagagactttcgaatctcgtgctgccaatttagatatacactcttccccagatgattcagacaagttctcagaagaagttcaaagttcaccgatctctctcacagccctagaaagccctcaactcaatgccatagattccacagatgaagacaacttgggaataagcttctgaaagatgttattattttcactatgtacaacttgagggtgctatgtaattttaattttatgaactttttgactcttctctgatattatcatctttaactggaaatctcttctctttatcttgctgcttgaccggtgggtttagtctgctgatcgcatcttcccttgtaggaagactgtgagattcatcaacattaggctcaagttttaagatgctaggcttcaactcctgtggaggtttgtaatcatctagcttcatgttatattcttccattttccgttttagatactcaatttcatgctgaagtgttgagatatcgtcagccacattttctcttcgggctgcctctttcttccgttgccgttgactttcgaataaaatgagagatccggctacagaaaacaggacaaactcagagagaaagttagctccattctcaacagctttggcatcgttcaacggtcgtatggttacgtcgtggcccatgatacgcatcctcaatttggagtcccattgatgtaaagactgtgccactaagatgcacgttttcttgaatttaggatgctctttcgcctgcagttttatggcgctctatcaaagactgtattagtataatggagctggaattaacagaaaaggaaacttacagccattggttttgagaccgtccttatgaataaggaggtaagctttaaggtaatactcatcaatagagtggaagcttatttacattggcagatgtagcacgacatggcaccagcgcgacagatgcctcaacagagcctcctcttccaaggtgagaaatcttaacatacaaccaaacctccgagctcgaaaagtcaatctgccttccactgaccccctcaagcttccaactcatccgtatcgcgcgcacgctaccgtcgatccaaaccgaacaggacagcaactccgcaaataatacctcatacatttcactacgtgtatgatatccatattttggcttcggatcctgtactactcttttagcacagcgggactcgctgtcctgctgtctctgatccagacttatcccaattggtactcgtttgcagtcgccataggtactaactcttacatgttccttgtgttggccaactttgttatagcatggcatttcattctaacggaaatcagcatcaagattttctttggaaggctgcggaccttggaggctaatcatgtttttgagcggtcttgggcttcgttggttggactcattatgatcctcttatcttttcaagcagataactcgttgataatgctattattagtggtcaactcatttaacctcaaatgcttcggatggatgctagtggatcgtatagagtacaagattcaaagatcagatactgtgaagcaactattggcctctaaggaatttgtagccttgaatggatgtttgggtctagctggcctgatgacatccgtatgtgaccgaagctctttagatagtgataatggagaagtataccttctattcgctatggagtatacgtcgacatttttgaatcttttaaagagctatgcatcactagtactgaactctgtggaaatgaccagaattcgtctagggattgaccaggaagaatgggaaagcaagactttctacatgaaagtcactaagttaattctctcggttctcaagtttgttctgctattggcagtagtctggggaataatgtcgttctaccacgttcctatctctttggtaagagatctttacgtctcagccgtttctcttttgcatcaggtgcgagaattacgtgcccatttacgtacgtttagtgaactgaatgtgaaactaagcgatgccactgtgcaggatcttgctgagcatgatgtgtgcatagtgtgtcatgaagagatggatgaaagcaaaattggcacaggggataggaacacgcccaaaaagttgaactgtagccacatcatccacttgagttgcttgaagaaatggatagacatatcacaaacctgtcccatgtgtagggctccagtattctcagacaactctcgaagtcaaaatgtgaacaccgatgtagcgggacctcttcccgataacaatccgcctccggccattgctgttgctcaaggaacccgagacgatccaaccccaacgataccctcaaattcaaataatatggcagatatctaccgctcaagtcctattttgaaccagatacccagagacgcttttcgaacagaaagacgagaaatcccaggtcgttcgattttggaaaacgacgacaacagctggttccaattcccactgcagtccaattccgataattccttcaaggtgatactgaatagtcaggattatctgcggttcggaacggatcttggtactacgcaagctcggccctctccacacattgtatcatccgaggatcaagggatatcctcatcaagcgaaagaaatacagacgtaaacacagaaacctatcagattattcagaatcaagctcaaacaattgccaatcttcagcagagaatacatctgctagagcagcggctcaactctcagtaaggccatcacagaatatacacaacgcacggaacaaaaataataatatcttacactaatatcgacatacgccagaagcaagctagtgcttcttcttattctccaccttgagcagaagcaccttattgatatgaggcaagacaccaccataggcaatggtggccttgattaacgtgtccaactcttcatctcccctgatggctaattgcaaatgacggggtgtaatacgtttcaacttcaaatcttttgcagcgttaccggccaattccaatacttcggctgtcagatactccaacacagcagcaagatagatagcagccttagctcccaccctgattttgttctgagcgttgcgcttgagaaatctcttgattctaccaactgggaactgcaatccagctcttgcggaatgggactgtgacctgattcccccgtctttagctcctgatttgcctttacctccgtgtacttttcctgacatttgtttacgtgagaagaagaaaataaaaacaagcgcgggggcaactattagtagtagtggtgtgcgcagttgggaccaaagtgcgaagatgaaatattcgcgcccttcggggattacaatctttggtgcaaggaatatacgtaatcagacagatttacttagtaaagattattttcactatcgatcatacactcatattgatagatttcacgctatttacagaaaccgggttgtagactcaacctagaacatacccggcataccgcccatgccgccagctggaggaccgccggctggtggtcccttaggttctggggcatcaacgatagcacattcggtggtggccaagagtgaagcgacactggaggcgtcaaccagaccgttgcgaaccaccttgaaaggatcaataataccagcatccaacatgttcacgtattctcccttggaagagtcgtaacccttgttgaaatcttctccaaagtcatccaggatcttgccgacgaccacagcaccttcttcaccagcattctcaacaatacgcttagctgggccacggatagccttcttgatgatttcgactcctagttgttggtcaaagttagaacccttgacactgtccaggatacgggaagccttcagaagagcagttccaccacctggcaagataccttcctcaacagcagcacgagtagcgttcaaagcatcgtcgtagcggtccttcttctcaccaacctcaacctcggaagctccaccaacacggataacggcaacacctccagaaagtttagcaagacgttcaagcagcttctctctttcgtattcaccggtgcttgggtcttcgacagcaccacgaatttgttcacatctctgctggatagcatcagttgaaccctcaccgttgagtacaacagtgtcttccttggtgatggtgatagatccagcagtacccaatagttcgatgctggcattttctggcttcaagtccagctcttcagtgaaaacagatccaccggtgagaatggcaacatcacctagaatgttctttctgttgtctccgaaaccaggagccttaacagcacagacttggacttgaccacgaagcttgttcaaaatacaggctgcaagggcctcaccgtcaatgtcttccgcaacgatcagtaaaggacggcgagacttagaggatagttccaatgaagggaggacatcctgcaaagaagagatcttcttctcactcaacaagatcaatgggttctcaaactcaacctttcctgactttgcatcagtaataaagtatggagagatgtaaccacgatcgaaacgcataccttcagtgacttccagctcgtcctccaaagtcttaccctctttaacggtgataacaccctccttaccgaccttctccatggcagaggccaataattcaccaatgtgagaatctccgttggcagagatagttgccacctgggcaatttcttcagaggttgtgatctccttcttgttcttttgcaagaagtcaactacagcctcaacagcagcctgagaaccacgtctaaggtccattggattacaaccagcagccacattcttgacggactcagtgaagatggtacgccccagaacggtagccgaagtagtaccatcaccggcagactcattggtcttggaggcgacatcctgcaacagcttggcacccaagttttcgaacttgtcctctagggtgatagccttggcaacggtaacaccatccttagtgatcttagggccaccaaaaggttgctcaattagaacattacgaccctttggtccaagtgtaactgagacagcatcagccaatgtctcaacacctttcaaaagtgcggcccggccttcaacaccgaacttgatttctttgtgagcgatagtacgagctagagaaatagcagatttctttagctgtggacgacaggccaatctatacatcgtggatattcttaattgtaaggaaaagttttaccttttttccaggaagtgaagtttcctttatatacgttcgctcactcaaaaatttccagagaattccatggtgttaggatgtatatatacgggcccgagtctggggagtgatggagatgtgggtattttgtccaggtttgtaggttagaacagtacaattggacttgaatagaaaggctttggactaggccagtgactaatttgtggctatcctcagctggaggtgatttctgatcaaacgggaatatgtggagaaggagaatactggagatgagatgggggaatcgcggattcgcaggcacacttcctttccggggttgaagaaaggattgttagtacgataaatagagttaatgggtggtgcagtactttaatggcttaggtagcgtacgtcagatagaagttcaattcatgtaaagtcggttcttgaaatttcctaagcaggtgtctcttttgctctgttggcatgaagttagcctccctccagagtcatcttggaaggaagtttcttcgcgctcccggtatcagaatatcactaaagtactctgctagacatcaaatactccacactactttacttaggtcaccgaatgtccaccctatttccagggtttgtgcccataacggccatgttttatgcggtgttccatcctacagagggaacaaaagtggttcatcaggtgcccagtggatccatggttccaacagatgcgcaggactcatcaagcgcagacgaaccgttgtttcactttgactcgattaagaattttattatcccgaaacctcaactctgcgataggctgatttctttcaaagtagaccaatttcgggtcgtaggatttccagtcaacatttatgggtctcattatgcaagaaattccttcagcttcaatttctgttttgtcttcccttatgatagagatattaccccgtataaaggaaatataaaacgtttgggtaaaatgtttcgggcactagaagagcaaagtcgaatcctctccaagaaatcaggcgagaattctggtgaaatcttcttcaaagacaaggaaagttccgattacctacaacaacaacattctaatcccttatttcaagtcaatcaaggcataacggaagatacaaaatatttaagaacagtgaacccaaatgtggagctacaagacattagggtaggaggtcacaaactaagtctaaactctatcgaatcattgattcagcagatttaccaggatcttaataactattctgaatgtcttatcccgattgatgcttcaaactctgttgatataaaactctttcctgtgttaccatcaccggctgatatccttccttctgatgttcccgtaccgaccatgaagctagattccatggtagacttgaattgggatcctaccatgatcaaaatcttaccgttcatcaacggtataaaccctgtttgccgaatttcacagttggctgatgcagactattatctgactaaaacttgtatccagcacctactgtattaccagtgtctgaatatggtttcaatattccaattctcaaacacttatgccccaacaccaaatgttagattattcctgacgcacccaaccatggctgcggaatgtcaagagtatgtcttatctgaagatgtgtcattctcagagcttcccatgcatacaccatcaccattacgaaatgaagaagaagattatttccatcgaccttcatctcattcccaatctgcttcagctgcttcagaaaaacaagttcgtattgtcgtcccatctcaatctagccttttcacgctctattcctctcttcatcagggccatactataaaagaatggtatattcatcatcaacggcatttgcgcaacatagacctaaggaggtttttactttttggggtgttgaaaggtatcatatatcacgttagagccatcccagtgttgcatacctctcacttagccctaggcagttctgccattgatgaagatccagcgcaggaaaacctcgttgcagaagaaccgacaagttctagccaacctgctttcaaaggcctgagaagctaccagctcaacgaggatatcagcgaaagtgtactcactgtgaattcagggaaggttcgttttagaggatctgctggccaagcagacttgtttcaagaaaagcccaacttcaagaaaatttctcaaaaatcacgtcaaaaacaacaactctttagacatatgcaaaaatccagagattttgactatatttgcaccgaattggcgtctagcaggagtgaagtcgaaagcctgttggatgaatactttggcagtgagtgggggcttctgctctgctgatgtaatcacttttttttttgttttcgtatatttgttttgaaggcacacactaccatcacaatacgtgaattcctatcgtcaagtacatactcattgacgcgtacgggatacatcaatggaaagccaggatgagtcgatcacggtagtggttcgatgcagaggtcgatcttcaaaagaagttcagttgaaacaacccattatagtggatgttccttcggagtttgactctgatagtgtcactcgaaccgtcagtgtaaatacgtctcacgactcaagtttgtcatctcaaataacgtccaccaaaagctatacagttgaccaatcatttggaccagcggtggaccaagaaatggtttttcagagtgtggcagagcccttatttgaggagtttatccgaggttataattgtacaatatttgcatatggccaaacaggaacggggaagacccatacaatgtgtggagacggtagggaaattgaagggtctttgtcaccagatgctggaattattccacgtttattgttcaagctctttgatgcgttaaatcaaaagaatattgattttgttgtgaaatgttctttcgtggagttatacaatgaagagttgaaagatcttctaggaaatatcaacagttctaaatctcgtcttagaatatatgagcaacgagacggtagcaagccgctgattaaaatcgacggtctcgaagagagacatatccaggatgctcatcaaggaatgaaattattacaaaaagggatcagacaaagaaagacagcatctacaaagcttaatgaaatgtctagtagatctcacaccatattcacagtaacgctttggcagaaactcccaaatgatgtggacgataagtattcagtagccaagatgaatcttgtggatctggctggatccgaaaatatccataggtcaggcgctgtgaatgcgcgtgcgagagaagccggagtcatcaatcaaagccttttaactcttggaagggtaattaattcgctagtcgataaagcttcttatatcccttaccgagagtctaagctcactagattattgcaggactcattgggagggaaaacaaaaacagtgttgatagctaatatctcacctaccagagccgaccatcacgaaaccattagcacactggaatacgctgccaaggcaaagaacatttgtaatgctgttcaagttggaggatttgtcagtaagaatctgcttttaaaggatttggccagcgaaatcactcgactaaagttggacttgatcgcaactagatccaaagagggcgtctttctagatgactctaactataatcaacttatttcagaacaagaaaatctcaaaactgaggtccgtgaactgcagataagcaaccgtgctctccggttaaaattggagaatacgtccaacacattgaaaaaggaaaaagagtaccacagtaaaatagaacaagagctcacagcttacaaaaattctaatataacgatacagaattcgttgaaggaacgaaataaccaattaattgacatttccttaataacgaataatatagcccaaactgctgaaaaggatttgaagcaggtgaaatcatttcaggaactagttgccagacaactgaaacacaggacactccaagagctacaagctagtttgaatcatttaatgagaaagaataatgccaaagatattactatcgacgaggataccggaatgctaagagttttattgaaggattttgagagcatgcttcaaaatactttattaggaatgactaaagatgtaatagagccatcagtgaacacaaaagctactgtttctgagttgagatctcacctccaagacttgggtcaactactgaggagtcaggtggatgataatctgagtatgatttctagtttagaacaacaaacacgctcaatctccagatacatcgagaagggaatgttcaaaaacaaggatcaaattgtagagaactgtttgtcacaattgaaggcagatatagaaagggaaacgttaaagtttcaggaggttatgttcagcaaagttagagacagtgtaagctctgcaacgaagacactggcatcatctgagactaatgaaattaccaagatctaccaaagctggataggttcaacttcggatgcagtaatgaaccggaaatcgcgtgaagacgaatttagaaagtcatttgaaatttctgaagctacgactgaacagaaattatctgaaattgatgaaagaaccacaaatggggccgagtctttgagagagcatcaagagaacttgctacaaaagagctaccttttatcatctaatgggccagtctgtcgtgctgttgaccagattgatatcaaattcaatacggtaggaaactgtcgaacccatctgcatgataagctgcattcagtatatgagcaactgtctcactatacacatcaagtgaatcaagttgtcaatcagaaccgagatgatgaaagtagcagacttgaagtagaaaggtttttgagatcgtttaaagcagtactgaaaagttctggattagaagaggatttcaagatgcgtcaaagggaaacagaggccacggtaggggagattcaacaattgtcagtgagggaattgaatctagatcaagatcctgattcgagtgggtcagccaatccaaccactagggtgcaagttctaactcctaggaaaaattccctgcacacaccaggagttggtagcagcaccccacagggcttgaagaggcccagatccaatgaagataaagagaatactctccttgcatctcccaaacacccccgaatattcggagatggagcgtccctattgggaaatcaggaaaagtagctgcagcacgcacactaccttttccgaaaggaggagaaggagagatttctggggaaaaaaatcaacagttacgtgggtggggttacccagcactcgcgcacagatttctgtgctgaaataaaatcctgaacgatttcattacactagttcccaggaatattccgtatttttgagtaactgccaaatattttagcttgaagacatggtggtggacgacgcttttcaccagcaactagaggagatcgatcgcattattctgtgcaatagatatgctcagattaatcggcaatatcgcaagggtcagaatgtttactatcagaagatcctcaaccaacagaaactgtaccagggacgttcttcgccacaagtagtatcattcaagccactttcaccagaactgccttctgctagagcttctaatagcaacgggccaacgtttgctggctctagccaacaacgtcacgtcgctacctcaccattaaccccaataaatagccaacaatttccagtcgttacgaatggcagtacaccagcagaaactggtatgattggtagcggtaatttggaagggtcaagctctactagctcaaccttgttgggtcttaactataagcatcctaagggtggatacggtgatatgaatatggactacggggtatctaagaatatctggggaagtgacacttcggtttggggttagcaaggttgattttttttcatggtttgtgtttggttcgttgttgtttttttttttaaatttgcatgagaaagaaagtaaagatacggtcagttaggatgtattgaggctctctttcgttaagagaaaaggaaacgagaaaaagaaagtaaaggaaggaaaaagagaagggaataatccaacaggtactaaatggtcttttggtactgcaagaacgtaaatatttcatacacgtttttcagggttggatatcaaacgttgttggttggttggacttgatagaattaattaatatttattatttcggctttattttgttgtaatatatataagtatatatattatatattaattctaggtatcgcggtaaagtgacactttgatctccaaatttaaagtgcctttttctacttggccctccttctcccaccttcgaccggctcagatcactgatggagagcagattcgttatccagtttcgtaactcttcagcggagacactggtggacgggggaaattcagttgtctactctagaaactcttctaatgggagtaactgtcctatcataactcatcaaactacgtctacccctacatccaagtcgtccagaagtactactatattgaatgattcagcttataaatctgagttgcctcctccgccacttgtgtatgccaatgaaaaggcaatattattgcattttgcgcggctgttcgccctgcgccatggataccagttggtgatcaacaagaatgataaacgaagagttataatgctctgctccaaacatggaaactatcgacattcaagtaaaaagacttcatgtgaagggcaaagtgtgataaggggtgtaaatggactcaagagacaggccaaatgtgattgtcttttccgggctgagcttcaatttaagtctaggaaaaatctctggttgttaaaacctatttacatgaaacataatcactcttcaaagttaacccttccaataattagaggcaaatcagataatgcttcgcaaccctccagactcgacgatttctgttctgataaaaatcacttgaattgtttcttcgatgcttcccgggattcaggcttggatttggcttcctctgacccatttaaattcccctatagtagggagctcgatggaatacgcgttctatcttctgatttacctacacctcctgtcaataccgaagagcctatcttagatgaccttacagtgtctgtttcggcacatctgaaaagagctttagatgccatgaattatactccaaaagaacactttctggaccagcgatctaataactcatttgatgaacctcctaccaagaaaccagatttgaaatccgagttttagtctaacataattcgagccgttgggttttttgcatttcaacatctcttttataggaaggtcatagacgctccagctcaactccacttttttcaaccaactcaataatatccactcttgagaagatacccactaactggttttttgaatcacaaaatatagcaatagaggtggacattttttgaaaaaaatcgtaacaagtgagaagatccatctccggaggcaatatcaacaaattggtttctaaaataccctctaaagagtagtcggatgatgaaggatttaacgtcactgcagtactccgatccactccttcaatatccaacaatttgtctaattccaattgcaactcataggaggaaatatagcctatgaattttcccccttccttttccaatactgggaaaccggacacatttgcactttccaaaatatcgcaaatatcatttactgtaacgaacttgtctttgcatataacaaacaactggtttgttggcttgaagagtctatgacatggaattcttgtcaggtctgggttcacaaactcctcaatcccagggcgtaaatatgggtaatcattcaatttcagccaaagctcataagacgattttcctgatagaatcgagtttgtcagaatactgaatagtactccgatcattacaggtaggacataagtcagtgctcctgtgacctccatcattatggcaatgacggtgattgtcattcgagtgaccccggtgagaaatgatgctgccccgatcactgcgtacgaaccaggagagatacattgaccctccgagttacaattcatgaatatgtccagggaaggatatcttaactggtagtatttcaatattgttccgaataacctcccaactagagctccgattgttaacgatggcaataatatcccacccggaatgtttcctcctacagtatacgcagagagtagcattccttgacaaaatgtagacagaaggactaagcacagtttccatgggaactccaaattatcagattgtaaagtagaggcaccacaaaggactccatattttgattttgagcaatcggtgaatagagcagacgtcatctcagttaaagtcaacccactgaacgaatttccgtaggataacaatacggttatcaaacaaacagcaagtacatctaataattgagcctgcctagagcccatgaattttacaactctgaatctctggagccgtatgtttaactgattgaataagacacctagaaatccacccaaacaaccgagaaatatgaaaggaattaattcaacattcagccaatttttatcctcagtgacaacaaacaaattacctgttatgatgtcatcaaaagggtgcaatgccttcatcactgtcacagcaatagtggaactcacaaacccgggccacatcaatgaatgtatgcctatggagcctgaaaactgctcgaagacgaatagaattcctccaatgggagaattgaatgctagcgcaattcctgctgctgtagtagcggctatcaactctcttttcagagcttgattctgagaatgcagattgggaatttttgttagaaaaaaattgcagattccggctgagatgtgaaccaaaggaccatcttttccagcccatataccggctgccacaaccatgatgattccaaaaatcttactcagaacaacttcaatattcgaaaaaccattgataattagcccattcaaaatgattttcaactctgcgattccactgtgcgcggaaaaagagtatttggtggttatcagaacagccatggttgcaaagatcccactaagcactaagcagatgactaaatttccaataccatggaaaacagtatcagaattcatgaatgtgaaaattgtttgggaccaacccttccactgaccctcttcacagttgctcctgatggtgactaaatgtccgctgcagtatccgtattttttatcgtgtagccatagtgagagaaagtcaataagaacaactaatacccccatcgtgacacttgaaatacctaacaccacccatttactcttgggaatatacatttgtagtaatggtgatccattcttagtaactgtttctttgacatgcttagccaattcatattcgtaaatccaatcgatgaaagttttgtttctgtatcgctttctagtacttctcgatgtctttgaagtagtggttgactctatcgttgaatcttcaatactattgtccaggctgtcattgtaagttaaaacaggtatcttctgagtacggatatccagatccgtgtcattcaatcgcattgtaccatcaacctgtccaaatgttgaagtttcaaagagtgaaaggacaacttgaaccctactaagatgagatgattgagttctcgaaatgattagataatcagttaagtagatagtatgtacgtctaaatgggaataccggtggtacgaatgtaattgtagataggatcggtatcgacttgataatctgtcatgctcaatatctgatcagatgagacaatgtcacgcaaccttctatccgttttgtaccaattcttaatcaaataaatcatttcagatttcaggaactttgtgaatccttcaaaaggttcaaaggtggtgctttcgaccatttcctttagcgtgtagtacaatttatcgtaagtcacgcccgacttcagaaatatatcaactagtattccgaccggtgtactctctgagggttgtgactgattgatgaatttggctaacagacgaaacaagtccggcaccggaaaaacagtttcagtatcactgagctttcgaccgaccgagacaaaaagattggacacaactgtgtagaacgactcgttcggtctatttttaatataatcagtgtgccacttgtttagtagtaattcccattgggataagacatcgtctgtgtttctatggtctgaaatacggaacactatcagagccagttcataataacccagagggttgatgaaatcattgaaaagctcactgatcgtcaggattttaccatccaggtcttccttggctttactttttgattcttcagttcctctctcgtcagaaattatagtttgcaaaaggatttcttgtatattggatactgcaatcaaatcggcaatgaaagttgacatttcaatcatctcctgtcttacacttggaggacagacgcagttgcagaaaccgttagcttgagagagatattgcacgcgatcagataagctgatggtgaaatcgctattagccaagtcatataagattttggccgctgcgtagtagttctcatgtttggaatggaaagcaaccaataacttggccatttgaagatctttgacggcacattcctgaagaaagcccaaaatgtagggagtctcaatatctagcaatctctcaccaacaccttgttcgataaaccacttataaaactcatagtgaaacaatttgtcctgataagcgaaacaggtcgcataacttgtatcccttagctgagtaaactcagtaattaagtctccattttgagtaatgaactggttttcttcgctttggaatctgctttcagtatcattgataagctggacactctctacagccttagtatcaatatcaaccagaatgtcgaagacatacttgtagaacatgtgtctcttctcataatctttctccttggaagaatttgttagcaacttatcggtattgtagtaatctgagctgtaagcgtccgatgtcgtggtgttgggagaagcattggccatatttaataggaactctattgctccactataatagttgacttccaacatgatctccacagcttccttgatagtatcaaaactgaccaagttgttagcctgcttcagcaggtccacagaggcctgaagatgttttaccttaagattcggatctctcttgcttatgtctttggcacgtttcaaggtctcaaaggctttgaagattagaacgtcactagttgagcaaaatgaaccacatctctcttggaggttcttgattatgaggtccaccgagattccgcggacaatgtttctgttgatgatagagaacaaaatttctttcaacaatttttgagtttgctcctcggtattgtctatgaactggctaaatgtcaaagagcttagatcagcctgatcctgtactgacatgaatctgaccaagtctttgaaattgccattttttgaggactcactttcttcgatcaagaaaagcagaaacgacaaaccttctttcatagtgtttagtaactggaaaatcgctctaaagcctatatgctcggcttggctgcaaacttcaaagtctctgtcacggaaattattctcataattgaaagttggtggtaaggcgcctggaatagatctcttgttcttttctaaaaaatcaagaataattaacaatgaggacagtaaatactcaatagtatttctggatattgttaatccggaaaggataatacgatcttcaatttttttgacagatccatcttcaataaagccgttcgaatcaaaattaatttccggtactaatttgaatatttctttagaccaaatatctctaaacattctcgagatcaagagaatcacagcataaaacctatcgctgagttccacattatcaaccacgggggttaggtttttgttcagcgaggcattttgtccaccacaaatgaaaagctgggtcgctttatttttgttgtcctcagacttaccaaatcgacaagagaggtatagagtggtagaacatgcttctcgggacccatacttttcagcaaaagctttaaatgtgttatcatttaagctgtcttctagtatcaagtctggtgtcctgtatctgtagatgtgaattcctgtgttagttaaaacagcaacctctaacgggtcttttgtgtattgggaagcaaactgattgtaatacccagcaggagtttcagtagcattaaatgtaggtgttaattgaatgatatcatggatcagtccataactgtccagaaattcaaaatcttcaacataagaattgttcttcttcaaaaccccgtaatcaggggtcgatacaaacaaccggtcagtgttttcagatttgagtctcagaataccgaaaaaaatattcggagaaattatctcacagtttttcaagcctgttaacaactcagatactgattgggcttgtcctaattgaagagcagtgacattcaggaacgaggcagtgttgccatagatattctcagataacttggatgattcattggaattgattgccaacgacgaatcttttccttgctttgccttctcatcagatactttttggaagaacttatgatcaggagggggaagtttaagatgactagcaatcaaagcaagtccatctcccaaattagctgacccattaatgaaaatacgtgaacctgtatttgttattgcaatcaagaataatgagctactttcaagatttgtcaccgggaagattttcaatagtttgaagtttttagtctgtggggtgagattcgataaaccataggtagtactcagatccttcaataaatccattggacctttagtagtaggatgagacaaggagacggtacccgagctcagaacctttatgcgatatgctctaacgactgatcgagtggataatgtgtataaaatggatcgagactggtcaatctgcatttgcgaaatgctttctctctcattgctagttgaggtttcagaatctgaagttccaaagatattcaaacctgggaccttattgaaagtggggacaacagtagaaaggctgtttcttgtaagacattctttattgcacttcttgtgaaaccattcttcgttgttggaataggaaagtttccaaacgtttacactgtcacctttaccacaaaagaaaatatcgtgggtcttctcaaaagtctcaaaatgatcgacgattagaccctgagtagaaactgacattccagtgttgaaaatctccagtttatccttgatagcattatactcaactgcgaaaatgtagatatctataggagtggataccagtaacaaataattgacgctatccacgaacacattaggtttaggctcaatgagttttacagtcaggatactgtggcgaatttcatcaattgtgaagtagtcttgtgtagcagacttgaagttgaatatgatcaacttgttgtctacggtaagccaggccttgccaatctgttgaaatatccccatgttggtgatacattcagtgctattgtactcttcaaacaatctgtcaggaaaattcaatatactagacttttcaaaacgggaaaatggacccaatcccaatggtggctgaaaattatagttgtcgatagcgtacttggatatggcatcactaaggaccactgtgttgttatctttagagatagccgaatggatggcgttcgttccaattttcaaaggggtggatgttgtaagtttgatatcattattttcttttgacgtatctatcttagaatcggtgccgttcatttggggatatgagggcatttttaacatccttaaaggagttggtttacgaatcccattttggacaattctcctaacggcagcctttttctgtaactccgatctttccagcttcacatcatcattggccgttgttgttttcttggaccaaagaacctggccgaaatgatctggcatgttctagatgcttaggtgctcttgggaggaagattgttttgaagatgttgaaagagaatgaactggagagaagagaagagagaatcgcgaaaaagatgaaaaataatttaatcagacattccctatttggtaataaggtgtcagctagaattgaggttcatggttcgctttagtggtgtgtttctgaatagacaagatggataccaaaacgcaaaaaggttgaccactgttgtacttgagttcaatggactatgattcaatcattgtaagtgttttcaaatcattgaaaacgaatagttttgtttaaatggaagagaccccttataaagtatgcttcggtcgtatggtgtggggagttgaaatttgactgtttcagttgttcacctgcggcttctgaaaaacaggagatttgcaaggcaccgcaaagaggctgttgcgcgtggtaattatcatcagatttgatattttcttggccgggactattggcacctggtaccttgcttaatctaaagcaatttgaaaagggcaggcagccaaaaacacgctccctgctttaataacatgtgtcttgcttaagttgagaaaaaaaaacgacatcacccttaacgatgcagatgggggctactcaaccgattggaaattaattgactgtaataggtttattgattttgccgaggcaaaccacggatatgcgagtgagataagacatgcatctacctacagatttgaaatttctatgatgcacgaccgaccacaattttttctccctattgttcgtattgtctctggcaggaatccattttctgccgccatttcactgatacaaccatttgaaaagaaacctccacgcgcagaaatgttcaactgtaaacctagccagaccatagctatttctatgaacaggtgtttttggtaggtgtggctgctctgtgcagataatttctcgatttcagtttaatctaaagaaatgcatggccccagccttacccaaagaaatgggatttttcatgcacagaaatacttagcagagtgcatttgtttattgtacaataattcgtgaccgccgttgcaagtgaactttgtagaggtcagatgatcaaaaattgttctttgacgtcaaggtgcatgggaatgaaacagaaagaaaatacggatttagtattgtcgagatctcttgtttcttatttcgcgtcttcacctataggcactgaaaacctttcgataatgagtgatgcacgtcctactacttttcggcttgaaagatttcggaattgaactcaactacccattactacacaaattaataatgtctcgtcagggaggaaaggctaagcgtaggtagaataaatttcttttttttttctgatttgagaagagcagaactaacgcatttgtcagcactaaagaaaccaaagaagaagacccaggagtttgatgaagaggatttagccttcaaggcaaagatgaaagcagatgctgctgctaagaaagcgatggccgagaaagcatcaaagggaggacctctgattggtggaggtattaagaagagcggaaagaaataagtatatactaaaatgagtacgttttaagttctattatgagtgccccttttttaaaggatagcagcagccttgaaaggtacgatctcgaactgtcgtaccgtacctggtagggatagtcctccaaccgtctttcgatgttccttcgcgagctttgtgttccctctcgcaatttacaacacaatatcgtaccaactgccctgattttgtaaagatcaaacatggctctaactaaatataaaatagtgttcttaggcgatcaaggtggtatgtatttggtagtctttgccttacgaaagatgtattaaccagaattagtgggaaaaacttccctaattacaagattcatgtacgacacgtttaatgatcactatgccgccactgttggaatagactttctttcgaaaactttgtacctagatgataagacggtgagactacagttgtgggacacggcaggccaggaaaggtttaggtcgcttgtcccctcatatatccgagatagcaatgttgcaatcatagtttatgacacaaccagtaagagttcattccaatcagttgataagtggtgtgacgacgtacgcaatgagagaggagagaatgtaattatatgtcttgttgcaaacaaagctgatttagctgatcaacgcgtgattagcactgaagatggcgagaagaaagcgactgggttgaaagtcgatttatttatcgagacgagtaccaagaaagggtataatgtaaagaatctgttccgtaaagttgccaaaactctactggagcaagatgggagcccaggccaggatccaaaaatagataacgatggtgttgaaatgatcgatctagcagaggcaaatgtggaaaacgaaagtcaatgtcaatgttaggaaattgcattcattgtagtagaatattatgtaacgttctggaggggtagaattaaaagataacaatagaccacccaataccgtagagtcatgcttgcgccttctttcacagtccaatgctggcttaggacctctgcttcttttctccgaaccgaaagatgatcattctatgcgtacattaatagagtaaacgttcggattaatttcatgtgcatggcaggtgccctgactcttatacaatagtccaaaaataacgagtcgtaattgaaaaaattttcaatggttttaatgctctatgacatcagcataaatcgagagcatccctggctttattcgctgcataattgtcacatagttgaggccacaagatttgcataaaatgcagtcgcgtacttctaccgagccgtacaaacttcgccgacggggatactctgtggcgatcaaagcgggatgcggagaattaaaaattatgcacgcatcagcagctgcaaacgtcgaaaacagggagaaccgcgattctcaactcccactccattagggcattcaagttctaataccaattcctcacaaaaaatttcccctgtccatcaacatataaatattcatcaaggcccatcagtgtactttttactcctcaccagtttcaacagtttttgtttcccattcccctccccctctcaccctcattcactttccattggacatcccttcccatgacatctccctccccacccaataacaaagatttcaacaaaacaaacaagaaacgttccaatagatctggtagccggacgtttgtctgcacaggttatcccaactgcagcatgtcctttacacggtctgagcatctggcacgacatattcgcaagcatacaggtgagcgtccgtttaaatgtgaatattgtgcccgaaagttttctcgtatggacaatcttcgccaacacaaacagacagtgcatgcttacgaaaactttgtcatctcctatccaggaaggctaggtgatatgcaaattcaggaggagtcttctgcgccattggtaaatgaggtttcaggcccatcgcatcgcaaggccgaacttcctaaagccgcgtccgaggggctaattccccatagttcaatgcctcgctctccaccaatggcggccagtaagtcggaaagttatctctcgttgcccaattcggggcctaaccgaatgctgctctctgatcattcacaaattccccatggaaagcaacatgagaatcacgcactcccctctctcaatccccaacaaccaattcaacacagacctgccaatttttacacgaccaatcacccccaaatccagccctccaatcaacagcaagatgttcaaaacagcactgttcatggtttcacgaattcatcccaaccccagggtttacccagattcccaaacgtaagtttccttcaaggtgcatcgaatcatcaggaattaccaaatcctggacccgtgccctctccacatccaacaaatgaaaacaagaacaagccacagcttcagcataacagtacatcttccagttcatcaatgaattttcagccgttacagtttcgtccgatgagctatcgaccgaaaccactctcttcgcctcttcctcccaacaataacagcaaaaacacacctggaaacctacttggtgccccgttgtcatctctcccgttatctcaatctcaatctcaatcacaatcccctttctactcctctcctcaacaacatagcacaggttttgttccatcgtctttaaggcgaccaggcacgatcaatgaaaatgcatctccgtcttcgaaggggtccccatcacaagcaatatccgtcccccaaactcccatttctaccacgtcctcatcaactgcatcttctgtcgggtctacccatactaggttctggcttaacagtgtccttaacaataatgatcccgtggcagaaccagactacggaaaccaaaatggttcacccagccctacaagtacttcgtcttccacatcgaccttggagtccacaaaatgtaacatagattcgctgctcaacgagtaaccttgtataataagtttttgttagattttcgtctattcatacatgtttcctttatctcatttcttctgtgaaattcaccccctagctaggatactttgtaacatctgacatcttgcggttcagttgaaaacgcttaaactatacatctctacctaatctataagagttcccccacagccctcgttcaacttctcttatcttcctctaaccaatgtcacaactcagacccagagattccagtgctgggaaatcttcttcccctcgaaggacagatagaaatcctgaatctatcgacgtcaactctaaggggggttctgaagggatgacttccggccttgtcccaggtacagcacctcataaggaagatgaaactgaagcagaggatgatattgactgtggaaggttaattacctccaagtcgctggctaccatgctgacaacggcgagcatgtatgccggggtgtcccaattggatgatgatgctattgagagcagcgctctcgatgagccaattccatatgttccatacgaagaggatgctgaaagcgtaatgtcagaatctactgttggtgttgacacagtcagagacacagactcttcagaacaaataaatccagaaattgatggcctggttgctttgagaaagaaacaacaacacaccctttccaagtttgaactctctgttgttcggaaacgatgttcccaactgagtctggctggctccagttcaggttcgacgcgcaggaacagtttcactttagacaataatgaaactacgagagctgtgaaactctgcgaaaaactgaaaaccacctttgatttgtctgacgatgacgagtttgtgaatgattacccttgttggctgttgcatgaagtcttccttcaaggtcacatctacatcacatctagatacctgttatactttgcatttcttccgaaaagagactccactgtgaccatgtctggtgccttgtccatcagaagctccacaactatgagattttctgtccgacgctgggctgtattgaagggtaactactttcgtctatacgccaattccacagaacggtattttccttcacttaatattgatttgcgtttcttgttgaaagtagaattgtcaaatcctaaccttgaggaaaataagcctaccgttttcaagttaatcacagaagcacgtactcattattttcaagcagattccctagacaatgctagatcttgggtaactgatctcagaaaacatatatttacagccaagaatagcggtggtcatgtcaccatcaaagtaccgctggagaacatactggatttatcaattgagacactttttgaagcatctcaaactttgaaacttaaagtcttggaaagtgaagaatcttatgctattgacgactactattttatgtttttcaacaacggagaccaggttctagatagcattcggcaatccatgaaagccctagggatcgaacttacagattctgatagttctgaaagtgatagtgatgtctctggctcagaaactaatggtcgatcaactcatcgaaaatcaaagctttctcgttccttgagtgtgttaacacctattccgaggggcattggaagtatttataagccaatcaaaagttcagctagtggcatcataggggctatcaaaaagccgcagaaatcagctacacgtcctttttcgtcagtagtagaaacagttgttccgaatgacaatgactccgagttgaaacaagatcatgccggggacgctccaaaggattcagaagaaccttctaccaagccaagtaattggagtgcaaaatctctggtccaagggttcttgagtactacttcttctatcagtcaaagtatgctctttgcttcccctatgcattacaacaatcagctatttattgagcgaggtgaagaggacccttattttgttaccaataaagaggaaagagaagttgcacagtccagatttcgaaagcatttttcccttcctgattcagaggagctactggctagttacttctgccattttcaaaaaaatatacctgtatacggcaaagtatacctaggaacaacttgcatttgctacagatctttatttcccggcacaaacacaactatgatacttccatactccgatattgagaatgtttataatttgaagggctttagattcgggtactctgggcttgtcattgttatacgtgcgcacgaggaattattttttgaattcggttctaacgaaagccgggatgattgtgacctgttcctgctaaagcaattagattttacaaaatcacataagaatgctcattcagaacaaaagaggaaacgcaatgatagtattaaactagcagaatctgtccaacttgccgacgcaagactcaggtattttgaaactcgaatagagtctgatataggcagggaggttcccataatactggaggaaaaccagtattctacgtcagaaattagatcaaagaggaggtacaaatttgtgctattaactattggttctcgaggagatgtacaaccctatatatctttggcgaaaggtttacttgcagagaatcacaaagtcaagattgtgacccatgaagagttcaaaccttgggtagaaagttatggtatcgaattcgcaacaattgcaggtaacccagcggagcttatgtcattgatggtaactcataagtcattaagtgtagggtttttgaaagaggctaaagaaaaattcactggctggattggagagttattgcaaagctcgtgggacgcatgtcaggatgctgatgtgcttatcgaatcgccttccgcaatggcaggtatccatatcgcagagaagttacaaattccctatttccgtgcttttacaatgccatggacacgaactagagcgtatccacatgcatttgtggtcccagaacagaaaagaggaggttcttacaattatctcacgcatataatatttgagaatgtcttttggaaaggtatttcaggagaggtgaataaatggcgtgagcaagtcttaatgcttccaaagaccaatttggagagattggaacaaaacaaggtaccattcctgtacaatgtgtctcccacggtttttccaccatctatggactttcctcattgggttaaggtagttggatattggtttttggatgagggggaggcagatagttatgatcctcctaagccattgctggagttcatggagaaggctaagactgatggtaagaaattggtatacattggatttggatccattgtagttagtgatcccaaacaactgactgaggctgtaatcgacgcggtgctcagtgctgatgtgaggtgtattctaaataaaggctggtcagataggttaggtaagcagacgggagtggaggttgaactacctgaagagatttacaattcaggaaacgttcctcacgattggttgtttggcaaaatcgacgcgtccgttcatcatggtggatctggaacaacaggtgcaacactccgcgctggaatccccaccatcatcaaaccattttttggagatcaattcttttatgccaacagagtagaagatattggagtgggtatagggctgagaaagttaaacagtaagtcactttccaaagctatcaaagaggtaactacaaacactcgtatcatagaaaaggctaaagaaattggaaagcagatccagtcagaaaacggtgtctctgcagccattcgttgcctctaccaggagatggaatacgccaagaaactttccaagagcaagcagaaatactgggacaaccagagcgaagatattagcgacgacagcgtaagcggatcatggtttgaagtgtaaattttgtgtagcttttcgttttttttttcaactgttctaagacttattcggagatggcagtaagcatacagaagcaactggtaagtaagtaagtaacttttctttttctgctagaaaacggcgggcgcgctcaccatggtaaaaccaccttccaggctaaacgtcttcctcccagaaagtctccccacaatttcccgacaagtgaatctaaccctcgaaatgcccccaaagggtatagaaaaagaaatataccctgataagtcactctttaacttttattcttctcaaatgagctattatcaaacttcaaactcttattccccgttggaatcgtacatgtcactcaatcagataggcggtccatactcgccgcagacgcccacggcagcattcaacagtttatacccaaataccgcttcatccctgtcctcttcggtatcgagcaatagttcagcttcaacttcctcttcaagggcacggttcaacgcctctcgatcttttgatcaagaagatgacatggagttctgtccagagattggattctatccaccttccacttactccaagttcaacccatatacatcgtctaccttctcccctaccagttctcctactgagaagatcgcgacaaccccagccagtctagctcggcccaaaactcgttcaacacttcctgggtcctcgggagccagaacaaataaacccttagaaatagttaatcccgtcacaggtcttagagtcgcctctccaagtactggtgccaaataagcgccggccgcttgtccccttttacaaggctctatacatatcgagtaataatcaggtattgttgataaaatcaataagtagtggatcacacaaatcttgtacttctgcttctgtgtgggattgggactttccataacgtaacaactaatactatttcttctcattcttttcctactccaatttttgtcccacgcaaaccacagtctaactgttgtcactccaatcagcaatccatcgtgtgcttataagaactcctttatttgcccttgtacacgttgagtcaattgtgttgtgtttctctcacctagtcattcctttactcaagaaacctcactctcacaacaaatgtctgcctccaaccccaacttaccttcaaagtggcaggagtacatacctccgtacccagagatgcaggcgtcgaaggaaagacaaccccaaaccacgataaagaaacacaaacgactcaaattctgctatgcttgcaatgaacagattctcaacaaatatatcagagccctggatcatgagtatcatcttgaatgtctgaaatgttacgattgccagcaatcatgttcttctaaatactttcccaccgacgttgtagatccagtaacgggtatcaccagcaaagtcccattatgtgagtacgactttttcaaacgtgtcgatttgatttgccatagttgcaatactgctcttagaggattgtacattacagcacttagttataagtatcatcctgagcatttcaaatgtgatgtctgttcgacagtgttcaaagacaacgagaatttttacgatcataacaacggaatttattgtcactaccattactccaccagatgtgctttaatttgtgagagttgcgacacagctatcctcaaacagttcatatctatcagtagagcaggtcgtcaggagaactggcatcctcaatgcttcatggttaataaattctggaaagtatctgttactcctgaacatttaggattcgataaaatcgatttgagaaaccatgacaacaacaaagaccctattccagagcaaactctatttgatatcgagtcaaaactagaatccaacgttatttcaatttggctgagtttatcaagttatgacgagagctgcgcagtctctatatctggcatgctccaggctgcactttccatggatagaattaaaggtgttgttcatgcgactttgctcatacgaaaagttgaaactcttttcaaaggaattgataccctactgtccctgaccaagatccgtgaccaacctaagaaatcttatgatgacgatacccctcaagaatccgataaagagtttttacagaagaaaccaagatatttggcagtaagagttatgagatatctggcgcttttgagaacctgccttcagattacagattctagcgaaaaaaggtccaaattttccaatgaaactttgtccttggctatcgctttagcacacacacttagattattactacgcttcagtctttctttggcattagatgtgaataaacagttgcacagctgtattggatcccagcgattcattaatgaggtgtcactccatactcaaatacctaaagacggttttcaaaatttgaatatcacttctgaggatactgacttctgcaatgcttgtggtaaaagcgtggaggaggaatgtgttcgattcagcaagagaacctggcatttacaatgctttaaatgctcacaatgtggtaaagattttaatagcaatttaagtgtgaacgaggcagcctacaacaaggagactaatcacatttactgtgataactgttccattaatgataaatattccatcaccggttttacgaaagtttctagattgggtcaagtaatctacctgttaaagatcgcagcttacagatctcacgcagtcatcctcaaagaggaaagcttcagtagattacatggcaaggatgcaacagctcaattaccagtgaacatttccatcaatgaagagtacgatatgacgctgaataacatcaaacgtatgaagtcaataagaagagatcaaccattatctcgttccaagtcacaagttgcaagacgttcccaaattattgaaactcctgatgcagactctgcggaggcaggaaatatcatggaagcatccggattgcactctcctgatctccaaagaattcccccagttgatgtggcttctgcacctgtgttgggtgccaagccctctgatgggaagaaaaaattcaagaaatggaagattaaagagtttggtagtaatcattcagagacagcaaaagatatcgtgtcgaagaactggaaccaaagagatagttctgaaatctgggcccgtgaggacaacttacgtttagaggatataccgcgtatcgcagccgtagaacatgcgagaaagttaagacctaatgcctttagacaccaaaagctgagtctgagaaagagaaacacttcgggtcatggtacagctgaaagattagacttactaacttcgtcgaagggtcaaaatcttatggtggaaggctcgcaaagagttgtatctggttcaccaagactggtttctggggcagtgcccaatagcgggcctctagataagtcagcaaatgtgacccccaagagatattcagagttatcccaagaacaatacaatgcaatgagatatgtttgcgttttcgccttgcatgttctaatagaggacgagaagtctttggacgagatgttgccatatgtcaatgtcaagaaacaaggtacattctgggaaaagctctttggtaaaggtagcgcaggctctaagaattccgaaaattcatcgagagtctttggagtttcactggaagatgtcactaaccgatatggggttgaaagtgacctttctattgggccttcgactttgaagattcctatactagtagatgagtgtatatctgcgatgcagaatatggacatgactatagagggaatttttcgaaggaacggtaatatcaagaagctgaaggttctgattgaacagattgatgccaatccaacgcgattaccggacctaacgaaggaagatccgattcagttagcggttttgttgaaaaagtttcttcgggatctgcctgacccattaatgacattcaaactgtacgagttgtgggttctctcgcaacagtataaagatgattttaggataaggaggaggatattacaattgacatatgctatgctgcccaaaatccacagagatgttctagagatcctactattcttcttctcgtgggtttcatctttcagtaacatgggagaatcgatgggtggatcaaagatggacattcacaatctttctacggtaattaccccgaacattttatatgacaaaccacctaacagcaacaatcctgcggatcttcttcctcaaggagataactatttcattgctatagaagtggtcaaggagcttattgaggagaatgattttctggcgattattcctgctgatatatggcagttctttgtggaagctggatttgacaatttagcgtctggacagttgatggcatccaaagagataatatccaaatgcgagcaaacattaaaggccaacccaggattatttgatgcgtctacgctcaagcaactaatccccgaaccagaactttcgcctgaagagccaatgacacctttaaataatgtcaaccgtgcagtcaaggtggatggtggccgtaaggtgactgctgtacaagaaaggcaaacttaatataaactacagaatgataacaacacgttgtaagtaataatataatgatagtaataaccaaaggaccacctcaaggtttcgagcatctgacatcacgacaatctcttacaactgcacaagactgattcgcgtcctaagtgaaaagtaactaagaaagactttgaaccaagcgatggacgaggcagagttgaacgctattagggcggcaaggatggcggaactgcgtcaaaaccaaggctcaggggccactcaagggagcggtactgctggcagcccgggagctggctctaacgaccagcatgaaaatttgctagcgaacgctctaactacagaggctaaggagaggttgagccgagttagaatggtcaagcctcaccgtgctcaggcagtggagcaatatgtggtacgattggccacctctggccagttgagacgtaggctaggtgaagaagagattgttgagattttggacggattggctcgagatgagcaaaaacagtccggtaagatcgtattcagtagacaacaaaaatacggtgacgatgacgatgacgggttttttgattaacttcaagccggttcatcgggaagtgtgacttaggagaggtatataggaacaactgttctgaccaataggaaaaactaaatgtaagctaatagatgtgttactaaacagggtttggagttggggggtgtattttgatatcgcagactaaacaggaaattgtcgtttccatgtccagataattcgagcgccattctcctgttaacaggaaaggacaagtccagagctagtgaagggcatgacacagtggatgggccaactttgaaatgttggtcaaatgagccatcttgagaacatttgaaatcacaaaaatgtttgttctaattctttggcatgtgattggaggagaacggatttcagagtttttcaccagagaggatgagtttccatcggctgcccctccccctctcctacatgatatatgcctatattcccgaaaatattttgaaagtagagactcaagttcccgaattcacccctcccccctcctaaggaaatcctttcttcctgtcgtttggcaacctgccttgcaaatgcactcgtcgcatccaccaggtactccccctaatagtagcgaaattccaacctcccatccgtttaggttgccagtttcaggagaacacccagaacacaaagacgccgaatcaaagcaaacgggacttcactccaagcattcctgtattaatcatctgtcctcacagtttttgcttttatcaacagcttgccaactcaacacagtcttttgaaagacttattttttagacttttcaaacgaaacagcgcttagtaaggagcctccaccagtggctgtaattataagctcaggttacttaactacatcttttttttcgcaaatcacttctattacagcttgcttcaaatggataatccgtttggacaggcgtccgcaatgaggataccaaccaatagtggagcagctagctctgctaacggttcagagcctatcaatataaatatctcaatgacacatcaacagcacaactacaatcatagccacaatcagcaatatccacagggaaactccaggcggaattcaatccatcccaaacttcgacgagactctattgcccactcccaaggtatgggaggagtgtcatggggttcggtggcaatcggatcctggctaaaagacgatgtactcaacctggctgtatacaatcaagctccaaaccatcagtttagtaccaatcatgccatgttcacatcgaatatgacaaccagttcatccccttccattcaaaatacaggatatatggccaatttggaagccgactattgtaaagattactcgtgctgcgggcagctattgccaacattgcatgatctcttacgccactatgaagagatgcacattcagccctcgcctccagaaatggagacacccaggtcaaaggcggtcaatagtattttggacactgtatcaacgaatgaggtgtttttatcccatcaaggaatggagccacaatttcaagttccagagtttgactttgccgtcacgaataactttcaaaatcagcattctgaaacttctggcgtggatgatcccacacctaaaactcagcctggagcgactgtaggtgctgggcctcaatctcaaatacggcagggccagcaccaacagcaacaatttcctatggacgaagatgaagatacggaaatgtgcattgatgaccccgctcgtcatctatacgttagtgaacacagcgaacatagaccttttaaatgtcctgttgttggatgcgataagacctacaagaaccagaacggtctcaaataccatcgtcttcacggccatcagaatcaaaagctacatccaaatgaggacggtactttttcggtcatcgatcccgaaagtaacgcaccatacccggacggcctggggcttgaacgggataagccttataggtgtgaagtctgtggtaaacgctataagaatctgaatggtttgaaatatcatcgaggacattcgacgcattaacggaatgtaggtagagtaaaactagatttcaacaagcggtgacaggttttgctatggagataccatttcaacttcaattaactggttagagagggggtactgggggccaagaaccacccatactgttcatggttgcaattataattttgattcacattttgtctttatgataaactaattttccccatcaggatggctatctgcaaccagcatcttacgcattgcaaccttcttccagtccaccatcctaattttgttccatagcattttaatttatataatttatatacagtttttccttgacttgtgatgtttggaggctgtagtagtattccactttctgatgttgggatttactccagacttgtaaaccttcttgtcaacatggttgacatatcattgcggattccattatttttgacccgtactggtctttatgtgacattgatcactacttctgtagtcttgttgctgttgccgctatcaattttgtcataccttcggttttatgagctacttattccgattccgaagcaacacgttccagtacacctcaatacaaacctaatatcatcaaagccagacgggacgttttatcacaatggtgacttcatcaaatttggagttctcaattctgcacagttgatacaacatttagaccctgaagtagattataccgtcacgctcataataaaaattgtcggaacaagttcaacttcaaccgaaacttctgttcctgactcaaatgttccactgagggtcagcatactatccaatcatctcctcaattctctcaagatatatgatataaaagggccaaggaataagttctggcctataacggatgatcttctggttccaagtcaatttgataaacatagtttctcatcaatcccagaaacttttacattcacaggcaaaggggtgtatctatgcacgacaagtgtacaaaccatctacgactaccataacgagaacgagttaatcctttggaaaagttttgaaatgaaaatgtttatacctcccctgttcaaaagtttggtacctcctttaatatttaactatccagatcgaagtgaagacgattccaaagtcatcaaaatgacagtttctccgcaattccgactcccatcttccaaaaaccatttgtatcaactaacacaatctcatcttttggtggagctcgcttcaaagtttaacaagaacatccccttaaactctgattcccttgtgttgcaactggatgtcaattggcatggggcaagatattatatataccaccatccactaatctcttttttctttggggtatttttattttggggtttcagttctatgagctgtgttgcaattgggctgtccttatggtacttcttcggcaagacaacatccgtcccaacccaaaaatgagcccttgttcattcattaattggcattcattttattgggagattctgctggtaaatacggaatcaagagctccatctcagcatgcacgttgtctggattatgctcatatcttcgaacaccagtctgtgaaaatgtcgtcccactattgagcatacccacattcatatcccccagctccaattgtaattgcttttcgttgcaaaatgtttcatactctttcacaaaagaatcccattcgttcaagctcttacctatggttccccatttttggaccaaatggtggtgttgattttgaaatagtttatcagtttttgtcttccctgactcagatgcatttgtatctagcgaaggtgaacttaaaggtgtgcaatacttcttttctttgtatttgccgtcggccatgcttaaatacagagattctgaatctgaaactgatgcgcctgaatcactcgatgaagaatatatgaggcctattccactattttctctgtagatcgagctgctcaaacgtggtaaacgtggtactgtgataattgatcgctcctctagaattcttgatttgggccccattaatctcaaatgtttattcatttgtgaatctacagggatgagctgaaatttatataaaggcttaatcacctttggaatgttcagcattatcttgaattctcttggctgcgaatcacttgtcaaccctaaaactcctccaaatgtatcatcaaacatgcttaatcctgatttgtcactggaaacactttttatgtcgaagttactggattcatcatccagagacacattaaccactgaagacgtgggcgaatcaaacgctgacttgagagacgacaatgacaaagacgatgagaatttctttcgagccacacaagttccaagcgactccttcggcgtagtagcctcagacccagggacggactgtgttttgggagagcctgttggagaattggtagcggagtcggacttgttcttgaaaaacttcaacgccgactccaaagaatgcacaaaagaactcccacttgatgacggggacttcggtgcctcgtctgtatcttgaatggtggaaagtgttgcagatgacgagtgcttagaaatcttgtttgaggattttggaacaacaatggggactccagcccaagtgtaaacactatcgtcaaaaacttcgaatgggtagttcgttttcttgtctatggcaaggtcatcgtcgacattcggagaagcgttagcagtggtggccatcgtcaaatcttcacttgataatagtgattgaaagttatacccaccattgttcttcttacagccattattactagcgattgttaatctatggtttaataatggggtcgaaggtttcacttccaattcaggtacgagttctgccattcttagtgcgattgaatgagacctcttcagttttttggtcactaaggatttgatttcgtcatgtctatagctcttaaaggagagaacgccaattaccttccatataattagatgctggtaatagcaacgtaataaaggttgccaatggttgaaaaatttatcccaatggcttaataggtaataacttgagttccacctatatcccttctcagggctccttatccatatggtttcacttttgatcggttcttcaagaaggggaatgaaactccagatgttgaacaatattgacaaagcctttaattcacaaatgatgttcaacgtatctgttaacaatcgaaagagtgcatccagccaaaaactccaatcaatacatgtggtagcagagttgtcgacatggagaaccaattgataaaacaagtctaataccacacaactctgatagtaatcatagcatgaaataaaggatgccattttcactaacgttcgatctatctttgagagaaatatgtcaattaatgccacgtcgaaactctctttatcataggacaggtatcgaaaagtcttgaacagcttcataattggagctggtagctcataattgaagctattgaccattgataatatgttgttcgaactatagttaatattgttattggaggaactgtgcttcttgaatgccgatctacattcaaaagcatggtcgatgatctcttcaacatggcacaaaatatggataaagcctggaaatttgagaatgtcgtattcagatattccagaatgacaaatatatccgttgacaatctttaggtaatggaaaagaaatgaattaaaaacatcaatgttcgtgtcaacattgacccatcgagtcacccaaacccccctgggttccaatatcccaggaaccttacctacaggaggctccattgagtttaaatgtttattctgctgagaattaatcttttctttgactgttcttcctttaaaatcatatagctttgaagcgggaagaaattgagggaaagggttcgtagcagcacattcattttcggccttttgacttggcctgttatggaatttgcccattcggaaatatctgctatttcgaatattgaatatgaataagagagcgttcgaaacattgtctagatgaaaaaaactgtaggcaaaaaccttccctatcattccattaacttgtagtgagcacttttttgtcgttgaattcagtctgaatatgcagtattccaaagttttggcaagataatcctggtacttggtgtagttttcattcccttgttgtgtaatattaaaccattcgggtcttgaaataatacgagatatgcattccaggataagcggtatatcagacgactttaatgcagatgctggtttctgtgaaggctgagatgaattagttagaatgttcagtaatatctcccaccattgtagaagaattctaaagccatagtccatcactgagagaggaatctttcctataagtatgttggagtccacgctcgtgtttcgtagaaaagggagcaaccatattctaagaaagttcgttttggacactccagatttggatccttcaaacttacaaatccccttatagagaaacttgtatgcagccgacaactcttggtcaatacttatttctttagtaacttggattcctctttcctttggctggtttttataaacggtaagcctcttcaggttggatttgctccgagattttgtgtccattcggggcgaatatccgtcaactgtttataaaatgcaaaaatgaatgctactttgtttcagtgtgtcgttgaagacttaacgggtggactatgagtgcagtatcacaaataaagccaggaccggaatgaagggggaaaacgcagcaaactattgagatgcaaaggattctggatgtaaaatgagagtctgtgttgctgactgtaaaggaaggacaaaagagagatctagccttgtacaaagtgtgcttcgggctgttgttatgcttggcggaggtttgttcagtttctaaattgtatttctgataccaaaaatatcccaagctgaatcagtgtgcacgtgacgcttaacgtgatctgtatcttttatctgtggaaaaggtgtcttggctaactggagcttttcgaaggtgtggaaaatgttgccgggggctttgaggcttgtggagtgtgggcttggaattttcttttcttagattgttttgcaaggatggtgctaaagacgtttggttgatatctgtggtgtgatgtacgacatgcatactgcggtaggtataaagttcgatcacctaatacggaaactgagaaaaaaaaaaccacataggcaagaaaggttggtagatagataactagtggacgatgctgtggtgggataaggccatcctcgggctgaccaagatgatggtagatgtaccggggatgtgttactgaaatttaagtgtcaatgtcaaagattctagaacattttcaaataatccgaggaaaaattaaaattcctttctcatgttttagtgtggtatccttcttttttgtgttgttccatacaaatagtttggtcgcggaattgattgtcctgctgtcaacaatccgatcgctagccccgcccgtcgctcccgtagacgttcctcgctcgccttctctgttcgcgaatattcgttgtaacacgaccgaaattttctgtgttttcaaagctttgaacatcacacgctctagctttgcttcatccaatccgaaatgagcgtagaggacagaaaacgtcttgtggacgataatccacctcagccggatcataaaaagcctaagctgccaaaggtactggatcagttgagcgagcctggtgagatgttgacccagaatgacatagtatttttcaagaaggaagcgatatggcgacagatgaatcacttcaaatctaacgtgaatctaatcggttcagagttggaaaagtacaaatctggatatgctaaaagcgtttctcatttgagcacggtcaatgagtggatagaccagcttgttgccgctttcttggagcaaggcttcaaagtatcagatgagataaatgacaaactggtcgtagactttgattgttccccggaccaagaggaaggcgaacatgtaagccaattactggagaagctcagagagaagagaataaccctaatcaagctgtttactcccttgttgaactcgaaactgggtgatacttctgaagacactgcagctttgaaagattctctggctagagcccatagagaaaggagtacgttgattcaggagaataaaatcctgaactcgactcttaaagacattaaacaacaatatcttgatattgtcaaagtaaaggatagactggaatctaaatccttgagtagaataaacgggaacaccgaggaaggtcaaccggcggagaataacatcaaactagagcctagtgatggtaacgactcagaaacaatttccacaacagctgcgaaaacagagacaaatggtactcctgtaaataatgaaacaacagaccatgatgaggatctccagaataatctggaaaaggtaaagctggagaacagcctactattacagcaattgcaagaaacacagcaaaaactatcaataaatgagaagaagctccatgagttgaatcttgtgttgaacaacctatctggggatatgctactaaagaatagtgtggtatatagttctctttattccaattataacgatttggaagcaaaatttaaagagctgcaagatgccgataagcttaacgtggagattgtgtcaaagttacaggccaataatttagattttgagaagaagattgtccaagaattcgaaaaggaaaagaacctgctacagaaacaacttgccaaaaacgaacaagatctggcaagaattagaagtaatagggacgagctgttatctcaggtcagcatgctcaaggctgaaaaggacaaggatctgctgtatcaagagttacaaaagttgattgatattcagaacgctagaatagatcagttatctgcggagaaacaagtgaatgaatttgaggataaaggtgaggacagagatgtattattgaagaaaatccagttactattggcagaattgaaagatattgaagctgttttcaagaagactagagaaatcgaatctgagaaactcaaacaatatgtggactctagttcagtgataacaaagttgaccaccgaaaaaaacaaggctgatcagaaatactttgccacaatgagattgaaggattctttggccatggaaaacaagttgttgaaaacgagtttaagcaaaagtaaggagctgatcgacaagaacaaagagttaattgcggaatatcagtccaaggtcaatattttacagaacgaacttttaaccacgttgaccgaactcaataagaagaccaacgttgatatttctaccatgcagaagagtttgaatgaactgatcaattcaaatacaatcttgaagcaacagttgtctttacgagatgccgaggttgagaataagtcccttgaagttctggaaaaagatgttgaactcaaagaaaacaaaagactcattgaatcattgaagtttgaaaaggaaaaactaactgatagaattcaaaggtaccgagaaaccaaatcgttaggtgacctggatgatcaatctaccagcctggaaagtttccgtaaactagtttactgtgacatttgcgagcgaaatttcaagaaagttgcagtcactacatgcggccacactttctgtaaggaatgtattgacgataggatcaactccagaatgagaaaatgccccaattgcaataagcctttcagcaagatggatgtcttggagattcatctgtagtttaatattgtataaagatgtatgaatagagagtataatagatgctaatcaaaaagggctgtacgatggtcggggtggattgcctgtttcatgtgcgacagatgatcttctctttttccttccttccagggccctgcccgcattttgcttgatatccaatattcgcaatcctattcgcatgaaataatacctaacacatccccacactccttatcgtcctccgcttaaccttcgttgtcatcagaaactgtcggaccttaccgattagctcgatttcacaaccttgccaacgttgtgccgcggagcaaagcgaaaattcaaccaatcaaggacccggcgaggtatacggcgtcgagcccgcgatttgacgtcgccgatattgataagaaatttcctatcgtatgtaatctattatcggggaagtcaaagctctcgtagaaaaaatttaatgtataaagagatggagggtgaccggatttccgatctaactagacgcagaagcattattgccgttgaatacctctcacacataatagttttttatctattcgtttaacttgtaataatggctgtgatagatactactggctggactacatcacagtggattaagtaccactcggaacatgacccggaagaatcttttcaattgctcagtgcactagtttcttctcagaaaactgcacctgaagatccagtctggatctcgttggtatctgaagacgatctgttgcaccaatggaagattcttcagtctaaatcagataagttccaattaccgttgtatggtgtcccaatcgccgtaaaggacaacatcgacgtcaagggtctgcctactactggagcttgcccctcgttcaaatactccccacaatcagatgccaccatcgtcagtctcttgagagaccagggtgctattgttataggtaagactaatatggatcagtttgctactggtcttgtgggcactaggtctccatatgggaaaccaacttcagcttttagtgataagcacgtttccggaggctcttcctctggctccgctgtggtcgttgctaaaggtatcgtgccaatctcgttaggtactgatacggctggatccggtagagttcctgctcatattaacaatttgattggtcttaagccaactaaaggtgttttctcttgccatggaattgtacctgcctgcaagtctttggattgtccttcaattttcagtttgacactgagtgatgctcagctagcattcaacatcatggctcaacctgatcttgcccaagatgaatattccagaccaatgccctccaacccaaagaagtatttctcatctgctttgaaaattgccatccctcaggacattccatggtttggtgattcggagaacaaaaagatctataccgctgccgttgagtctgcctccaaacttggcgccgaagtggtggctcttgatttttctccgctacttgatttggctaaatgtctctatgaaggcccttgggtctctgaacgttgggagtccatgaaagatttttacagcactaaccccgataacaaagatctggatcctactgtcaccagtattatcaaaggtggtgaaaagtttgatgctgccaccactttcagatttgagtacaagagaaacgccattctgcaaaaagttaaggcttcattcagtgattttgatgctcttttggttcctactgctcctttgaaccctactttggaagaggtggaaaaggaaccagtgctggtcaactctagacagggagtttggaccaatttcgtcaatttagctgacatgtcggcattggccgttccggctggctttagatctgatggattgccctgtggtgttaccttcctttcagcaaagttcaatgattacgctttgctcgaccttgccaacagatttttcaaagtccattaccatgagggtgtgagaagacttggagctaccaatgcagaaaacggtatcggggacgagttgttacctttgcctaaaccaaacttggatgactgtgttaagctggctgttgttggtgctcacttgaaaggattccctcttcactggcaactaattaagtgtaatgctacttaccttgcttctccaaaaacagctaaatcttatagattgtatgctctaccattgaaagggggacctattgccaaaccaggtcttagaagagttgatgctgatatcggtgaacaaattcaactggaggtttatgccattccaaaggaacactttggtaccttcatttcgctggttccagagccattaggtattggatctgtggagttggagtctggtgaatgggtcaaatctttcatctgcgaagagattggctataaggctaaaggaacggaggacattacttcatttggtggctggaaaaactaccaagattcactgaaaaaacacgcagaatctcaaaagaaaccttttgatgttgttttagtagccaacagaggtgaaatcgccgttagaatcatcaagactttaaagaaactcaagatcaaatcggtttctgtttactcagatcctgacaagtatgccgagcatgtcctgatttctgatgaatcagtggcattgaatggtgtttcagctgctgagacttatctagatgtcgagaagattgtcaaagcctgtaaggatactggagctcaggctgttgttccaggttatggtttcctttctgaaaatgctgatttcagtgatagattaggcaaagaaggtattgtctttgtaggaccttctggggatgctatcagaagacttggtctgaaacattctgctagagagatcgcagagaaagccggcgtaccacttgttccaggatctggattggtcacctcaacaaaggaagccaaagagattgcagccaagctagagtatccagtcatggtcaaatctactgccggtggtggtggaattggtttgcaaaaggtagactctgaggctgatattgagagagtttttgaaactgttcaacatcaaggtaaatcttactttggagactctggtgtctttttggagagattcgtcgagaatgctagacacgttgagattcagatgtttggtgatggttacggtaaagctattgccttaggtgaaagagactgttccttgcaaaggagaaaccaaaaaatcattgaggaaacacctgctccaaatcttcctgaagcaacaagactgaagatgagaaaggctgctgaacagttaggttctgctatgaactataaatgtgcaggtactgtcgagttcatttatgacgagaagagagacgctttctatttcttagaggtcaatgctcgtttgcaagtagagcatccaattactgaaatggttactggtcttgacctggttgaatggatgctgtacattgctgctgatatgcctcccagctttgaccaagagatcaaggtcactggagcttctatggaggcccgtctgtacgctgagaatccaattaaagacttcatgccttcacctggtcaattaactgaagtcgagtttcctaaatgggctagaattgatggttgggttaaaaagggaactgtagtgtctgctgagtacgaccctactttggctaagatcattgttcacggaaaggatcgtcaagatgctttgaaaaagcttagacaggctcttaatgagacagtcgtccatggttgtatcaccaacatcgactatttgagatccattgccaattctcaaatgtttgaaactgccaaagtggcaactaaagttttagattcctacgactatgttccaaaggctcttgaaattttagctcctggtgcttatactactgttcaggactatcctggacgtgttggatactggagaattggtgttccaccttctggaccaatggatgactacaatttcagattgtcaaataagattgttggtaacgctaaagcagctcctgctattgagatcactttgaacggtcctactattcttttccaccacgatgctgtgatcggtgttactggtggtaatgttgatgtaactgtcaatggaacttctgtttccatgtatgaacctgttaagcttagcaagggtgacaagttagccattggcaaattgacaaccggttgcagagcttacttggctattagaggtggtattgatgtcaccgaatacttgggttccagagctacatttgctttaggtaacttgggtggatataatggaagagtgcttaagtttggtgacgttttattcctcggacaaccagagttacctgcttgttcgttaccatacccagaaagtgaaccacaagctgttccaaaagccttaattcctcaattgccagctaaggaatgggttatcggtgttacatgtggacctcacggatcaccagatttcttccagcaggacactgttgaagagtttttcaaagaacagtggaaagttcactacaactctaacagattcggtgttagattgatcggtcctaaacctcaatgggctagaccagatggtggatccgccggtttgcatccaagtaacactcacgattatgtgtactcccttggtgctatcaactttactggtgatgaacccgtcattttaacttgcgatggtccttccttaggaggatttgtttgtcaggctgttgtagcacaagctgagatgtggaaaattggacaggtcaaacctggtgacttgatcaagtttgtgcctattacgtgtgaaactgctgtttctatcaaagcctctcaagacgcttcttgcgatgatctctctggaaaactggttgagatttcatctgtgaagcagttggatggacctattaacccagtactctacaccattaagccagataaagaaactggactaagtgccacatacagacaagctggtgatagatacattcttgttgagtacggtgacaacaacatggacctcaacatgtcctatagagtccacactctcattagtatggttgaaaagcataagaccgttggtattgtggaaatgtctcgtggtgtcaggtcagttttggtagaatatgacggaactgcaatttctcagaaagagttggtagagatcttgcttagatatgagcgtgaaatccggtttgtgaacaaatggaaggtaccttccagagttattaagcttccgatggcttttgaagataagaaaactttggatgccgttactagataccaagaaactattagatccacagctccttggctacctaataacgtcgatttcattgctaatgtcaataacatccaaagatctgaagtgaaagatatgttgtactcagcaaggttcttggtgcttggtttgggtgatgtcttcttgggtgctccatgtgctgtacctttggatcctcgtcaaaggttcttaggaaccaaatacaatccttccagaacatttactcctaacggaacagtaggtatcggaggaatgtacatgtgtatatacactatggaatctccaggtggttaccagttagtcggaagaacaatcccaatctgggacaaattggttttgggacaacactctaagaagtttaacgatggtaacccatggttgctgagtccattcgaccaagtcgaattttaccctgttagtgaagaggaagttgacaagtttactgaggaagccaactgtggtcagtttgatgtggatattgtcgacagtgtttttgaccatactaaatacttggaatggatccaagcaaaccaagaatctatccaagcgttccatgacaagcaaggcggagagcaattggcagagtttaacagacttattcaaatagcaaacgaggagttgaaaaactcgtcatcggttcaagaagtcaaagccgatgagttttcagaggacgctgagttggtctattctgaatattcaggaagattctggaaaccactggttcaaactggagatgttgttacggaaggtcaagggttagtagtggtggaagccatgaaaactgagatggttgtcaattcgccaagagctggtaaggttgttaagattgttcacaccaatggtgacatggtagacgctggtgatttggttgttgttattgaatgaaaaaataaaatatgactcaaaggaaaaggcttaatggtgcttggttgtgagaggccgagatattcagcgagtttgatcctatatacaagatataatgttctaatatgatagtaaatgtatttaattaaggtagcaactcatagaacaacatgtaagctgcacctgaatccttaagaacatcttccaatttgtattcagtgattttactatcgcttatcttccagaatggattcttgaccgagctggaaacaagtttacgagtaggtttcgactgttgatcacttgagtttgctggcgaattgtcatcatttagttttggcattgatataattgaactcatccttcttctaaatcgagacccagagctttctggagatttgactgcatctgaaggtatgtcttgattagattcgtcaacttctggagacggatccgataatggagtttcaggtggcggtccagcagtttcttcggctggtgctttgaaaagtaattcaggtacgtcgcttaaaaattcatttgacgtggaagttttgtagtagtgaggttttcgtctgtaacattcatagtgtccaattctatgagatccctggtggcaaatgacggcctgtaatttgtaagtacatttttttattgatgtctccgattccacttttgcagaagactctagattttttgactcattatcagcgttggtaacagtgttggacgattcgatgtgttcgttcgatgagagggactcatcctcggaatcttgacctgcattttcaacaaacattggttcttctatccctacatgcttctcatcttctgtaaaaagtaagttcgggggaagagtctcgctggaattgttatctattggtttacgctccttagcgtcctgtattgcttctttgagtttctcatcaatgaatttttgagcctcttccaaaatggattcatttatatctagagccagaatttcatcaaattcgactttgcaactatttcgaactgcttgcgactgaaggaaaatcgatcttgatagatgaataggcaaaatttttggaggttttgccaaaccatggtttcttataagggtggattttagctgatatttgtaccttttgcaagtttgatcaacaaatgcttgtaaagatggtggtagatcgtcattaatctttaaagtgacattgagtttctttagttgtttaagattctcccgctcagtgggtgtcggatctggagatttagataatacatcaatgcagaatagtacgttacatttaacgcaattgtaaccctcaattacctctctctgattttcttttatcaaatctggcaatgagataaaaggtttccttggcgttggcaaggaataaattgccatatgatcaaatcctaaagatgatgaaccaccacattcaacagatctcaattggttaatcgaaagtgaagagaaagggaactggggaatggaaacaggagaatcattgaaaagttcttcgttgacgccgataaacagctgaaccgagacatattccttttctaaggtttccaaaattaattgtaatagttcatgagcatcatgttgggatttagagattcttgagttaaatattttctccaaaacattaaggaatgaccaaacagaaatggatcgtcgctcatagattgtttcctggagctgactcaaaagaatgctcaaggcttcatgtagaggtgtcgatggtactgacaaatcagaagatcttgtgtcattgtgtggttcttcatttgagcgtctgtcctccaacaatttacctaatgcgctttgggttgaaaaaaagtcattcaaatagacattcaacccagggagtgatgccaaagcttgaacagtggagttggcaaaacagtctacggtggcattaataagtccagttgtagttttatctggtcttttcttaaacattccgcgtggttctctattcaggcaaggtatcgatggagcaattatgtaataggataggcttaaaagtgctagcgttagcaatgatgaaaatttcctctttgaaagccactgaactactggtgatgtttgaaaagtatacgtggagggctgagcaataattaaactgggatgctgtggagaagatctgaataagaaatttgttagatggttggataacgtttcttccaagtccatttggtgtgattagtattgataagcgaggggttggagtgcagatttactcggcccacctcgcggaactgcgagtgtagaaagattatgcttatgggtacgatgattaagaccaaagtggtgagctataacactgctacaaggtaacatccttccaaaacttggggtcatccatatatgtggaggtttcgatatttttctgaagacatgaaatttgctagataatgtgcataaattcttcttggcgacatactgactagcccccaagatcattcgttaagttcgatagatctcgaagccctgactggcgtcgaagattcttactggggtgtggatttctagaattccccgagttcaagtttacacccgaggggacttctactgcattgcgtatactgacagagtaaggtttgacgctttatctctatattgtcataagccaatggactggaaacgtgagagcagctaaatcagacgaatatcactgactccgcagtctagccgatatgttctggaagcattatttcaccaaataagtgtgtctagcagtggagaaggcaactgagataagccatgccacgttcacctgccaagtttcaaaaagtcctccatcaaccactatggtaattacagaaacaggaattaacctggatgtaagctaccaggaagatcaaaatcggtttatggatactcaacgtttaattgttagttttgaaagaacactgttataatccatgaggtggatgaattgccaaacttcccattcttttcagccgatatcacatgaatagattccatctgctcagcacaaattctagttcgacatcatcaattcatagttttcccttcgacaatcatgaggagaaaccatgttcttcaatgtgaaccgttatattgcttatgtaatatttatctcattaaaccttttgcataagtcttatgcattcttgccttcgattatttattcccatatattcctttaacgaccacctaatgatatgaccgatagaaacagtttaagagttccaccaatgaggggcccacctaactcttcttctagaaagcctcttctagaaacatctctttcagcgccaggcgctggaccaagaagacaaaagattggactgaaaccgggacattctgccatggattgggcgcagttgaagcagaataaaggaaacgcattgaaaggcaatatcgatccttctcattttcctctcagagttaccaaagaggaattaaaacgacataactcaagagatgactgttgggtagctttgaacagaaaagtgtacaacatttctccatatttagactttcatccaggaggtgtggatattctaatgaagtgtgccggaaaagacggtacccttctatttcagaaataccatcactgggtcaacgcggatagaattttagactcttgttgggtaggaatcatggtgtaatccagtcactaaaaattaagctaaactcatactgctataaagtgatcatccatagaatcgaccgaatcgtcgtatcctgtgctcaaacacacatttttgggaaatagtccaaaaaccttttgagtcacctgaaaatatttctgttgctctgaaataggtatgtcagaccactcagcatcaatttccgggatgatctggcggtaaagactaaacaattgttgtgggagcataggctcatctgcatcttgagctaattcttccagtagttccaccgctggagaaagatatgtctttttcagtttcaactctgaagtccactttggagaacttaaattatctgatatcttgaacgctggtttatcattttccttcaagaaagatgctgtagtcttagaaagtttcaatatttggtcccctgaagatgacgatgatgttgaagaggtattggtatgttttggctgtagaattctgtctgattgattggactttggagagttcttccgaaagtttgattcctttaaaaccttaaaggatggctctttcatcgtttgtattggagttcggagtggagaatcgggtaaattaattgaggatttggtttcgtcactttttggatcttgcttggtagcagtatctgtggatccagcttcatcatccttaagttcagcacttttgaactcttttttttggagattcaggagtttccactaacttgttggcctcctctgtgaaaaaactggccagttttttaactgtgccctttggaatacctgatttggtcaacggtatttcttccaattcttgcatccaacttccttcatagtactcgcccaggtaatgtctttgagtgtttggtgtcagtttccgttctcttagtattggagagtactcataagtagctctcttagtgtcgggtaaacttgtgagataattgtcttttgtgcttcgtggaagttctctccatttcgattctcctcgctcccatagctgccagagcgtaatgttgggccccatttctgcaaagatagcctgttcgttgtccttgataaactttcccataggggatgaattcaatttgttcataaacttggtgattacctcattcttgtgtttacccaaacttgagtaatactgatcaacagcactatctaaaagactttctttggcttcgaaatcagagattggttcctttaagcttgctagttgttttgaagtttttatagaatcgtcttcaatgaatggagatttactattggtgttgatattgttgggccattgtgtttcgggctcttcttgaaaagaatgcctaaggatcttcttaatatctccaatgtaggggacaataagttcaccgttagagtcatcctcgttgaggtacttgcctgcttccttaattttccataacaatgaagcttttctgttgactatattttggggagtacatggaggttcaactttactatgttgggtgggatttcgagtgggtgttgatggagacgagtttgcagaagaagccgtagaaggagtttgaggggattttttaacttgaaacttttcggatcttctcagtgggctttctgaagatcctctgttaaaaccctcagctttattaagacaacatctaggctcctcttcgggtagagctcccgcaccgaacttctccactgaattccaaaagtcaacgtctattgatcctataatacccttcattatgttggtgtcatccttgaaacccatccaaatatcatgggatggtgcgccaaaatcgatgcttaggggtctgggtttgttgctgtatcgtttcaatttgcgaaacatttctggtatagatggatgctgatggctagtggaagctaatttgatcttttctttatctcgttctttgtgggattgcacagacacaaactcctgaattcccctcatagagaggtatataaataggggagatgtggacatgatgcaattcttgacagcaaatgacgggtcagatttgctgttgtgatgtgatgattttgatgtttacaatttacttcgaaaacctgcttaatatggggtcgcgacacaatctttgttgtgagctacgatttcagaatcttccccaggtttccagattgggaatgagatacaggatcactttgagttactctctctttattacttttaaaattaaactacaagacagaattactaggtaacagcatgtcagcaagcacgggcttgtttcgcctcagagaatccgaatgattcggataatcttatgctgatcacagcattggtttgaacggcatagtagttcggattatcttctgatcacatgaccaggttccaacagaagaactggatctttgcccaatctctaatataatagccgatatcccttttatatgtgttctgactaagtaatgacaacaaaagatttgctatacaagaaatttgtccttttcggtgactccatcacccagagaacctttgaccagtatattctaggcggggacccctcccgattggattactcgctgggtgcccaactaacatcaatttacaataggaagcttcaagtgttgaaccgaggattttcaggctataacaccgaacatgcccgccatattcttcctgaacttttaaggatagagcacgatgaaagtaacagtaaggttgaactgatgtggatcttctttggttccaacgacgctgttgaaaagggtttacaaaaggttgagttggaaagatatgagcagaacttaaatttcctaactcaattggcgttggatcgtggaatcaaagttattcttattactccaggagtagtggacgattctgtgctttctcagagagatcctgaatggaaagatggtcattttcgaactacaacaaggaacaagatgtacgctgcagccgtgaaaagggtcggcaagcactttaatgttcccgttctggatttgctttccgcattagaaacacacggaaactttgaacaattgctggtagatggtttacatttccttggaaaggcttaccaaattctattcagagagctactgaatctcattgagaccgagtacccagaacttcatccagacaaattaccgatgaaacttccttattggagagacatcgattcatctgacatcgaaggaagtttgaacggctgagtcgtaaaatctcgggcactatttttaactttccagatgagccgagttattacgattttctttatgctcaatcttccattttagttaatttagacgaaatcaaatacactctaaaacaacactcatttcatctttcagtccacccaaaatctaccgtctgtctaggctacgatcctccacttttttgccattccccggtaagttatctatccgttcctgaatcaggtgcatctcgcgaaccacaactccggaagaattgaaatttcttaagtataaggaatctgcctggtcacctcacattcttagtacccaatgtcactgttaccaaaatgttgaagctgggttctgtaatatactcagctgtgaagccaatcttcaagatatacatgatcatggggtgcgggttttacttcgcccgcaagaacgtactatcagtggatactggtaagaatatttctgatatgattataactctaatcttgccctgtcttgcgttcagcaagatcgtcaacaatattgacaactcagacatcaaggaaattggtattatagtactagcaagtgttgtgttgtacggctttggatatttgggttccttttttgtctcgttgttgccatttttccccaaaggccgatgtgaaggaacatgcctttctgtaggaggattccccaatattagtgaccttccaatcgcttatattcagacactttcttcgggattggtattttccgaagcggaaggagaaaaaggggttgcatacatttgcatttttcttgctgtccaactgatatgccagtttaacttaggaggctatcggttgattcaacgagacttcaaaaatttcactcctacagatacagcctctttatctggaactgaaggcgatcataagtttgaggaagttaaaagcatcactccctccaagactcagacccgaaatagcgtatcactaccacccacgcttaggccaatgccaactattcaagatgagcagtcaattgattcccaaattgatcccagcgtgacaagcaatagtgatgaactatccagcacgtcagcttatgcagaaccacagaatccagctcccctggttcgtgagaacacaagtgatattcatcgcagaggctcaatcatctccagaagtaacaggtctcaaacctcgttggtatctaacttggagcttcgatccatgccctcacagaatttaagagatttggtcaaatactattcgcatgcagaagaggatgcgactggacccatggagaggccacctgttgatgcagagtcaaaccagccagctagtaaatctacatggcatcagttccttcatgggttcaagaaattcctatttgagcttatagataactgtcgtaggcctgcttccattggaatcatcgctgccattatcatctctatgattccctgggttagagcattattcgttctgaatgaccaggctttcgtggataacgctcctgatcagctcccaccattatcatttgtaatggattttgttaattacattgcagatgcttgcgttcctcttggtttactaatgttgggtgcgacaatagcacgtttgcagtttaatggtttacccaaaggcctctggaaagttccattgctgctgactattctcagacttataatattgcctatattaggtgtgctggtactaaccaaatggcaacacaacggatggtttgatgacaacaaaattcttgaatttgtttgtgcaatcaattttgggttgcctccggcaacatcactaatttacctctgtgcattttatactcctccaggctatccgcatacgatacaagtggacattttagcattgtgttacatattccattattctgctatagtgatcagtttaccatttttgactacttatgttctcaaagtatccttgaagctttaactcttataggagttactgcgatgtttaggagtgaagctgaatccctcagtagtaggtcccaaaaacatttctgtgattttaatccaatcacgataatctggggatcccaacagggtctccaactcatttcgacctttccaagtcggaggtctttgattcaatttgggaggtaatctctccataattcccacaggaacatatctgtgagtaaaagacatgaactcacacatgaatcttcgagcggtatttacaccataatcatctgatccccaatgttggagtgcaaatttagaatattgctccaacaatgccaatctttcggtagcagacttatcgatatattgttcagaattgatctcttcgaaaatccatggttttattagagcaccacgagcaaccatgacactgtcgatgtttggatcgctcacggctttatgccagtcttcatgagtgaaacaatcaccatttcccacaaaatatatagggtctctatctgattgctctttatcatctagttgattgtgattgtagtccctgacaacttgaccgactttacttatgtaactccagtcggcttctttggtgtatctttgttgtctagttcttccgtgtaaagtaacacatccaatatctccttcttcgcatacccttttgaccaagttttcggccaatgggtggttgtctctggttccaatacgcaacttgaaggtgaccggaatttcaccactacaatagttcattcccttaagcactctcaataatttgggtggttgctccatgagagcagacccttgtccctgtctataaagtaagtcaattgggcacccacaattcaagttgatctctgatacctgtggcgtaagtttggcaattgcctctgcggccttcgcaccggtccaatgttttgaagttgcaatttgaacaccaaaccctggatactctgatgaatgagccttcggaagagcccattctgaattagttccttgaataagaggtagggataaagccatctctgagtatgttatatccgctcccaaagtcttcatcaaacgacggtatggcaagttaccaacagtggtcaatggagacacaattttggcattctttacgtttagcttcttcttctctgaaaccttgaacggaggctctacatagttgtttgcattttctttttgcagttcctgttttgtcttgtcatggacttgaactttggagtctagaaaaaggatcattttatcggcagtatcaaactgaaacttcttccgagaaaggtccgttttggcgttttgagaaatgtgattgacctcatagtctaccttggaaactttatcacacaaaatttcatctttgataagctttcccgacttgtaatgagaagataaccaccggcatttcaatccattgggacagtatccaatggcagcaaacacgggacaaacaccttgcacgtcttgtggtttcgaattcaaatactcctctatattatgggtaaatctacaagcgtctgcaccgaaacgacattcttttggtgtttcagggtcaaccaatgaaggacagagtttcacagcttcttttgtctgtttcaaatctctatccttattttggcctcgcttcttctttgatttcttggcttggggcttctctgaaccgtttaatcggtccagtgagctttcttcgtcggcatatactacctgcttatcggtggaaactagaaattctttcttgatcggtgtaacacctttggcgaaatggtcatgatcatgtactggcttcgagtcattggagggctgttcgatgtgaaccttctttgtagtgtcttgcagagattcctcggccgttcttttatctgacattgtgtgttcgaaagatcaagtccagcctcctcaaatctatggagaagttattctttttttttatcaaacagcattagaaaacttttcatagagaagaatatgcacgattgaacagataagcggctgacggttgctgtactaacatccattagagcgccgcgcggctcaaaattttttttctttctcaaagctaattcatcagcttacagcttcaaagttcacacctatgaataaggagccagacgacatgaacaatgtcgtggagtccataaggatgctgagtatacggcccaagagcaagcaacccatagaaatcatcaggaatagtaccaaacctgtcacgattgccggtcccatggtcagatattcaaagcttccctttagagaacttgtcaggttttataatgttgacctggtgtacaccccaatgattctagcccgagaatttgttcgaaataaggttgcacgttacagtgatttcacaaccaacattagggatactccaacgatagtacagattgggtgcaacaacagcgtggatttactgagaatggttgatatgattcattcatacgtggatgggataagtttaaactgcgggtgtccgataaaagagcaagtaagagaaggaattggggctgcactgatgacagaaccggaaaaagtcagtcaaatggtcagggtggtcaaggaaaagtatggggattccgtttgcatcgaaactaagattcgaatacacaacgatattcaagagacaatacggtttgttaagcaagtccaagacgctggagtagactacataacggtgcatggaagaactaaaactacaaggtcttctaagccggtggatttggagagtataagaataattaaagaggtagcaagagtccctgtcattgccaatggtgactgcgttgacgtgaaatcgtttgagcacatcttagatgtaaccaaatgtgacggagtaatgtctgtccgcggcttactagaaaatccctctttgttttcaggatacaacaagacaacttggggttgcgtggagagatttttcagtctcagtatgcattatggcttgccatttcggattattcaacatcatctcagttgcatgacttcacagatatttacaaagaaagagcacctacaattgaaccagtgcaataatatgatcgagttgttggatttctttgatagagattttgaactaaagagaatgggtgaaaacggatttggagaggacgttgaggtcaggcggagaaaccctgaagggattgttggaacctagcaagtcaatcgagcaaagcacaaaaaaaaaatttggtaagaaaacttcctcaccttaatttctacggcagacaaaccttaaccaatgggtgtacaagtatagatatactgtgtacctttggaagttgaatactatgatgatgatctatattataaaccgagtgtgagcagcgtcaagtctgaccgttatggtaaggctgttgtgatgattggtttttctgtcatagttacactgagtattcgtttttcagaattggataaggattagttgcagtgatattttagattggtgataatgaaatggttgatgacaatgcttatgatcttgaattaagtgtagtaacgataacgaatttgggtttcaaatctctggacactacatactagtagacttgctcaattcaatgaattgaacgatacgcagccatacacacttgctgcttagcagtgtgtgaccgtaacaacgactacgtgcaacctcagctctgctacacgtaaccgtcatcttcatcccctccaacctggcaagaattctacaaaatcacgcccttccaagaattcaattagaccaaaagttccctacattgtttcacatctagaaaaattactttgcgtacataacaccatatttactcttcgtcgtcctcctcaattacaacagtctccaaacccttgacggttgggacgttgacgggctcgacgtaagagaacaacttgtacttggcatcctcatcttcatttctctttctggaaattctgagtctcattctgaaaggaactcccttgatacctctcttccacacagccatgttcagcttaggatccagtctgacgtcttcagttcccatgtgtagtttggcaaatttcttgatctccttgacggcctttggagcacgcttcttgaactgaacaccaaacaatctcttgtggaggttaatggtgtactcacgggtcaccacgtcgtttaaacctgtggaagccatttttgatgtagttgtctgtgtatcttaagaacagaaaatgtaaggtaacggaaggtttagactttttttcactatttccttggtgtatgggtgactagtcggtagtgtttcgcggattgcatacttttcactggtaggatccttttatgtgactggggaaatgtgtcccccaaaaacatgcacgtgatttatattaggggttacaacacagctgttttgaacaatgcttacgtcatcagtctacaaggtctgcccccatcgtgtcttctatgcccaggcaagatagcaagcgacatcacctcctacaagttgcatgtcaaacatagaactaccgcccatttccttcatcaatgatagtttgcctcaaaacaaggttgacacaaagacaaacatattgcctcatcccgctgttctagggatcgatcgtcgcaaacaaagcttgtctgaatcaggcagccttgcaccaataatagacatcttggatcgtaacaatagccctgcatccagcagcaaggatacgcagatacaaatatcaaaggagagaaaggttctggaatttggaaacgacgtggatgtggacaattcatccatatttcgtgatattcaagaacttggctttcccagaaagcatctcggtttcgtagtgtacaatcagctgccaactgtcaataatgtaacccatcaactatcaatcccatactatccgaatgttgcagaggacaataacaaggtatatccacttttaccacccaatttgactgactatatcaactgtaccatagatgtgagaataccttattttcaaaccgtaaacaatcaaaacgttaaaatcagacagttgtggggaactgatctatacactgacgatagtgatgtagttgccatgtgttatcatgatgggattctactgggcaaagctcctttcgatacaaagattattgatcaacatgtcgtagaaatgaaagaaaggtataatttagaattacacgataagagcagtgaatatatcgtgaagacacctggaaatcaaaaaaatcccaagtcgatcatcaagatagcagatggggatgccacagaccttatcgtgactctgttaatattgccaacattaacgcattatcaaggtgcgtttcaaaacaactacaactcccgcaccttcaataatagtcacaatggggcgaccatatccatctatgaagtgaaatatgttccattaaattccatttacaaagacctacggtcaaagctcccagaagaactagatgttgcgcaagtcgttaatgaagtggatttcttctctcagagtgtcaaggtttgataaggagcatttaatcttggatgtcagatagcatatagaatgaatttttttagtccatcattgattttcttttgattgggcaagtattgctatccctttttgagttaatattcatgcgtaatgagcatttaacctcccttgacgcatctatgaaccagaaatgttaatcagtaatagctcattcctgaaaaccacttattttaagggtctatctcacttattctccattaggaagtccaccctaatttgctcgttttttttcgtttgggagatattgctcgtattatcgaatgagcaaatatataggctgatggtatttaaatacctgaattgtcctctaagcattggcactcaagttcaatagacacataaaatgacaacatacttcagacacgctggccatgatcattcggaaacttcttccaccgctgttgatttaatgatgtcgatgagcacgaccaccgggtcggcgactagtacagagactggaatgagtgacatgactggtatgagtgatatgagcgactcaagtagccacatgggaatgaacatgtactttactaccagctatttgagataccctgtcattttcagggacttgaaggcttcaaacaaaggtgcagcatttggtatcttttgtgtcttgttcttcgctgcatttttcttgaagggcttattcttcctgagtgcttacttggaacagaaagtattccacaatgttcaaaactctgtgattattcaagaagttgacaattgcgcctgtgacgacgattccgaccccgagaaagtgttgactgaaaaaacaaagaatccccacgttttacgacaaatcttctttcctcctgtcggtgaactgggtaaagatttcattcgtttaataattgcgttcgtctctgctatgtttggatatgcactgatgttggcagtgatgactttctctttggtttatttctttgctgttgttcttggaatagcctttggagaggtctttttcaacagagtgggtattgttctcggtaccaataagaacagtgcactttgtggtgatctacattgaattcttgtttataggaacaaatcagtatggagtaaaaagtaatgttattagtggtgataatagttagagcgaatacaaatcaaattacttggcaattcattcggtgaatctagcgtcttcagcgtcgtcttcatcttctggaagtgcgtccagctggtcaactaactcggacaatgactcagagacagacttgtagtaattgaggcgaatcttagtgaataccttcaataggttgatcgaatcagttggttgcaacaatttcttcaaagactcgacggcaacctctgtggaatgtaccagctcatcctcagccagttcgagtttcttttccatctctgcaggaacttcagcagtatcatcaccagcttgagctttcttgatctcagcacgtatagtgtcaaatgtcaatctggaagtctcaacattgcgtctatgcttcgtggtctcggtgaaactgtgttccaggacgtaacgaatcttgttattgaactcattaatgatcagtttgtcctgttccagacgcttgtcaccaattcggtattcagtgtcagcgagcttcaacaaagcttgagtcaatgaagactcttgatcgttctgggactttaggaggttgtcgttgctggcagttacaaccttggatagcgagtgcgaaaaagtcttaggatactggttgccagcaggtgctatcaacactgcttcagcttcagcagtggtggtagcatggctcaatccttggatcttctctccaattgtttttgtcacgtcaaatacgctctccttcagattaggagggtaatcataactttcaatctcgtattggctggtaatagcaagaattttcttgtaaacgattctcaaagcatcggctttcttttccaagtcgatgtattcttctggtaaagcgctgatgtcgtcaatctgtcccagtttctcctggagtgatctctgagttcttttgaagattggagataagttttggttcaaggaggtggcttccttagacacattctggattccttcctggatctgctgacccaattgctgggaggtctgttgcaacgactggccgaaggattgcaatgaagggaatttgaaagacatattggagtgatgatagagagagtagagaagaaggaattatagcgggctcgacttgtcgcgtttgaaggtcagtctcctcggagacgaactgaaatgagctgaggctgaggctgttaagacgctggtgcataataatactttagaattatatattcatcttctacccagcagatgattccagtccatggtcgaatataggctggtaattaaatattattaaaaccaattttgtcaagatcaaggttaatcaatagagagtggaaactgagagatccaaaatgaaatacatgtagtttatctggcattgaaatttgacaaattaaatactagacagcaaagacaactaactacaagcaaatcctaacagaaccacatcgtataactgcaaatgcattgagtcaacgtgcatagaacggagagacaatcggggaaagatattctccacaagatgccatctaggagatacatgtaattccattacttacagaaacctgaaatcaataacccatacaaacaacttaaaactaaacagtaacaatgacaccttagtgcttgatcttatcgatcaacttcttgatccctgacttatcatgttcctgatgttgctggttgtcggggtccagtgtcgaatttttgacatgttcaggtgcatccttgggaatgtgtttaccaccagtatttctgttgccctgaaaatcacccatagcatatcttccttctagatcatgagttggctgatcattttggtaaccggaggcggagtaaataatttcttcctcaacaactttagatttttggtctccgccaactctgctattgtcaaccgaatggcccgctggaattgtttgattaccgccagtgctgactccagctggactagttttttcgtcgttgccctttggataaacaacagttggatcagagtccagttttgtctgatgtaggcgagaagtatcttgagtgttgcgattgtcatgtgaatcgttgatattcacatccgctactcctctggtggcagattcaacacccttgttacttccatgagtgttgtgcaaacgtttctgctcctcaaatgtggttcctttttgtggagattgaggggggctattcttttcctttctcaaaaacttgcctaatcctttgaaggaccccgaaccggcagagctcctacgttgttcgttggattgatcatggccttgggtctgaggttgactctgggtgtgagatgcctgtcctccaacaaatgcctcgttgtgagtatgtttgactgaagacgaggaagaatcttgtccattgtggtggccataaggctcagcatctctggtggaagcggaagcatctttttccttgttatcggagtgtttgaaggtgtttgacaatcttcgaccaataccaaacaaccctccacttttggactctttctcatcatggtgatgatctttttttaagtcgtggcttttgttatcatggcgatcctgtttcgactcagcactgatgccctgatgatgatgatccttcctcagctcagagctagtggtgtcgttacgcccctggtcctttctagaggaagcggcagctgctgctgcagctgctgcaccactagtagcacccacaccaactaatccctctctgttttgcgaaggttgatcagaagatttgctgcgtcctgaaagtttttctttggtgccttgccttccctgctccgacgaagcgtgccccagcttttgtgatttgtcggttccagagtatctttggtcagctgtgcctggaatatggacgccagttcctacaccactttcagcagctgatctcttatcttggtagtcagagttggggttgttaccactactcggttgagaacccttagtgccaggtacgtgtacgttggcatcaatattggactccggtagagaagttccgcctcttggtttgtcgtcaataacacctctctcagaaataaaagacttggtgctagtatcaccagttttccacgatcctggggtctcggcttgcgagcctctgccagttccaagttgtgagccctcactgtttcctgattgaccggtaattgcagatatagcttggttcaagaaccctcccccgatttttcggaggtatcattatcatcacggacattggaattggtggttatctgagttttgtcaatcgaaacgtttcttccagctcctcctctaacatggctatactcggtctggttttgttgaacggtaccacctgggttagagatacgggtggttcctgaataaaattcggagttgatatctcttggcacgtcaggattgttctgctgattaccagtgttggtattcccagtgtggcctgtgtttgggttaagatttccctgtgctttgttgtcgtgaaatatgtcagtcatgtttcagttggacgatttgctaaagatggaaggaaagcaaacttatcctttatatagctcgatcctgaaaactcaaaatacactgtcttgctatttccatttatagagttgctttcagttgctttttactcactccctagttacgaaaatctggggtaacgtgaaatcgagaaatatacacaaccacgaggacaatgttgtacaactatgttatgtgttagagtggaatctgggaatctttccagtttcagaattatattctcctacttagtccagtgatacaactgcattgcttaatatttagtaaatcgccccctattattaaatgtttcaaaaaaaaaacgcaaaaacaaaacgtaaatagcaaccaagtagcagaggggcccttccttggatgaaaaatcccaagctagagttctggacttgcagggagctcgggtacccttaacgattctgaatcattgagttctggctcaataaagggctctgacggtaagagagcattctcctgtatttgaagtatttgcttttctgttaatcctgattgacctggaacggatggatactgttcgtctgccaatgatgaataaattggactgtcctctattggttctgggtatgagtatggatactcttcaagaggtggaggctgagtataatggtgtctagaatcggtaacctcgtattgcctgtttggtcttattgctgttgttgattcgaaagcaactccttcttgaatgtctccaggactattttgcattgacgaagcttgagatcgggctcttgaggcacgttcgactcttctatatgtaccaattaccacttcgctattcaaggtgatgacatcccggagccttttcaacttgtcaacgttgaatatgttggaattattagtatttgacgaataattggtagatgattgtttcacagagtacaccttcactggtgaatcttcattattgtcggacgttggcgtcggaatagacgaagttcctaataaggaattatccgacatatctggaccttcattctcgtctatgctttcattattcagagagtgtgaataggacactatatcattgatattctcatcatcaataagatgtttggtatcggtaggtgaaaacttagtctttcccaaaaagactttcaaagaattggttgttgataggttcaccacacattctacggagtattggaaactgactaatggacagccaatgatacttggaaagacatcagcaggaatttttagagacgtgctaacttcaccggtatgcaaattaggatctgtaactaaagggagaattgcttgagataagtcctttctaaacgtttggactgcgccttcaggcccaaaatcaaacttgcagactcgtatcaaagtgacaatgatcccatttgagttttgaatatattttgtatgttgtaattttattttcactggaatagactcccctgggaggtatcccaagtgcgggtattccacggacaacttgatactcttggatgaggtcttttttggtaaatcgtccacggtttgggaaaaatccggcgttaaattcgattcatctgctgcattcattccttgactgttgtttgattgatctgaaactaccgaggaggccgaagacttgattctgtgtagtcgtctcgtaggggattttaccaccaaagtcttaggctttaacgcgggtaatcttgctacgttaattggttttactatgttgatgaatttctcacacactaggatgtttgaattgttgatattggaagccaatgagagaagactaaacgtggacttgtctcctacggcacatttgaggccgtatcgaatggaacctttctcaaaactgatgctcgtaaaaacatttcttttgggtagtttaacaataaatggaaaccggtgttcacctttcgaaagtccgtttgacaacccactatttgtgttactctgttggtctccatacaaactgatggtgtgatcaaatagtgttatgttcttggatattccacgaagcgtcgaagcacgcgttgggttttttatctttacggtgccactaagagacaaagtgacaaccaggttaaccaaatcacgatccaatactaaggctatgctgcccttaacttcatcaccgggatggtatgatctatgtggctcgtccaaagtgatgtaaaactctcgtatactacgaaaatccaacttcagacttttcagaagtctgttcttgttgggtagtaggctattagctgctcttctcatctggggttgtgttcatacggtggttcactggaaaaggaatgatatccggaacactccgtacgatgcttagcaatggaccaaaaataaacgaccagtgttttcaaaaaaaaaaaggaaaagacaggtaatttgaaaggactgcctgaatctctaaagatgatagcacagaaaatgggaatctggatgacaatgcaataagaatatcactaggatactttcacagtgttttatggtgctgtatcttttcttttggatcgaagattagagtatgaggaggtgtgctagcgcacttttcgctaaactcaccgggagcttttaacggctagagcaaatatagcgtacccccgtactgcaagattttggaacgaatagaaaaatctctgggccgatatttggctgtaactgattgagacctatcagctgttggagtttaggcctttcaagacatgtggcaattctaaaaaacaaggttgttacaatgtttccaccattgcgaatgtggggtgacaatagtttactaggttgggagaagtttttggctcttcaagtcctcaacatcattttacgagcaactgggctggaaaccgtttgatttcttttggttccagatgtctaattatggcaggttgctaccagagtccaatgtattatctcccgaccccgaaatctggatccatagaacaatgtgagtgataaaatcgagtaccaaaaaaagcttgttttcatgcctaattgggagatcatttttaaggtaagcgccaccttagaacattcctacaaatgcaaagaaattttgaaattcggttttatctgttcacgatataggttattaatgtacactattaaaactaaacgaagattatctacgataaattagttgaaggtcttcttttgaccttggaaaccactgttaacaggagcactgttggcaccagatccaaaagaacggtcaccagagaatccaccacgtcctccgcggaatcctccacgaccaccacgtccacctcttccaccacgtccaccggaggcggaagggtctcttggggtagagtagtccaatctgattggtctgttgtcaacgtactcaccgttcaaggcctccaaagcacccgtagcctcgtcaactgaagagaattggacgtatccgaaaccctttggttgctcagtctctgggtgagttggaattctaacactagtgacgtttccatgcttactgaaaagctcgaacagagtgtctctgtcggcttggaatgaaaggttacccaaaaacaatgtgtctgaaggtggagatctcttgtctccgtattggctggctctatcgttgtttctggcggctggggcggctggctttgagttggacatgtccacattaataggtcttccatcgatctccttaccctgcatctcttctaaggctttctcggcgctggctttgttgtcaaagtctacgtaaccatatccacgcgatcttcccgtagctctctccatcataactctggctcccacaactcctccaatgtgctcgaactccttcttcaaccattcgtcatcaatagaccatgacagtcttccgacgaacagcgtagtgatctcttcggtcttggctttcttagctggctcttcttcggactcctcggcagaacgtttagcggacttctcatcttccttctcagactcagactcggactcggactcggactcagatccagactcggcggcttcctctttcttatcggactcggcttcagactcagactcggactcggactcggactcggacgaattggcttccttcttagactctttcacactttcctcttcagattctgattcagaaccagaagactctgatgaggaaccagaagaagattcagaagaggatgactcctgcttcttggacttcttctctcccttcgatgccttagcggcggacttggacgaaactttgctagatttggccattatatatcaattggtaaaataaatctaatagaacagaaagagaaaggagccttatactactttttatagctccttgaaaaaattttattttttcccttgcgaaaaagaaactttgtaccgggtaacgccaagataaagtgggacctgcttatcaagcatttgtcagggacttagggtcaaattatgatagaagctgaatgtccattaaaatattatgccgttttttatacaattcatgatctattgtcgaagtcatgttccatgatgttggctttttcacacatggctcgaaagattccactggatttgtggtacaatcgccatggagtatcgaattctgcgacttgaccagcctcaagcacgagaattctatcatagttcacaattgtcttcagcctatgagcaatgcagaggatactgcatttgttaaactctctcacaatcgcagattgaattttcgcatctgttttgtaatcaacagaggaggtcgcttcatctagaattaagatcttcgagtctctcacgatggctctggctaatgctataagttgtctctcaccaagagaaaagttgctcccttcatcttctactacttgatccagatgaaacttgtgaagctcctcttggccctttttcttttgaagtttaacctgttccaattcagacgatgactcgacaattccactcttgagcagagctgcccatagaacatcatcttctttctcaccaaacggatctaagttctttctaatagtacctttgaacagtacaggatcctgtggaattattgataagttgcttctcaaatcatacaagttaagcgtcgagatgtctacgtcatctatgacaatttgtcctccagccagctcgttgattctgtaaagagctgtcatgattgaagattttcctgcacctgttctaccacagataccaactctaaaacgactcggaatatgaatgttgatgtttttcaggaccagagggagtcctggtctgtaccgaagggatacatccttaaagtcaatgacaccattctcaggccatgtgctagggggacttggtcgtgatggagagtcatacgatgcctcttgaggaaggttatacgaatactcatatagcctttccacagaattcatattattttctaattgagtaattgatcgaatcaaaagggacatttgaccaacgatttggaaaagataggtcaccagaagaccaacggaagatggcccgatatcaaactgccttgtcacacagagcatggtaatcaaaaatgcaaacccagctcctatagtgtccaaaatgacggccagccatctttgcgcaacattagtaatgaaactagcctcattcatattattcagtaaaaggtcgttctttgatataaagctatcttctctttggtaagatttgatagtatgcattccattcagaacttcattaacatgactgaagacaaatgatctctgaatagattcaattctcttgacttccctagcggttgcctggtaaaaagaacaaataagtaagaataataggaacaagaaaggaagagctatcgcaaaccacggtaagtatgcaatacacatgatcaacacacctatgacgtttgcagacgggtataccaccattctaaactgttcaccgatttcattatccagtgtgtccgtatcctttgtaaacctattgattatctggccaataggagtagtatccaagtaggacattggaacatgtaaaaatctcttcattgctgcaatattcaatttcgtagatgctttattggtcaagtatgcaatcaaagtatactcagtggtcacagttatcatggacagaaatgtgaacataatgtagataccaatatagattccctcacttagatgtgaaaacctattagaagtccaaaatgacagccagacattggtaaataattggcagaatgttgtcacagccacaactagaataaacatgggtgaaaacagttttccaaacactccagaacccattgaaatatacgtcttgtaaacgtcaattgggattccatttatggcacgctgctctttcttcattagtttcccatcattgatgtcgtgaaatcttggtaatttttcttcaatggtcagagttgtcgatttgatcagtttcagttctttctcctcgtccttggactcggatgactctgagttaaaaaccatcaaattggtgaaattttgatttctagcggagagttcttcaaacgttcctacgtcgatcgttccgtctccattgaggaaacatatccggtctgcagtgctgattaaagacagctgatgcgttgctaatattctagttttatcgtgcagtaatcccataatacaattgtccattatatgcttaccaactcgagcatctactgcactcaaaacatcatccattaacagaatatccctatcattgtagacagctcttgcaagattaattctggccttttgacccccgctgagagtgatccctctctctccaacctcagttatatctccatgatctagcatatccagatcttgagtcaatgcacagcatttaatgacttcccagtacttggtctcgtcgaatggctgtccaaaaacaatattctctcttatagtagtattttggatccatggttcgccacagagcaataatgacccctggtggctaactgagccagactctctcttcatctggccgcttaatgctgctaacagcgaagatttaccggttccaataagacccgttatcactagaaactctccttttttcacttccaagttgatattcttcaatcttgagaaagctttattattctctgtcgtcttgtgatcaatggcaactgtgtcatcttcgttctcaaaagtttcccaatagaaggttccgttctttgcttgaagagccacatccgtcttcaaagtttcttgttcgtcgtatagatgagcctcaggggcttgcaaaaaattacaaactcgctttaaacctagcagagcgtctgcagataggaacaaacacattggtaacaagaacacaatcatcgacaatacgttgaacaaactcaaagaagaaaagatctctgcaggggtacgatctctagagaccgcgtgtgcaaccacaaatgccaacatagaactcaaagctggggtacttacggccaatgcagtaagtgagtttctgattgcatgcatcctgaaagtgtatttcatttcagtcgttcttgcgttagtaagagagctgaaataagaattttcccaggagtagaactttacaaatttgagataattggcaagttctttgatgtgagaaactctcttatcagtagatcccatgatctttattcttatctttataattaagggaatggcagagaaaacaatgacgagacaaagaaaaaacattcccaatccagccaatgcagagacaccgatgttgattatcaacaacgttattgcaattgccattgtaacggggattgtcatcatgaaaggagaaaaagtgaaagccagttcaagacgagaaagatctgttcccaacatggaattgatcttggcaattgggtaattatgttcagcaacaccatccagtcggaaagatttctccaaaaccattttattgaggacagaatagaggacttgtccacataaagttgagtaataaagactatgatttaggcaaataccgggtactataatcagaaatgaagcacccaaagcgtaacctacaccctttccaatcccaggttcaactccaaccgattttaaggaaacgtatttgatcagctctttggtaagcagaggtgcaagcgtagtcccacagtcaaatattattttgaaaccgatggcgtaaaagtagtagactccaatggttttgaaaagtggcttcatgaatgttgtcaacttcattggttcatttggagatgccctcttgtcaacttccttttgatagacttttttgaatttatcagcgagggcttccactttcagagaacgttccaggtagtacaaatcattaggaaaaatagttctgacgtaccctgttttaagcagtggaacaacccaccagaagaagattctgctgataaacgctggaacccattgatgatacggtatgtcagaaaattgaactccggcagggtagggcttcctttcttgatcggtgggaagtggcggtatagtacttggaaggaggaaagaaaacaaacgtttctgcctagccatctcagggaggatctgcttctccaaagaggcagaatcgtcctctttactcgaagaattaagagagctcatgggtggcaaaagaaagcaccttcggaattataattgaataaatatcaaactttcttttaggtaattttctcgataatgctttttagcaatgcacggacaatgcaagacgtcggagatatacattgaccagttccaattttgatttaaaatgcatttggtaggaccaaattgaaattgtaggaacaattttcagccacatactagtgctccgcaatattttttgcaggacatttttcatctcaatctttcttgatccttgctggtcagtatcagtgacagtttctctgattactaataatacacggctttaggtgacgatttgctcaagcctcgaaattttacaaaacccaaaaggggaaaaaccgagatgtttttcagtcaatagataaccttactcttaactagaagttcgcagaggaagacaaaagaaagtaataaaatgaacgcagtgttagagtgacaaaaaggataacggaagggaagggtgatgaatggaagatacctgaactggaattacgagtatacctaacaggtttctagagttcatccttcctagctgaagggtaattttacaaaatactgcagaaaagactttaagcaaaacattgtaagggactagccttttttcttaattcagtcaacatgtaatgaccttccgatcgataggcttgcactagttaggtattccacttgttacattcaccagtcgatgttttacacctttgaagagatgaatcatcgtccccagtaggcctcctgaaagtggtttctggccgtttgatagccgaatatatgcatgaataatgtatgctagggggatacactaaggtggggagtaaaacacaacagtaataggtgtgggcaaatgtcagttatatgatagtccaaattagtcaagaaactattgagaccaacattttcaacctgccttcccctagactgcttagctctcttgtcgttatacgtgaatcttttttgcacatgtaactcaatgtacctcctttgaatccaaagggtgactcttccctattttgccataatcctgagtaatatagtctttcccaacggtccaaggcgttgagccaaatgcccttgatgtgacgtccaatattctcttgaagattgtagcacatctgcaacatttcctctgtgaaatcacaaaacttgtcactaacgcgcttcactaccttttcattcgttaatactatttctctttcaaactaagctccgcatgaaccatttttcaatgtgaagaaatgcagatacagtccagcctacaaatatgtcaaaactgcaggcaaaacatttcacagctgtgggcgtcagatctaagttatctccgttgagatctcttggcaaaaatattgtttcgtgtcacatgatttgatgtactccacccacccagagcgaaattattaatctatgctcgctttgtcagataccaagactgccagaaatctttccctttctgtttagcctagtcctaccatacacagtccctgaaagatggggcaaaaactcgagaaagatggcgatctggttttgaaaaaacgttggctgacccctttattgctgaacaagaaagtccctccagttcctgatccatccgagagaaagtcttacccactacataaaacaaatctgctctacagagccgggttttggtggctaatacctctgttgaacattggatataggagaccacttcaaccggatgatctgtacacacttgaggataatgaggcgcattttttaaaggttgaagatatgcatgaccgattccagtactatttcaatcgaagattggagaaagcctaccgaagttgggaaagcaatggaaaaaagcaaacgccgttcaagtaccctgataacatactcttttggaccttgttggaaactttcaagtatgagtatgtgaaggcaaacacttggaagtttttgggtgatgttgccacagctttaactcctttactgagtagggagttgatcaaatttgtgcaaatgcagccagtactgaattcccccgtaggaaagggaattgggtactcgtttggtatcgcagctttagtactggttaggtccttcctccagttgcatttcttccatgatactggattgacaggagcaaaagttagagctttactaaccaaattattgttggataaatccttccggttgagtgacaaatctagaaatttatatccccaagggaagatcacctcaattcttggtgcagatatctcccgaattgatcttgcagtgacttatttctcattcatttggcaatttcccgttggtttagccatacccattgccctattaattgtcaacattggagtgtcagctttggccggtgttgctgtactaatactaacgcttttcactgttattgcttctgtcaaaccattgctcaaattccgaaagaaagcaagcgttcacactgatgcaagagtcaaatctctgaaggaaatactttacaatatgaaaatcatcaagttttactcttgggaaattccttattttaatcaagtttccgagcaaagacaaaaagagatggtccagattttgaaacttctgttttcaagaaatgttgtaactgccatatctatcaattccacaactgtgtcgtctgctgtagcttttctgacaatgttcggagagagaggaatgcagagtgccgctgatgtgtttagttctttgcagtttttcaacgtcctttctttgcagctggtgctgttaccaatggcgttcagtactgctaccgatggctatcttggattgaaaaggcttactgaatttctaggtgcagaggaattttatgaggatgatttggatgattcatcttacaacagaagcagctccgagaaagatatgttactggaagatgtggctttgaaagttgaaaagggaaatttttcatggccaagcttcgaactcgatcaagaagactcagttggattgaaagacatcaacctggaagtgaagaaaggagagtttttggtgataactggtctaattgggaccggtaaatcttcattactagcagcattgagtggccagatgaaaagaaaatctggctcagttagccaccaggggtcactattgctttgtggcgaaccatggatccaaaatactactataagagagaatattgtttttggacagccattcgacgagaccaagtactgggaagtcattaaatgctgtgcgttgtctcaagatctggatatgctagatcatggagatatgactgaaattggagagagagggatcactctcagcgggggtcaaaaggccagaattaatcttgcaagagctgtctacaatgacagggatattctgttattggatgatgttttgagtgcagtagatgctcgagttggtaagcatataatggacaattgtgttatgggattactgcacgataaaactagaatattagcaactcatcaactgtctctggtcagcactgcagaccggatatgtttcctcaatggagacggaacgatcgacgtaggaacgtttgaagagctctccgctagaaaccaaaatttcaccaatttaatggtttttaataccaatgaaaccccagaaacagaggataagcaagagattgagcgtgaaaaggagtcccagcctaaccgcaattttacggaaaaggaaggtaagacgatggtccaagaatctagatcagattcgctttcgaagtgggaagttataccgatttttttcaaggcgggtgcacaaagattcaccttgcttcttttgttggcgattatccttactgtggttataagcgcctttttagttgtgttctgtaatgtttggttgtcttattgggtatcttatcatttcgaacacttgacaaatggtcagtatattggaatatacatcttactaaccttcctgggtgtcctaatggtgattttggagttctttttcatttcctatgttgtgaataaagcctcccagaatctgagtcttcaaggactaaacactttacttcacactccaatgagctacttggatgttaccccaatgggtcaaattttgaataggttcaccaaagacacggacaccgtagacaacgaaatggctgatcagttacgactggtggtatttggtttctcgtcgattgtagctgtgttgattttatgtgtggtctacctaccttggtttgcgattgcaattccaatattagtgcttttctattgtgtcatgtccaatttctatggtgcttcagggaaagaaatgaaaagaatagagaacattgagcgatccttcgtttataacaactttaatgagtgtctgactggaatgaacacgataagggcatacggtatggtcgataagtttctaacaaagaatacaagattgctgaacagaatgaatgaagcttattatttaacagttgctggtcaacgatttttggcagcaaatttgcatttcatagcgacagttatgacacttctagtcgccctgttagctgtgactcaaagtttcagtattagtgccagttcgactggtcttcttttatcatatacgttacaaattacgggactactgatgatgttgacaaagtcattgaccatggttcaacttcagatgactgcgattgaacgattagtggaatgtgcgattggcctcccccaggaagcggcttacattaaaccaggagaatcagaagacgatgatactgatgaagataattggttgaaacgaggcgaaattgaattcgataatgtgtccatcagatataggcccgaacttccattggtattgaaaaatatcagtttaaagattgcaagcggtcagagaatcggaatttgtggaagaacgggtgctggaaagtcttccataatgacggccctttatcgtattaacgaactggcctccggtcgaatcaccattgacaatgtagacatctcaacactgggtctgcataatttgaggaaaagactatcaattattcctcaggaccccattctctttaaaggaacaatcaggaaaaaccttgatccctttggacaaaaaactgatgaggaactgaaagtggcgatgatcaatagcggcgtgcccagcgatcctaagttcgacttggatagtcaagtcactgacggtggaggaaatttctccaatggtgaacggcagctactcgccttggcaagggctacagttagacagtcaaagatcttgattttggacgaggcaacgtcctcagttgattacgagactgactcaaaaatccaaacgacaattgctacacagttcaatgattgcacaatcctttgcattgcgcatagactaaaaactattctagactatgacaacatcgttgtggtcgagaagggtgaggttgcagaatatgacactccgctgaatctgttcaacaagaacggaattttcaggagcatgtgtgatcagtccaacatttcaaggggagacttccctactaaaaattgagttggggttaaatggttaatttgttttatattattaataaagtaaacattctaaaaaaaaaaaactaaagattaaaaaaaaaagttgtatagtggaaacgaaacaatgtctgttctgaaatcagtaataaaagcagaaaaactaaaacgcaaccaaaccagagttggctggtttgttgtaagagtaagggctcatcataccagaatgaggagtgtagtaactaccgtagtaattccgggcgccaggatccatgtgaacttgacttgttgcgagtggtggcccggggtacatgggtccattctgatatgaatgaggattcatggggacttgaggataatacaaattgtagtaatccacaggatgtggctgctggaattcgtaagagttggccagtggtgactggactcttcctgagttgtaagaaacttgggcagccatatagctggagttgacagaagatgaacagatacgttgactcaaatagttgaaataaatgttctccatttggtggtaacgttcattgatggaaagattccaactaagtctgtttagccagtctctttccatagagttcaagagttcaatgggcaatccagaagcgttggaccaggatctgttggtaaaagtttggtcatccatgtatttgttagaaaccatgaaagcgagtaccagattggtgaatatagtgtaatcattgtcggtttccgaaggatccacgagttgattgtaatatatcagtgcaccaaaaatagtagtctctggaaggttggtagcataaagcacagaagacaaactggaaggtgtcttgaaatgcgtcattacacatacgaaatcaaccatggtttcgatgtcgtaactcatggcattagagacactcttgttattgttctgagcgacttgatgaacaggagcaggaggttggttttgaacaccaaacagctgaccattgttgtacatgtcgtagttgttattcggaagataactcgagcccaaatgagacgagtattgcctctgatgatggtggtagcccacggactccgtctgatggtggcccatcaaaggaggaggagcttggttgtaccctgagtaaaacattgtgcttttcaggacgaaggatgtaaaaaataggacacgataacttaatcaaaagctcgcaaattgtttggtaaagaaaaggtttttcgtttgtctttccttgttataaatggaatggttaagtggccaaaaaaaacgtaaatgaataggttcttttttttggggtcaaacttaaaggaaatagacaggaaaagggttggaatagaagaagaagacagtctgatttaaaaaatagaaaatcagagctttacttcaactatttgaattttaatggcttgaacaaggaaactgtgaaagtcgacaggtcgtctacttataaggatgtgaatcaggaaaaaaaagaactgaaaaattaggcacaaaatcgattaaggaacgactatgattgcctaatccggaaatcagtggcaggctcagcaagagacgtcagagggcgttgctggttgattggaaacgggctttcaagccgatcagtttactgtggaaccgaaggttaccagagactctcccgagaagttatcgtttgtctttcatttggacacctcatcatcttgataattttttttttccagactatgactaaagaccacttttctcaaaattatgtaagcttgggggcgaattttttctttcttattattaatttcgtcggctgccgcggcaacgggcccactgcctccaccgtcgcatggctgctaaacgaaattttacgggactcgcggatagattactcacagagactgcagtggccgagtttgctcctgaacctgcatgtataaaacccatgcggcggtgagattcgcgcattggtagtaactggattttgttccagaccgcgaaacacaatatcggtaggagggccgaaaagttctggcgttctttgtttacaaaactaaaactaaactttcaaaacagctacaccagtgcctccccacgttacttcttcgttgatgcccagttgtcgcattagcagtcattgccaattatgaatatccataagaagaaataccccaacaacggcgcatctgtcgttgcagaccgctctccactcacttccccatcacgtgaaaactcctataagtatctgtcttcggatgaagactcgctactctctcacgatttagtcggtagagacgaggtgattgattatgacaggcttcatcgatttctgaggcggtccaacaatttacccaagcaggatgtcaagacacctctggttcgtgagagagccgctcaaatgcccttatcgcattccactcccatgaaccttcactaccaagaaccaaaaagccataacaacccgggacagcgtatagcagaactggtcagcgatgtgagtgaagaaggagataacggttccaccaccaatctattaacacctccaggtactcatgacagctctatgacgataaaagaaggcgaacacgaaacacagacagatgataaagacgagcaaattcgcagactaaaagaaatgatagaccacaaagactcactaatattcacattaaaggaacaatccacagaaaaagacagcaaaatagcaaagataaatcaacaattgcaagaatcaaagacactcaactcgaagctagtccaccagttggcaacaagaataggtaaagttcgatctctgaacaaaagtgacttcgaaggcgataaatacaatgaactcggccttgctgtagtagacaatctctctcttaggagacttcaaaattttgtcaaacagatgctggtagatttgaacgtcccctacgccagaatcgattccatcgtggagcatcatcttgtgctacagtcattcgtgcaagacttacatcgaatgatatattcgaactcaattgacccgaaattaaccaaacaatgctgtcaaggcatgaatgcatatataaaaagacatttataaaagacaacaaacctatttaagactgtccaaatcaacaggagaagactcaagagtaacaacgtctgggtacagtaagtcggtcaaaaactcagcaacctcgacttctccactaatctccttcttcaaacagtcggcagcaatgtcaaacttgttgttgggtctgctggggctcagctttgcaacttcgtcgtcgatcaacttgacaaccaggtcctttgtgatcttctcgccagtgtcagtaagttttacaccatgcttgacccaggagaataattgcagtcgagaaacttcagcagtggcagcatcttccatcaagtgattgataggcacacatccagaaccttgcaaccaagcctccatatagttcagaccgatataaatgttaatcagaataccgtctttagtgatcttgaaaccatcgatgttggtatcaaccagatcttcctcagtaacttccctgtcgtagacgggaatcttgtgcaattggttaggagttggcatgtgcttgttgaagacttcaagagcgattggtgccaaagctggatgggcaatccaggtaccgtcgtggccagcaagaacttctcgtagtttgtcatcatgaacagcttgcatggccttggcattacgttcagcatcgttcttaataggaattgtggcagccattcctcccatagcgtgtactccacgctgatgacagaccttaattaactgcttaacatagttggtcatgaaaggaaccttcatggtcacaagaccacggtctggcaaaatgtgcttggggtcattacgtagacgtttgatagtggagaacatgtaatcccaacgtccacagttcaaaccagcggaatgatctcttagggcatacaaaacttcgttcaattggtaggaaattggcaaagtctcgatcaagacagtagcactgatggtaccacgaggaatggccaaagcgtcttgagcgacgttgaaaacgtcattccacaactttgcctctaaccagtgctccatctttggcaaataaaagtagggaccaacaccattgtccagcaattgacgggcattgtggaagaagtaaagaccaaagtcgaatagagaggcactaattggctcaccgtcaacggtgacatggctctcaaccatatgccatccacgaggtctgacaatgatggttggtgggttgcgaccttccttcttgaccttgtatgatttgccagtggcaggcaaagtgaagtcaatttgatctctgagagcatcatacaaattaacttgtccgtaaataatattagaccatgttggagagcaggagtcctcaaaatcagtcatgtaggtataaacatctgtgttcaaggcattgacgaccatctttctctctggaggaccagtgatctcggcacgacgatctgtcagtcctggtgctggagccttacacttccagttaggatcatccctgatgtacttagtctcggggaggaaagtcaacttctcacctttgtccaatttggcctggaccttctgtctattctcaagaagctcctttctggtactgttgaaagttctgtgaagtagaacgacaaatttcaaagcatctttggtcaggatatcagcaggggtaattggactatcatacagtggggttgagtcaacttttccatacaattgcactccttcaagggagccgtaagttcttggggcagccatttttgtgataaagcggtaaatctggggggattgtgggtttatatacgtttgctggggtgtcattcccgagtcacggcaatggccgatgggatgaacatgcttatcagtcggccaaggggagcagagtcatggaagcaaacagagtcaacagaactggtcggatctcaaccgggtgagagcaatttactatgtgcaggtagtgtgacttgcaattataactgacctaggtgtcaacttccgggggggtctgaaacctgtctgttctccgtccgtcaagtacccaagaacgccgggagcagcaaggttttatggtgatccttgcggcgacggtgggcggagaactgtatggcccgctgttgagaggggtcactaccatgccttatccgttgatgcggcgcgaggctcaaccgtctgctcggagagtcggacatttcacacccccggggcagatggagcagctaagaatccgaagatgacgagatgaacagcaaggtggagtatatataatgcaataaagtgtatacagattacattagatgatgcctttctaaaacaattcgtaaagtgaaaacgaaaaagaaccaactgagagttctcaatcacatgctgagttttcatcaaaacctagtttaataatgccagcgacgtatggattaagcactggttcccaattttctgatctctttgttacgggcccagtatttcgacttgagttcttggcctgctttggtagcgttgtagattttgtcgctgtcaaaagtcaattcaggatcagcagccagcctgaccaagtcctggaaatattcaccagcctcttcgtatggaatcatgtggaaaaaggtggtgtcagacttcagattgactctgttctgaatccaagcctcttgttcctctctttctggtaattctaccttacctgtgaggaatcgggcaatcaaagctgactggtactcgaatacagtgaatgtgtaagtaccattagccacactgaggaatgtcaaagaaggatctggtatgtaaaaaatgtgttgatacaattgggaaactctgccgttcttgttgataaggttcagtccgtcttcttctttcaggaacgggaagtaatgtttgtaaccagtagcaataatcaacttgtcaacatcttcaagtatttgaccatctttagtggtgattcggagcttaccgttactatccttctccaatgttgtgatttcatgtgtgatgttgatattcttttcgtctccttcgtaaataggtttgcggaatgggtactccttcatttcaccacccctcgtcacaacattgataggcaattgacagatggggtaaacgtcactgatgaaatcacaagcagagtaactggcacctaccaccactagtttcaatcccttatagtcttcaatgcgacggaatgtctgagaatgctcaattaagtctgggttttcggcacggatttgttctacagcatcctcgatgttagcaggaatgtagggaatgttgttctgaccaacacatacaatgacagagtcaaagtactcaattgaccaaacatccttaccatccttgaattgacgaatggttaatttccatttaccagtttctgggtccttctgaactctctcgatgttagtgttgagttggactttgtccaaaaactggtcaaaagtgtctctaatatactgataaacacttgtataatgtctaaaggggtacttttcataatctccttcataccctttgaaaaggtagttatccttcaataaagtttctttaacgtcctctggtttcaaagggttgtacgaaaactgcatcacaacggatggcagattggtctgtaggtagttatagattccagaggtattgtaggcgacaggcttcttactttggtcagtgacgacttcctctccctcggcgatgttctctaatttttggagctgttcgttcaatccacgctcctcttctatctcctttcgggttgggataggatcaggatttgggatatagttccacagaccacctattttgtctcttctatcgaaaactttaattttaaccttatcgaagtcggggcctagttccttatgcagccctttaatagctgaaagccctgaagggcctgcaccaatgatggcaaaagagtcggagtgtttggctttcatgaattgttgcttaaagagtaagaactaatagtccgcaagaaaggggggcataagtagtatttatattggtgggaaaaaaaaaaaaaaaaaacggaaaccaactattcatgcaggatttagacgggacgaggagtagacagcccgcagtgggattaattttttttcgtgtcccatggaagaatcatcggaataagagccgatcttataggacagctcgttggcaagaacaaaaatacaaccggttacggacaaagttttgaaagtcgactacccagtagcacatagcctttgtcgcaatgtgatgaaacgttcaacatcaattgtcatacgtaggcgtactgtactccatcttctaagacggcaccgcactgggctccacaaagaatctgggtaggcaaaagcgcatctaagcttcgtcgcgaaaactgtttaaggaaaaaaagaaataaactataagaaaaaaagaaacgccagccacaacgttcaacgccctgaattaacttaattgtctctctaaatttacttgctcactaaccacaaagtcatggctgcatccgcaagggcttggccattcatgacaaaaaattttaatgactggtcatcctcccaaggggtttcaggtgcagatgacagcctatctctcgccttgacaccacacggaaagattagatgacaattcgcggagatctacaccacctgtcttccatccaacatcctttctctattctcaatctttacttgcactaatccctgcggccaatctttcatctataacttcatcaggttcattctcttgttggatgactcctgcagttttcagaatacgggcggtgttaactatggaacggttatagtctacgcgtgtcacgtcaccactaaacttgacagttttcagccattccattgcatcctctttggagtagtcaagatgggtcgaaatatgttcaactgcttctgtcttgtgttcttcaaaataatctactccctcctgaacagctctaagggctctttgcaattgagtctgatccaatttggaactccctacaatcacccaagacggccaaggagtatatatctccccaattcgtttaatctctccgttgtcatagtatctcttggatgtaaaatgctcccacataaaagcatcactgggctctacaccgtccttcagattgactgagtctctcaaattggcaaagttatggagaacgggaaatgacttgtaataaggtcttgaaaattcactctgaagtgccaatacaaagctcataatgtacgagccagagcctatccttgaaactcctattcttttaccgtgtaactcttcgggactgttaatgtcagtacgattcaccccgcttgaaattgcccagcataaaggagattccacatatgttcccgcaatcttgtactgcgtatcattcttgcaaattccagcaacaaatgcttcagtgagaccaacagctatatctatctcgtcgtttttcagtgactggatcaaatgaccagatcctgatgggtagggaatcaactccacctcaaccccactgttctcaaagaaccccttctctttagcaaaccagattggggtgctaaaatgctctggtatgtaacctattcttaacatgactgctagacacaaaagggcttgttgttatggatacacgctgggttgaaattctgtatcaatttgactctcaatgtcttaattgtctgcaatttgcagtgagtacgggcgataatgtcactcccagatggtcgtgcactagttagcagttgagtttgttggtagtgcgtgaccgaatatttcaccgtcttttgccctcactaaacaacattattcccaagccatcacatcgcccattacaagctgctccctggtcccttgccaaatgagtattcaattgcgagatggattcataaatgaatcacaggataaagttttagaggatctgcttgtcagattcgttgttaattgtccaccagaagatctctccagcatcgaaagagtattcttccagatagaagaagctcagtggttttatacagattttgtcagacagctaaacccacaactgaagaacctctctatgaagactttctcccaaaagattatagaaaaatgtcccttgatttggcgctggggcaacccagaagatgctttggtcagatttggaaagtacaagtccaccatcccagtcagaggttgtgcgctgttcaacagtgattataccaaactcctactagttcaaggttatcagtccaaaagctggggatttcccagaggtaaaatttccaaggcagagtccgatttaacgtgtgcattgagagaattgaaagaagaaacaggttttgatgcctctaattacattgatgaaaatgaatatattgaacgaacaattaaaggaaaaaattatagaatttatttggtcagcgatgtgccagaggatactccatttgaacctctggtaagaaatgaaatctctgacatacaatggaaagacgtaaagaaactttcagtggcttgcaagaattccaacaagctttttttagtggatgctatgataaaacccatcctcaactttataaagcggaagacttcaagtgaagattatttaaagcaaaaagctaccttcgagttatcaagtctcttgggtattggggaggaagaggagactgccgattatggtagggagctaatgaatattattcaacaaatggttctaaaagacaaatcacagtcgaatgctccacagaaagaaatatcatctcaacagtacccacatccacagccaaacttccccgatatcagcaacaccaacatcaacaactctgttcccattccagttttccccaatttccctttcattcagaatcttccccctcagcaaatacccgctttcatgaatggtcagctacctcctttaccatttttggctcagcctttcccatacattccaggaggaatgcctcccacagcaatgttcccacccgccatgcctcaacagcagcagcagcagcagcctaatggacctccttttgtcccacaagatactgggcctaaaccagaaactttcaacagaccaacattttataggtcgaaagaagccgatgcctctcaactgctggacattttacgaaaccctgcaccatcaccagctccaccatcagcaactcaaaccgaatccaagaattctgctgaacttctgagtattttgaaacaacctaattccaacaccgctaatttgaccgaaaatactatgaagcaatttaataaggatgtaagctcaacgccaaaggaacagagtgaaatattactcaaatacttgaacgaatcgtccacagaccgaaatagtattcctaccagagttccctcaacgcctcccacaacaggcgccacttcttcgaagaacagagtacgcatcttgaagcgtggtactgcgctcgacgacctatcaactcgtactgttgaacaaggtagtcatattgatgaaagctttatgaaagaggtatcattcaattccgacaacagacaaaatgataatagttctacatcttccaaaacaatatcaagaattgcaccgtcgaagagaggaacggatgcacccaagtcacccttcttgaacggcccctcagttccacagataacacaatcaggaaatgataatgacgatgatgaattcggtgacttcaatcaactccatgaacaacactatagtgaaaatgattcccaaatagatttgtatgaaggacttgattccgatatggacgaatacgttccacctccaaaagttcaagccgcatctgttgttcaatctatctcagcatctaagaatgctattcagccatcagacgtgaataaatgtaagaaatccaaagaaaagaaagaagctcaagttgctgttgaacctgtaaaagctagaaaaaagattactattctcaaaaaaggagattcattagaagaacttcttagaaggtcaaacgaaggaacgccagaacctcaaagtttcaaaccaactgaagcatcagttgatctggatgctaccaaagatttgacaaacatcttgtttcaaaagtctcaatccaatgagaaccaatcggccgagcctccaaaagaacagccactcaagtcaaatccaatcccgcaacccaatggcaactctggcagccaacttgggttacttggacttgtaaagcagaacactgcattgaatggaaatagctccgaacttttagatatgctgaaacgcccaagcttccgggaagaatcaccggccaaaagcaatggatcatctgaactgttggacattctacagagaagagaaccctccatcccaccaacagaaccaccggctcctgcgaatagcagtttggagcttttaagtattctcaaaagccccgaccaacaaaagaaatcagaagacagttccgagttgttgagtgttttgaaaggcaacgttcaagataatgagcctgttattaataatgaaattcgcaaggaaacttccaacggaagctctgaactacttggaattttgaaagggaactcatctagtagtgccgagttgctcggtatgcttaagggttccaactctgtagcccacatatagtaagatttgtaaatgataatgtatcactatgacttcaaaaatcttgtgttgcagctaaaatatctgcccgagagtttcttatttgatattccttattatcagtgaggagagaatttaatttctggaatgagctttcaccaagtgttcagacgaacattcaccaggtgagcattatacgaggcaatacgcatgctacgagtataattaatttgagacttttgataatcactgttgtcttgaactactgtgaatcattgtacgtatatattaaacacaatttataacctttcggttgcggccatatctagcagaaagcaccgtttcccgtccgatcaaccgtagttaagctgctaagagcctgaccgagtagtgtagtgggagaccatacgcgaaactcaggtgctgcaatctcttttttgctgtcactactaagctctttgctgtcaaccctttgcagcgccgagtaaccttagaccccatggatctttcaattaaaagtactatttcctaaagtttctttagtatagcattgcagtactcagaattatcattattcccctcacactagttatctgtatcagaagagcttcgcgatatctcaaatccaaaaaaaaaaaaattagttcaaaatttctgtctatcccatctcaactagctcatcatgaaactcgatatatcacacatgaggtacctcaccaatgacgacttccgagttttaatagctgtggaattgggatctcgtaatcatgaggtggtcccaacaccaatgatccatcaaatcggagggcttcgttctccgtctactactaacagatccatctctgatttggccaaactaagcttgatttcaaagcttcgaaatgccaagtatgatggttacaggctgagttatttaggatttgattatctggcgctgaagagcatgctgaagaaaggttccttgtactctatgggttccccaatcggtgttggtaaggagtctgatatttatctggttagtgaccctaaaggagtggaaaaggttttgaaagttcacagactgggtaggacttcattcaaaacagtaaagagaaacagagattatttaaagaatcggcagtcatgtaactggatgtatctttccagactagccgctgaaaaggagtacatgttcatgagcatcttatactccaatggattttcagtccccgagccttttgatagttccaggcattgcataataatggagtggattaggggtgttacaatgagaaggctgagaactcataaagattacaagaagttgtactctgaactgatgagatttgccgtgaaccttgccaaccacggattaattcactgtgatttcaacgagttcaatgtcattattagagatgatccgaaacccgatgagcctgggtttgtggtcatagattttcctcaatgtatttccattgaacaccccgatgcttctttctacttcaagagggatatcgaatgtataaggaagttttttagaaaggtattcaattacggtccaacttctgacacttcaatgatggacgaggatggctttggtgaaggttttaaatatgcttacccagtatttgagagggatgtcaaacgtatcaacaacttggatgtgctagtggaagcttctggtttcaagaagaataagaaaaattctgacctcgagacagcagttcaaggaatgcgagagtacacctatgaagaggaagaaggtgaaggctcaactgaagaagaatctgactacgaagatagccttgaatttgatgattctaaatcagaaggcgaacaatctgaccttgctgaggaaaatgaacgaattgtccaagccctcacatctggtgttgaaaacctaaagatggataaacttggtaattacatattggatgattagaataggcataaagggacgcagcattaggtaattaggttttctttttaggcacttcatttccacctgtaaagaccatgaaatgaaatgtcgcgggcatctctgctttttcttgccagctttcctctttcctccccaagttccgacagtcaccagttaccaaaatggtaagtgttatagacggcttctgaaacaatccagtcaaagctaacaattaggccccatcgctgtactcgttcagcgaagaaactttgcagcgtcttggaaagtttcgcttttcatctgccagagcccattcaatggaggctcttatctatcacattgatacctcatcttacgaaatcaaggctgaaactgatgtcattacctctttagaggacttggtagatgaagttcctgatagttcgccaagatttatactgttgtcatatccaataacactgcaagatggaagaaaatcttcacccctggtcctggtgtacttcaggccccaaacgtctactcaagagggcaaaatgttgtatgcaggagcagtagagcttttccgaaacaaggcaggtgttagcaaagtcctggacattgacgaagaagaggaattgctggacattccggatctattgcaacattagagattagatgggtccaggaagaaaaggggatttttttaataagcagtcaataaattaattaggcaaatcttttctatccaaaacaaccaggaatcctcccaccaagtgtaaagatccggtaacaaaaacgtccacagaaccttcgagcgaacgaataaagttaatggatgtttcaatatcgtgaaaaatatgtttacgacttgctttatcgagactgttccaagtttcagcaagtgccttctgaacatccatattatcaatttcctctttggagatgttcaaagacacgaggtcatcagagtatccgtctgaccacgttaagttagtagtgaagataacatggttgaactttaatttcgggtacactacgccatgcaactgtttaatcagtgcttcaccatctctagtttgctgattaaacaaaagtacagtttgatcagacttggtttgcttttcagtgaaccactgggaagaagcctcgatactttccttggtatgggcaccatccaaataccaagtaatttggttctcgggttcttctataatctgacatctaccaggccacgttgcgctagataaaccctccacaaattcatctggaaggtcatcctttacatcaactttgaatcccaatttctgtaggtgaattgcggcaagctctatggccaagttcgcattctctttctggaaagcacctgcgagtcccagtttgatatcactgagatccctgtcaggaacgactttgaagaactttacctttctctcttcagctcttctgacgagttcattcataccttcctctggttgtggtactgaaacagctggaactccttctttgaatataccagatttgttccaggcaatatctgtgagggtatttcccagcatgaaagtgtgatcaatgccaagagcagaaactccagtaactgtgggtttttctattatgttcgtggaatcgaactctccaccaactccaacttcgtagatggcagaatcgacgttttcactcatgaatacatggaaagacagtagggttaaatatttgaagtaggcaggtttcaaacctgggctcaactgagggaacgtagaagggttagattcagagttttcaagtctgtcccatacttcaaagaagtatttggtgaaaaggtcctcagttagaggcttcccattgattctgatacgttcccgcacagacttcaagtgtggagaggaatataatccaaccttggttatgtggggtttttcaagttcattggatcttgaacttgcaagggtggagctacttgagtttctggacgctgtggcgaagtctttgttcttgtatctcttcaaaattgactgcacaaatgcacatgtggaacccttacctttagtccccgtcacatgaatgatgttcaacctgttgaattcggttggagagtaacctatccttctggtccattccaccatttcagggatgttattagcacttctgttgttaccagactttcgaatagcctcaattgtggcgtagttggactgaagggagttcaaggcccttatagcatctttatacgaacgatgtaatggcatatctggctgtcccatactggttggatcgaacaaagagaggaaaatctctggcaggcctgacgtttttaaagtttttgggtagtgtgcaggcaaccaagaaaagactctaggagggcgctgggaagtaactgcttaaaggggatcgctatgaagaattccttgtttaattcgggcatctatccgtccgtgagggataaataaaaaagaaaaaaaaagaataacagaaaccaagcctaaagttaccagataacgaaaaattatcataactaaatttaatatacattataacgtaatatgacgttaagtctctaaccgctaacctttgtaaaaaacccccctattattgaccaaaaaagatctagaaatcctcatcaaaggcaaaggcatcatcattagaagttttgtctgtagaagccatgacacctgccttttggtaatcagaaactctcttttcgaagaagttggttttaccggccaaagaaatgttctccatgaagtcaaatggattgttgacgttgtacacctttttgttgcccagagctaccagtagtctgtcagcaacgaactcaacatactggcacatcaagctgcagttcatccccagtaaggagacaggaagagcgtctgtgaagtaccttttttcgatctcgacagcctctgtgataatcttttcaacgatttcctcactggctctattgtttaaatgagaaaatagcaagcaagcaaagtcagtgtgtaatccctcgtctctgcaaataagctcattggagaaggtcaaacctggcatgagacctctcttcttcaaccagaagatagaagcaaaagatcctgaaaagaagataccctcaacagcagcgaaggcaaccaaacgttcagcgaacaatgcatcgtcatcagaaatccatctcatggcccagtcagccttttctttgatacatggaatggtctcgatggcattgaacaggaattcagactcttttggatctttgatgtaagtatcaatcagcaaggagtaagtctcggagtgaatgttctccatcatgatctggaaaccgtaaaagcattttgcttcgggaagttgaacctcagcactgaaattttccaccaagttttcattgacaataccgtcagaggcagcaaagaaggcaaggactctcgagatgaagaatttttcattatcgttcatacgattattccagtcatgcaaatccttacccaggtctatttcctcagcagtccaaaaggaagcttcggcctgcttgtacatttgccagatatcgtggtacttcaaagggaagagcacaaaacgacgtttattctcaactaagagtggttcatccttctccatctccttcaacttgtggcggtggaccttgtgcttagcaagaaatgccttgtggtcgtcgtcaagcttgctctcttccttcactggcgcattcaccttctctttctgatcagcagctgcttggagtacagaggtcaaatccttcttggataagttaatgtctaggttagagagagcagctttggcacccttagttggtgtttcttgaacagacatggttgttagttgtgggttgttgattgtacaaagtagtaaagagggccatcgctttccgtttttatagtagcacgtaaaaaaggaacgcgaaaaaacacgtaatttggccaacgcgttactagggctctttgatgcactatgaagcaattcaaagtcatccggcgtgtttacgagggcgtctcctatacaaaaaaatcgggagacagtagattccgagggttttgcattaacagtaattaccacatgaggtgttaatacaatgcttgagatgaaatcgataaagaataggtcgtttcttatggcgtatatcgagaacagtgttagcttatttacggttcacgataatccgatatctcaatccaggggctgagggttacattatctattcgtctaaaatttacccttagccaagttctttcccatgtccctagcagtatagtatgcagtccacataaaagtgtttagatccaaggtggaggaaatggtgtctaagaatccaaatggaagcatggcaggaatccagccttgagcaagttccaaggcccagctctcgctaggcattgcgtattgcttgacatgccctttggggagatgatgctgagaaccagggagatatacctctggctctagtgctcctgggtacgcagccatctctttaccttttaaaatggtaaaatagtcatcggcgtaatgaacaccagtgtgcccttctgttcctatggcagttccgaagaaaataagatactcagagatggaggcatgcaagataaacatagttcccatagcacctccagcgttgttgtagacccattcttcgaaatttagatcattgataatatcaccgtattcttctttgatcgtgcccgcaaggtcaattaagatgttagttgcatttccatctggatgacgggcaagagcttcctgactcaacgtttgaagcaatttcttgtcaaacacgtagttatttgggagccatgttcggaaagaaatctccaggaatgcatagacgagggccaaagagaaaaaccacttatataagttcattccttcactgttgtgttagtctttgaagtatagttgggtgcatgaattgaggaaaactttctaccatttatggtctcgtataatgtcgtataatgtcgtataagttcgtaaatgaaaaatggtcgttcaaaacagaaaaacattgaagaaaatagcattcgttacacccgaacaccactaccaaagcgttagcgcatatttttggtgtggtggatatactgaaccaatatcgtttgacagatcagtgagagacaaaaaaacgaacatctttactgaactcgctgtgctcgatgaattttttggcgaagactgttgcgtctctatctggaggattctcaagtattccatacaactttggagatgtcatagttactggagtagagaacgatatctattccaattctatatggaatgtctataagggaacttccaagtccgataagactgtaaactgttctattttcatggttgataccaagtctgtcactgatgagctatttgttgatatgattggaaacgcgttcaagttcagtaaggtgttgaagttgcctggagtgctgaatgttttgcatgcttccaacaatgattcccattattacattgtgacagaacaggctatccctttggacaagtatctttcccagaatgatctcacaagcgaacaactattatttggtctttacaatatatctgaggcactcaaattcatcaacgttgaaggtgcgactgctcattgcaatgtgaatagacattcaatttttgtaaccgaatcaggtgaatggaaactgtttggcttcgagttggctacaaatgcccagaatatttctacatccctagtccccatgggatttcgtctcccttcattcaaggatactctagcacccccagagtatctgaaagatagtcagacttgtgtccagtcacttttgcaagctatcaagattgatgcttggcaattaggtgtactgacgtatgagctatttaatgatgtgaaaatgacggacagttcgttgatgaattcctttacaaagattccaaaaaacctagttccctacttaagaaaattgcttagtccttcagttgcaagtcgttgctcacctcaacagttttttgaagttggtacttcaactttttttaaatctcctctggtcgacatggtcaagatattgaacgaattttccttagctgctgaccacgaaaagctggccttttttcagaacctccaaactgaagagattacccctccaaatggattcttggagaataaggtgctaccacatcttctgacatttttcaaacagacaacccaggaaaataaaccaatgttgttacatttaattctcaagctctctctaactattcccaaggaacggtttacagatcatataaaacccgttattttggaaatgattcacgtccccgacagatctataaggatgactctgttgacaacattaccattatatgtagaaaaattggacaagcaagatataaacaatcgtttttttgcggcttttctaacaggtttcaacgactctaacgttgccattagagaagagacgatcaaatcatcagtattactagccccattcttgaatgagaggcccttgaacaatgagctgttgaggtatttagccaagacgcaaatggatgaagctgccgagatccgttcaaccacgatactatgtctcaataagatagcatcccacctcagtgttggatcgaggtctaatgttctaattattgcatttagtaagtccattagagatcctcatattccctctagactgaacgcgttgacggcctttaatgacaatattgatttatttacccctgaggaatgctgttctcgagttctatctgccattgcaccattattgttagataagttctctactattagatcagaatgcgacagggtattcaagttgtacatggaaaagattgaaaaggcagcaaaagaaataccggatgacacagacgatgcgattgaacttgttaatgatgagatgaacaaacaagaaaacctcaaggaacagataggttctttcggtgactttgggtggagcgctcttacaaacatcaccaacaagataggaggcacactcaatgcagaggtaaaccaagttactccaggacccagtcaggcacaaacccccacacaatcatttaccaatctcccgtcacaggttttacaacctacgatttcaaaggccaccgaagacgattcttggaactttgacatggagaaggagccatcctctcaacggttcaacactgaagaaaagcttccccagcatagatctaaaccaataacgttaggcaagaaatctttaagtttgaaaacactcagcctaaaacctaatgcaaacacacccaacactaaaatctccaacaagatggaccaaaatgcgtgggatgatgacaatgataattgggataatgatttcgagtttggagataataatatagagggagaagaagcagaagaagacgaaggttggggagatcaatggtaagataaaactacgttaatattaaacgattattaattttatagcaaaaacaagtatggttacatagacatgtctaggcattcttggctctagaattttctgtttggaagaggagcgttgttggcaccgctggatctgtatccaccattaccacctccgaatccacggttaccaccgtaaccaccacggccaccacggccaccgcgtccaccacgaccaccacggccgcctcttcctccaccgaatccacctcttctacggcacatagcttgtaagtcttctggaatgatttggttggcctccttaaggatgggaactaaatcgtcagccattctggcgtttgcgttggtgaagaaagaaacagcagtaccagtggcaccagctctaccggttctaccaatacgatgaacgtagtcttcaatgttacctggcatgtcatagttgacaacaaagttgatacccttgacatcttttttatgttagtaaaatagttcaagaaacagaaagttatttcttccagagataccctaggacacacgaaggcttctacaaacttatattctaactactaggaaaatgaaaaatgtgaaagaaggtatagttttattaaagtttatgatttcaagcaggtactgccatgcacaacgccagtttgtacatgaacccttctctgccaatagctaaaactttacttctttgctggatgtcaaaaatagtcaaaaagacaccctatttgtcattttttgttggcaactcaacgctaacaaaacgcatctcaatgtgctcgatcctagtagagatttaagttcacagaagaaaactgtctctaacatcgaataaatgaccagcatttattcgacttgaaaatatcgggacgggaaaataaaaggaaaaaaaaaaaaaacttaccaatacctctagctgccacatcggtagctaccatgattggggatttaccggatctaaactcttgcaaaacccagtcacgctcacgttgttctttgtcaccgtggatggccaatgcgggccatccgtcacttctaagataagtagttagttcatcacatgttctctttgtggaagcaaagaccaaaatcttggaagttttgtcttcactagcttgttctaaatatttggttagtctgtcacgcttttcgtactcgctcaaaacttcgataacctgtttaatgttgtgagaagcagccagctccaaggaaccgacattaacttgaatgtagtcgtgtaagtagtcccttgccaaggcttgaacagacttgggccaggtagcggaccacattaaagtttgtctgtctggtctaatttgatcaacaatctttctgatttgtggttcgaaacccatgtccaacattctgtcagcctcatctaaaactaagtaagtaactcttctcaggttggtcttcccagtctccaacatatcaatcaatctgcccggggtagcaatgacgatctctgcacctctagccaaatctctgatttgttggccctttggaacaccaccatagacacaagtgtttctgattctggaggaagagccaaacttggaacattccttttgaatctgaacagccaattctctggtaggagccaaaactaaagcaacagggccatcaccaggtttcagcaaaggctgagcattgatatgcacaatagctggtaaacagtaagacaaagtcttaccagaaccagtagcagcgataccgaccatatctttaccaccaagagccataggccacccttgacattgaattgcagttggagaagggaaaccctgagccttgacggctgttaaaacgtaatctgggaaaccagcctcgtcaaaagatgtaattggcttaggaatatcctttccgtaacagttcatgtcgtgctcctttctgaaagcttcaacatcttcttgggttctagcagtgacatctgggtgctcgttgtagaagttcttctcaaactttggcatcttgtccaagtcccattcctgaaccttcaggttacttccaaaggagtcgtaagagtcgtagtttcctccgcctcttccgcctctgaatccgccattgaatccaccattgttatagccgccaccatttccgtagctgccattgtcgtatccaccgttgttgtaagtcatcttgggcgtatgtataagttgaactgtgttactgtaagaagagtaactgagggaggcgttttgcagtataagtactcacagaaaagaaatccaaaaaaaattaaataggaaaatttttttttaaaaaagaaataaattggtctacacacgcaagcttagctttatcagagagaagatttaggtgattcaggatagggaagaacgcagagggtagggcccctaaatagttggaattactataggctattatacagattctatgtgataggtgattgggtcaatcaatcaaggctcttcggtagagtagtcaccagcagcaatgacatcagaaaattttttctcaacatgatcgcagatgtcaaccaagtcatctagtcctttacgtagggcttccacggcagtcatgccaccgtaagtctggattcttatattcaatttggcctcagaaggatgaggaatagagtaaccacagtattcgacttctggattcttgattatgatgtatcttagagagttacccaaggtatggtcttcatctaagatttgaaatgaggcagcggttccgtcttcggatgctccaggtagtaacgtaattttatttgactgaacctccacgtcttcttcaacattttgttcaacctcgtctatgtccatctcttctggcttggacttgctaatattctcctcgttggccattgtcactctcacacggtgtatgaagattttcaggttttcactagatgttaaaatgttcgcgaaacatctgcatccatgtccctcttaacattaaccattaacctttttgaaccgtcaaaacgttgcttggatagtgcactaccttttcgacccccctcgtgtccgattgccacttctgtgtggctgataggaagaggtatttgaacccagcaagaaacaaagccgtcaaaagccttcaaaaaaaccagacggaaagctgttggtcagtttcctttagagttagccgaccacaaaccataatttattttttgcaagcgtgatagtcaattgaccgtgttgttggattgttgtgcgtttggattgtttttccctaccagcaattgtctgaatacgtccgaacaataatccactccttccttttttttttttcttaccttacccagagtatttctttttccatcaaggtcccaaaaacaaagatctggggttatctaatcgtggttttagtagtagatgcaatccatacatactaacaccgaatctgctcccactgttccaccaaataacgactcttacaggatgtcacccaattcgaaaacaccaggagactcggacaaggaacaagcaggggaaaacgcaaacaactcaagatctggaatggacccttctcatagcaatacaggcaacaacagcacaggagcaattgttaatcaagcggtatccgatattgaccattcggcgttccctagaaacgactcattgagccaatttttccctcggttttcgttcgactccaacgcttcaaattcactatcaatgtcctttggtggcgatggtaccccttccttttcttacaactccaactctgaacttccacgtggatactcagtagtcggaccggcattgaataatgtctcattcaacaagaagggctctacctccaaggaaacaaagtctaaacctcctaacaatgaagtatacgcgttgccatatcagggctctgattatttcaacagacgaccaagtgaccaattggacccgtttatcccatcccttcagagttctcgttccagacaaggctccatgcttcacagaccgcgtcaaatgagcattttggcatcaaacaccggtggtgagtcgcaatcagactttgattcctttttgaggaaagatggattcaaagggatgcttgtcgatcaaggggatcttcttgataacatcggcaacttcgatggtcaatatcatcgcaattctattctgccttttcctaggttgtcaatatctgccccatccaaccaagggttatatggaaatcaaacacctccattcgctcctcaaactactggggttcaacagaatacaaatccaaatcaatatcagaaccaaaaccaactaaattataggggcaaacctggaccttatataaagacagatccgacaaagcaggatgatgaggaaaggagagggccacaggatgccactcagccgaagcaggagtatacgttcaactctaaggtagcttcgaaagagccaagtttatctccctctccagctgcttcgtacccacccgaggataagaaggcacatacccaacagaatgcaacaggcagtattaacgtcaataactcaatcaacaacgtccagggatctaaacaatttcaatatcagcaggtgccgaccgcgggtcagtattatacacagaatccaccattgccaagtcagaacgaccaaggacagcatattactcaggtaccgcagatacccagtcatccattggctcctgaccatttacaacaacaacaacaacaacaaccccagcaacagcaacaacaacctcaacaacaggcatatggtcgtcagcagaactattcaatgtcacaataccagccaaaggcaaacatgtactaccaacaatatcctcaatcaggatttcaatatcccaacacctcaaatacacagatcccaatgacaccacaaaatcaacagcagaatcgttcaaccaaaaaggcaaaaactattcaatctcaatctgcaattgcttcacctcgtgacttatcgcctggatcaccccccacatcgggtaatgaaactgttcgaccactggttggtgcgacaaagattgatcaattgatgttggtgattcaagccagaaataagggaattacaaaacctatagcaagagctccagatgggagtatcattgaagatgaaactgtgatacccaaagttaatgatttggttggcggcattgaaaaaccacactcaaagggttctaagcaacatgaatgtcctcactgcttcaagaagtttacccaggcaactcatctagaagtccatattcgaagccatattggcttgaagccttatgcttgtgagtactgtgggaaaagattcactcaaggtggaaacctgaggacccatcttcgtttgcatacgggcgaaaaaccttttgagtgtaatacttgccataagaagttcagcaggaagggaaatttacaagcccatcgtctgacccatgaaaactttaagccatttgtttgcaaacttgacgattgcaacaaaacattcactcagttggggaacttgaaagctcaccaaaaccgtttccattttgagagtttgaatatgctaactacaaagttggcaagcctcagcgcttctggagaagaagatcttcaaacggcgttcaataagcttcctcaacaagaacgtgagttattggagtatttctccaacttgtacaagaatcttaacaggggtattcgtggccgtggaggtggagctcattcacctcaacaacaattaccacaggaagaagagaaacaggtcgatcaacaacaaaactattacatgacttgattcacaggtatgggttaagtagataacgctggtagtaaccgaaaacactagaaaatagtatttgtatgttctacgtggagtcttatgtcacattcacgtttgaaattatcaattaatttacagagttaactgtcaaaatttattgtatctggcgcagtggtccaatcattaaagaagagatcgtcaaactcgtagttgctcaacggtttcaaatctttgtttatcgggccttggctatgatgatccatgtcattggatccatctgatgtagctacgctagctcttcttggatcattcatattcgatatgtttgacatatgattattgaatttttgggccgcttcaggattttgcactgttgatgacaaccccgagggcaccattgtaaagttctgtagtaagttttctaccgagttactgttatttacaacagactttgaatttcctgggtcgtggttattattattatcattctgcaacgggtataatccatccagaactgtcacaggttgtgatccatcaggagtattcgacgaggatggttggcctgataggttcctttcattttgtccctgttcaaccttgttggagttcagcatgtaaggtggaaggaatcttccgaaaattttcatatctagctggtccatcatgccgggaatgtactttgtttgtacaaaattattgttcaaattagaattgtttatactttgaaatgctggattatcgataccttgagtgttagaagtttctgagagattaggcatatttaggttgatccctgtaaacacaccatcgatgtagttcaccccattcactttctgatcaatctttgtatttgaggaaccatcttcgatgttagtgttttcaaactgagaaccaaaggaagagtaatcgatattctctgggtccacagatttcacagttccagaatagttacttggttgtaactgcctgtgttcaccctgtttctgatactgggtagcagctgggttattcaaccctgatggtggttgctgtgcctttgctaggttgacctttgcagttcttctgtttaactgctcaaacaaagagttgagaatattatacgttcttcttgccgccatactactatctttgaggatatttaagacctctcttccactctctgtatctttcttgatttccatgtattggggatccagttctccattgtctttcttcggtggagcgaaatgaacatagtacaccagacatgccacggaaaaaaaaatggtataaatggaaaaccaatatgaaccacttaacattttcctattaatcatgtcttcggctagtttaacaacaattctggcaacattgacacaattcttggctttctcgatagaagtgatctcttcgggcgacggagggatagaactatttccaaccttatccttttctgagatgtaatgaataaatggcctgtagagaataatcttgacatgcaggtatgccaaatgaagcaatctgttagctttaaaatactcggtcggtggttctatccccggttttagttctgcaggtagactattgacccaattttggagatccatctcaagttcatgaacgatttcatgagccaataaatcattgttctcaagtggggtatcgccactgtttgaggttggtttctgtagtttgacaggatataattttttcacaattttcttcattatgaatatcaatctagtgtgagcattggctattcctgaactggataactttgtaccttgtaaatcgaacctatatccggtttcactaatgttctcatcatcaagttcgataggcatttcctggtcgaaatcctcttcagaaatggttcttggaagccccagcattgtattgacatagatgtccattttatagatagtccaaaaaagacgctttcttgtttctaactcaattggattgaaaggatagttcaactgacgatgcaaaccttctctcaatgcagctcttagagcaatgccaatataagaatagcatgttgaaagacgagccgaacattgtaaaaaaatgatcagcataacaatagtctgaattccgtaggtatccctggtatccgtgatatctattagttttcttgcggcaataaaatacttgtaaccctcatcgtctatgagactttcatcagaagagtctttgggcttggagctcttttggccgtgattaatcccatcagtcttgcaaaaaagagcaccacaagccatcaccgaatatacaagaggtaaaaacctttgttgtttattggtgtagtttgccaaatctgtttcatataactcattcaggtcctcaataaatgcgggtctgtgataaaagcggaaaagtacacacgcgttgtcccaagtcttgtagataagcttcagcgcaatatctctcggaggtaatatgatacgtatttccctccctagattagattctatggaaccatcaatagaagcattattatgattgggactgtgattagagaaggaccctccttgccccaatgaaggaggagctggctgctgtacaggttgttgcatcgttttgtgaagcatctcaatgtaattgtcagaaagagccttgactgaaattaattcatcacttgatttatcggctctcaattgttttaagatcgatgctagacgaatcggattaactcgaacagttggagcactgttggggtatatcaactggtttaaaagatcttcgtaatatttgagtgcgtctctcatcctttggaaatcgatttcaggaggttttacagatttttgtacggaacttgttgcattaatgtttgacggagcactcagactcagagattgtccctgtctcttcttactggaaggttggctgtaagtgcactcataggaataaacggtacaatgaatgcatggttgttgaccatcacatttgaccttctttttccgacattcatcacaagctctggtgactcttcttctcttctgaactgaaatgtttggggtagattttgcatctacttttggattcggcagaataaccttattaccgggtactatttgttgagaagccatgggctgtatactctgctccagccgatgtttaggaggcattttagttataaagaagggagattaatacagggcaaagatgattgtgataatccctagtgtagaaggaaaagaaagaaggacaaggaagtcacgtgcagcaggtgaaaaaaacaccagcacaagggatgaagtgctggcggttgaagacggaggatcaaagaaggggatgaaatttcctactgtgagccgtaaaaacagaaatcagaaatctgactggggtctactgtttcaaagtgctgtatggggctgatttaggctgttattttcctgtttgctgtgtagtcagggttgggaggggaagaatctaattacgcgcgactatgacagccatttaagatttgaagtctgcgtcagttaaggggtacgacagaagaaatggaactgaaccttcagttggaccattgaacccggtgcaatatcaaatccagcctctactgcatgtaatctcagctcttaacggcttgtttgtcggcctgtatctttaaattcgacttttttattgttctaaatgcaggtcatcgcctggctgttgggatctttcttcgcgagcatattccatcaggggaccattatggattattcatcaacctaatactaatcgtaatcatcggatggatactgaagaatattgccccatatgcaagacagacaagtatctgtctccggatatgaagtttctgatcaatccagagtgctatcacaagatctgtgaatcatgtgttgatcgcttttacagtcttggacctagtaagtgcatgtatcccaattgtaacaaaattcttcgaaggaataagttcaagactcaggtgtttgacgatttaagcatagaaaaagaatgtgatgtcaggagcagagtgatgaaagttttcaacaagaatgaggaagacttttcagacctcaaagactacaatcaatacttggaagagatagaggacatagtgaacaaccttgtgaataacgtagatatagaggaaacggagaaaaaactcaaggattacgaattactaaatcaaaaggagatcttggagaataacactaaacaagttgagaaagatcaaatacaggccgatctgaccaaactagaaacacaactcaaacaggaaaaacgtcgtcatgagaaacaaacagcagaggaggacaagttgttgaaaaaggctaacgaggccgccttaattgaccaaatgcaaaacgagtccgcacaaccaccgcaagcagttaggatgcataatacgaacgtgctaaggaaatcatcagcacgaaagaagcatattaaggagctagaggagcagataaatatgcatcgacgagctcttggagcaggtggacatggtattgaatcaagtgtgccaccgcaaactccattcacaccgtttaatggcgataaagataggacgaagtattatcaatttcaggataactactacgatccaatattcaatgatatggtgtcaaaggatcccacattcacagcgtcaggttacgatatcaagaagtatttcaagaggagtcttgctgaagcctttacaggtctcaacatctttgtttcggaagagatttcttagcaagccctgtgtatagttttatagtacaaccattggtcatctgctaggaggtgcgtaccgcgaaggaactcgaaaactatcttactttctcccccttgtaagctgtgtatctccagacctcctcccaccaaccgcggtcgcttcttccagtctgcctccccccctaggccgggtcacaaatttttgtttaccgttgggccatccaaacgaaaacaaacaaacagagcaaagactacaaaggaatcgagagaattttatttgcagatcatttcacaaaaagtcaccatgtcgtccccaagaaagaggcctattgatgacgatctcaatgggataccatttcaggacgatccggtggagctgatcaaccaggtgaccttaacactaactactcctcccgatggtatacccacaaatgtcagtttggagtataacaacagcaagaatgtgcagaacgaaattcaggcgtacgcaaagatatcgggatgtgattggactttttatgtcaaatcgttgaatgttgttatcggaaggaataccgagttcaatcagaatggatatggagatgaggagaccaaggtggacattgatctggggccttctaaggtggtatccagaaagcacgcttcgatcaactacaatctgaactcaaggaaatgggagctgaaaattttgggtagaaacggactgaaaatcgatggtattcggtacagctacagtaaagatgaaggtgcagtcacggaactgaaatctggtaatattatcgatgtgggtggaacccagatgatgtttatccttccagactcttctccggtaatcgccaaacaatttctattgaatttgaagaataagaaattgaagaactccgatagttccaccatgctcaacaagatgccaacagaataccatcagcaatacaacttctacaataataccctgaaaggatttcagctatacaacaaacaaatccctccacaagaactatctaagccacagtcgtcatctataagttatgatcaactttcacaacaaaatcaaacccagcaaagtatgattgaattggactccgagcaagatttatcgaaggacgatgctaaagatatcaagcctccgtattcatatgcgaccatgattacacaggcgatcttaacaaacgaacaaggcatactctcattgagtgagatttatgactggatttcttcgcattattcttactatcgattttccaaaacgggttggcagaattctatcagacacaatctttccttgaacaaagcttttgaaaaagtgccgagacgcccaaatgaacccggtaaaggtatgaaatggcagattagtgaagcatataaacaagattttatgaaaaagtggagggacggtacgttgaacaaagtgagaagaggaagctcggtgacgagacaattgcaattgcatttaattaaaaacaaacgactacctgaatctagacccaccacaggatccggtcctatactgcaggttaatccttctgccccttcctcgcttcctgcctccgcaccacagttacctcccatgaaccaaacaattccctttgcaactcatgacgtcaatagcttgaactacatcaataaagccgggtcccatctttcatctcccatgaaatatagcaacttccaaccaaataatgtcaattcagtaggtcaaggacagcccggcccacttccattacccaattcacaaccaatagttcgaagaccagagtcatctcaagaaaggtctactcaagtatctagaacgttacaaagtgcccaagcgacaaatggtacctccagtaccgatctcgcaaactaccctgccagtcctcaaaaaaggtttcttaccgaagcgtacactccagagcgatcgaaagataaaaacgggacgcagaactcatctccagcgttgtggaacttcgtccaattttctactcctattggtcctgattccaaagacaacaaaagccctgtgaatagtccgacggccaccaaaaatgaatctactcaaaacgcccttagtgacttgaaaaatattgaccttgccaaaggcttcaagaactaggaacagttcagtgtttttttcagtttttttactagtttcactatgtacgtaccaacctccgttctgcatactattattatggggtgcaccgttatgttgcgtaaccgattattgtgattatctaaaggggttatcttacatcatatttcgtgtgccacacatttaataatgtatctggaattagcacctacaaccacggctaactagaataatctctacgttgatggacgccatttggacatttgtatattagaacaaaaatacgatggataatagtaacgacggcattaagttgcttttcatttccggccatcgggtattgctggagcctcaggtgttgtgtgagtacgctggagtatcagacttaaactttgttaccattgcttccgtcctagggtatattttagaacattggaaagaagtaggtgatgttgaagaggcaccacagtcggttgaacaaatccatttgcttcaccttggatcaaggctggatggagaagtaagattggatcagattaacctttcgatctccaatatttttcatgtgtcaataactccaccccaactcgtccttccaccgggaggtcatcaaaccagaaaactgtctgctttcaaaggagtcatcaagtccagaagagggtcccagttatcagaaacaaagatgacaagtgtaaatttgaaaacagaacagcaaacagccgagagtcccagaactcatttaacagttaaagatttgcccatcgaacaacagcaaccgtcgcagaagagatcggtagatgaaccgaagactcccaagaacgaagagatggcaagtgatcaatcgttgcgctcatcaagaatagatcaaaggcaagaaggaggtgccaggcaacccgaatcgcttggaaggaacctggagaggaatcaacctgaaactaagtcacattgttgtgttatcatgtaattatgtaagcaggtacgtattaatcaggcatggactatcgggatgactagaacttgtatgaaggtatactcaagtctaaccagcaatcctttgcagatcgaacatgcaactcttggaggagaatctggagatttggcatgtgcgcgattgttctgacacattcagatgaggagcgaaacacttttgcctttatttatagaagaactgtgcgactgccctttatgataagaagtatagtaaagccgctggtaggttccgtcactcaattcgttactgaagagagtacgacggatgctcagcagggggcagttacttcattatatgtagtaagttgtctaataacactttagaattgagggttgtactaaccaaacagacactgttgcaagttatggtgacaaggttgctttcaagccctgatactaaagtggttcatatttgcatgagtggttcgtatccggaggatcatctacagaacgtgctaaaatcattatcttttggtgacgaaaaaaagaagttaccattggatgacaagacaaagaatactattttagatagtatttggctggcttaccctgacgatctgaatgagtcgtacgaacaattggagaaacttcaagaagagaattcagcgggtctctcaaaactgatgattgttattcaagatttggatgatatggctgagttatacgccttcagagatttcacatcaggtaagtttacactctgaaattttgattacaaaatatatactaacacatttagcctgtgctacattgatgaatttcatgcttaaattaagaaaaatcagtcaactgggagctacggtcatagttactaatatcaatcatgactctggagtgtctatgatattctcctacatagccaagttttacgacaataaactaacgttcagctttcacaaaggctcaatacttttagagatacgtcctctaacgatatcaaccgaacttcagctcagcactactacactctctatcaacccacaaacgatgtaccacatgcttttccccagctctgaaaatgcccttatcagcacgtgattaaagatgagggctcgctgacaagatgtgactagactgccacctttacaccctcagagaagacaaacgtctcatttcgcggttagtaaggttaacccacaaattttcaacgtgtactacccaagagctctctgtctgccatgggcgcgcgcacactccctggtgtgcgaatccaaccaaagtatgaaaaaaaaaaaccattacttcaaagttttctttcaacacacaaaagaagatgagcagtttcgaatcagttgtgattgacggtaagggacacttgttgggtcgtcttgctgcagtcgttgccaaacagcttttaaacggccacaaggtcaccgttgtcagatgcgaggaactcaacatctccggagacttcttcagaaacaagctcagataccacgactacttgagaaagggtactagattcaacaagaaccgtggtccattccacttcagagccccttccagaatcttgtacaaggctatccgtggtatgattcctcacaagaccgcaagaggtaaggctgccatgaacagactgagtgtttacgagggtattccagctcctttcgacaagagaaagaaggttgttgttcctaaggctctgagagttctgagattgaagccaggtagaaaattcaccactgtcggaaagttgtctacttccgtcggttggaaatacgagtctgttgttgagaagttggaggagaagagaaaggctgaggaagctgagtaccaggagaagaagagagcttacacccagagattagacgcagctagtgccgagtttgcccaaaccgaggagggaaagcagttggctgcctttggttactaaatagtaaagtagggtatcttcaagtaatagtatactaaccatctgaaataaccaccgtcctgtagttttttttcgatatcgaagagcctatgctagtactgtggatttgcgctccatccaacatctgtgcgcaaactaaaacttccgagactgacatctaccatcgctagaccctaagtaaaaccaatctcgcgtccgaacttttaaatttcagtccttaaaacttcagagcattggttgtagtttccggatctgaggggtcgtattggagtcaagagacggagctgcctccacagcgcgaaacgtcaaccccaacaccaacctgaatttgcaatcaccatggggacaagtttcagcagtcaatgggcaattcagacgttgatacggtacccatttgctaagctcaatgacgatccatccaacttcagagaaaggcctttctctggtatgctctggtattcattcgtcttttatcactctcgttgcacaatgcccgggtactcccggaacaagggagtcttccagccaagctgtacagagtgaaaaatagaaatacacctttgcaatcaagacgcgcgttggccaatcacaagacttaatcggtgcaaagaaggattaccaaatttttttttcccaaaatcgctatatagaaataatggaggaaaaagggttaatataaaggagaattcccccgtttttctccccttttcttttcttcttcaggctttcttacaaatctataatattccaaaatggctgacaacaacaagtctaacttcttcgtcgacttcatgatgggtggtgtttccgccgccgtctccaagaccgctgctgctccaattgagagagtcaagcttcttatccagaaccaagatgagatgcttaagcagggccgtcttgctaagaagtacgatggtatcgctgaatgtttcaagagaaccgctgctgatgagggtattgcttctttctggagaggtaacactgctaacgttattcgttatttcccaactcaagctctgaactttgctttcaaggacaaattcaaggctatgttcggtttcaagaaggatgagggatggtggaagtggttggccggtaaccttgcttccggtggtttggctggtgccacttctttgttcttcgtttactctttggattacgccagaaccagattggctaacgatgccaaggcttccaagggttccggtgagcgtcaattcaacggtttgatcgatgtctacaagaagactttggctactgatggtattgctggtttgtacagaggtttcttgccttccgttgttggtattgttgtttaccgtggtttgtacttcggtttgtacgactctttgaagccaatcgttttggttggtcctcttgaaggttctttcttggcttccttcctgttgggttggaccgttactactggtgcttctactgcttcttacccattggacactgttagaagaagaatgatgatgacctctggtcaagccgttaagtacaacggtgctttcgacgctttcagaaagatcgttgctgctgagggtatcaaatctttgttcaagggttgtggtgctaacatcctgagaggtgtcgctggtgccggtgttatctccatgtacgaccaattgcaaatgattatgttcggaaagaagttcaaataagccaattagtttgaagtgagattttatttcattcctgttaatattatatactagagtatattttaaattaattgttcatgaacttgccaaattatgttagttttgtgtaaacaatcttaggctatccaatttagttctacttttggtagatttcctgttttggtaaattacaaacaacaatgatttgacttatattctattcggaattttacttatcaccttgtacagtttgtggggatttccggacatgaagaagtttggactggaaaaggacggagatggaatcttcaggctcaaacgaaggtcctcctctcccaataagaagggcaaaacaacattgcctcctttctcgtcacctccaaatctagcccatgacagtccaacagggcccccaatattacctactctcagaaccagagtttctgaaactgacactttggtagatggtatcagtgatacggtcaacattccctctccacaagctatgaatgcgagggccgggtcccccattagacccatgctaggaagccctacgaaatcattcaatgatgaggccgatgcggaactggcccagattataatgctgctatcaaagattgtaagactggggttcaactttgtcaaagatcttacgttggaaagcagctttatttcagtggagaattataccactctgcatctccccagtttcatggtgggtattgctcttgcattgtttttcacctctggaggctcagatgaatcaagtagccgatcaagaagtcacgagtcatcaacatcatcggcctttgggattcttcgtaagtttgtgatgggatttctggttatttccctcgtggtgttctttgttagtttccagagtggggatcaggcatccaattccggatcggatgaactgccccttgtgaactacaagcaggaaacaacagctccttcccctagcacacatccctccggtcggagttcaccaaagagatattcagtcttcaaggaagacctgagtccattacaagagcctcttcaagaactactagaaccagacgagcccctatttttggactcacaacaatcacagcaagacaatcagtacagaaacagaggcaggcctcccacattggccaacagaagggcaaacactggatctcctactcccaaatacagacttcccacagaccactataactcgttcatccagaaagcgaataggtgaagttattcctctacaaatcgaccgaatatttctatacgtgtaataacttcttcgtattagctgcaacgatgcctaaatatacatttcccaaaaacaacgacgcttcgtagaaattataaagtttcacttgggatctcgaagacaacttgcttaccagtcagcttaccgtagacagcctggaaagagtcaagcttgtagtcaatgttggaagagtccttggagtcaagcaaaactttggtgatttggtcaccaccgaccaagtatctgattctcttaccgataatctcggttgggaaaaccaagtcctccaaaatcttctcgtgaacgaccttgacggttctagatctaggtctcttctggacaacctttggtcctcttggaatctttggggtgatctttctctcagccaagaaaacgacatggcggtcagggaacttcttctccaactctctggtcaacttgatttgtaccttgtggaaagcagtcaacagaggaactggtacaaagattacgatggcagtctttccgctctcagtctcaatctccttgatggagttgaattgcaaaggtctcaagtcagcctttaagtctggggagttagcttccaagtcaacaaatgattgggcgacttgcagctccaactcagtgggctcttcgttcaggattttggctgatgacatcttgtgatactgctgttaccgtgtgagtttcgacagaattgaaaaaagattgttaaggctctggaggaaaaactggattcgcgcacaacagtcccaagagaagagtagtaacaaaaaaaattacagtcatgtgatgtaggggatgtggttagggtcgaagcccagtacggtgttgggatgctaagaggttaatatctaatgcacaatacgcttatgtaagttcatgcttgaaatagcctattgatgaatgtaagggaaattagaccgtcctttgtgggtacttattcacgtcttgcctctagcatcttagacaactaatgtctgaggaactaattgagaagtcaaaaaaattggctgctttcgcagcagtcaatgaaaacgtttcgaagtctgacagaattataggagttgggtctggatccaccgttgtctatgtcgccgaacgcttggggcagttggaaaataaagaaaagtttatttgtatccctaccagctttcaatcaaagcaacttatcttggacaatggccttcgtttaggaaatgtggaggagttcgatgagatagacgtagcctttgatggagctgatgaaattgacaccaacttgaatttgataaagggaggaggggcagcgctttatcaagaaaagttggtggcatcattgtctcgtaaattcgttgtggtggcagattttcgtaaacagtctccagaaagactgggtcatttctggcgcaaaggcgttcccattgaggttgtacccaacagttatgttaaagtattgaaagatcttttcaaactaggagccaacagcgccactctgagagatgctggaaaggcgaaagctggtccagtggtcacagataatggtaacttcgtcattgatgctgattttggagagattccgttaaataaggttaaagagctggatgaaaagctgatacgactggtaggagtcgtcgaaacaggtttctttgttgactatgctgagaaggcttacataggcaacgaggatggctccatcacaagcttgtctgttagtgtgccagctagattgtaactagggtagacagacaatagacggcaacagtatggggtaaacgaatattatggccaaaaacgcgaattcccaaattgagtatctggggcggggcctccatcattggagatttagtcagaatttccatgtaccgaagatttctttccaaggctacaacccgtacaatgtcatcccttgtagaacagtcaaaaaaacttgcggcttacaaagccgtagatgaaaaccttaaagactcacattcagtggttggtgttggatctggctctaccgtggtctacgtggctgaacgtctagggcaattggagcacaaatcgtcatttgtctgtattcccacaggattccagtccaaagagctgatcttaagcaatgggctaagattaggatctgttgaagagtactccagtatagatattgcatttgacggggctgatgaaatcgactcccaactgaatttgatcaaggggggtggggcttgcttaatgcaagaaaaactggtagcttcctgttcgaaacaactattcatcgtcgcagactatagaaagagatctcctgaaaagctgggccatgcatggcgccagggtgttcccattgaagtcgttccggctgcttataacaaggtattgaacgacttgaaaaatttggagggctacaagtctgcaaaagttaggtacgggggaaccttcaaagctggtccagtggtaactgacaacagtatgtttatcatcgatgctgattttggtgaaattcctgttgagaaagtttcaaccttgcattcccagattaagggcttagtaggagtgttggaaacgggcctatttgcgaatatgaccactgctgcttacatcggcaatgaagatggttcagttgccaccttaactttgtaaggaattgaaaataatgaatgaactcataaacatataatgtacaataatgaaaaaagaacccgtaccattttcctctaactttcaatcagcttaaggcattggttgatatccaactcaaagcctcggtaagaccagtaccattgatagccacagtagggatgacacaccagttatgtgaagttagttctttaagacccatttggtcaatcaattcggtaggagttaacgcgtttggtaagtcctgtttattggctagcacagcgatgtaacatccggccaattccttgtcgctaatcaccttcagtagctcattctttgcatctgacaatctgctttggtcggcagagtcaaccacgtagataagggcatctgtacctgagaaataatgacgccataacgctctgatacgttcctgtcctccaatatcccaggtatgcattatcaggtttttgtattttatcgtttccacattgaaaccaacagttggcacggtgttttttgccttacccaactttagtttgtatagaatagcttattagttagtattgtcccgtaccagtggacaaatgcctgtacttactcgttttcccagcgttatccagtcctaacatgaggattctcatctccttatttttatgactctaatgttttgttagaaggaaacttattgtttcgagttaaagatctgtttatggactgttacataaaagacttacgaatagtttagatatgctgcctcccatttattgcccagaatgatatttgtttcaaaagaattcctctagatttgctcgcccgttagcgtgataaagacagagcgcgcgatgcgaacctaaacccttcagccaccccttgcattaactctataacttcttgacataggaactggggaaaagtccagctacgttatttaattttccttcggtccaaccatcagtatcatcggttatcaattctatcttgtccccggcatggatggttagttcgtcatctccagcagcttcataatcgaacaatgcctccaaatattgaacctttttggctcctcgtctgggtgcaacttttggaggaatcttggatgccttgctttctaaagtctcaatataagaagtaggcaccagtcctttttcgccactagacttggtgatttctgtccaccctgatccgtccgtatcaaagttaaccacattaaaagtttctccttgagaaatacttacctcgtcatcaccattggcttcataatcatagagagccttcgcattgcttccggaatcagtggttgtattggattttagtagcgacccaaacaaccttgctttgctgaaagttgttgtggacgaccgggaaagcattgtattggtgttactatgaacacttgtgatatccgaggtgtctggcacggtgtaatgtctagtctttttcccaaacaacccaaatcttttggattttttctcttcatgaatcggagcagttaaatcatttccatcacttgaagactggattgtctccatttcgacttcagcgacaactctaattacatcgtcctgagtgaaattctgcaaggtcttcaaatatttcattaacaactcgtcatacttgtaaccctcttccttagagattaactcatcgccggtgatatatttctctttaagccctttcttcttcaacaaaacttcctccagtatctgcttttcggtctcacatgttttgacaaacttttcatacttagcattcgctgtgcttagttgtatacgcagatgattcatttctgctggctcagtgaccatggactcgtcgtcgtgccaaatgcttgaagggatataatagaaatcctgtggttccttccagtccttcaagttatgctttataaacatggcggtgtccaaacttggaacgttttgttttatcaccacatccatagcgttgagacattcgttgaccttttcgttgcatgacttctccagtgcagtggttgttagcaatatgttattcagtcgagatactcgagattcgtttagatcttgcaagccatccaagatctcaggaagatcctggtaaaaatacttgtcctttaagcgattcgccacgttgattttgataagatacgtattcttcaaaatattcatgtcaatttctttctctttgtatttcttttgagctttttcactggaacttctctctgttttctgcctcgtttgttccataatctgacaagagctatcatactcctttttagctttatcaacttcagagtagtagtggtctctatcaacaacaattttctcattgaactccttccattgatgtctaatgctgtcatatttcgaacgaatgctttccagttccaaaagtactttcttctccagacttcttgagaaatcctttctatgttttgcaatctcttcagtgcgagttaatacctctgtccacgcaaccattgatgcggcttccaaagaaccaggagtaattgtaggggtttctcccacacttaaactcgtggaaactttgagctttcgcttgatgaaatcattggataaggccagtagtttagaggagtactccttttctattgaggctctggttcgatagaactcctccacatcgcttagccattcaattcctcccttcacccatttattcgtctcatcgaacgaatcctttaattcgttaccaatacttaaatccataactatgcggggcaagatggcggagttgttttcgggaggttcacaacgattctgcaattccgaaatttcgaggttgaggttctgatctcttcatgtgactgggatgggttggcattttggttaatggctaattaagtccagaaaattatgaatcaactgcaacgaattgctcatgccgataaccggatcaaaatggtgttatcagttttctttatccgatgggcatcttacgagtagaaatgctatttttcaacgattcaaaaaaaatttcagaaccttatcactccatctgactattatttttttcgctcccctcttatctcaattcaagtccaaccaaccttccgtcctctgaataaaaagatctccacctcacagactcccgtataccacattatcagatattttcacatagtgcgggaaaatggatgggaatatatcgcttggccttgtgatatacagcgctgtcaaacccataataaagctgtacttggccttgggtctcggatttcttctatccagagttaacttgcttagtgtggagacttccagagggatcagtgacctagtactgatgattttcttaccatttctggtctttgacaaaattgttaccaacctttcgatagcagatctcaagaccattggaattatcttcctgagtgcttttttcatgtacggtgtgggggctactgcttcttctttgatagcacttgtgttcaaacctccaaaacgtttcaaatatggttttattgtgggaggaattcttccaaatgtcagcgaccttcctattgcatacctctccaacggaatttcgttcttcacggaccaacaatctcagaagggcatcgcttatatttgcatctatttggcaacttatatcctggttcagttcaattttggattatttcaggtggttgaatgggactttagagaaaagaaagaggataaagagactcaactggttgatttatccaaagttttgtctcacaaattgcagccccaagaaactactccaaccgtaagcagtatcgactcgaatattgatgagcaggacttacaaccgatccctattgcgccagataacttggtctcattgtctagtgaaacatcccatgtggatctccaatctttagggagaattccaagcgcaagattaagggaacctgagcaacattccacaaggaacagtgtgagctctattacatcccatagactattgtcaagaatcatatccaaccaagacgaggaaaatcagattgttaaagagtactcaaaagctgaacctttcaatgcccatattgatcctttgatgaaaattgtcaccgaaacaaatttatctgctaccgacatcaacgtcagtggcaataagataaaatttgttcagaaatataaattgcaatggttggtgttcttctatcaaaacttgaaaaaaccttgttcagttgccctagtctcatcactcattatagcattaataccatgggtaaaggcattatttgtcgaaactacaaagaatataccttctgccccggataataaacctcccttatcatttctgatggatttgacgagctttataggccaagcagcggttccaatgggtattctactactaggggccactttaggccgtctgaaagtctctagctttcctccggggtactggaaatgtgttgtcagtttaacagtgttcaagctctgtatcatgcccatcattggcacagtattctccaatagattggcaaaaattggctggatctctgacgaggtagtacaattcatagtaatccttcagtggtctcttccaagcgccactgttcagttgtttctcactgcttccaacactaggttagaagacgggccaaacggaaaagccactggtcatgtgcaactagactgccttagtatctatttacttggtcagtatatgattctattcattacccttccatttgtggttgcttacacagtgaaatgtacactataactagactatgaatatactaattggagcagggctcaagtaaattatatattaagtaatcatttctgaagcatctcttcccgcgccctcctctagctaagccctacctttgtttcctcacagtagtccatcgacagtgaagttcagactcccaaggcttagattaaggaggaattctctccgcttaaaaaagaaatggaatcacagcttcaaaccaattaacaaactcactgcaaaataccacaagttaaagctactagcatcccatcctccccattcaatatcctccaaactcttctcgtttctgagaaaggcgcagtacaataaaatggagcctaaaagaaacaggtttatcgggtttgttcaagagaggtccgcttatatccctaccattaccaagtctattagtaactttgccaccaatgcttttgactcctcaaacgaagtacctaaatccgttccgccaaattctaagatattgctctacaatacttatactaggatggagacgcatgagggaaatactaagtatattacagatgtacagggaaatttcaactgccctgccactccgggctcaatgacaaggagaaatcgattactgctttccatggcaaaacaatttgtaaaaaatccatccacctttaatacagaccagtttgaacacgaactggaaagcgagatggcgaacccggacactactttggaccagctctctggtgtccccgagttctctagaactagcactatgtccacgacggcaagttcgatctctcaaactaattcaatggcggatttagacgacacattggtgcaacgattggaggggtttctatgcaaatccataccagaccaagaagtacgggtgactattggctccgagacaagatcccacaatcaggtcttgaaaagtaaaaccgtacgtacgtttgcgaacggtgactttgttacccaagtggctaccgactatgtcccatccattattcaggtcagttccacctacgacgaccaaattttttcatttcagcaaattatgctgattccagattggggcattggtgtgatttcagatattgatgacactattcgccaatctggagttattggtgataaaagaagtttattcactaatatttttgtgaagccttatcggctttgcgaagtaccaaacatttctcgatggttcaactctctcgctgagtcatgcaacgtttctttccactatgtttcgaattctccatggcagttgtatcctactacttatcaattcttcgaggaaattggactaccaacagggtcaatacatttgaaaaagtattccggaaatttactttcaagttttatgcaaccagcctcagaaaggaaacgaattgccttgcaaaaaatcttacgagatttccctcacagaaaatacatattgattggagattcgggtgaacaggatatggaggcttatcttgaaatatgtatcgaattcccttctcaaatccttggagtttatatccgagtcgtggataactctctttcggactttgacgacgataagatattcaacgaattacaacagatcatggaccgtgatcataagaactgtcgaacccccgcattaaatcctctggacgaagatttaatcgacctggatacagaaatagaacaaacagcaaccgagcataaaccacctcatctttatagaaaacctcccatgatccctccaaaaccaaaagtgctcaagggtgctccaatagttccaaaaaaaccagtagagctgaaagggcgttctgtggttccccaacaaatgtcctcatctagcacaacatcactttcaactaccaatgggaaaggaactttgacatcttcaaatttagatcctccaccgttgcctaggagaacaagctcgtctcccagttcattggtttacactaaactgtcctccctgtcttctaacgacagagagaaaagatttagagacgcaggaacaacagaatatatcaatagtgctggcgatcaagtgacttatacaatctatgacaagaagggtgaattatggaagcaacgaattcatgcactcaaagatagacttcctgatcatatagactttcagttttggtggaatattgacgataaattaatcgatcaaagtattgaaaaaatcaaaaaaagtatgtagagacttatttaatttgataatggtgaagatctaacgatatgcaattggaaaaggaaaaatcttctcatgctctctaagtggaaacttgttttggaggaagtctctgtgactcagcaaatgctgcactaccatcaccataatccctgaaagcgacaccttcgtctgcaatattattatcacttatacggaattgagaaagatcgaaggcgactcctttatctgccgatatttcttcagcctggaagaatttatcagagaatttctccaagatgatctcttttcctgtctttggttttttgtctttgatgtctttctttgcctgcaattcctgtttccttttgacatgttctgccttccacttaacaaacgtttcccaggtgattggtgtgaggtcctttttaggcaacttgtcacgttccttttcaatcaactcttccaatgttatctttggctgttggtctgcagccaatctctccagacgtttctgttccttggtcttcagagtgaatccaggaggtaaggaatgcttgtatttacaatccttaccgtttggacactcccaaaaccatccatatttactgttttcgacagcctcaatgaaaaatttacatactttatccgtcgtcgtttgaggattaccttgctttgaagaaataaccgatcgcaatttttcttcatcccaatcctccatagtatcatcagtcttggagtctggcgctctggcatctgtgtacaggtctttcttgacaactttcctaccaatctccaaatcgtgggaaaacttacactttggacccttcttacatacaccctgtttgaagttgacacataggatcgatttaggatcaacaccgaagggcaccttttgttctatagcgactggattaaagagttttgctgcctccagtttggcctgttcggcagccttcttttcctcagctcttcttttggcagcggcagcttctttgcttgctgatgagacagaagtagatttgacctgacttatgtattcttgaacctttttggacttatttttgttctttagaccaaaagttttgtcctctagactcttctgagactttttctgcttattcttcttcgaaaggtccggctgattcttctttggaggcatggttagctgcaaaagttgttagtcaaacgagtgttaactagatgctgaaaagaaaaaaaaatcagaaaaataggaacccagataattctcgctgtaccaaatctggtaataagtcgccaatctggttctgccccaaactttagctcacgcctcacctcaaggctttaagcacttatctactgggaaccataggacctcctttaaccacttgttgcccccctattcaagtagcatgcttgtgtttaccgtacgccctagggtgttgcgattgttaccccgtgaattgattaaatccacgagcaggactttgaaaaaggagtcttcttctcagttgatgttgcctcaacaaggtcaagctcgccaggcaagtagtacaactcgaactccaagaaaaagacgcaacatgcgcaatctaaacgtggcttttgtttccggcattttggtggttgcttcctacgtttccatcaccaatcaggggaaaaattacctttcagacacaggtggagctgctgtgggtgctgcgagcaacttaagaaacggagtctctggaactcttggagccttcttcagtacttcttcgcaggaaggttcatcccaatcgtctgaaaagtctggcgtattcaagctgtctgatgaagaaatttcggccaggctgaggcgcatggaggaaagttatacagtgaaccgtggtaagggagtagtaagatatgatgtcagtcagttgccaagtaacaacccaatcgaagacgatcgagctgaacgaatggttgaggttagatacagagataccgaatcaccatctgacaaaagcaaggcaattgctgatcccggtgccggtgaagtgcctgccgactggatgctgtggggtgtcttcgatggtcattcaggctggaatacttccgctactttacgcgatcgattactggattatgtggtagaggagctaagtaatgtgttccgcttaggtgaccgtggaccggccgctcgtactgtaccttcaagtgatgcgattgatcgtgccatcaaagccggatttacaaaattggacgatcaaatcgtaaacaaatcagtagagaaattgttctcgggaactcccaaagtttctgctccggaactgttgatgcctgctttgacaggttcgtgtgcattggttgcattctatgacactcatttacgtgaactccgagtggcattaaccggtgactctagagcagttctagggtccttgggagctgacgacaagtggactgcgactgctttgacagtcgatcaaactggaagcaatccttcggaggccgcacgattggctgctgagcacccaggtgagcctaacgttgtaagaaatggacgtatcctgggatctttagaaccatctcgtgcctttggtgatgctagatacaaatgggcaaaggatattcaagatagagtttgtcgtcaatttttgggacgaactcctccccctgctttgaaaacaccaccttatgtcactgccgagccggttgtgacttctgcacgaatccgcccaggaaagaaagatttcttggttttagcatctgatggactttatgaattgttatccaacgaagagattgtaggtttagtcgtacgttggatggagaaaacgggaatggttcctccaccatccaaatcattgaaggagaaattattgggaggaaggggtcaatcatcgaccctgactccagttattgatacaagtgacgcttctaccaaatcgtctcaacgtcctcctatcagaaggtcctctcaaacagcaactggttctcgtcccacttatttgttggaagactctaatgttgctacacacttgattcgtaatgctctcagtgatggggggtctccagaaaatgtatctatgctattgggaattccttctccattgtctaggcgttatagagatgatcttactgtaacggtggtattctttggagaaagagatgaagtaggcggcgatacggcactctcggttcagttgactcccgatgctacgcttggactacagcctaagccaaagctttagattaaaaacgaagggggaacaaaggaataaacaacaagaaaagctaacccttaatataactatttcaaataaaattaaaacttctttaccctaacattgacaggttgattccgtagaagaactatccagtctatttgtaagatcaactctttcctgaccagcagcattttcagagctagtggcttctggaatatgctttccaatagtggtgaatacttcattaacgttaaatcctgtctttgccgaggtctcaaaaaacaatagaccttcatcatccgccaaggtctgaccctcttgtacactgaccttacgtttacgggaatcatcatcttcattctctgtcgaaacatcgttatcctctgactcgacaatatcgtatttgttgccgcaaagagcaattatgatgtttttggatgcctgttcatgtaattcattgacccaatggcgggccttgatgaagctcttcggttttgtcacatcatacaccactagtgcagcttgtgcgttacggtaatacatgggagcaagtgactgaaatctttcctgaccagcggtatcccatatctcatacttgatggtcttatctccaattgtgcaccgttgtgtcagaaaggctgctccgatagtgggttctttattttcctggaaatcgttgctgacaaaacgtaaaaccaaggaagactttcctacagctgcctctccaagaagcactagcttgaccgctgtaatttgcttgttggaactcattattaatgatacaaagcaagacgttagaaagccaggcaagaaagggtgatgtttagctcaaattgtagccattcgcgggatgcctctttgataaccaatatatatattacataatactatcagatctgcgataagtgtagatcattaattagaagatgtataggcaacgggaatctgtctaccaggtgctataatcaaagtttacgctttctgacaaagccagtattcacacttgtactcccatcctcctaactctcgctcatcgccgcaataccgggaggatatttcggattcatgtttgagaaaaataaaaccaatgtctgtgataagttggatcaaatcatccctagtcaattctagtcctttcaacggttctacactttcaacttgcattccgttttctgtgcgcaccctagtcctgacattttcatcattttcatagtgccacaataaaggtccaaagttaatccagtaaccatggggctttaagcagtggtggatactcttcaagtattcaataacattggatgcagtgtccaaaaaaaacgtggttaccacaacatcccaggtccctttattcagagccctaaactgagatgcttcgtcatcagcagtataaatatctgagtgaactaaattcggagggccatacaaatccacaaaagatcccgcagtcattgacataagatcagccacaggaatgtcaggatagtctcgctgcaagaatgatatatcacctggattgtaatctggaataaagacaggagccaattgcaagtttcgtttcttattgtgagagaacctatgaatgaaggggaatatttgataattgtttgccacaaacgtgtgattaaggataaagttggacgcaagtagcatatgatatgaaaattcgttgccttgagtttggaatccacgtttgacaagctccactaccaatctgccaagcccacaaccgggcactagaattttgacacgctgtcgttcttccacttctgggtacattgactctagttcctgtgttattcgcccgtagcagatctctctttctttggctcccagttcactccactctctggtaaattgtagcatggtcgatctaaccttatccaggtctgacccaaccgagttaccccatttcgaactatcctcagaatttccccaatcagcagccactttagatgcgagttccctcataaacaattcattgctggcaatgcattgactcaaactcgttaaatgatcagggaaccaggcaaggagttcttgctcgtctttacttaatgatttccattttagtgtacgtggttgaataatttcatgtctttcccagtcgccaaaatcgtaaaacgcctttagtattgctgcaacggccttatattcatccatcagggaagaatagacgcaaacacttgaaagagattgtatatatataattataaccgatgtctttctcgaagttcgcaatcgaaaagttagattggtctaggttaacttaaattgtgacaacacaataactcatatctttaatatataatgcttatttcttttctaacaattgctgccgtagctctttgttatcttcaactaattgtcccaccagtgctgttagcgtttctagttttttcataacatcataggtctctaaagaaactcccatctttgagctttcgtggattggtgggaccagacgttgcactgatcgcagccattctttgcggccagcttgaaattccggatcctccagttccgcttgaagctgtacagagagattttcgttaatttgttgttcagcttcttctgcgtctgtgtcgtcgtcaaaaccatctgtcaaactccactctgtatcatgttcgttggcatcatcaggcaagtttcgtcccctattgtaattcacacgcttggcaatcttgacctcttcagaggcaacatacaatatcaacggcaaatagataatggtcataaccgccttattgatagagtgataagttgaaggttgaacaagccactgaagaggtaaaatgaaaaactcaactaagttgtatggtgcaacgtatacattctcgtcaggagctctcacatatcgcaaagtcttctgagcaacaagtgccagatattcgttggtagagttgtccacaatctcgctgtaggcagtgctgtaaagtgcaatcaggatgttcagcaagattactgtgatgaaaaatgtaaagacgtaatacaaaatttgcgcatagggaggagcaaatttgttaaagctctggaaatctggtccaccaatgacggtatgaactaatacagacaatatcttggtagtggcatctctacgaccgtctgcttggtctagaccaaggaaaccttgcagaaaaccaactaaaatcacagtcagtaggaaaaaaaagattgcagactccttcatcataaccttaataaccacaatcattgttccgacaaacttgttcacgtccaagaacaacaataatctagtccacatgaacggggctgcgcacgatagcaatcggtaggaaattgtatcaaacttattcatgttaactggagaaccagcacgtactgccatgatacggaacattatagaaaccgagagcaaggcgtacatcgtgtcattgaatgcattccaaaactgaatgtaattggatccaatatggtacactttcacgatttcatccacaacataaccaagagtgaagatgtaaaaacacagctcaaaaaaatcaatggaggcgcttgcttctgtgttcactataaaggtgtacaagatcaagtaaacaattgaaaacaaaatctccagaatgttctggtattgaggtgtcctaatcctgtcggggttgaagtgagataggaaacgagtatcgttgactccatcgtataagacgtatgatagtgggttttctctagattgtattatccaacctctccaaatccaggtgacacatcgttggtaaccagacgaactgattatcatagtagaatgcatgtctacactcagctccaaaacattctggggatagctgtcttcggtgttgagattaattgtaaaccgacgagtcaacatagcaatgaacaaatatcgttcatcctgttgctgttcaatgattatttttgacaactgctgagcagcaacacttcgtgactcatgtagttgagcagcagacagctccatatcagccaactgcatataccattcactgactttgagaagacaaaaaggcaaagcacttctatattttctagaagaagttccctctttgcccttgcccactccaccagctgcattgtaaacagcttcaacaacattagcgtttagcaaagtactgtcaggacgcgttatctcgtggatctcagcaggaatgataatcgccctatcgataacctgtttcagattcagagcaatacgcagattctgcctagcagtaggagtaccatagtaatgcgctgccctttcgctgtcttgactcatagacgccagtatactcttgttggtgttgtagaaaaaaatgaaagatgctgaaaaatgaagaatagcctgctgcgcatcctcatcgtgcagggaatcctgctcacgaagttgctcaggggattatttggacagaatattgctttgttcgaaagtcgcactaggccagttttcgttttctccgcccagcgtttcccttctgcacctcttcgagaacatgatcaatctgggataatctcatttttcgacagaaacctaaaagggttacaacgcaacattcatcacctactaatttagcacggcatctcctaatcccctacaaaggttcttatgcacaaaagatgaccggtacgagaacagagaaacctaacacacaggactatgttgccggaagggacgtgatgtttgactatcaaactgcattgtctcataccaacggatatgagaacaagtctagacacaagaacaaatcgcacagaacgaagaaggtaagacacgaaacgccacccgttagcgtagatattaatgacccagatgcagattatcctgtatctcgagtcattaagcagacagagaatggagaggtggtagtaagtgaatatcaaagtgcagatccgtacaacttttggggtgctttgaccataaattccgaagaacacgagggactgaaagaattttggaattctatgacaccagatcagaggaaatctcttgtaagcatcgataaagaggagttattaagctccctgaagtatattgaatgtggggcatgtcgatgtcaagcttgtggtgacaagaaggctcttgaacaagatctcattgagctatacgatagctactacgcccacattggtgagcatgaaattaaaaccttggaaccatttttttcaaatgatttggagtctttcaagagtatgctgggtgactatgagtgtttggatactgaagtggaccttgactctgaagaatatgaatctgatgagcgggattatgagcacgaacatcatacaatttgtgagccattagctcaagaccttcctactgacaatacagacaacatacaggatggtcaaatagaagtaaaaatgcctacgtcgaatcagctttcaacaattgccgatgatatacttaatcatgatgggcgttcttttatcacgatgatggaaaggctagccataaatatgaacaggcttgaggattgcaataataaaaatagtagcacaagcaacatcagcgacaacatttccacagccccaaccaacagcattaatatccaagcagactcagatgttcaaaaaagcgtttccaagatagaggatgttttccgaacgaatattggtgtattcaatcctacatttctgaagaacgctttgatcaagtacgctgaacgtactgatgcagattggaccaagactcccaacacaccaggtgaaactgaggcctggctcaatgggatagctgactcactagcattaaaagggcgagacagacaagaatttatagccactccgaagaagctaatgcaattgaaagatgaatggaaacggactgaggatgaacaaggcgaagacgaacatgtgtggactgacgagcaatcaaagttgttcctagaacgagtcgagaatgccataaatacagtatcttcagaagagcaagaataccaagaagtagaggaggtgaaccaagattttgaggatgaaatctacgaagatgaagatgaagacgaagaagaccaggaaattttggaaaaggagtatcttgacaagaagagacttcaacaagctttccgaatgttgcaagtgatgactacacaaatagtaaaggaaaggtttgtcactgcataccgagagaaagttgccgaagataccagaaatcaattgcttgccgaactagaaatggaagaagctcttcagaaggaaaaagaaaaagaagagaaaagacggaaagaagaacttctagaaaagaaacggctagaagagattgcaaaggaacaggagcgccgaagaaaggaggcagagaaattggaagaggaacgaaaacgagaagaagaacagagacgaagaacggaggaaggaattcgtaggaaagaagaacaacgtcgaaagaaggaagaagagaggcggaaagttctggaagagaaacgtcgcaaggaacaagagttgaagagactagaagaggaacggctagagaaggagagacttgaaaatgaacgtgtagaaaaagagaaactcgaagctcaaagattggaggaagaaaagcaacgacttcagcaacgaagttcagcacaacaaggaaatgttccaaattcaagacaaggcccgaccggttatcaacagcaatatcaatctttagtcccgccaaaaacttcacagcctgtagaagaaaattcattcgaagaggtcaatgcccttttaaggaaggctgagtcttctttacgagatgaaaatagcaatataagcaacacaccagtatatggagcaccagctaacaacttcttcaatcagaataagcattatccttctgaaatttcaggtgctcagatgccagcacattttagtggctggggaagtgatcctaacgggtttgcatctccttcgagccctggcaatgtgtttttaccgggaagaaccagtcaatcaggattcaatgctggctataatggaggatttttcgagcagaatagaccagacgccaatccagcaggcgctgcacacatttctggggcaactctttttggggggaacaactctatttggagttacccagggtctgttggtagtatttggagtgctcaacttggagtgaatgattacgagaggattcagttggcgacatttcaagccataaagaacttcaaggacgactctggcgagtacaatctacaaggtttatttaatttcagcaaaccggccttgactatgtacccaacgttgacattggatcagtttgtggtagctcttcaacatgatctgcgaggcatattacctttccgatttgaaattctctatgagcttgggcttgcaagtcgtgtcagatttatgcccagctggccaaagactgaccagatgagatgaatagtgtttaaatatttaacgtagaatatatgataatcaacgccaacgaagtcaaatgcctcagcaacttctggatcccctcaactccaccaaggttgatattctctctttcgcgagattctgttccgtcaaccttattcttccctcatcgcgttgacagtacattccttaacaaaactcaaaacctgaagacgatccgagcgctccagtcgcaaagaaatcagaacgagaacgaatcaaataggcacccttcatcatgtcggttgaaaatatcattaatcgtaagctggtgattgtgggtgatggtgcttgtggcaagacctcgttgctctatgtgtttacacttggggagtttcccacagagtaccaccccacagtatttgaaaactatgctactgactgtcgagttgacggcaaggcagtgagattggcattgtgggatactgcaggacaagaggaatatgaacggttaaggccattgagttatgccaaagctcacgcaattttgatcggatttgcattagatactccagattcgttggataacgtggggacaaaatggattgaagaagttcgttcatttgtacccaacgccccgagaatcttagttgggttaaagaaggatatacgccagcaacagtgtaaccctgaagatcctgaaagtgttcgacagttcgtgttcccacaacaaggtgaagccatggcgaaacgaatagatgctaggaagtatattgaatgctctgccctaaccggggaaggagttgatgacgtctttgaaactgccaccagagccagcctccttgtgacatacaaaccaacccagacatgttgtttgattctgtagatactataccggatctggcaagcgcgaatttcacgagacaccaaaaaagcacatagaaagaacaaaaatgcccattttagttaaatagaacgcgtcacattatctctacttacaactaattacccataatacaatggctccaccccgtaggaaacgtattattgaagactcgtcagatgaagagattgaagatgtcgacttccatgcctcttcttcaaactcaatgcgttcgtcaccaccaccacctgcaacattgggattacctccatcgtcacctacccttccctttgatgacgacgaacaggagattggagaggaagagatacccatcattgacgaggaggaggtagacgaggaagatgatgctgaggacctgattggagacaatatgtttgacgattaccgccaaaacagggaccaagaccactacgatatagaccagattgacgataatgagtatgagcagatggacccagaagagagaagaaaagttgacaaacttctgaatgaaaaagacagactacagaaacaagctttagctgcagacagagatatttatcttggtgatggtgctgatatggatgttgagattgacacccgaactggattgccagtgcaatctagaagaagaagaaccgcctatgacgatgacagattgggacatgatgatgatgacttggaagatattgacccgttggcggaagagctgactcttgaatcgttggccgatgtcaaagctgagtccattctccaatggattctgactcccaatgttaatagaactattgcgagagaactgaaatcattcttgcttgagtataccgacgaaaatggccgctccgtatacggtgcaagaattagagctcttggtgaagttaactctgaaagtctggatgtatcatatactcatattctggaaagtaaagctattctggctctgtttttggccagttgcccagatcaaattcttcaaatatttgatgttgtagctatggaggctacagaattacactatccagattatgcgcaaattcattccgaggtacatgttcgcatcacagactttccaaacatcagcagtttgcgtgagctaagagagacacatttaaatgctctagttcgtgttactggtgtagtcacaaggcgaactggtgtgttcccacagctgaaatacgtcaagtttgactgcttgcgttgtcatatggttttaggtccttatattcaagattctacccaagaagtcaaagtctcctactgtaccaattgccaatctcgtggtcctttcaaaatgaacgcagagcgtacattatataggaattatcagaggataactttacaagagcctccaggagctgttcccccaggaagactaccccgccacagggaaatagtgttactatgggatttggtggacgcagccaaaccgggagaagaagttgatatcactggtgtttacaagaatagttatgatggtgcattgaatgcacacaatggatttccagtgtttgccacggtcattgaagcaaactgcctgcggagaagggacgcttctggatctaccaatccagctttggattcttcaggatcggtgccctggactgatgaagatgaaagccaaattattcagcttagtaaacagagaggtattgtggacaagattatcggttccatggctccctctatatatggacatcgtgatataaaagccgccattgcttgctccttgttcggaggtgttcccaaagatatcaatggtaagcattctattaggggtgatatcaatgttcttttactgggtgatccaggtacggctaaatctcaaatcttgaaatatgttgagaaaactgcccacagggcagtgtttgctacaggtcaaggggcttctgcggtgggtcttactgcaagtgtcagaaaggacccagttacgcgtgaatggactttggaaggaggtgcattggttcttgctgataagggaacctgtctgatagatgagtttgacaaaatgaatgaccaagatagaacatccatccatgaagccatggaacagcagtccatttccatctcaaaagcaggtattgtcacttcgttacaagccagatgttctataatagcagcagctaatcctgttggtggaagatataatccgactatgaacttggcacataatgtcaatctaacagaacctatcttatcccgttttgacatcctttgtgttgtcagagatttagtggatccatcagttgatgagagattggcaaagttcgtggtagattcccatattagatcccatccacatgacgatgccaatgattctgatgatagtgagggagaaattgaaggtgatcgaactgtgagccaagtacagcatgatgtgtctgtaaacaaaggaaaacgtgagcgcagacaacagctacagcgtgaaaaagagaatcaaatttcacctattcctcaggacttactggttaaatatatccactatgcaagaacaaaattgtatcctaaactaacacaaatggaccgggataaagtagcaagggtttacgctgacctgcgtactgagagcattactaccggtagtttccctattactgtccgtcattttgagagtatcctacgaatagcagagtcctttgcacgcatgcggcttagtgagttcgtttcaagcagtgacctagatcgagctatcaaattgagtattgacagttttgtcggaactcaaaaactgagtgttaggaagcagctgcaacgtagtttcatgaaatacacacttcccaagtgaagaactctctaatacggcatagaaatttataccatagtctttttaatcttacataatcttaatcacttttccaacttcacacgcgaaaagcctttcccatcaccaatttgtctcttaaacttcccccctccaccttagctttccaacttccatcgactgtaatttgtctctctgtattgagaatagaatttacctgacaatgtatccccaacgacaggtatacaatgatccacaagtacagtcgcaacttccccaaagagggttcgggtatccttccaacgttgtcaactcgggcttaaccagtgacaccgctccaattcagacaactatggcggcaagtctttctgcaggccctccaggaggtattgcaacgaatattcccggaggagtacccgcaggaacatcatcagggcctcctccaggagcctctgtgagttctggtggagctcctaatactaacaaagctttgaatgatgaaaaagtttacgcatggattctggagttggcctatggtccgaacaaggaacaagcacttctagaacttggtaagaaaagagaattgtatgacgatttggctctagtactttggcattcatttggcgtgatgacttctctcttggaagagattgttgccgtatacccgttgttgtcaccgccccaattaactacacctatatcaaaccgagtatgcaatgcgttggcccttctacaatgtgtggcatctcatccagacactagaaatgcatttctgaacgctcacattccattatttttgtaccctttccttaataccagttccaaacagcgaccatttgagtacctaaaactgacctcactaggagttattggtgctcttgttaagaacgattcaccagaggtagtgtccttcttacttaccacagaaattattcctctatgcctcaaaatcatggaatcttcatcagaactgtctaagacagttgccattttcatagtacagaagattctattcgatgattccggattagcatacgtctgtcagacttttgaacgcttttctgctgtttccaacgttttgaaatcaatggttgaacagctagtgcttcaaccagccccacgcttgctcaaacatgtggtacgatgttacttgcgtctatctgataatgttgacgccaagaaggctttgaaggaatgtctacctgagccactcaaagatgggacgttcagctcagtattggtgaatgatgcggctacaaaaagatgtctgtcacagttactggtaaatgtctcccaggagtaatgtatattattgtatagctaattgaatggtattattgcaagggatttttctatccagctactttctacgctccttctggtgatcgatccccttaggttgaaatccataatttccgcccaccgtacacgctgtcggtcgcgcgcattcgctcgctgacttgttctttcaagtctccaaaacaccacaacccaaccaatgtcgactctgagctacaagaagttcgaagattcggactcaggagttctccctgacaagatgacagtcttccaggactgtctgcaggctttcaatgcttctccggttcaggcaaagcgttgtaggatgttgttggcccgtcttctacgccttttatactctggtgattcgttcccatctacagagtcgactacattgttcttttccatttccaagttattccagcataaagatgtatctctacgtcagatggtgtacctcacgattaaggaactctccaagacttctgaagatgtattgatggttacatcttccatcatgaaggacgcgcaaaatggtgatattacttataaacccaacgctatccgaacgttagcaagggttttggatgcatccactgtcaatgccactgagagactttttaagaatagcgtagtggataagaatcaaagtatttcgtctgctgcgttgatatcttcgtatcatatgttgccggttgctaaggacgttgtcaaacgctggactaacgaaacccaaggcactataagtgcatccaaagtgttcttgacatcacctgttgccaatcacgagcagtatggatcacaaaatttgtcatcgttcatctaccaataccacgctcttgggttgttgtatcatcttcgaaatcatgacaagatggcattaatgaagatgatccaatctctaagctcaaataacgttttgaagcatcctgcggctttggttcagcttactcattatattgcaaaagttttggaaaccgattcttctcttgcaggaaactttgaatcatactttgagatcgcccttcaaaacagatctgatatggtggccttagaggccgtgaagacgattgtgacaatcccggcattgtcaggtttgattgttaaggctatttacgttttggatacttttttgtctgctcctaggactgttgtaagatttgctgccgttagattactcaacaaaatatctcttactaacccagagaacattgttgtatgtaatgggtccttagaaggcttgattaatgattcaaacagagcaatttctacttatgccattactacacttttgaagactggtaacaatgataacgttgatagattgatcaagactattgctggatttatggatgatatatctgatgaatttaagattgtggtcatcgactcaattcgttctctttcactcaagttcccagaaaaacacaagtcaatgttgtccttcttgaacgatagacttagggaagaaggaggcttcaacttgaaaaactctattatcgaagctatttttgatgtcatcaagtttgttccagaatccagagaatcttgcttggagaagctatgtgagtttattgaagattgcgagttcactgaactggctgtgaggatcttgcaccttttaggtaacgaaggtccaaaaacttctaaaccaacgctttatatccgtcacatttacaaccgtgtcgtattggagaattccattgttagatcatcagcagttatcgcactttcgaaatttgccctaatcggagatgcttcaataaacaagagtatttctatcttgcttactagatgcctcaatgacgttgacgacgaagtcagagacagagcagcactggccttgaaacttctttcaactgagaagtttgacgaagcccgtgcatttattgaccctggattcagctattctttacctattctggaacaaaagctggctcaatatgtgaatggtgacgaagaatcgttcaacgttcctttcgatggatctaacattccaaagatctcagaagacgaggctagagcgtatgagtacaaagaaaaactgaactctattgaagagtcgatccagaaagaaagcaaacaacctaaggaggaagtcagtgagtttgccaaacacaatctattgcaacaacaatacgcccaagaactttcaagcattcctgagttggcagcctatggtgatcttttgagatcgtctcatgttgtcgatttaacagaaaaggagacagaatttgttgtcacatgtgtaaaacatatttttgcgggtcatattgtgttacagttcaatgttgagaatacgttgacagacttacaattagacaatgtaacaatggtgtctgaaccagattttgaagaattcgtcgaggactttgttgctcctattgaaagtcttaagcctcaaactacaggatccacttacgtctcgtttaccagaagtgaaacccttgagggctgtctgttcaccaacaatttgacctatattgccaaggaggttgatcctgcaacaggtgaagcagctgagggtgatgaaggatttgaagatgagtacagagtcgagagtgtagatatcgttccaggagacttcatagtgccatctttcgcaggtaacttcactagcgtgtgggattcgttacccaacccctgttcatcggtattcaatctttctgatgccaaaggaattgcagatgttgttgcgaagttaatcaaggactcatcaatgtcgccctgtgactctagtgagctagtcggctcgcatgcaagtcataccctgaaattattcggaaagagtataaacaacgaaaacattgcagccgtaatcagatttgtatacaaggaatctgtgggtgttatggttaaggtagaggctaaatctgtgaatgctgaactcggcactttctttgcaaacgaaattattgtttgatggccttgtagttaaaataagtaagagaataaaaattaagtgaagctagctcgaatcggtagtattatttactcatctccctgctcttctgaaccaatgccttccttgcccgagggaaagccagaggttttggcaaagatcgatgagcgagtgtcgtttaaaaaagatgaggagaaatggatttttgaagatggcgatgaagagttcgaatacgacgatgatcttcaacgatgggtccctgagaaaagaaaaattgaaaatgatgaaagggagctgaaagaagaattgaaaaaggaaaagaagcgtaaaatagaggagttgaaggagcaagaacggaataaacccaaaagcccaccgcagactggagtctacatcacaaacttaccatctgataccacgttagaggagattgaggatgcatttgggaaacttggtactatcggggaaaatttgataactggtgaaaagaaaatcaaattgtatcgaaacgaagagaatcagttcaagggagacgcattggtggtatacctaaagcctgaaagtgtcgatcttgccattgagatgctagatggcatccaatggagacctttaagcaaggaaaccatacatgtagaaaaggccgatttttcccacaaggaatcggacagtaaagctcacaataaggacttgacggaggaacagaagcaagtaattaagaagaggctccagagactcaaaagtcgcagtgacgattggaaagacgatatccaagtagaatatgagcgacgacaagcagaagaacgattcaagcatttcgtcgttttaaaaaatgtattcgacttgaagacaagtgaggatgatctattcgagatcaagcaagacatcagagaaggttgtgaagaaattggatccgtaacgaacgtagtcctttacgatttagagccagagggaatagtatcagttcggttttcgtcaaaagacgatgctgcacgatgcgctcaagagatgaacggcaggtactttgatgggaaaaaacttgaagcgttcatctacgatggaaaatcaaaatatcgtagaaaggaagtcagcaaagaagaccaatctgacaggttcgggacctggttggaaggttaggggattcatggcatcgcctttgatgcaaggatggaggagatttgagattcgcaaacgcttctcccaagtcattgtcacgtgaggctatctttgtcgaccacgaatgcaaaatttgaaaatcacatccctcacaaaaagtctattcataaactcgttaagatgcctccaaagaagcacatagaagagaagaaagtactgctgggacgtcctggaaacaatttaaagtcaggtattgtcggtttggccaatgttggtaagtcaacttttttccaagctattaccagatcacctcttggaaacccagccaactacccatttgctaccatcgaccccgaagaggccagagttattgtcccatctcctcgtttggacaagctgacggaagttgtcaagcctaaggctaagattcctgccttcatcactgtctacgatattgcagggttgactaagggtgcttcagcaggtgaaggtttgggaaacgctttcttgtctcacattagagcagttgatgctgtcttccaagttgtcagatgtttcgatgatgcagagattattcatattgagggtgatgttaacccagttcgtgacttggagattatcagtaacgagttgagactcaaggatattgagtttgctcagaagcatctggaagctgttgaaaagatcactaagagaggaggtcaatctttggaagtaaagcaaaagagagacgaggctgagtttgttaagaagctcatagcccttttggaagatggtcaaagagtggccaatcaaaattggggacctaaggaagttgagatcatcaactcgatgcaattattgacagctaaaccttccatctacttaatcaacctttctgagaaagactacatcagaaagaagaacaagcacttgttgcccatcaagcaatgggttgacaagtactcccctggtgacgtgatcattccattttctgtttgtttggaagagaaactatcacagatggagactgacgaagagagggaagaggagctgaagagattaggcaccacctccgctcttcccaagatcattactattatgcgtaagaccctaggattgatttcctatttcacttgtggtcctcaagaagtaagagaatggacgatcagagaaggtactaaggcccctcaagccgctggtgtcatccacaatgatttgatgaacaccttcattctggcccaggttcaaaagtatgaagatttgattgaatacggcgatgaagctgcggtcaaggctgctggtaaacttcaacagaagggtaaggattacgttgttgaagacggtgacatcatatatttccgtgctggtgctggtaagaactaagtaggacagtagtattttccctacctgtatttttttcattcgcatgcttatataatacaacaatacaatccagaatactgctcgttttgtcttgaaaagtggtacggtacaattccactaacttttccatttgcagatctgaatgttgggtcgtactaggattcctcttcgcctgagggcaccgttaggcgtcccttttaggcaggtatataggccaatatctattagccatgcgttgcttcaggaacaaaaaaagcaggaaggtctaaatactactgatggtgctgaaaccccgaaacgaaagcccctatcccgaattcctatcggagctatccctgaaggtaacagtcaaaagattggttccactggaactgttgaattttccacttggaaagctgtggtgctttttgcagttgtcggaacagtcgtcacatttttcttcaagaaagaaaagaaaaggctagagcttcaaaaagaggctgatcaaaatagaggaatgggtaaacccttggtaggtggtccatttgatctaatagatacaaatggtgagcagtttactcaagagaagttgaaagacaaattctctctaatttatttcggatttacccattgccccgatatttgtcctgacgaattggacaagctgggcttaatgttagacgagctaaagagcaagtataatattcagattcaacctattttcataacatgtgaccctgcgcgggactcccctgccattataaaggagtatctgaaagatttccatcctgacatcattgggttgaccggaacttatgacaagatcaaggagtgttgcaagaacttcagagtttacttttccacccccagagatgtcaaagctggacaggactatcttgttgaccattccatattcttctacttgatggacaaagaaggtgagttcattgatgtccttggccgtcaatatgatgcgtcgggagctgtcgaaaaaatcaagggtcacatcgacgcctatgttcccaaagaccagagagataaacaaaagaacagttggtacggtttcttgttcaaatagtattgaacttgagtcttctttagtctctgtttgtttatttactgtatataggattaaatctattccaaatcaactaagtctagatcatcatctccatccactctctgatccttgatgtcttgtttattttccagagagtctcttaggatcttacgtctgttttcttcaatttcacgttgaaccacaatgtatgctccgagaggagtagactcccaggcggtatctttcaggaagttattcaccgcacctcgattcttgggggtgaagtcaacattggatctagccttcgtgataaagtcgacattctgattcaatttctgaattaagtttgatagctgtctgttgaatttcacattcttggatttcttgataaatcttctaaggtaaattacagcaggtgtagtaacctctgggaatgcaatctgcttgcagtacaagacaaaatattctcctagaagagtcactatttgttcacaagatccctcctgatagactctggttcccaaataggcttgattggctctaatgttatgatcgaaatcaaaggcgtgtaaagaagaatgtttgggggaccgtgtaagcactgaagagttcaggatatcactcaaaagcggaaatattgggataaaaactccagtgttttgtgacaccctgataagtgatcgaatcaagtagaatcttaatgggaaaaattgtggagatggaatcaatttgatagtaccaatggtcacttgaactaaaggatatatcaactgccttagaggtgactctttgccttgttctcgttctggattgcaatgagctgagagtaaacgggaccaaaagtccaacgaatgacagaattgccagttataaactgctttatatttttccttttctttgctaattatactgtttctcaaatgaatggccaattgacggatatactcgaagccaacttggtagccaacgttagggtcaatgccaaataattcaatcgaagaatttttttggaaattaattaatggcatagtatgagcattggtctttctggactgtttcacaaatgttgagtacattgcctttagggtaatctctagtatatcaccaggatactctttggcactgttgttcaaaaatgcaaaggtagtaatttgaatatcaacttcattcgtagttgcccaaaggttcacaactgccgtgattatttgtttcaacaaggatttagatagtgtgatgtatggcagaagttcttgaagagaactaagaacaagagcgccggtctcaacactctgtgtgtcactgagtaaggtaactaacgttggagcatgggatttcagtagtacctttactttcggaaactctggagagtcgatcaacttacgaacacctttatgattctttttgaacggcaccaaggtctgaaaagcagaaggaactttgctgacggctaaaatcattaagtggttgaaagttttcggatcatttatgacgtatttacttccatcctcttcattagcatcttggatacgtacagcatccttgaaagcttccacaagttgcttcagcaaaataaaggttggagattccaattggatttcccactctttcaacaaagtattggtgatattaattttttcttcagttgggattcttgattcttctttgtcttcttcatattcatcctcgtcttcgtcgtcatcaatcatatccaacggattgactggtttgaagtccaataagtctttgtcattctttgcaaggtacttgtagaattcaggatcttcggcttttaagtcttctaggtcctgttccatgtcgttatcatcttccgaactttcgtcttcatcttcatcgttcgttttggattgagtttttgttctcaatttggagcttcgttcatctttatggtcaggctcatcatcgtctggttgggagccaacattaaaatcagattcttcctctttttcttcaggctcatcaagtttctcgcccgattcagaatcaacttccacaacagaatcatcctcagattctaagctttcgtcttcaacagttttactctcccttttggaattcttgctcttcttttcttgaggaatttcaaatccagactcaaaaaattggtctacatccatgtccttgaatatcttacccttggattcatcatcttcctttggttcaccagttccacgcctcttatgactagcaactagtttagcatgcttttgaaccttctttctgtgctttacagttctcttcagatgcttagacaagaacttctttgtggcactggaggctttacccatgactattgtatgatctgtgcttagtctgaaaagtttagaaaaaaaaaattatctcatctcctacacgagaattgatgggtgcacacaccagatatcgaaaatcttagagttatgatacttctcctataaaaaccaatgtatgactattcacaatatgcatatttagtgcttaccattggtacgctttctacgcagctcggtttgctccttctctacttctggatcccagtagataaattcatctagagcttttcctcctggaaccataggaaggactggaaccttcttctccacaaatacttccataaggacaggttcagaagcttctaagaactcagtaacctttccaactaagtcttcctgtttcttgacacgtatacctttgaatcccatagcctctgccaacttcatgaagtctggattcgtttggtgtgtatgagaatatctgtgctcgtaaaacagggattgccattgggtgaccattccctgttcttcattgttcaaaacaacaaccttaactggagcgtccgcttgaacagcggaggacatctccatcaaagtcatattgaaggatgcgtcaccgtcaatgtcaataaccatggcgtctggcttggcaatttgggctccaatagcagctggaagtccgaaacccatggttcctagaccacctgaagtgatcatagttcttggttgggtccaagtccagtgctgagcagcccacatttgatgctgaccaacaccagtcgtcacaataacctccttgtcctgtttctgacattgtttcgatatttcagcaatcagcgtttggggcttaatagcagagcctggagtctcgagttggtaggcatagggatactgttccttccattcgtcaatttgcttgaaccattcaggtctttcgctgacggtttcaaccaatggaatgaagttattcaagttcttggtgacgtctccctcaacagctacagtggcatcaacaaccttgttgatgttctttggagagatttcaaagtggacgatacctcctctgtgttgaacagcagctaatctggcctgaggagcgaacttagagatagtgcctgtgactctgtcatcaaaacgagctccaagagcaatgatcaagtcagcgttttgcattgcgaggttagcaacagctgatccatgcataccaagcatatcaacagatttgtgatctctttggtcgaaagcacccagtgcttgtatagttgtggtgactgggatttgtgccttgtcagcgagttctctcagaagaccagggccattctcgtcgttcaagataccagcaccaacgtacaaaataggtttctttgcaatgttgagcaagtgagcagcttctttaatgtttttcatggtgaactcggaggcaacctcctctgtcagacgactaagagttttgtttggtaaagtggatgaaattggaataggtgttttcaaaatggctgcagtgacatcctttggcaagtcaactagaacaggccctggacggccggaagtggcaatctcaaaggcttcgttgatacgtctgggcaattcggccacgtctttcaccattacattccacttggtacaggatcttgagattcctataacatcagcttcttggaacgcatcagtaccaatagcagatgttacgacctgacctgagaatacgacaagtggaacaccatcagctaaggcatcagccattggagtaataacattagtagcaccagggccagacgtaaccaagacaacaccaggcttacctgaggctctggcgtaaccttcagccatatgaccagctccttgctcgtgacgtggcaaaacgaacttaaaatgtgacgagttgtagatggcatcgtagactggtaagatagctccacctgggtacccaaacacagtgtccactttatgcctcagcatcatctcgtggaaaatttcacctcctgatagtccgatgaatgaatcatccatcatttgcttttggttgctacttaaaggttcagggtctgtagattgattaaagcttggagctggtcttggtctcttagcagaagccggggttggagcggtggctactgcagatttgaatcttactccttgtaaaagcgaccgttgggctctatttgaaagggcatagcgtctgcttgccgtcctaatggcgaacattttgacttttcagtaaaatagtggggacgaggaaacagagaaaaaaaaaacactgaaaagtaggagtgattttgggccctttttcttttttgcttttttttttttttcacctctattactcattgattttttcttcgatgtggggggcgcgaaatagctagacaggccataatccggaaacgggccgagattgcggatggaaggttaattctattcatttacatgttatacacggtcagcaggagaggacacagctaaaagccggctttatcaagccaatatctgtttttcgagtcacgactgaccttcgatttactcctactgtcaagctttgctttgacatcagcttcgtcgtccatagctttgctattgttatccttctcaactgtctccttgtaatcatcatcctcatggtcatctagactcataaaaatatcagctctcactccggtactttgagccttgggtattttatttttcttgccactctttcgtcttttacgaactggaggcatgacaacgttagtaatgtcggaatctgatgattctacggtaatgtcagcatactcctcttctaaagtaggtcggtcccgttttctcttctttcctttgcctttattgagttctgacggtaatgggggtaagcctccagttgtgtaaatatcttgtggagtctcagaacgagaaactgaaacataagcctcgttgatgatcttatctcgtgcatcttcaaaatctctttcttttcctgtgtatcgtataattccaccaagaatactctggcctaatctttccttgtaactggcagcttgtaattcgtaacatttgttggttaatagttcaaaagcaccaataaacgatcgtttgatatttcgaatatcgtaagagcttcgacttatgttatttgaggggtcatcagggtcttgaatagccaatgcaaaggtattacttgcgcccaagtatgaatgctcttcctttttcaaatagcatacagttggattgtatgataagatgacattgtcatatccaaaattgtatccatacagttcaaaaaattcaatgaggagaactcctaaattgtccaaagggtcaatggaattcgtaattaacctcggatgcagggagaggaagctatggactaaacatatgatagaaaatcctcctaatcctccatgatgaacattgttcattcttcttacagctagaaattgtttcacaattaaaaccagttctcttaatcctggggtttctcttaaccagccttgtattctctctgcagctcttaagccgttcgtcttttcaaaagaaacatctatatgaattttcgaccttggttcgatgaatttgatgatagggactttagcccttgctatcgtttctatgtttacccctaggttcttgcttctgaggaatgatgacaattggtacaaatatgatttcgcacaatactttccagaatcagacgttatgaccatatcaatatccgatcctggtaagtacaagtcagtggcaaaggatccaaacacgttgacatagcagtcaggccacagatttgtcgtgatttctttccttaatctcttgactgcattatttctagcttcaatctctgctatcgagggagaaatgtaattgataaagtcttttatctccaaagttaaccagtcactcagctctagttgtttggaatgatcccggttttttatccatgggtattgttgtatgggcttatcatctagtggtacaccttcttcatcagcactctgataagcatcgtagtctgcgattcttccatcttgttctaaaacttgctctgtatgatgatctgattcttcgtctgaggaaaaatcaaaactgataaagtccttattctccgtgagttcattagattgtatcttcttgggctcgggtgaaattagttgggtttgaacggaagttgcctcttcagtctctttgagcattattcctccttcattttttatgccattcaagctttgcgatatagtactgtcagcatgatttttgcttaccaaagtgacagccttttgggcttctgtgatcattacagttgaactactagtagcttgatatggtgcaagtattttttttttcctcatacaccctccgcgggtgtaaagaggcaatgcgacattttgattactttaacattatttaattgtgtagggaataaacattcccagacatagttccaacaaaagccacagaatttttcaatgctagcttgttttcattagcgagttcaaattccaaagaaactgttttgggttggtgaaatcctttgcatataaacgtaatcgattcgccaatttttagagagctttttaaaatgaacccatcttcagttttttggaataaattaatgttcccaaaactatcactggtaagcaagcactgatctgataaaacagacaccagggagcaaagtgataatttatcttcaaccggtaatgctttgatagacccaatgtatggtttatccaaatctatgtcttgacaggatactcctaatttgaagtcacctatgagcagcttagagtcgttgaagaatgacagacatgagctagcaattccaaccaccgaaaacaagatctgatcctccagttcttcgttatagattttgagatgactaccaactgcaactaagaagccccctctagttgcaagttgggatatggtgcctattggcaccctgacttccttgagcttctgcaggtcaaagttaaatgatctgatcacgctttgatctgatttatgatcgttactggaaacgtagaaatatttgtccacaactatgtctagcatttcttcagcatatgtttttatatgttttatctgtagtttctggtccaagatatagataaacgagtgaatttcagaaccaacttccttcagacctagtacataaaaagattcaccgcgcagcaatatctttcttatcacccctggtactgttattgatcttccatcgactccaaacaaatggctcttgctaatagtgccttgagccaaaagaacatttccatgcccataacataaaccagcagttaagggaccaagaaatccatcagactctaggctcagtagttgagttatttcataacggcctatgtcaacgattaaggacttatcagttgtagaactgatgaaaaacttttgatcctcaagatgtaccatatcatttcctattgtcgatttcccaacatgcacaaacttccacgatgagatactgtagaagtcctgagactcaatttctagttctagctgtctttgggcattcagtaattcctgctctctctcaagttcttcttcagttttgggaagtgcgtgaatgtcaaatgagacaagataataatctcctgtattcgatcccaagatgactctatgttcgtcaataacgtgaaacactgtaaaaatctgtttctgtgtgatctttgctctcaaattggcgagttcccgtgtaaggattttaactgccgccagtttattaataccgaaacttgcgttattttcaaacttaaatattgttttaccagaagggtatattgaatggatttcctctcctagaaccattaaacacccattaggaagtggaattgacaagactggagtttctggtaagggctgaaatttcctcagcagttcacaattgaattcactaaatcttgaactgtgtttaactactcgatagtacttgaccaagtatttcaagtttgaatctctgacaaccaaagccagaatattatccgccaaaaaatggcagttctgaatcagttcatccgctaagtaaatgttgcaaggcttcaaaaatattcggttttttttcaaagttcgatttatttttcctgccggaggattatgttcaagggcttgtttgtagagttgctgctttgatggatccaggtacattatgtggacaaagttgtcaatagaagatatagcaatgaaatttccgtcttctgtgacagtcattgtacatatttcacctttaagaccttcgaatgtcactctgtccactacaacgaagctattctgctggtccgaaaacgcaattaaccataactgatttgactctgttaggcataccagccagtgtcttctatcggatggatcatcttttatgactgggaggcttttcaaacacagtattttttcattgattgtaatatcaagtaagtggtgcaatttgccatcacagtactgttgaacttccaagcgatcgtgtcttatgagaaccaaagaattaacgtcattttctatcaacggagccaaattcgaacaactaattccataagatcttctttcgatgcccagcttcatttaccttaacctgtgatcatgaatataaactcagaagacgagtctcctatgatgatggaatcggaatttttcaattcgagatatctcttggggggtattggaatatcattgacattagtcccagacatagaaccaagatcaataatgtatggctttattgtacctttcattttcctgaattgaataacggtgtttacctgaccaatgtccacatctgcgagtttaaaatcacagtcgtcagtattgcccaaagtgtaaaaggaattattcagagagattcgtttcccatcagggtagatgtcattgaagagaaagatgtagtatttatccttcggaggggaggttttttctggcggctcgctgtaattcttttctttctctgagcttgacttagatttcagatctttggagtcttgctggcccaagattcctgagggcccgatgttaaaagtaggtctctttgggctctgatctctcttggtattaacggatgaactatccctattataggaagatcgttcacggtacatcttgtattcctcatattgactttcttttggatcatttctctgtagtttagttttatcagtcacttgttccctgtcttgccccattgtatttttctcctgttacaatgtgatgagcttctcgtttcttgatagaaaaaaaaaaattaggaaacagaaataaaaaaatttgtagtctaaagagaacttacagtatggcaaggaatcaaaaaatctcaacacaagaacgaagaaacttgcgtgagaagcatcagcaagctcaaaaagaccgtcaagagaagcttgcccagcttgatccgaaagaatacaccaaatttacaaagttttctgagcttcctctatccagacaaacgctaataggattaagaggagcccacttcatagaaatgacagggatacagaaagaagctattccaccagctctccaagggcaagatattttaggagctgccaaaacgggatcaggcaaaaccttggccttcttgattcccctgatagaaatgttactgagagaagattggaatgaatttgatggtgtcggagcactaattatatctcccactagagagttggctatgcagatctatgaagttctcctaaatattggtaagcatagcagtttttcatgtggtctagtcatagggggcaaagacttcaagtatgagtccgaaagaatcggaaagattaatgtactcattggaacaccagggagattattgcagcatatggaccaatcagccaatttgaatatcaacaacttacaaatgctaattttggatgaagctgatagaatcctagacatgggtttcaagaaaaccctggatagcatcatttccagcattcctccgcaaagacaaacgttattgttttcggccacccaaacaaaatcggtccaagatttggcccgtttatcgttaactaacccgaaatacataaacagttcctcggatcttgatctggcaactccagattccttggagcagtcctatatcgttgttcccctcaatgaaaaaataaacacattatggtcattcatcaaaactcacctcaaatcgaaaattttggtcttcttatcatcttccaaacatgtgcatttcctctatgaggcattcaggaaattgcaaccgggtatatctttgatgaagttgcacggcagacagaagcaaacggcaagaatcgaaaccacagtcaaattttctcacgcacaacattgttgtctgtttgcaacggatgtggttgcccggggtttagatttcccagccattgactgggttgtgcaacttgactgcccggaggatgcttcaacatatattcacagggttggtagatgtgccagagctggaaaagaggggaaatcattgttaatactaactccttctgaggaagaagcttttgtgcggagactggaagctaaaaacatcaaaaatatctccaaattgaatgtaagaggtgcaaagaaaaagacgattgagcctcaaatgcaagcgttatgtttcaaatctccagaattaaagtacttgggccagaaagcttttattgcttatttcaaatcagtttttatacaaaaagacaaagaagtatttcaagttcaaaagttgccggttgaagagtatgccaaatctcttggacttccaggtgctccgaagatcaaactgctggagaagtccgccaaagccatgactgaggagcaactatccaagttaaaagaacgaaagaacgcatccaggcaattacttaccctctcaaaacttgatgagaatggagaagaaaaacctgaagacaagaagaaggttagaacaaaatatgataaaatgtttgaaagacagaatcaaaatgtgctttcggagcactatagaaatttgaatgcagaacaggatgatgaggaagaagactttatctctgtcaaaaggaccgatcacgacttgacagagaacgtccctgaacttgacaaccttccaacttctaagagggctgctaaaaaggctttgtctaaaaaggctatgtcaaaggctggtgccaaccccaagaaattggtgtttgatgacgacggtaaagcgcatgaaatatacgagctagcaggagaggaagagttccatgaacaaggtgatgcgctggatcaaaagaccaagtttattcagcaagagtccacagttatggctgaagctgactctgaagataaggtggttgcaaaggagaaaaaagtcgaaaaaaagagaagaagacaagacattgaacgaaaagccaaagaagagtctgatctgtctgaggaagatgatgaagaagacgaagatgaagaagaacttccagacattgctagggactatgacagcgacagtagtggggacgatgagccagaccgtaagaagactaaaaaatggttcgagaatgacagaggcatcaatggaactgattttaacactaaggtgattgagttggagaagcctgatactattgatgacatggaagctttggctgaacaattgcttcatggataaatagacgaatcaaccatgacatccactcaaaaatgacttaaataagataaatataagactccaattcagcgattcgctaatgataacttaccaccactagcataccccagaaagtaagtagaaccagctgtgtattcttaggatatgacggatgggaatctaatttctgacttgatgcggaaaaatctcttggagtcactcaattctggtagtgaccatgaggatgaggtggaggaagaggaagaagagactgatgctgtgggagagttgaaccataaagagtggtctggatcaaatgccaaagattgtgattcacggttcaatgtagcaaatggatttgaagagtcaccatatcaattgaaggagtggacagcccaaacttattaccaaccctttcaatcagaatctgtcaagcctgtaatatttatcgcacaccatggggccggctctagtgggttaactttcacattgcttgccaaagaattggttagcatctccaaggattcccaaattaattctggagatgaattggacataccgggattcttttgctttgatatgagaggacatggtcaatcaaagtttgttgagacagtggaatccaaagattattccattcaaacactatgtgtcgatttcatcagcattttgaatgaattctttgctaggaatgaattcgatactgtcaaatgtagacctagtatatttttcattggtcactcccttggtggatcaatactgaccaaaattttgaaagaggatatgattgaaaaccagttcatcaaagattgcatcaaaggattagttctcctagatattgtggaagaaattgctgtgaaggctttagacgggatgcaaggctatatcgatcatagaccaaagtcatttgcttccctatcagatgccttacagtggcatttagattctgggttactacataatgaggaatcagggcttatttctatcccttttctattttctaaaagagaaactgaaggctctccggtatatgaatgggtgacagacctcaagtctacaaaaccatactggaaaggatggtttacagggctgtccaatgggtttattacgatatcttcaagaattgccaaaatgctagtcttatcaaatcatgaaaacctagataagtatctcaccattggtcaaatgcaaggtaagtttcaattagtggttttccggaatcagcaaaactcacagtttggacatttcatacatgaagacattccaaacaaagtagcatactccatactagatttcgtcgatagaaatgacttcacccgtccgaagtcagttttgcatcacgatgagggaacttctcaaagagagctcatacagaaactaaacgccaaatggggtgttaaaaattaagcaacgtaacctatttaatcaacggtcatggtatctagttgagatgtattgttcttctccaaagtctccactacttgatcaatcttttttctagcccaagagaagcttggatcgattaaaaatggtctgaggtcaaatctgttatcatctggagaatactgttcagcatggtagctaggtgtgctaactgtttgcttatgcctgttgactgcatagaaccaccaaaaccgttttactttggtgcctatttcttctggtgtcagacgaggagaccattcgtgcagcaacttaataaacatggagtaaggaccacatttgttgacctttctgagtcttccaaaaatagacaactcctcataactcattcccatgtcggcttcatctgattgtacatgagtgtcggtaattggttccaattctgctgtgggtgtagcgtcaacaaaatcccgaagtataggcagatcaaaccggtttatagaaaacttaatgaaactaatgagatcagtcttagaaattcctcctattggatttacatctgcagatgaacaatcatacttggtcaaataacctcgaagctgctcatccacgttggcacttcccaaaaccaacaaaccaccagtgtttgttctacccctagtccaaggtagcaactgggcaaaaaggtaagctaaaaccattcttaatcgggcttgaatattttgaagggccaagttttcaatttgactaccaccaaatactttgaacaccggttttctgcctgttactacctcaaagaggctgactaatgcagtgaccactgaatccatgttcaaatcaacatgataagatccaattctggctgcaagatctctggatcttgctctagtctctatagatgagttggtagtacccatataacaagtatggaagatcttattgcaaagctcttgaggggtctcaggaatccaaccttctggcatgttagcaaccagctgagcatctcgtataacttgttcgtttccttctaatgcttcttttactacaagagtgcacattgaaaagacaatcactgatgtggcacaactgtctattccaccactcaacgggacaaagtaacctgaacctttacaccttcgcacatagtcccacaaccagcaagcaggtccgaatgcaatctcttcctctggaagatggtatcttatctcacgaggcgatgttggtacgatggtggggtcaaaactctttgaatctggagataactcaatagcagcatgaactctttcgtaaacaggagtagagcgactttgtagaccatgtgaaatcatgtttctataggacctgacatcttctaaatccacagtggcagttattacttccacatctttcaaagaaaactgggaaccttgagctaggactttgccattgacaacaataagtgcacaaccatcatagtacaatctatcaccatcacagcctttttgattggaatacaaatatattccaccacacttggtagtagcctctgtaataagatccattctggtattcagttttctcaactcatggtgggaaccactagaatttgcaacaatttcaaccccatccaaggccatagcaatatgaggagcttgcggagtaaacagctcttcgcaagtttccgcaccaatacaagtatccaaagttgaaataacggcgtctccgaattgaactgttatttggcccgtgatcttttgtagtaatctgggaagaacaaactcttcaacgtattgcggctgtaaccaaggcgtaaagtatctcatttctctgtaattgccgtcattagctaaaaatatcttggggcggatcaacaaaatttttccgtcataggataggatacgacagttgtaacgtctattcttgtgcattattggtaagccgatatccaaaagaattccatgagttgactcattctgaagtatagaagcatacatttcccaggaatgcaaataagtgtcgttctcaagaaaatgatccaggcacccgtaaccagagatctccaattcaggtcccactcgtaaagaagctttggcctctttggcctccttaatactctggagaatcctatccctattcccttcaaagtctaaagcccattgattcaaagagcaagttgctaaagtaatataatgcggcatgttaaatttgcactggcagacaacagaacgtcaatggttcgatctttaggtgagtgcaattaggaccgttagtagtgctggtaggctataaaccaagttgtggagatgaaacgaacagagctatatgatgttaggatctatacgcgttgaaaaatcgaagcattcgtacgacccagatgagacggattacctattgctcttactttcaacatgatccttcagttattaagttatgtgggcatagtatccgggtttgtatcaattacgctggcaattgcctctggattgtactatctttctgagttagtagaggagtacaccgagtttacgagaagattaattggcagactaataatagctattgttggtgtattcctgttattgctatttctagatgggttcccaatcaagctgagcattttttctcttttgacgtactatatctactacaagaatttaaagacatttccgttcattgacttgactggtcccgtgtttgtctcgtcctgcatactggcggtgctcaaccactatatgtggttccaacacttcagcaatccatacattccaacaatagaagaaagaatttctcccaattacatacccccacacattccaacatttgctgaaattgcaagcttttttggaatttgcatatggttggtgccgttcacgttattcatttcattgagtgccagtgaaaacactctgccttccacattgaacgatatcaatagattcgacaaaaagaacgacgatactacaagacagagaggagttggactagtcaaattagccataggttttgcttatgagacattctacaattttggtaggttactcgggtatgaatgggatccaaaccagggtcggattatctaatagaattgagaaatgtattttctttgcggtgtccaacagacttaatttctggatgtagacggtgaatctggggtttcaatgctgggtgttggtctccttgttggtgatataaatggcaaattgcgaggttgtttggacgtggaatccgtctcgacactgttggagatgttgcttccaagggaaaacggacgtaatttatctgaagaccctgagtttgctgtgttacttcgactccgattttgttcgattgataaatcttgctctgcccttaatttggataaccgcttctctctctgggcgttgacttcttccttatcaatgaccatttgcttcagagattgtagaaagtttcgattcagcaggttcgccaagagacgatcgccaactgcagaaggtatcatattgaacgagtcttgttgctttacgtctggtggtggtctaaggataaaatggacgaatggaatagagccaatggcttctgagttattcaactgcttgccaagttcgtcttgagtagaagcatcgatgcgatcagataggtaattgaataggtaccacgtagctgcggcattagcttgaggcaactccagttctagaactttcatcaaatctgatgatgccgattcttctttagagaataatttaacgagtgaggtataggaaaactggcccaatagagagtcactcaactccaacaaccacaatttgagcagtaagatccagatagccacattatcaggatataactcctccagtttattaataaattgatccatgacaaattcatccacgctaaccttgttatcttcctcactaaataacatttcccagttatgtgtattcatgtaatataaattcctgagttgggtagccgtaatgagttcataaggtttagtccataaagttttatcaaaaccggacgctgaaattctctctaaaactttcataagaaacaaaggaacggactttgttgacaagtctgactcgttggaattggttacctgagacgaaacttcgcttccaaacaaaagtgacttggtcttgtgaaattgagatcttgcttgtaaataagagctgttgtattcgtatgccttgacagtattccaaagctgattatcgactggattcacagacagatagcctccaagttcattttcaatatatggcttagaaattttgatagcgttcttgacccaagacggtttcgttttgaaggttttgtttgaagggatattagcttttaggaagtcatttatttcctgcacagttgaggaatcatcataatcttgagtgcccttcaaagattgttccgatatactggcatttttaactgtggtattatgggtaatctctgtaaacttgctaatcacatcatacaaaaacttggctcttcctacctcatgttcttcaattgcgttgtaaaaatgagatatgttggtttctagttgtcctctagcttggcttaaatgttgattggccaaaacaaagtcctgatagagaggttcatatgttaataggtaatggttcagtttagtatttgtggtacctgaaggtgtaattgaaattgtcggtgcgagagagggttgggtagtagcagtagaaagctttgccaaatctttttcttttgctaatcttttggcaagtcttgcctctcttttggcctgtattcttttttcccttctggctgctcggtcttttgaacgctcttcaatgtagcttcgctttttttcttccacttggttggagtcaaattctagaatatccttcatcaatgcagtccattcaaacgtggctctatcatcgtctgatctaaacttatatgaagaaaactgtagaagacttttagattttatcaatcctaaatccaataaacgttggcaaatcttttcaacctgataccttgatatagcacctgctctcttggaaacgtctctggaacttggaggagcaatgttcaaaatcatccagtcaatcaaatctgttcccttgatactctcgatataagaggacatgaatggaatcttggatctttccaatggtatttctttcactagttttattgcaaatcctttgaactcttcgatactgttgaatcccaacaacttatcacagagcacaattgggaaatctttggaaaaaacataggccggatgctcatcttcgaactgttttaagttgtcctctgcctcagagggttcagaatccgacgagatattgtcagaattgtcttctgccagtctttgcaaggattcccttaattcgatttctctctcctgctctttttcggtcatagcttttgacttcaaattcaagttggagattttgcttgtaaacgatgccaaggaatgttgtatattggttggaataattgcatggtctgatgaattagtactcagatctgatatggtcaagatgtgcttgaccaatttgtcctttaagttccgagtttccgtcaaacagtcatcgtactcattaaaggagttctgcagctcggtctccacataattgagaaagttcttgtattttgcaatgtactgttgagtaggacttaggatctgattcgtgagctgggaagagagggccagctcattatctgcctcgtcaattgttctattgattatcaaattgagcatatcattgacagatttcttctttgaatccgggaatgtcccatttaaatcaaataaatcttgttcggctgtatttatccaatcgttcaagagatcaactctgctagagaccagcttagactggtaaccctttaatagcttctccaatttgactaaattggcgtggttctcccataaaatactgaaaacatgattgattcctttttcataaccagaggaccaataatggttgactaaatgtgtattcaatgcctccattgacatggttaacagttggaaaagtacaccgtgtgagaggagagatcagggcgcattataccagctcctaccgaatcgagaaaatattatcgtgaaacataatcatagtggtgacccaaccctttcaacaagttctttcattaaacttatggttattcttttgatttacctattatataatacatgattagaagagcccttcaatctctcccttgtcattgacttcgacattcatgaacccacatttagtagccaaacctggaatagtttggatctccgaagccaacgcatagaggtatcctgcgcctacagaggctttgatgtctctgatagggaacttgaatcccgtaggaacacccttcagtttggcatcgtgagaaagagagtattgggtctttgcaatgcagataggaagcttgtcaaaaccttgagctgtgtattccttaattttctcttgagcttgaggaaggaattcaacttcagcagcaccgtacatcttttgcgcaatagcactgatcttatcagcaatagaagtcgattctaaatcatagataaagctgaaattctcaggctgttgtccgggatactcgttgttggcagcacgaatgataccagaggcaagatcgacagcaccagcaccaccttcttcccaatggttggatacaatggcatcaatagcaccggctttgatagcttcctctctaatgatatcatgctccttatcagtgtcactgctcattttgttgatggctacgatcacactacgtccatactgcttggcattttcaatgtgcttaccgaggttagcacaacctgtcctcaacatttctaagttctcggtagtgtattccaaaggcaactgttggccagctttaacttcacttcctccaccgtgaaccttgagagctctcacggtagccacgatgacaataacgtctggctccaaaccagaagatctacatttgatgttcaggaaacgttctccacccatagtgaaatcaaaaccagcttcagtgatcacgtatccctctttgccctttctttcttcgtctggaagattagggtcggttccagctagcttgagcgcaattctatcggccaaaacagaagaagcgccaatagaaatgttagcaaagggaccagcatggacaaaaactggagttccttccaaagtttgcatcagattaggtttgatagcatcctttaaaatagcggtcaaagcaccagcacatcccagatcctcacaagtcactggttcgccactcttgttggaggcaaccaccatacgacctaatctctctctcatatctttcagagaactacaaagagccaaaatagccatgcattcagaggcgacggtaatttcaaaaccagtttctctggtcaatcccttttcggttggagcttggccaatggtaatacctctcaacatacgatcgttcagatccaagactcttttccaagttatagtttttggatcaatgtctagacgaacaaattttccaatctcttcctcggtccactctcttggatctttcttgtcgagacctaacttggcaactctgggaagtaacccgatgggaatgtcccttgtaccatcttttttctcggggcacagtctcttccacagacccttatcagtttgagtagactcgtggaaaatcctggtatccaaagctgctgccagtaaattattagccataccaatggcatggatatcaccagtgatatgcatgttgaactcatccataggaattacttgagaatatcctcctccagcagcacctcctttaacaccaaaggtggggcccattgaaggctgtctgacattagcaaaagctactctgttcaaatgagatcccaatgattgagccaatccaacggtcgtggtagatttaccctcacccagtggggtaggagtgataccagtgaccaatatgtatttaccgttgaccttgtcttgcaatctctctaaagtgtccagactgactttacctttataagctccataaggttcaatttctgaatccaaaactccagactctctggcaacctcagttatgtgtttgggctgctgatttctcgagatttcataatcagatggaacgggcttagtcaaatttaactttagacgtttgaaatcagacatgctatcggtaagtttaaacaatctctatctttcccgcagaatttgcctatcaaaaggagagaactggaaaaagggttttttgattttctgatatttatatatgtaattttcaggatgtcaggtctctgactctgtttgtgactcggtcgaacggtcctttcccttgcgcgtctagagttagcgctgaaaaattcctaaactggtaacagagggtttagcgttggcttcagtcaaacatctaagatgactgactgtcaagagaagccttagcactttctaaaacgttggctaataccataacaactgtcattggtccaactcctccagggacaggagtaatcaaactagctttaggctcggtagaggcataatccacgtcgccacacattctttgtcctgatttcttggtagcatcaggaacataattggtgccaacatctataacaacagcgccttccttgatgatgtctcctgtaatgaaattaacttgcccgacggcacttatcagtatgtctgcattcttgcagaagaactccttttgtgcttgagttgatctagagtgtatgacagtcactgtacccccacgcttctctaataattttgataaaggcccgccaacaatgtcagatcgtccgcaaactacgacgttttttcctgaaatctcgactttttcatgatccagcaagtataggattccctttggggtacaaggaacgtatagtggcttgtcgctctttttgaagacggatgcaaggttcaagttggtaaagccgtcgatatccttgctttgaatgaccttgtttgttatcaatggttcatcaaggtgttctggtaagggtaactggatcaaaatgccatgaacactgggatcctggttgaggcgttctacttcggtaatcaattcttcttgattgatatcggccggaaatttcaacagttcacctctgattcctacttcttctgaagatttgagcttcattctaacgtagactgaactgtcaggacgatctcccacttgaatgatggtgagccttggttcaaatccaggatttttctgttttagctgtttgatctcatccgctatagacaaacggagttccgaagaaattgatttaccgtcaattttcactgccattctgttctgtcccttgtgttatctattctctatgacgaggtaattgaaggctcacatgtaaaaaggacctatttttgtttcgcggagccaacccaacaggtgagtaggtgattatgtcatcaagctctatgtctttttagcctattagcataatcattcagttggccaattccttcctcagtgacgaagaatttacgtttatcatcgtcccgccacagcatcacaccaacttcatcagcgtagttagccaattgctcaaattcttgggcattggcaaaatctttgaaaagaaaaccggcaaaagtttgaagtcgatccatttccaactgccaaagcttgatctggtctactacagttggaggaattacctctaacttgacttgcgacccgatttgttgagtttccgtggcgttcgaatcgaactctaactttttaagtaatttttcttctgcgagtttcttcatttgtgaatgggcatgtgtttccaaatactttattatttggtcagcagttattccattacgtagagcctctcttacagattctcttgtgatcattcccgtaaccatatttgcgaatcttgttctcaaatgaacaaacagattcaggatagcaatctgtaggggagaagtggtgtaacagtatagtttgaaattagtttccagcactatagatccgtggtcttttacctccggtcccccttccagcacttgattcattgacatcgatgcagttttgaatgttgttttttctgatgtcaatgtcgttgccattcgggttgggtagaagtatctatttttctctggataataaattaatccataatcaaccaaatcctccagcattatcacttgggtgtcactcaagagagtaacagggtactgttttcctagttccagagaacccagcatgaagataaaattcaacacatcgactggattcatcattaatttttcactcatccgaagatactgtagcagaagttgccatatctgggcattgatatcttgtaacaaaaactgaaacccgtcctgcgtaattttcatggatttcaaatccatattatctcctttgaaacgtttaggtgtggctataaactcgttctcttcgccaatatccatcaacccactatgcctcaataacgagagaacgccgattgagggcaattcaggcacctctgagcctaccatgaaatgtaagatattttcccacttcattaaagagtaccgatccaggaactcctccgaaacttcctccacatctgtcatctcgatatcattattgagatcattactcatttgggatcctgtgagagcattacgaaaattcttacgaaacattgggttcaattgaagtacaacaacgtttgtcaactgccctgtattaggattagtccactgttttctgacatccttgatcaggtttagctgtttcaaccttttcagacattcgttttggtacatcttattctttccgattgctcctggaaaattagtgactgcggacgacgaagacgactttgtagaggacgaaaccaagtgcgtcatgttatctggacgtatccatcttgtcaagtcaatgtaagaaacagaatgctcattgaatagaagactcatgacgtagaatttagctagtgagggcaataatctgaaaatagctaaacatgtgattgaagattggtacaatttgttgtgcacagattcaggaaggttctccaaatagtcgttaacagtggtcttcaacaggttggaagaatcactcatgttcctgtccctgaaatgtgccaaaagatctctatctctaggatcagattttttgtagagacatctgagtatcgaagcttatgtaaacattttccaagaaaatttgtaagctgtttgtagttagcatttttttttttctgaaacttttgatttgatttctctccaagtgcttttagttatcagcacagaaaggggtggttttttggaaacaaaagtaagcaatgccgcctcggaagaaacccttgaataagccagttaaaacggaagaagctgatgacgcttttggtgaacttttgaaacctatttacaaaggaaaagccctagctgatccaataaacacggcagaagataagtggaaccttttaccagctttccttcaagttaaaggactggttaaacagcatctagactctttcaactactttgtggataaagatttgaaaaagattatcaaagctaacgaaaaggtgctcagtgatgtggatccggagttctatctgaaatacttggacatcagggttggatataagtctacagaagacttacagaaagtcaagcggaacatgattccgccccaccaatgtagattgagtgataccacctatagtgctccaatctacgtggatgttgagtatacccgggggagaaaaattattatgcatagagatcttgaaattggtaaaatgcctattatgttgcgctccaacaaatgtatattggaaagcaaggatgaatctcaaatggcttcgttgtgtgaatgtccattagaccctggtggatattttattgtgaatggtaccgagaaggtaattttggtgcaggagcagttaagtaaaaacagaatcattgtagaagctgatgataagaaacaaatcgtgcaagcttcagtgacttcttcgacacatgaaagaaaatctaaaacatacgttgttaccaaaaataacaagatttatctcaaacacaattccatctccgaggaagttcctattgtgctagtgctgaaagctgctggaatcgtgtctgatttggaaatcatgcaactagtttgtggcgatgattcaacgtatcaggaccttttcactatcaatttcgaagaagctgcaaaactcgatattcatactcaaagggatgctctagagtatattggtaaacgagttaagaccatgagaagactaggtgctccaaaattatctatctatcaagaaggtgtcgaagcgattgcaaataccattgttgcacatatctctgtcgaagatcttaacttcagagaaaaggctatataccttgccatcatgactagaagagtggttatggcgatgcataaccccacaatgatagacgatagggactacgtgggtaacaaaagattagagttggccggtcagttaatgtcgcttctattcgaagatttgtttaagaaattcaactcagatttcaaggccaatattgacaaaattctcaagaaacctaacagagcctcagaatttgatgctttactaagtatcaatgttcactccaacaacattaccacaggtattaatcgtgccatttcaacaggaaactggtcactaaaacgtttcaagatggaacgggcaggtgtcactcatgtattatctaggctgtcctatatcagtgctttgggtatgatgactcgtatctcatcccaatttgagaaatctagaaaagtttcgggtccaagagctttgcagccttcccaatttggtatgctttgtacttctgatactccggaagatgaagcttgtggtttagttaagaatttggccttaatgacccacattaccactgatgacgaggaggagccagttagaaaaatttgctatctgttaggagctgaagacattaagattgtggattccagtgtaattagttctcgaagcaactttggtgtctacttgaacggtactatgataggggtcatccgatatccaactgtgtttgttaccaaattcaggaagttgaggcggtcaggaaaagtttccgctttcatatccatctacattaactcgcatcataaagctgttcatcttgcagctgatggaggtcgtatttgtcgtcctttgatcatcgtagagaatggagtttccaaagttgaggcacatcatttacaaaaactgaaagatggagaatggcagtttgattcttttttaacgaatggtctagtggaataccttgatgtcaacgaggaaaatgactccttgattgctctgtatgaaaaggatatcaaaaattacaccacccacttggagattgaacctttcacagttcttggtgcagtagctggtttaattccttaccctcaccataatcaatctccaagaaatacatatcaatgtgcgatgggtaagcaggctattggagctattggttataaccaattcaacagaatagatactctgttgtatcttatggtatatccccaacaaccaatggttaaaacaaagaccattgaattaatcggctacgacaaactgcctgctggacaaaatgctactgttgcagtgatgtcgtattcaggatatgatattgaggatgccttggtcttgaacaaagccagtattgatagaggtttcggaagatgtcaagttttccgtaagaatactacattgctgaagcgatatccaaaccatacaaaggatattctgggtggtatgtccgtcaatgatcaaggagagcccatttttcaacaccgttcattaggacctgacggtttaggagaagttggtttgccattagaaagtgggcaggtttacgtgaacaaatttgtccctataaattcagaagaatccatcattggccaaactccagatgattctcagagaaaggaacaacacagagagacgccaatggtttatcgtggacctgaaccaagttatattgaccaaatgatgatgtcacttggagagaatgatcaggttctcgttaaggctttacttagacagactcgccgacccgaattaggtgacaagttttcttccagacatggacagaaaggtgtttgtggtatcattgtacagcaagaagatttgccattcaatgatgatggaatatctcccgatatcattatgaatcctcacggtttcccttctcgtatgactgtgggtaaaatgattgaacttataagtggaaaagccggtgttttagacggatctttacaatatggtacttgtttcggggggtctgatttgaaggagatgtctcaaatattgattgataaaggattcagttacagcggaaaagaccaactttattctggtattactggcgagtgtctgcaagcttacattttctttggtcccatttactatcagaaactgaagcatatggttttggataagatgcatgctaggtcgagaggtcctcgggctgtattaacccgtcaaccaactgaaggtaggtcaagagatggtggtcttagattaggtgaaatggagagagactgtgtggttgcttatggggcttcccagctgttactagagagactaatgatcagctccgatgcttttgaagtagatgtctgcaatacttgtggtttgatggggtacaatggctggtgcccaacttgtaaatccagtgaatttatcatcaaaatgacaattccttacgctgctaaattgttgttccaggaattagtaagtatgaacatagctccacgtttagaacttggggatgtcttttgacgacgggtactattaggtgaaatagattctaccagttagcgatttaagaataaaagcatttaattatagatcaatatcatacaaaaaataatttgcttaccataactccaattcttcgaacagatcaactcttcccttgcatttgtttaggttatgtgctactaactctctgatttcgtcaaccatcttggtaggcccacaagtgacaataccaacagagcagtcctccgcttcagtaaattcgtcaacaattattgatttcaagtcaggccttccaaaactaaagtgcacaaaatctttgatgttatcaacggagacattatcaatttccaagagtgaaaaactatcagataccgactctttttccttatttacagtatccttaaaatcgtcttcagagacgtacattggaataggagtttctctcgttaaataaatctgcacctccagagccttattttgtggacatttttccttcaacagaacaagctcaggtaagaacgatttgatagtgtgaaagctctgggaaatccaaactagcttgactttttgactagctattgtgggatttttgtcagtaaccaacttgaaagcatgatcaaacggtcctggtataccgttacccccagccaccagaagggccctatcatatttgtgaaggggagaagaatgcccataaggaccctcaacaccaaccctcattgttatctgtccgttggcggtcttgacagcttgctcgtagattttcttagttatacccttcttaactttaatgtagacaacaatcttgtcatcatagataactggtgtgaaggggtgggattggaagaatcttagcttatcaccaaaatacaggaatatatggttagctgggttagacttccacctagatggctttgggaaacttaccttcatagtttcctccccaacaacctgtatcgttgcctttggaaatccataataagcaatccttactaatcttataagtctgtcaaatgcccagatggcaattgaagcatacacccattgcatccatcccagttcaatgcagtggtaccatatgcccacaacaaacaaacaaccaagtattatatgtgcatagaggaaaaactcgtacattgtgttcctaacacagtggaaggagaacagaaccatcaaactgcacacaatggtagcaacgacaccccacttccaatatgtgtctgcaaacatttctggaagatagtctctttccaaccaagtccatgcagcagaatgcatgatggcattaaataccattattctggcaatccatttatgataaacaataaaactggaaaagttgagaccagtgcagaaggagagaatgttgtttcgacctccaaacaggaacaaaagaggtagttgaacaaatgctataatacctgttctgtcagcaaaatatctgattctagcttcagtcttattgaggaaaatcacgtcatgtgcaacattgtagtgaacactcatcatgacaatgtaggcgacaagataacctccaatgataaaaaaatcaagtcgggtgggtaacaatgtagtgaagaccttccagaaacctgctgcttctgtatgtttccttccaactagtgccggaagcgatatatatcttctaaaagcattgatcactctgtttcccttaaacttagtaattaatccaaattttttcatcaagttaaccaacacaaacataagcagtattccaacaacgtaaacatggagcacgatagccactgtatcttgagaaaagtcaaagttccagtaaaactgaacatatgacttgtagtaaagatcaacaaatgtcagattgagctggacagggttgtgcaaaatgtctgcagtggcattgaacgaatccgcttgaataaggtactgagatccattcttggcttgatcttcaaagtaatcttgagtcaagttggaaagtgaaccgtactttgaacaactttcctgcaaagcatggaagcctctttcagcatagctaccgtcgtcaaactgattcaaacatattgcaatagtttggaaagctggttcataatgacaatttatctcccagtatgtgtcctttgtaataggagtgtaatcaaacaagaagctaaaataactacagctgtatagagccattgcaccagggtcactatatttagcttgcgctatggtgaagagcagtgaagccaatagcacaggaataaattgtagcattttgaacacggcctttccaagtgtataaggttttgccttgccttaaatagaatttcttgaaaagacgtaagaaattaattgaatagtagtaattggctgaatttgtctgaacatgagaaataatttcaatgttatgcaggagctgcatagtagactaactttccgacctgggaatcatgaaaagccgacccacatcaacgatagctgttttccgtgtttgacatctggctatgaactatcttgatgctgcgacttatgggagttatttcaatttgctttttgaaacatgccagggggacagtccgtttcaagatctaagtatcaaatcaacccgttttgtggaaagcgttggtcattgaagagtgtattgacttccaccttcagacaggtttgaagattgcataattcttacccctgtataatctggactcaaaagcttatttcgacatccccttactctgcgattcaaaaaggaaaaaagtgagcatattttgttttcacaacttgatatctcaaacgtaggggaataattgagagtggaaagttctgtttacagactttggctattgctgggacaagtacaagaaacgaaaacttttctcgtgcaaaaataattccgagtggttaaaatgctggactactttattggatataataaaattgatatttttttggtgcattgaataatgcaggaggctgcacaaaaaatctgccgtccaagcttaagtgtgaacctatgtaagtgatcaacgaaaccccactatccaagagctattgcagcggaactagcatccccgttttggatctcatgggattaggaagatgtttcaaaaagaaagtaacaagattccaagcacagaaacaagaaacagccgtaaacaaaataagctttcagtcgcaataaaatgctaaatctcgatggacggataacagaggtggattttttatcagattgatcaatcaaaaaacgataatatcagttaccatagcgctaatttcaaaagcttgatttatagctggtgcctcagtttcaccaggattttccgtaattacgcacagatcaaggggggcatgagcagaatccgtgggtcaggacactcggcaacggaaataacgacaatctatatctacaacctgcctgcgtacggatataattgtgccggctttgaagatcaagacactctcttaacattatcttgatgatctattggattcaggaactcaaggtgacttagctggaatgtttcaagtgtcagatttcatcacatgactagctgtattcacctcgctcctaaatccgaaaccctagatctatacgcaattggagggtgacggcttctccaattttacctcgtttgctgcatcacgaccggtaaataacaagcgtatgattggctattattttcttgctcttctattgttcttttttttctcattttcttgcccacctccacctagacctcagatcccagttcatcttagattttctcacggctactggataggaaatttcgcgccttgagatttcgtataaagtcaaactatcacgaaaaaattttcttctctttgaaagttgcctccggataatttggcagctagttgagttaaaaggatgtgttccattgccattcgtctgttaggtgtcgcctcttaattgagggatgctgtttgaagtctggtggagcctctaatgtgacctagttgttgataaagtccggacagatcaatctggcttcaaagtatacgttattctctactcacgatagcgtatcccgtaaagtctgtacattcccgtaacatgtaacccatatagtctagtaatcactctagagctactttctgtcgcccttctctttttcatgtcacttgacctctgcgccaagtttcatttgtgtggtcagatgaaaactctgcctctctacatcagcgatcgctatgacctccccacagacattccctttctaagtgtattttgggataccttctaactaactcttcactgccactcgctcatgagactgttatgtttaaaagaaaacataaacactcccaaacacctctaaatactcttttagagctgtataatgaagtggctaacaccgccctcaataacattcatttagagcaatcagggaaccctgccgaagccctacaaggctggaaggcgctccatacaactgtcctctacaagcttgatgccgtggacaaggtgatcaacaatatagccctaaccgaagaggaggaacacgtactcagtgagatccagatccttcaatcgcagagtgatgatcatctgacccgtttacagacgaagctgaatgaggataatcaggctcgtcaaaagcaacgttccaagtcgaaccctggatcgttaacttcgtcttccttgaacgtacccactttgaggacttctaaccctcaaccaatgcaaacacgtaagagagctatgcaaaagactctgcgaaccacgacctccaataatagatctgcaacatccaacaatgcgaagacagcggcgtcacttagctggacccaagacgaggaacatgcacatcgaaataattggtctccttcttcgagtttgaatgtcaacaaagcaaccaaatcatactcctcaatgtttgactcctttagtgacacgataatgacaaagagtgacacagcgttgaaagaattggaaagggaagccacattacgagaactagagaaagcaggaaactcatccagggaacaacgaactaaatcacctcatctagcaaccgaagagaacttaatagatttggatacagaactccaaagtctggagctgaccaggttaaagtcacctccttcgaatagtgctacagaaccatctagcacacatactaatagtacaccagcctccagaaaagctgcatatgtctacaagcaaccatcagtaccaaagtttgttattaccaaacaaaagcagtcatacaagaatccctctaatacttcagcacgccctcaactgacaagaccaccgcctaaatctgcatctcttgtttcagtaaagaaaactataaacccagcaactgcaagttcaacaaagccttcatcgtcttctaagaagccttccactccaagatcgagatctgtccctacaagtcgaaagaaatctccttctctttcccctaatagacctcccaccaagaaagaatctttatccagcgatacgagtgacaattcacaagatgattctgacaagattgacgactctgaagccctaattgcttcacttcgtggggtggatccattggctgccaaacaaattctcaacgaaatcattgtgcatggggacgaagttcattgggaagatattgcaggcttggaaagtgccaaaaactctttgaaggaaactgtagtttacccctttcttcgtcccgatctcttcagtggtttaagagaaccagcgcgtggaatgctgttgtttggtccgccaggaacgggaaaaacaatgttggcgagagctgttgcaacagaatccaaatccactttcttttctatatctgcatcatccttgacttccaagtttcttggagaatctgaaaagcttgttcgagctttattccaactggccaaaaaattggcacctgcaattatttttgtcgatgaaatcgactcgttactttcttcaagaaatcaagatggggaaaatgaatcgtcaagaagaatcaaaaatgagtttctagtacaatggagtgacttaacaaaggcagctgcaggtaaggattcgggagaagatttgcagcgagtacttgtactggcagctacgaatcttccctgggctattgatgaggcagctcgaagacgttttgttcgccgccagtacattccattgccggaagaggaaactaggaaagcacagttatcaaaacttctatcctatcaaaatcatactttatccaatgaggattttacagctttagtcaaattaactgaaggatttagtggatcagacattactgcattggcgaaagatgcagcaatgggtccgctaagacaactgggagacaagcttttgatgacaaacaagaacgaaatccgaccagtaagcttggaagatttcaaatcctctttaaactacatcagaccaagtgtgtcgaaagaaggacttttacaatttgaagaatgggcaaagctgtacggttcttctggtgtttgaaaatagtaatattaaagtttgtttaggatacgaaagcacatacatatacacattattctttaccgtttacgttctcgtgcacatcaacagtgatagggttgtgtcttttggggtttctaagatcctttaccctaacacccttagcttcgtttactaactcttcaaatacacgagcatcttcttcttcatcaggagagcgcttagcattaagaaactcgtttcctatgatcaaaagggccttagctctcatgacacgaactggaaggtttacagccttatcgtgcaaaatatttgcacacactttcttcaaagtgttctgaatttcatacttcgatgaaacccaagcagtatggagagctttaccagtcatcagtcggtccatttctgcctttgtatattcatcgagagagcctgacttctcctgcatcttggaaatttcttccattgtagtttgagcatctactgcacttgaaagcataccaaacagactctttgccgaattatgcttctgcttaaccgaagagaagactttggaaaatttacccatgattggtttttgtgccttgataaatgatgtcgattgaaaaatataaatctttccgatcagatggagcatttctagaccaaatgattcaattttcatatcttcgatttctttattgagaactttatctttgaagttctggatgctctcaggtttgatctctgactcttgcgtggtatcaaccagcaaattgatcttgttcaccagtttttcagatagctcttccactctcttcttttgctcctccctctgctcatcccttagcttgagtaattcctccctttgtttggcagttaccttcttcttacgatccttctccgtaagggtcggtttggcctcggaggtttcagagttggggtgagatacgtcagtggtttccggaactgtttcctcatcaatgtccaatttctccaaaacttcagttgttctggtaagatccttcatcattgacaattcgcctatccagtctttaaacgattcgccaccaaagatgctactgaacatctctcccgggtcttcgaatccttgttctggtacggcttgttctttgccaaattcatcgtagttctttctcagttgaggatctttcaagacctggtatgcttctccaatgatctggaacttttttgccgcttcggagtcattaggattcttgtcaggatgtgtgagcatagccttctttctgtatgccttcttgatatcaatgtccttggcatcggggctgactccgagcacgtcataatactcggtatccttgaccatttgaatagggttgatacaaatttacaattacaatcttgaagggtgaatcggaaatagagagaaaaaaaaaacactgcccgatggcaccctacataagaggccagttttctttcctttcgatgcagatctgttaattgattatgtaataatgacatatgttcagtctgtactcttggcatcccaagttgcattaatatcccatctggagccaggagcgttgaagctcacgtatttgacgaacttcaacacggaagagtcacgtaacatgatcgtgagcttattccagctcgcttgagaagtgtataagacgtcttcgtcattttcagattgtttgtatatggcagggtcatcgtcttcttcgttgtcgtcattactcatcatacacagctcgtagcctcccacctctccagtttcccatccacttgacggcgtaaggttcagcgttgcctctagaattccgtctatgagcccttcaccagtcttgtctaattgggtagccaaaataaaatcttggccaggtctaaatcgtctaactaatacctggtctctcacaaccacaagaccactaaccaaggtcaaccattttttaaaggctatgctcttgaacaaagatgctagttcgcaaagcttagaagaagctgcgtagccattgtcctcttttgtttcgtgtttcttgtctgactgagcagaatccaactgactgaaatattttgaagtcatgccaaaattaggtaattcctgtggggcaacgtggttaacaaagtctatggtgtcagcgttatctataggttgttcgtccaatccgtccatgtatatgtatcgttgcttgtggggtggaatagccaatttccaaggaaattcaacttcatcttgtttttgaggtaacgagccatctaactcgtgacgacgtaagactttcttcaggatacttgcatactcgttattcaggaagctttgaatttcaatgacagactcatttacaaaactttcattcagctttttaacagacgaagtgttcagtacagctggattgataaactgacccaagtatgtgagatcttgttgggaaagcaccaagtttctgtctacatcagcttcataatgggaaatatcatctggtgatatttcagtccttctaattttaggaaaatcatattctttcaaccctttcgactctaattgttgcaatgtactgcgtgcttctgtacgctcttgttcccctggaataaagccttcttctcctttttgcgggatatgaaaccaaccttgaatactcaatctatgtttgtccacgcggacttcttcaacatcatgaaacgataagcccggctgcactgtaaaaaaggcgatttggttgaattgaggcgtcaacttgcattcgaaatcagatttgggtacgttgggaacaattgagtcgaacagccttaaagaacctccgtagtgtggtttccacgtcctaccaggctcaggcatatagaggataaaactcactcttcttgttccaataacatcatcgtgagtcagaagatgacatccctttctataagtattgatactcatatctgtcttaataccactaagcttcccacagccggtgacataagaaatgtagtccctgaatgttttagaataaattgctgatctcagcttgtacagatttgggagtcgtgacaaatcgtcccagtttagtccagacatgttagcaagatcaccactctggtagaccttatagatatcagtttctttcttagtgaagacaatctcactcaaaatttcagccctaacatctctgagcaactgatcgttcataagttctgttattgttccccaatgataaggcttggaagtcttgatagaacttttcaacccattcttgtactcatcatcgaagatttcctgattaaaatacgttctagccttggcctcctcctcatcagttggctttatcgtgatatcttgcttctttattgcagcctttgatgtgctgtttgcccgtttggtagtcatagtctacgctgatatgagactgtatgaggaagtaaaatattgcctgcttaacctgacctgctacaagaaaagaatgggatgatactgaaaaaaaaaaaaaaacttagaagaaagcaccgcacccacgctgggagtcgaacccagaatcttttgattagaagtcaaacgcgttaaccattacgctacgcaggctttttcctgataccagttttcctttgaacgttaagtttggtaaagatgaaggaattttttgccaaaatgataagctagaaacttcaaggcctccagagactggatcgacacccaaatctcaatgtttttcaaaacagtcattacttatagtataaatgtgtgcttcaaccgatagaattatgaatcgaaagcgtcaaagctatcaacgctacagattttgaatcacggtaaatgaaatctggaatacaaagtactctatctatggaattacattgtcatttaatcgactaatgacttccattttataattcaataatctgtacttcttcagactaaaccaccgaatagaagtagctacatagtacaaaatcaatttaaacgattcattgatccatgctaccacaataataataatcgtagtgttcaggcggataatttctatcctcaatccctgctgttgcctggactattacggatttcctcaacattgaacagtccaggatactactattttgtagtcgcgtataaaatatctgagaaccgcgttccatcttacgatataacataatcatgtctgatgagcttgaccccgataatgtcctcggggcttctgctgatacccaaagtaaggacatcgatgaaactaaccaagatctcttgggtcctaagaaatctacttccacgaggagaaagttgtatgttttaaacgaggatgttctactatccagtaaaggttatcccgacttgttaagacagtgtcagaatttcaagttcaagaagagaaaaccctacaaagaatttaccagatcctatcatatggaaaacatggaaaagctactacaaatgtaccaattatggggccatcaagtttatcccagagcaaacttcaacgattttaccaaagtatgtgcaagagcctcaaacagaccaagagtgaaaaggtggagagttcaaacgacaaaagatgaaatcaatagaaagttctacaatgaaactggtcaatttgatgatatactggtggaaaatggtgagaaagatgaactaccagtcagagagtctacaccaggggaaactacagtgttttctaatacagaaccacaggacagtacactaaatacccacctttttgttgatgacgatgacgacgacatttatacaacaatgccatccaattctacgtctacgtctgcatcaaaggaccctactcacgaagaaatgctagacatcgacgaacccacagtccagaaccaggaactggatttccaggacgaattagaagccatgagagaaatgggaatgtaataatttgcgctagtattaacaaaataaataaatatgaccgatctactgctcctacttgtaagctcctcctattgtgtgataatacctcttccctcacccaagtcttcaacggtttgggatagtggtcttctgtaaacaccttcccagaaaccttgcctttcggttttgataaccttgttgtcgaaaccaccttcgttaccatttccagcttcaagagctgctctataagagttgtcacccaagttgaagtttccagcccaggtcaagaatccaaataatgatcccattccaacggcaatggccacattggaagaaagtggcttctttgtacggaagatggacagtccgataagagatgcaatcgagctagctgcgaactcgccagtggcagtctgtccctcttgcaaattggcaaaagaatgagataagaatgaaaaagcacccagggccacagggaatccaatcaactggctcttgctcaaggaaaacaaattcaaatatttagccaatcctggtctggcagaacctttcttatattgcatcaaccttctgaagtgcatacctccaagtaagacacctgaacctataaacaccttggaagcttctctaattgaatcctttggaacatactctccttctttagtttttgtagttggccaaaaaggttgtggcaggtggaactgctccacgaccgtttgctctgctgttgtctcggacatgctctaggcttttctaaactgtgaacctctggtttcgatgagaccaattaaatggaagcctttttggagaagatcggcaggctcgaaaatacacccatattattacccgttcggtgtttagcccgtaattgttgcgaatttctgtgcaccgtaaaggttaggtatgtcaaacataaatatatacctcatcccatcgtatccgaactacactttttttgacgtcgttcttgaccctctttcaatagctaacctacagttacttttttaggtgaaaggagacttctgatatactgacaagaaacgctttatccttttgtggtctttctgtgcctgaaagattactgtttacaggcaactgaagacgcttactaagaatgggattgttggagaagagggtgataaccctctcaatagtcacattgcttgtgctggttaaccttctagactttagatcagtatctaatgggtcaacgtcacaggattatagggcgaacaacattttatttaaactgaatctgcgccatgcagatgctattgattcaagacaacaattgcaatcaaggttcattaattactacgaccaactccgctctttcaacacaggagagctcaatttcttacacactactgatactcatggctggtatatgggtcatcccactcaaccccaatattcctcggattggggagactttttgtcattcgttcagaggttaaaagatttactctttcaagaaggaaaagatttaattttggtcgattctggtgatcgacacgatggaaatggattgagtgactgcacttcccccaatggactacgatccaacaatatcttctcggctattgatttcgacttacttactgtcggtaatcatgagctttactctgaagctgtgagtgagttagaattttccacagtaattccgcattatggtgatagatatatttccacaaatgtggaataccttacaggtgacggtgaatgggttccattcgggaacagccaatatcgtgtctggaagtccaaaaacaccaggagaactattcttggattgtctttcatgttcgactttagatatactggaaatgagagggtgagagtaacttcaatttctacaatgatccaaactggttctcttgatgcaatcattgagactatcaagagcaatcacaggccagaaatcatcgtagttgtgggccaccttccagtccatcatgtctgggctgagtctcgtatgttacatgactatctccgttctaagtttccggataagataattcaatattttggaggtcattcacatatcagagactttgttgttcatgatgacctttcaacagggttacagagtggtagattttgtgaaaccatcggtttcttgtcaatgaacaatatagacagtgccacctcaaaggacacaagcaattgggcttgggataatattgacaggaagtatatcgatttcaacttacattctatgctttttcatacaaatatctccaaagttagtgaattcaacacggaagagggagtcacactttcagacaagattatatcaacagtaagtgaactaaacctaaccaaagaatacggtagggttccaagaaattactaccttgcaggaagaccatatccacaccaccagaatctttacagtctcatttctgatgaaatcctcccaacgctgccttatagagttaagttaggagatgaaccgtttgaacccagtaatgcccgagtcgttatcatcaacacaggtgctatacggtatgatctttacaaaggtattttttccgaaaacaccaaatatacaatcagcccattcttgaaccaatggagggttatcccagcagtccctaagaaaattgcgttgcagatacttccaaccttaaaccagttagattatatcattagcaatttggataagaatgcagaccaggacttctctttggacattatgagcgattactataatggagaccattcttccagagatcgactctttggccaggatattgttgatctcacaactttgatgtccccttttgcacgttcaaatttgattgaaaagttgatcatgatgggcaagttccaatcggatgttagaaacgccaaagagaaagagcaacagcccttcttacctcatcatgagcagcatgttttggtcaagctgctagaattttttaattggaacaagcttacccacggatacgtaacaaatgacgattttggagatgaaggagacgatactaaacataagcaaatcagtttttatgaacctccatgcgttattcaaagctatcaaagacactacaatgatagcatatccaatataatatttgacttggtgataccggatgatgaagatgaagtgattgatgtcgtgttttacgactttatagagccatacattttgtacgctttgcgacaaatcctcaatgtcgatttagacaagagatcatgggtgcaaccaagggaacccgtatacttacaaagtgctaccaaagttggcaacactacattatatcagagtttcttgcgatcaattcaagtttacaatgatgttgaaaatgaatggaacgttggagagatgctgaagagatatgtcacagagaactgggcctaaataggcgtaatttttaataacttttgtatcatttttgacttttaatctattgcttctactttaccccagctactaaattctcatagaaatagtccaacatctcaacattttgtcacatgacaaacattaggggagggcccaaactttgttagcagacacgggtacacttgttcaccgaaacacgaccttccatatttgttcatcaaacggagagagagacagtgagcagcacacgacagccgcgattcatcgcggtaggggaaaacctctcccatgctatggtagcgctaaaaaaattcacccagagttttctcttttttcatcttagtagaaccattgaagtaattaattgaaaatggctagaggaccgtatgttattttgttcacggattagcagaaaatggaaggagcaatatttcaagagaacagagatggtccatgttcagatctgaacacaaggttgtggatcaagacgtcaactttgaaaagtttttcatcatgatcatctcttttgactgggagattgttgttttctgcaaagctattgaaggataatgaagtcgcaagtactaacaattcttttagaaagaagcatctaaagcgtctcgcagctccatcccactggatgcttgacaagttgtcgggtacttatgccccaagaccatccccaggtcctcacaagttgcgtgagtccctgccattgattgtgttcttgagaaaccgtcttaagtatgctttgaacggtcgtgaggtcaaggccattttgatgcagagacacgtccaggtcgacggtaaagtcagaaccgatgctacattcccagctggtttcatggacgtcatcactttggaggccaccaacgaaaacttcagattggtctacgacgtcaagggtagatttgctgtccacagaatcaccgacgaggaggccacttacaagttgggtaaggttaagaaggtgcaattaggaaagaagggtatcccatacttggtcacccacgacggtagaaccatcagataccctgacccagatatcaaggttaacgactctatcaagattgacctggctaccggaaagattttggactttgttaagtttgatgttggtaagttagtcatggttaccggtggtcgtaacttgggaagagtcggtgtcattacccaccgtgaaaagcacgagggtggtttcgacttggttcacatcaaggatgctctggaaaaccagttcgttactagattgtccaacgttttcatcattggtgaagctaacgccccaatcatctcccttccaaagggtaagggtatcaagttgtccattgctgaggagcgtgaccagagacgtcaacaacagggtctggatgttgaggccgaagaagaggttgaggaagaggctgacgttgattctgaagttgattttgagtaaatatactaggataaagtaacaccaaggtattcgtattatacagacagtagactgctaatttattgtgcatcattgtagaggtaggtgacttgattaggttttgggtaaatggttttgattacataataggctgaagtatttatccctctctgtttttggagggcatcgatggaactcctccgcactatcactaaccatgtattcattgagtaaccgagttttgccgtcatatacttcaagaaatgtcagtaagaggattgttttgtcgtgttctagaggattgattaggagcagtaggtttaattctaccacaacacccttacaaactccccgtcgtggcggatactggaagtactatttgggggcatttgccttaggtggactcgcagcttctcaattgccgctttacagtatatatcaattatcagcaacgagtttgccagaggacggtgactcttttgaatacgctgagtatatgacttctttggaattacagctgcaaggattgccgatagtgaaagcgctaagcaacgaccccagatatgtcaagttcagggcatggcaaaatttggaaggtaatatcttggaaaacagtcttattgggggtacattgaatgtaccaggaggtttcgcagtgatgcctgtagcgttcgtgaatgagtccactgaagagatgattactgttgttcatgtgggcaggaaactctgtggatatccattactagttcatggaggaatactagctacaattctagatgaaaatctaaagagatgttcaattctagaattcaataagaaaaagaatttgaatttgaaatataatgacgagatgagctataatatgatccacacaaaaacacttacgatatcctacagatctccgacactggctgacaatttcatagtgataaaatctcagtgccaacctggtggggataaggattctgtcaatgtcaaggccaacattgaaacagtaaatcaacgggttttggtgaatggtgatgcagtatttaagatcgacaagtaacgagagaaattgaatgtttaagatgaccgtctgtaaatgtcactgtcaatcaatacatagtccaatttttcatcatgcgcctcgattggcagggaatccaccaactgctctttcaggcctatcccaatcaacagtggtctcggattgccagtagattcttggtatctcttgatgtaatcgtcatagaaaccggccccatgacccatcctgtaacaatccttggtgaaggcaacaccaggaagaaccacaatatcaattcctgactccaagccattcactcccgaattagattctggctccaaaagtttgtagacccctctgggtttgagagttaaaacttgagacaaattgggcacttccagcatttgcagataagatttctgaccaggaaacctttgaaacgatccatcttctagctttgtgatgcgaggcagaaataaccttttgccatcttcaaaaatcttccttatcaaaggaagggtctgcacttccccgtgtggcatattcatataaagtgcaatctttgatgcattctgatattccggtagcgtgagcaacaacgatgcaatgtgattggactgatgcgaaatgtaatcaattgatagctgtgagaggcatttctttatctgagatctcacgatggattttgacatctatcatgcgggtttgcaagctctaattaggactgaaaaataaaatagtcatcatcggctgacggttgtgagtttgtatggtcgagcaagaccggcccgttaccggttcacttaatcatagagaaaatatatcctcgaataaccgacggaggtttcaagacccctcagacgagcatcagttctccaggaggaaaaaattgccttccgaagggacatttttttccggtaaatataataaggaaaactccctgttgaacgcaccctcggtaaagtgactaattctacacattaacctcaccctataaattaaaggacaaatgcaaacatttgtcaaaagatcaattcgcaatataccaaaaatggccactagtgctcaccagaattttgcaaaatatcttgcaactgaccatatggccagtgacttggttccactggatgcttctaaacttcaggtcactcgtaccactcagccaaaatccaagcttcctaaggaaaagcttgtttttggtcagtctttcaccgaccacatgttgacagttgaattcgaccaagcaagcggttggggcaccccagagattaagccttacggccctctttctttggatccttctgcttgcgtttttcattatgcatttgagttatttgaaggtatgaaggcctacaaagactcccaaggaaaaatacgtctgtttagacccgacatgaacatggcacgtttcaacaaatccgccgctcgtatatgtcttccaactgttgacggcgaggaacttatcaaattaatcagcgagttgctcaaacttgatcaatcatttgtccccgaaggagaaggctactcattgtacattagacccacattgatcggaacttcatctggacttggagtaggtgccccagataaggccttgctctacgtaatttgctccccagtgggcccttactacccaactggatacaaagctatttcattagaggccaccgactacgccactagagcttggccaggaggtgttggtgacaagaaactgggtgccaactacgctccgtgcattaagcctcagctgtctgcagccaagaatggtcatcaacagaacttgtggctgtttggagaagagaagtttatcaccgaggttggaactatgaacgttttctttgtgttcaagaatgcagacactggaaagaaagaacttgtaactgctccattagatggaactattttggagggtgtcaccagagactctatattaaaattagctcgtgataggctggaccctaatgagtgggaagttaacgagagatattacactgcccacgaggttgctgaaaaagctgaaaacggtttgctagtagaggcctttggttcaggaactgctgctgtcgttgctccaatcaagaacattgcctttaacggaaaggattacgacgtgccattggtacctggtgaacaatatggtgagatggccaagactgttgccgactggattgctgacatccaatacggtgttgttgacagtgagtggtcaagagtcataaattagatagattagatccctaaaactgtacttaataaaatccttgtgtaataactccttcacctttcataggcaaaccaacactgcatactcaatcgcttatgtaatggaaaaattatcctcattttctcatcatctcttctagcccacaagtatgaccacactggattacaagctggacttgaatataccattagagtctctacagcatgttgagtatgttaagaactctttaagtccagatccagttttgaagcctactgagattcaggtggacttttactctagcaaagaacttctcagcgatgacattgcgctgatcattaaatttcaaggacaaagtgaccgtatactaagggtagctgttaataatatgatagaaaatctgaaaacttgtatagaatgcttagaagtgtttggttgaattaaaatatatacaactagacatttaaattcatgcccatttcattatttacaaggaaaactcaatccatgatctaatacttgctgtatctgtcgtttctaaagttattactgttcttgttggaacttcctcctctttcttcccaagtacggctattcttaccactactcttgtaattacctctgtctctgctgaaacctcccttattctctcctccaaacccacctctatcgttcttacggtatcctcctctgtcattgttgcggtaacctcctctgttaccagctccactcttgtttctatatcctgaagatcccctgctggtggcggatccagggatgtcatagtatcttctagagtagtcagtgttgattcctagtccagaagctgctcttgaggagaggaatggtttctcctgggcagactcttcaacgtcttcaaatgctccgcctggcccgtatttcatatctctgtatagcaaagcacaatgcttaacgtagtccttcttgctgatcttaccaaacttttcaggcaattggttgtagatccccaagttggaagttgcaatctggtcaaaatcttcatttttaacagtgtttctaatctttctttcaatgtcttcatttggtttagattctatcacttcgtgaaacttatttccattctcctttagcttttcaacgaatggctgctcaaagtcggtagtgaaaaggatggatttgccaatctttccggctctaccagtacgtccaactcgatgggtatagttggatacatcgtggttaactccaatttgtaaaacatgtgtgacatctgggaaatctaaacctctcgaggcaacattggagcaaaccaaaatggcacgcttgcggattttaaacgtcaattgggccatattacgacgcccttgtgtaagctttccatgtaagcggcaaacgtaatctcgtttgtctctggcattcataggtggctttggtatgatcttgttcaacaggttgaatacaaaatcaacactgtatgtgtttggcaggaaaatcattggcttgaacttcggttcatctttgtgctggtaaacgtaatcaaccaacgcagcataactgtggaaaatagaatcactcacgactaaagtttgttccacactttggttaacttcagattcggatccaacattggtatcaatgaatttgtagtcttttcccataatgttctcagcgagggacaggacatttttgtcgatagtagcagagaacaataagactttgaacttgggatccacgtctgaagtattcaattccttcagtttgtccataattctctccaaatcctccttgaaactcattgataacagttcgtcagcttcatcaataatcacgttttcaaccctggtaaaagcggattgaaaatttttcgagttggtaatcaaatcaaggaacctacctggcgtagcagctacgataggaggcttctgaaattgggtacattttttgatctgttgtctcatatcttgaccacctacaatcttttcaatattcttattgttgataggtaacgagcagtttctcataagattgtggatcgcatctgaagtttgaattgcaagatctctggttggggcaaaaatcacagtttcgacatgtgggacattaggatgttttctatgtttcagtttgtgcaaaaggggcagaccaaaagcaagggttttcccagtacctgttttggcacgaacaacaagccctctttcagcagtgagaaattcgtcaatagtggcctcttgaacgggggtgaacgtttgtcctaccagtttcataaaagcttgcttgatatggtgggccaaattggaatcttttacgtgtttaccgttgatgaggttcacatgagaaggtgtctcaatagcctttacatttatcggcttgatggttggattctcagaagcctcaacagtttcttgggacgatttatgggatttttcaaataaagtctcctgtctttcagaggataactgaaaacttcgagatgagaacatccgaactgtcgaacctctcataaaataagaggtcctcaatagctcatttctgaacagcaccaagttaagcatcagagggtcagtagcttaagaggtgggaaaattcagagtagttgtatcactaaaagaaaattttcttatttaaggataaagagattgaatagtctggtgttcaggtgcagtacataccaagtagatatccggccaaagagaaggaattggaacaattggtcgaccaatattccactattaccttgaagtagtctgttcaccacctgggaatgtagtttaaacaggtattgattcaggcatacatagttcccttcatctgcctaagaaggaatcttgaaaggagaaagatttcacggtagtgtaccgcttcaatatttctgatctagctggtgggtggtgctgttcgattcatcaaacagacccgaagctatccctaaccaaatgtcgttcactacttcattgcccagtcttcgtgataggcagataggtaagctattacaatttgttaattttggtcggcacaattactaacccgatagccactctggagaaaatgcttcatttgaatgagcccattgtggataatggttcagatatacaagcggagttaacatggaaggtactgattctggatagtaggagtactgcaattgtttcttctgttctgcgagttaatgacctgctttcttctggcatcactatgcatagcaatatcagatccaagagagcggctttgccagatgttcctgtcatttactttgttgaacctaatgcggaaaatatcaactttatcattgatgacttggaaagagatcagtacgctcatttttatatcaacttcacttccagtctaaatagagatcttttggaggagtttgctaagaaagtggctacgattggtaagtcctacaagattaaacaggtttatgatcagtacctcgattacattgtcactgaacccaacctgttctctttggacttggttaacatttactcgcagctaaataaccctaactcactggaagatgaaatcaataaagttgctgacaagatttccaatggtatattcgcagcaatcctaactatgaatgggatccctactattagatgttgcagaggaggtccagcagaactaatagcgtccaaactagatcagaagctacgtgatcatgttatcaatacaaagtcatctgcctctttcactaacagtaaattagtgcttatcctgctggatagaaacattgatttggcttccatgtttgctcattcatggatttatcaatgtatggtgagtgatgtttttgagttgaaaagaaatacaatcaaaattccctctcaaaagcccaatgaatctacgaaagaatatgatatcgacccaaaggattttttttgggcagccaacaacagtttgcccttccctgatgctgtagaaaatgtggagaacgaactttctagatacaaagcggatgctgcagagctaactagaaagactggggtttcttctcttcaagatattgatcccaatgcaattactgacaccacagatatacagcttgctgtgaagtctttacctgaattggcttttagaaaaagcatccttgatatgcatatgaaagtacttgcgtctttgctgcaagaactggaatcaaagtcattggattcatactttgaaattgaacaaaactacaaagatcccaaaaaccagaagcagtttatcagtatcctcaacaacgggaatgagcataccttgaacgacaaactgagaacctacatcatgttgtatctgttaacagatctcccagggtcgttcgttgaagaatgtgaagagtatttcaaaaagaattccgctgagcttggttcgttgagttatatcaagcgggcaaaagaggtgatcaagttgtctaattatgagttgtccatgtcaattgatgctagccactcgaccactagtggattggtgaatgaagctcaaaagtctgctttgttccaaggattgtcgtccaagctatatggattaacagatggtggtagtaggcttacagagggggtggggtcattaattactgggttgaaaaacttgctacccgacaagaaacaactgcctattaccaatattgttgaatcgataatggaaccaagtctggccactcaagagtcgataaaactaacggacgattacctatattttgaccctattagcacaagaggagttcactccaaaccacccaaaagacagcaatacaacaattctattgtgtttgttgtaggagggggcaactatttggagtaccaaaatttgcaagaatgggttacgaagaccaatactagcaacgtcaatggcactaagtctgtaatctacggtagtaccagtatcgtgaccgcgaacgagttcttgaaggagtgctccttgctcggtgccgaagcaaaataaaagtttggaatcatatcatagtgcttatctcggaattttccgtcctgtgagatcttgtgttaccaatactgaacacagaggggaggaagacattttgagctgttttttctttttttgatgacgtatgctaagggcctatctgtcactgtaaagtttggatagcccagaagactgtttgatacacatatgcgaggtgtcctgttattactcatacttagcttgcagattgctgaatgtgtatagcccatgattcacagtaagcctggaagtcgacgttatcgacgtgctgtgcgtgccgtgacacctagggtgattttggtcccgttttgaggcgtaatatacttctcgaagaaatttcgtgcatagaattgtctcagaagcggtcagcaatcgaggcggaagtcaaatagtcaactttaatgaggcttgcgcgctttcgaaatggttgattcttttggaccgcgtgattctagagcaaatatcaaatgtacagaagcaaataactcaaacaaggttccatgcgatgactaaacctggaatagggaagtaaagcgaatcattttggtgctcgctctcccacccaccaccagcaatctcagcacgctacaacatcgcactgtccatttctttttgaaccctattggtactagaccgccaatattattaatcaaagtaatattgagtatacaaaaatataaaattaaaaacttaatcctaagtaatgaggtccagcccgcccgtcagagaaaaagcccctgtgtgttccccaattactcgtcagatttatatgcaacaatgcctctaagaatttttatggtgccgtacacctcgtgatccatttcatcacgactttgtctgttgtttttcgatctgtttttgttttcagtaccaggagctggccatttgcagtccagccctaaccttgaacattctttacacgctggtttcgtttcacagcatcgcttctttctatagcgacaggtcagacatccgtttcttgatctcttgctctttttgttgttggaagattctgaatctggacttctactatccatttggagctctggcgtcgcagattgacaactatccgtaactgtgtactgatcagatctagaacttgaaccatggcgctcattttgaaacatgacatcctccagtgtcaccttattggatattcccatgtcgtcgactggatctgtgggtgtggtcattgttcgtgctagtctgggagcttcaaagctattatactgctgttctgaatccttggatgccctgttcttgaccggttgctttaacgatccttgagggtgtagcaatggcatttgccagaagttgttaccgtagccgttgggagatgccatccgttttttataagttgaagtaagagaaactggttcagcgagacaaacactcgtattcgtcatgcccgccctttctcttaaaggctataatatcgtgctcccgatggtgtatttccttttaagttgacgatcctgatagttatatatgtatcgaatcaaaaaaaaagaaaagcaaataatagcagattagatattgtacagtacatgaaaactgaatgctcggatcgtatatatagttttcttcggatgcaagtaacaagacaccatttcatgcttgtgattgtacctgtactatttactcttcggataaataattgtccacgtacctcttgaagctggagtgcatagcatgcatatctgcagagattcacagggagagataatagaatttgctcgaaaaaaagaaacaaaggggtcactagtaggcataaacactacaaaagcaacgattttagttgctgtcatagactgagataatatcagaagcagaatttattcattgctctggtctgcgcctcactatgccctattgttgacctcaaagatttttacattgaaccgttctttttttagcacaacttgcttggtctcgagtcggggggttttgtcatgcatggaagaataggtaaacggtagcaacttttctagtctggatttctgctgtggcctttgattactaaatgtcttgaatacaataagtagtacgctttaacgccgaaaatgaggggaaaattaccgactaagcccatatcgcttttcggcaactaaaaatatcacgtcaagctctagaagttgctaccgaagtgttgggttcgatcttttcttttttctttcttttttgctcagaccccactgcatcagatagatttcagaaaaagctcggtgatgcacgacttggaatcacatcaccatcattacatcaggaagagctgttcgaccgatgacactgagttttttctaccaccaaagctgactgcatcgattacatcactaatatgcttccagcaacgttatttacgtcagtccacaggtcaattgttagctcgagagtgcggagcatcgtcccatcggtggcacctgccatattttcttgtagatatatcacccataatgccgttttgttaaaggctaagaagaagcactcgaaccaccatgaaatagtagaagaggcgcccgaagttgtcaacccaaaacaggtcctgaaagagatagaggacaggtttaaactgacgttacaagaacatcaaaagaaaattaacgagataaagttgggaaaaagtaatcccaagatctttgattcgttgaaagtttcaattgctaaggatcttcagccttttccctcagttgcccagactacctccaagggtagaaacctattagtcactgtttttgacccaagtctagtaaagtacgttgtatcttcaattctcagttctggtttaaacttgaatcccgaagtggaccccaagaacccacaattgttgaaagttccccttactgcccctactgctgagactaagaaggaaactttgaaagctttgaagaacaaccttgagcattacagacactcaatcacgaataaacactctctggcttctatcagagcccactatctgaaagagttcaagggaaataaagaagactctattaaaaagttagtgaatgagattgaaaaagttcataaggattactcaaacagtatacacgaacagttcaaaaaagtagaaaagacactataattagtttgcgtttctagctaactgaaacaaacttttcactttttcccatttgctattgtgataaccgcatttgttaagagctgtgacaaatttccaggctttcttctcattggcaattgggtaatccaacggtttagggatctgtgtattgatgaatgagaatctatcgtagcagactgacttggcaacacataagccttgtagaccctcttcacctccgaatttaccataccctgatttcttcactccaccaaatggtagttgacaaacatagaatgttgcaaaatcgttgatagccacgttaccgctttcaatattgtttgcaatgtaatctgcggtcttgaaacttcgggaaaaaatagaagatcccaatccatacggggtgtcattcgtcacccgaattgcttcttcaacatcgtctaccttcatcattgtcaggatcggaccaaatacttcgttctgagcaatatccatatcagaagtcacatcaatgagcaatgtaggttggaagtaatgaccttggggataattaggatgcaagtatctttttccccctgacagtaaacaggctccttttgagatagcatcttcgaccaatttctccattgcgtcaaatctggcatcggtgatgatggcacccatgtcaatatcttccaattgatcgatatcagatccgagtctcaattcttgcactctatgtgataggatctgaaccagttggtcatatactttgggcatggcaattaccctctctataccaatacaattttgtccagcactttgaaaggttcctcttagtatgattgaagagatagcttcaacatccataacatcatcacagacaatgatcgagtcctttcctcccagttcaacaaccacaggagtcagtgattttgaagccgcttccagcaccttatgtgctaccggtttagagccaataaatgtcagatgagataaggattcatgggaagtgaagtagtcagcatcttctggccacgtgcaaaccaactgtaccaagttttcatcgtggccacaaactttcagtgccatctttgccaatccaatgaaccatcgagaactccaatagacgttctctgaacatttgatgacaattgcatttccagtgaaaatactggccaacaatgggcccataaggttgtgaaatggatagttccaactgactaaggctcccactacccccaaaggctcatatctcacttcagctttcttatattgcatgagtatattggcaggaccaggtcttgaagagactttcaaagctttctctccatttttcaagatccagttaagtttctctaatgtgaccagaatctctcccattgaagcatcgatcatcgtttttccagagtctctgcaagcgaccctggctatcccttcttggttattggctatatactcattcaaagtcctaaggactttctttctctggctgaaggtagttttcttccattctttctgagcaatttgactctctctgatagcattatctatatcctctggggcaaaagctttgaatttacctaaaaactgtcctgtagctggacaataacactggatcatcgaagggtcttcactagctcttactccagttgggtacaaccttttccctttccagtgaggtttagcctcatctggagtagcccactcaaacttaatgggtttgtcgttatcaggggaaacctttcggtaaatgaacacgtaagttagccccaatgttaacaacacgaaaacaaaaatattgacagggatgaaatatgacgattgagagacggaatctggcaaatgcttcaacaaagctaactcttggatctcaatggacatcagttgctgggaagtcaagtgaagagtgctattcagttgttgcaacaactgagtcaagttggagttcatatgttggcagttgtctgagattgaatattcgtctgtacgatgagtagcggatgggatagcgaaactgttgggagcacaacaaacactgcaaagagtacgtctacataggcaagacaatgataaaaacgaacgtattctaactctacagggttcttcaaaccgttcttcttaacattaaccatctacattctcaagaaaaaagaaagggaaagttggataaattgatttgtattatttcaccaataaacaatctaagctctggcattgacgtgaagttctggtttgggatgggtgattgcatcaaggagcaatttaaccacatcctccttcttggcttcagcacttttgtcaatttccaccaattcagtttgaacctctgattcagctgccttttccaagtcatcgtttgatcccgaaaattgggcctcatgttcctttagttctttttctttcttttgcttatactccttgatatctttggcagcatccagtttggcttccttcagtctttgtgtacgatctaaaatggttagttattacagattttgggggtatagccttgctctgatacatacattgtctagcagcggaaacaatttcatgagcttccttttcagcctatattttacagttagtacaagtcctagtactccaccgcattcctacaagagcaaaatgttcaatggtcccttcataaagttgggactattagttgaaccaattgaagatcactcttaataccctcacataccttcagcaaagtttgaactcctgactaaatgtttgttagtaatattcctttcaagccaaaaattgcccaatcccatttggctctctacttaccatgtctaagattttaatacttctctaggaacaggtccactctctcaatctgtctcatttccaacctaagcagcagcccgttgaagggttgggcggtgcacgattccataaacctgtcacgcgcaacgtcatgtgactattttctatctcatcgcatcagtcatggaatctttttatttttcctatctgatattatacaatcgtttgacgatggagaaaaagaaggagaagtgtcacatgtgcagtgacaaggtctccaaatacaaatgtccagtatgtgcaacaatgacatgtagtctggcatgtgtcaaacaacacaaggtagaaatggactgttccggaataatcgattatacaaagtacatctcaaagaaggaactcaacaatataagcgtcaatagagattacaactttctcatgaaagttggaagagaattggacattgtaaaggatgacacaaacaaaaaggcttataatataatcaatggggggaaaagaaatcgccctggaaaccaggaaagaaataagagattaaaggagaacgataacgaagaagagtttggtatgaatgcagcccctttggtggtcaaaagggatgttaatgttagaatgttgcctcctggtatgttcagatcaaacagtaacaagtcaggattcgacaagaagaggagttgttttacctggacaattgaatggattttgctagacaacgagggtaaaacaatcaataaagcaacgagcttcaggctagcagaaaacattccattgggcactttatttccattaaaggcattttcaaaagatttgtctacgacggacaatctaaagttttatatacgagattactctacgattgaagaatctaagaagctgatcgaacttgattccaatcaaatgttgggtactttattgaaaggtaaaacggtgattgagtacccgacaatttatgccagccatttcgatcaaacagaatccgaagatagtgataatgacagcgacacctcaagtgatagcagtactgatgattctgatagctctgacagttcaaatgatagtgataatgatgaccctgcgcaggacgatataagtgaaaaagataccagcaacatctcttgtaacaattcagatccagaatctccaccagaagaatcttcaacacagcaactgcaggatattcccaccaccgattctaacacattgaccaaaaactgcttggaggaaactcaaatctgtccacctactggtccatagtttctatcagtcttcgaatggccgtcatatctgaatcaccagaagttgcttgcattacagcctcagtgactattttatcatccatataatctgtaatagaatctccatttgttggaggcaacacatcaaattcgtaaacttcattttggttccaaaacgtctccggtaattttgccatcacagttccttcccctgacaaaataacatgcctgagaaggttggttggtaaagtcagacctgagtctgcttccggggtcccgctatatgtcgaacacgatttgtatagctcctcttccaaaaatgtaagagacttaggatctgaccacaaggtcttcagacggactatataatgctgggcaagtatttcttgttcagctgggatgtttttgaacaatttggttatttgcgatgtgatgatagaattcaaagattcatagatcttgaatccaatatatggaaatttctggaatgccgacttcaagctagttgctgctttgtggacattttctgtcgtttcaccagatcttaaataagccaatgacgttgaaaatgctattcctggtgtcagccattccttatacgttgtcaccagagaagattgtgataaatcaatcaagtattcatactcctcactcatgatacagtaaaaatcgataaaaaaccttactccatagggatcttcggtgggattcagtgataggagaagcttgcagtaagtcagagccgtgaggaacgtggacctctgtgttaatgcttcaatgtacctaaacagcgctaaataaaactgtctgttcaagaagctttcaaacggaaacctaccttttccattcccaagctcaaaattttgtaggaaccctctatcaaagacaaataacgccctttcaaccagcccactactgttggatttatctccctgtcgcattaaaatggtagaaatctgtaacaatgttggaatatggtatggagatcgctgtaatgagtcaatgagggcttggtgatctggagcaataactacagaggcataaaaattagcattctcagccaaatggtctaagttgaacttaaatctgtaatacttgatatcttgggaaatttcctttgaaacttcttcttctagagcatctctccaatcatcaggtctagaagccactctcagagatattaattcctgtttaggaatctcctccatagctaaactctttttcactgtaggaatccaatcatccctaatcttggtaagtttcagctttctagttgtaccagggattgatctatggtctcgtccaccccagcccctagtcattctactcagctttttgatttgttgtaagacttcgggggagacaaaaccagaagaagttgaatctgcatcttttatggtttcatcggatatctttccaaataagctcctaaattcgtagtcaggatccaagttagctgtgtgtatctttaatagcttcaccgttttggcaaatttcttaagagtaaagtatttatagcctgaatccacagtgtccacggtctctgtacattcgtattcgttgtcactatcactttcacttacgatcagctcttcttccttttgctttattttaagctgttccaaaatctggtccaattcttcgtcactgttcataggctgctttgtgttttgagttttcttatgtttgcctgagctctttcctttaagaggtttcttgataactagcttgttttcttcagttgcatcaaaaaactcatcgctactttcgtcaacaaccttttcggtaggctttgctcgtcgactaacgctggagactattctgtcatcttgctgactatcatcatcactgtcatcttcacttggcaaaaaggcaaaactgttttgagctttgctcttggtaggcagaccttcagccgtttcgggttcgtcaaaggaggctatccccttcaattcatcttctaactggagtttatttagctttctgagggctttcgaactcattgacggttataaaagattgaaaggcaagagagcctgaaatgtctagtcgagaaatatgtaatttttcaagtagactgtcattcctagtatatggtttttaaaataattgtacattacctgcctaaactatagattctacggctgttagaagactatttgcctcctttccaagacctcctccttcttttattaatgatttcagaccatctatcacgggctttttgaaatgttgaatgaaaactgtgatcctcgtgtgctcatcttcacagttgatactatccaaatccctgatagtttcctcttcgctctctttgtgggaaacaataagctcagtttttttgtaaaggtttagctgcccaaaaggctgtggtgttgttggaaacatataaacagcagttagtggatgtatggctttgaacttgagggtcgactgggcttccttttcgccagatgttcccaacttaaggaactcagctaaaacttgcaaatggctctctttgggttttttatttacaataacagagctggaattaactgctagaacgagcgacttcttagcctcctccaaatgccagttcatcaactgacagtaattcttcagcattttgacccagctagaacgaacaatgatgccaggtccatatttcagtattacacgtagaaacttcgtcgaatcattccgtatatctgtgttgatgtgggacatggcactgctaatgaaaaggacaatggagttggcatgtagttcaataaatgtgggatattttgatccgatatcatctaaaagagtaactaaagcctctcttacagatggtgaagtatctatgatcaatggagtgacgtttttcaatatttctttatactgtgctgggtcagagggaagatgtttgtctaagtgaattaagatctcttttctggtcgatggggagtggtgtctcaccattgcaagataatgtgccaactctttatcatcgtgtgacttaaccaacgtctggttgggtagagtgatcgattttgccttgaaagatgtatcagtgaaattgttcggtaagttgttcgattttccaactttgagtttttttttctataagttagccatctagtccatctaggtgccagagtttattggtacgtacctgaaagtctctctgcttattagtctttttctttgccatcttgaaacagagactgataattaagtaaggctcaactttctttagtaataatattttcctttaattttttgttcttttcgagatgtaacaaactgataaacagaacttcaccagatacagaaccaccccgatggatgagctacaatcgttgtccctggatgagaaaaggagcaacgtggaccattttgttgactacctgataaataatggtgaagaggctgaatcaacagtgcgttgtcgaaggcctgagtatatcaatgatcctatggatatagatagcacagtatgtgaagatgagcccatgttgatggataacgatttagatttcaatctagatatttcattgaatgacaaattgcaattccaagaagaaaaagaagcaaagaagcctctacacagtcctaagaatacgcggaacggtatcctaaacactatgttgtcaccaacgagtttgggactcaaagttgccactgcttccaataataccactccaaacaaggaaaatcattgggaagaaattataccaaacaatgaaaatcccgtaggaaataccaatacacttagagaacggtttcaaaatgttgactggagtaaaactccaatcagtttacaaatgcatcatcatcattattaccctccagcagacaatatctcaaactataatcaaatcaataacaaatacactacagacaacaacgaaaaactcccattaccgtggcaaccagacagctctccggaggataaaacaccatacattattacttcatgctttcagcttcttttgaatttcacagcaacagtatactgtttttcgttgatatatggatgcataaaaacagtaaagtcggatataagtgccaaaatggctcaaaaagtacaagaactgctagtagaacgagccgtttgcaagaggaactggaatgaaaacgggtgttcaccggatcgaattgtgccagctttggaacaacaatgcgcagcatgggagaaatgcattaacaaggatccttattcagcagccggctattctagcattagtgcagaaacattgggtatgatcatcaattcactacttgagcccattggaatcaaatctttcctatttttactcggatcaatggcagttttatttctttccaacttttcatttgggtttctgcgtgcaaagagctactacggttggaattaccagcacaacagagatccagatgaaagaatcaaacccaacacagagaagcccaatattcaatatcttacgtaaggagcatgtagatcctaatataagtgtctcggcattctcgaaccttataaaaagaaaggtaagttaccttaaaaagaacaaaggcaaaccaacctaccatttgattccaggcatggatattcctactgcaaagtacagcgaggaagatatgaaggctgccttgcagcctaccgaaccagagttcttcaaggttaaggtttccaagaagaagaagactcgtagaaaggtcaaacatgacactactgcgtctactatcaggagacacatcagtgagtccaaatggacaatttccaactggtatcgtcatattcactggaagaatgtagttctcgttgtaattgtacctctgctggcgcttgtgggctccttgacggtgcctttgaccaggacaggattctactggatggggttcaattacattatcacatgcacgtttgttattatgggttaccataggtattgggcacacagatcattccagaccaccaaggagatgtcctttctgtttgccatggtaggtgccagtgcaggcgttggttccgccaaatggtggtgtgcttctcatagagctcatcataggttttgcgacaccgagagagaccctcataacatccgaaaaggtttttggtacagccattttggttggatgttgctgatacatcatccaaaggtacaggcggcaatcaaggaaagcgagtctgaggatataagctccgatcctgtgatactttggcagtatgaaaattatttccacatgtttttagtgacgggtatcttaattcccgcaataattggctggtggttatttgaagattttgcgggtgggcttgtttatggtggactggtaaagatcttcttggtgcagaatacaatattctccgtgaactcgttgtgtcactgctgtggagatcagccctttgatgatgccaagagcagccgaaacagcattttactctctttgatcacatttggagaaggacagcacaactttcaccatgagtttccttctgattgtcgtaatggtgtggaatggtatgattttgaccctgtcaaatgggtcatatttacgctaaatgcgttgggcgtgatatataatgttcatgctgcgccaactacggccatcaatcagttgcgagtacaacaagctcaacgaatcttggacaaggaacggtctcaattgaattgggggatacgcattgataaattacccacacttacatcagctgaattttcgaaattagctaaggaatcccaacctgaacgagctttggtagtgattagtggaattgtccacgatgttacaccattcttgcatgatcatcctggaggcgtggcgttaattaaatcttctattgggaaggatgcaactaatgcttttaatggtgctgtatactcccactccaatgcagctagaaacctattagccacaatgaggattgctgtaattctaggctctgaacaagaagtatggaaacaacaacagaaagagaataaagacgtaccactgaagaatgattcagagggaaagaaaattgttcgaagcggagaacaaattacgatgacgaaaacgccttccactacggcaggagccgcctaagagcgagcagtaacacatttaaattacaagttcaacctttttcaatatcatttgtatatactatttatggggagctattatgtatccaaagaggatcttatcagatggtgtcgacagtaatgaatgcacattgcgcgagtttttcagtatcagaaatctcggtttctattgtagttgatctaacctgttaatggtcaccaaagttcctagccttgtcaaaaaggtttttgacactttcccactaaaagtgtactcatcagatgaggatgcagatcaattggaatttgatgagtcttattttgaacttagaaggtttagtttccagtctactggagtaagtgcagttgcaaagtttcaacttggagtttactctttgagcccctgtatttacgacagctctatacttcttccggtggacccgttgtgtttgtcgacatgtctaatcatgtgtgtcaagaatggtctcaagcttcctcaaattggcggagaacatggtagggagaccagtatggtggtaatggcgtaccaagcatctcccgactcagaactccccttactagtcgaggacgacctcaatggacagaaaagagtagtacgtccctatcagacagttaaagattttcaagattccagagccaataatgtaaaagaaactatgttaattgagctaattgacggagtgctatttgatgcgtggctggtaatggttatttttgagcttcctaaagaattgacagtgcaattatatgggttagtagataaagaggatccggttgtattatcacacgatattggcatttcctggctagactctctgagatactccaggatattgaactcctccattagaagaaacggctttcaattgagacaccctaatattgctcaatatttggggtcacttacggatagatactcaggcttatcgtctaagatggagtttgagaggaaaagaatcatagacagggcctgccatattatcaatcagttcgaaggtatactgaacgaggccagagatgtgtcactaggctcggttgtggactacaaactggctgcattcacatactgcattctccacctgggacgaggtgacctcagccaggctgtcaaaatcagcaacagtttgaaatcccactgccaaagggtaataaatgaatgtatatagatagctatcaataccataccacactttatccgattacataagcattttcttttctgcccgatttgaaaccgttgctgggactggaccttggtgtcgactttttgcgcctagtttcaggacctagtacacgacgttattttgttgtttgttgtttcaggtctgtttcaagtctcttttataccacaagtgtatagtgtttcagattaggcttggttacagtttaaaggaattgccgtatctaaatttccagttcattctactcatcttaaacagataatggtagaggaaaagtcggaggctgattcttgcgttgaggaatctttgcggttgattgacgacctgaagttcttcctagccacagctcctgccaattggcagccgaaccaggtcattaggcggtattacctgaacagtgtcgaaggatttgtttcctgtgtctactggaatgatctttattacatcactggaacagatatagtgcggtgtatatcctacaagtttgagaagtttggtagggaagtcaccgatcgcaagaagtttgaagaggggatatttagtgatttgaggaacctcaagtgcaataaggatgccatcttggaaactccgaaatctgaattcctgagctttttgcacaagaatgcctgtttaaggactaaaaagaagcaaaaggtatttttctggtttagtgtgcctcatgataagctgtttgcagatgctttggaaagagatatgaagcgtgagtcagacgatttatcggcaaccactaaacctgtaaaagaacctgctctttccttcaagatggataaatcaagtgggagtgaacctctctttgaccaaattacgaatcatctggaaacgaaatggaaatcagtaaagactgccgatgttgcttctaatccgatcaaaacagaggaatttattccagctacagccagtaatgttcctgttgatcaaaagtcttctgagacggatgatttccccattgattatttccaagctgcggacgactatttccatgaaccaaaatctgctctggatctaaaccaggactttttcatgagtgctactccttcgaaagtgaaatttaacgatgagtatttggtcaaccagacgatccccttgtacacatctcagattgtccagaatgaccagatacctactagcgcaagactgatacacaagaaaatcgcctcccctcaagaatcgcagatagtggcagattcaagctattttaatgatcaatacttcaaagaaaacgaggatccatatctcgtcggaatgaatcccgaatattacgagacagcttacgaacctgaagcctaccagacgtatgcttctttgccatcccaggtccaaatgcaaccacaaccgacggcatttgctcctcaaatgtacattaagacccctgtatatctacacccagggaacacaccccactataactattacgacccaacaggcaccactgggatggtcgctactacaggtgggacggtcacaactccatatctacaacaaaggacaccaatatataatcaagtacagttctttccacctcaacaacaaccacaacaacaaatgcagcatacatcgtcacaaaacatccatccaaactacaagaacaataggggaatttccaaaccccctgttatgcgaaagcccgttttcaagaaccccaacttacaacatctcaacctagaggacttgaatttacccgccgagaaacagaaagagtatggagttaaaatgacggaatagagttaaatatagttttactgggacgtgtggcaagtcaacagcggttgaaccaccaccattcacataatacaaccaccaccgcaaacattattttggccgtattctcgtttaccccatcaactccttaatgatgacgtaagtatttttgtgcgatttcgcgattccccagagatctctcatcattctttaagattccatcgtactctccctagaaatcagtcataacgaatcctacactcttgcccagaacttttttttttgcccttataaaacttgaggtggccctttctgacttgttaccatacctcaatcatcgttaggcgggcacgtgagtggatttttagtgctttaaagtcgttttgtactgtgtgtttttttttcccactaccccttccatttaaagtttagtccagtttcattggcatcatgggctcttggacaacaaccgagggagcattactgaacaaccgctacctcaaggtacgggatatcagtgaaggttcctttggcctcgtgttcctagccaaggataccaaagaaaacgacaaattggtggctgtcaagtatgtggcatctcctaatgagatcacacgatacaaggagatgagactcaagaacaatttcagtgacatatccgatactgccagttcggacaataactctgtaccgactacctccaccgatgcaacaagtttggtcaacgtcgatgcagtacatcctgattctgctgacaagagtaaggagccaacaaatttgactaacttaatcagggaaaccaaattagaagttgatattttgcgcaagctgggcttgcatatcaacatcgcaaccctctacgacacatttgaaaactacattgtcttggaatactgctcccggggagacttatacgaggcaattcgcaatggagttggtccttcatccacgcatgatgtcattgatgttatgatgcagctaattgaagctgttgagtactgtcatgcacactcagtttatcatagagatattaaaccagagaatatcttgattgcagaagattggtcaatcaaactctccgatttcggtctcgccaccacttccaaattttcctctgattttgatgttggcagtgaacgctacatggctccagagctgtttgataagaatgatagcgagtactttgatcagacatatgatgctgaaaaggctgatgtatggtcaattggtatttgcctcttgaacatcgtctttggaaagaatccgttccaaagggccaacggctccgataagatgtttttacatttcgcttcaaatagagagacactatttgatattttcccctccatgtcgtttgatctgttcggagttttacgacactctcttacgctagatcccaacaacagaaacctttataacatgaaacaggaacttttgaaattaaagtctctcaccatcgaagaggaatttcatcccttcgacgatactgatgaactcggtgaaattcaggagaagaaggagttggaggtagtagaaatttccgaagagcctgcctcccttcctgttcaagagacaacagatacagaagagaaatcgttggctgtttcgttcaagcaaactaatagcttgctgaaatcaagaagaccactgggagtccctacttccgacaatattgatattaaagtaaccaagaaacctgctaactcagaacatggctatgctgataatgatattgataacggtaatgatggtttcaagcgtcaagatttcctaaccccaagatctgttttcaacaactacatggacaaaattgaaaagaacagagtaaacaaggagaccaagaactttcatcacacaaaccatggtttgcaactcaattctactaatcatcaaagtcataacacccaaaaccaacccccatcttactcgacatatcatactccaagcagtcaaaaccattatcatcctcatagcaataagccaggatattatcgccgtagtttcagcaatggaaacggtaacacttattccccccagtaccaggaacattaccacaccaaaagtaataactacaacccacagagaaaagcgtggagacgaagaaagaagtcaaaccatagaatgccacgcaagcagtctactagtgttggcggttcctataaacccaaccgtatttcttttcacactaatcagagagccagagatagtttcaagggatctttttcttcacataagaagactggcttgatggcaaagggtgctatggccaatactaatacccctgccactggcaagtatgttcctcctggattacgatctcctgtgaaatttcaaggaattcccaatgaaagtgcaattgtcactgatgacgacgatgtcgacgagctctttgtcttggagggagatttcgaccaaggagttcttgcagaaaaatttgatacaactatgaagattggttataaggataaaggctctaaggagaaagaaaaggtgaaaaaggacatctatattcctcctcatcaaagaagaaacagcgaagacaagcattcaagaccatttggttcaaagccatttggtaatcacatttctcctcctaattcagggaaaaacttgccctactcaaagtttaagatgggtaataggagacacgaaaagaagatcagttttgataacaatgatgattcaattagctcgtcccttccaaatctctcatggtttgataagaaggaaaagtgggataaagataaggaatcagattatgtgtactaaattttttatttcatttgggtagtttctctatttattaattaaatgatctcttccattttatttaagcgtgtaagtgaacccaagagtagaaaccagcaataatgcgatgagaagtttcctaaccaagggaggttcggtagactccagattaatgtagttctctttagagctgtctttgtttagtggccttggtttacggtcagatgaaacgttagtctggcgatgttgtgagagctgagcggaaaactgttttggagagccatcttcgttggtcattgcaaggtataagagatcatcttctaagttacccacctccactttttggacatttccaaagaaatcggtgagcagaactttagagaggtttcggttatatagatctgttcgtataccagcgtgtgaatgtatatcttcaaaagtgtaggtttcaaaaagatcagccatagttttgttcgagtccttttctatttgttccagaaattccaagttgtaataggtgaacctatcgatgacagccactccaagctcggtgtcggaatgatgtgaatatgaactttcatccaatcgtgaggatcccacagcaaggatattgggcgagtagaacttggaatacattgtatttgcctggcaagtgtcaatcataaagaaaatctcgttgtaccttttcttttctgccatttgctggaaagcatcagcaatatcataggaactaatctcttccgcgtcttgaaatttaagaaagtcctcaccaccatgaccggtcaagtatatgaatatgtttgaattttcgtctgtgagtaatcttttactacggggatgatcaggtccccatcggtcggtcaataatcggatgaagttctcaacggtgacctcgtaacctctgtaatccacttctatgttatcaccgtataggtctaaagctctatctttattgttgaacactgaaccaggaaaggcattacgcgggttacaggccacgtcgtcggacatcatcaaaatgatttgagagtctggaatacccaatcttttgacagtcctataaaagctcaaaacattcgccatatgtctataattgaaccagaacctggatgacgacaccagaacagcccagttgttggtgtgagttgatttttgatcatcatctgtgtttgacgaggctgcaacacaacaaagtatacctagaaggatatacagaatcttcatctacctaattgttttaatgtggccagaacttctatagtaaggaggagatggtttcgctggatgcttacaaatcttctctagaccagtagtttaaagataaagctcttttctgggaattaataaacagccgttcttccagactgaggatcgtctacgaaaagttcaatcggaactcattaacgaagcaggccttcattgttgacgaaagtaagcgttccgttcggtctcacttttcgttttagtttattggaccagggtcatcatgggacttctttctatcattaggaaacaaaagttgaaagacaaagagattagagtgcttcttctgggtttggataattctggaaagactacaattgtcaaatcattactgaatgaggacgtcaaagaggtctcccctacaatgggatttaacatcaacactttgagttatcaagagtttaccctcaacatatgggacatcggaggccaatcaactttacgcccattttggttcaattactttgaaagaacagactcgttagtgtgggtagttgacgtgtcagcaattaaccggttaagagagagtttccaagaatttgaaaaagttcttcaagaagacagattggtcggctgtaacctactcatactacttaacaagatcgatatcatacccacagacaaatcactggatgcaattgtgtccgatgtagtggaagaattgcatctcaaagaaataacgaatcactgctggaacgtcctaccagtgagtgcttacacaggccaaaatttacaccaaggaatcgattgggtggttgaagaggtaaagaagaggctatacattctctgagaactgtttcagttgctcagtatacatactactgactggtccttgcctagagtaaatacatcgtttatataggaggaaacccaaatcaggcattatcttgtattctttaatgttcgagacatcgctcgatggatggctaaacaaatcccaaaaattaaagcaaacccatacaacaaactaattgacaaggaaaactcgtgttagcttgcagactcaagtaagtatcagtcaatcaggatggtgtggcggaggagcgatgcatgggtcagttttttgcagtgaagtattttccacttgtcactatgagcttcgaccggggaaattcttttaaattgggtttatccatacaaatcaagcaatacactcgttggtgaaagcccagacatgttgttaattacagtgttaaaatcctggagaaaaaaccatactcacatgcacttcctcatccactttgactgcctcttttattcggacttctactaaccttttttagtctatcaatgagtgacatcaacatttcacaagttctccagaacgcaatcttggctacggatgcaaacaagcgttccgaagcagagaatcaacttaatgggcttctcaacagtaatttccatgaatatttaagacttttaaccaacacgttggcggacgagaatgaacgaactgaagttcgaatgctcgctggtttgggcttgaagaaccagctgactgccaaggatgaaaggaccaagcaagccagagctaaccgttggatagagttggagactgaagctaagaagcaaatcaaagaaaccgcattaaaggctcttttgacggaggataccagagtggccaactccgtggctcagttggtagctgctattgctgatatcgagttacctagatctgaatggccagagctcatgtcaattatagtagaaaacacaaaggctgacaaaccagtgaacgttaaacgtgcctccttattgaccattggttacatctgtgagacagcagacccgttaaatgctggtgtagtgtcccaggctaatggaattttaattgccattgttcaaggtgctcaagcctctgaaccttcgaagatagtacgtttaaccgccataaatgctttagtgaactccttggagtttatcagatataattttgaaagagagggagaaagaaactttatcatgcaagtagtctgcgaaactacccaggcagatgatccagagttacaagcgagtgcatttggtgctcttgccaaaatcatgagtttatattacccgtatatgagcgtttacatggaacgagcgttatatggattgacagtttctggtatgcagagttctaacgaaaaagtcgcctgtatggccgtggaattttggagcactgtctgtgaagaggagctagaaattgccttacaaaaggaagagtatgccgaaactggtactgcggcagaagacctgacatcctacaactttgcattggtggcaatccaagatgttctgccaaccctcctgacactactcacaagacaaaatgaagacgcagaagacgatagttggtctgttgcaatggctgcaggtgcttgtttgcagctctttgctcagaataccggaaactatgttgtccagccaacgcttcaatttgtcgagggaaacctaactggccctacgtggaggaataaggaagcagctgttatggcttttgggtcgatcttagatggtcctgatagagagcagttgaaggttttgatctcacaggcccttcagccaatcctgcagcttatgcaagatgaatcattgcatgtcaaggaaactgtagcatggtgcttaggaagaattgcagacctggtcattgatgccattgatatcaatcaacatttgccagccgttattcaagcggtcgtacaaggattggctgaccatcccaaagtttcaaccaactgctgttggactttgattaatttgatggaacaactgtgtgcaaacggatcgcaattggaaactacaccaatgtcgcaatattatgaaactctagttccaacacttatcaaattgtctggttcggaagagaatgagtactctgctcgtacctctgcatatgaaaccctagcgacccttgtgtattacagttccaatgatgtcatgcccatagtaaaccaggttgcgtcagaggttttgaacagattggaagccaccattcaaatgcaacagcatgtggaaactgccgaggaaaaggcaaacttggaagaactccaaagtagcattctaagtctcctgaccaacgtcatccgtcgggcaggactagaagtaagcgctgtatctgacaatttgatggaattgtttttaagactgttgcaagcgcaagaaaacaatgctctgattgaggaggacattttcatagccatttcatccattgccacggcaatagagaagggctttgtgaaatacatggatgcatttttgcctttcctggtagctgcgttacagaatattgagtctccagtttgtaatacggctattggattgattgctgatatctcacattcactcggtgatggaatccttccatatgttcctaacctgattaatattttgggagctgctcttatgaatcaaaacatcaaaagagatttaagacctataatattgtcatgttttggagacattgcatcgtctattggtgaacactttttaccatatctggaagtggtgatgaacatttgcgcaagcgctcaatctctgcaggtagaagatggttcaattgaaaatttggactacatccttaccgtgagagagtccgtattggacgcgtacgtcggcattattggaggattgcattcacatccagaagccattttcccctacacccagcaggtgatggactttttattatcagtttattcggatataaacatgtcttcttctgacaccgttagtcgatctgcagtgggtattctaggtgatcttgctttgatgttccctaatggggaaatcaaacaaatttacacgcaagattgggtgacacagtttataaagagcacgaggtcaaatccttctttccaacagtctaccaaggacactgccagatgggccagagaacagcagaaaaagcagttgtctctataatataacatataatgcaatattgattaaggtcgttggttaaccatatagtttctcgattctttttatgtatcaagcgttggaatctcttcacccatcttagcatgagtgccttagtaccatttgaccacacgtttgtcctgtacgattcgtccgatctaatatctttggcagcggcagtgtggtcactggttccaatcttcattttggtattctatttctcatggtttgtatgtacgcgtgaaattgaagctgttattgtagcagctggtcatgtagccaatgatgttgtcaacagtctagtcaaaaacacgcttaaacaggaaaggcctgagctggccagtgaactagccggctttcgggttgtggggaacggatttaatgagttcttgggcactcaatatggaatgccaagcgctcacagtcagtttatgggctttttcgcttcttattttgtcctcaagctctggttacaatggtcaagatcagaaggtaaagctccttcccagcaaatgaaagtgtttggaacgctatgttttcttcttgccgcgtattgtgtgtgcgcctcaagagtttacttgttttaccacactttggaacaagttgcagtgggcgtatcccttggtgcatttctgggtacatgctatttccttctcatctcctttgccagagctataagcctagtcaattgggtagtcaattggccgttctccagctggttgagtgtgaaagactcttgggctgaaggagggttgacgttgaaagaagagagattacaatggctggaaaggtgtaaaggatgtaagttgggaacgagtgaaagtgagaagaaagggaattaatactaatgttaaaataagcatgttagcatatcaagtgtcttcaatgatataaagagagatgttggctggttttgggtactgcatggactggttttctaagaattgagcttgacaccgagtgaagagcagacttgacactttgatcctaccaatcaacactttgttcagatgagacgttttcttggcatatagttgttgtattagtgcattttttggactccatagtctaaatttcagagctatgataatatgagatgtagctaaaacccggaaagaattttagcagccatacatgttgttatcagtcactggcagcagtttttggatgacaaccatcactcggcgtagataaaatgtaatcgtgaaactaaataatcttcaaaaggcagttccatcccaaagcgatgaaatgacagaattgacgcctgcatgacacacttaatcgctgtgcatgagtttattgatactgccgatctggactcagcattcttcttggtgtttatgcgtatgatgggactatcgtaagaaataagataaagatttagaaattatggtagaattacgctacagcgtgcagattttttgagattgtatcgtatctgtcatgtacttccaagagtaattgaaatttaaagctaaaagattgtaaatgaagcagcaatatatgttgcaccgggtaacaagacgagccaaacctgcaagtaattcaagaagaataagctaagcaggtaccatcattgcatagatagtatgaatgaaactgtcaggccaaaaaagagattgcagcacctgagtttcgcgtatggtctcccactacactactcggtcaggctcttagcagcttaactacggttgatcggacgggaaacggtgctttctgctagatatggccgcaaccggaagcctagctttttatgttactaagtgcccataacataataagtgaatcttcgatagcctaacaatgtgaacggcattactgtgaaatcccatgctacaaacaataacttaaaaccacctttcctttcaccttagatctgggtttagtaacaataatataccaaatcttgcttgacattatcctcaagaacatattactatataaataaataatcgacttcatgacatgaccaactatttagtgtatacaactatgctagaatacataaactgttaatcttcagtctgttctaaaccctcaactgggattcttgttgcggtattagtgtaggcattataagtgatctgaataacttcattctctgggaacttcaatgttggaatgtcataagagtgacatgccatcaaatagccatacaaaacacgtagcacagtctcgtcagcaatgattagtacatcacccctcattctttccatttcaaaaagtaatggttccaccttgacagccaggtcgtggtaagactctgcacgagggtatctgtgatggtatgggtccgccaaatgctcttcataatcatgaggaaatttttctttcaattcttcaagagttaacccttcagcatctccaggattcaattgggtcaactgctgtctgtgacgcgtggtgattcctaaatctttgaacatctgtgcagcctccaccgtcctgcgtctcacagaggtccaaacgactagagaattctcatgctgaccatcgactccataagccggttgcctttttgtggcctcaatttttggtctttgaacattatggtagaagttctctcccttgaacttggagatatgacctagtacagttttcataactttttgggagtactctctacctgcttctgtgagtggtggatcgctcttgaaacttaacttattattggagcatcgggccatataaaccgatccacgcttgatctttgaattcatcagaaagaaaacaattttcgatgtaaggaaatcgtgattactgtttttgacaataagtctttcaccgaaattgatgaatttgacataactcaaagaaggctcgttcatttcctgataatgtggagctaccatttccactcgctttttataatcttcgacagcttgtttactatcccaattctgatagtcgggagacttagaagcatcctgaatgttggcccgtaataggttatcatcagtgaccagtgattcaataaacaggacacgaatgccgtacaatttcattctctctaccaattctactctttctttggaaatagcgttaaccgcatcgtatatggccacctgaccatgatcgccctgaaaaaatgctttcatatcttgaacgcaagactccgtaagctctttacgcattttgaatgcctcttcagtatctggaacaggtttgaaaaaatcatctgtaatagtgccagtttttgcccttctatagttgcccatatgaaacaaatttgatttaaggcccaaccatctcaggtatcggcataatgaaatagataggtttgtctttcctctggcaggttggccacagatacaaacacagacttgaccagcatgaaacattcttccagattctgtggagtatagctgacctggactgatgtaggtggaatcgacactgtcgtgaattccatccaggtgaacagcttttttacctttgacggtgtccagtttctcccatcttgtttgtttcctagctgagtagtttcctggaataacgggctcttgaatttcttcggtcattggtagatctggggaagaagagcttgcggttggtttgaagttgtgggggaaacggttgtattactagacgagtgatgatacgcgaagcctttccggtgtttggaggtaatttaaatattagtggggggaaaagagaggtagaaaggagagtgagtttactatgattcaacggaggaaaatgagatctcaagagtgcgtcgacagtaagtgctggaaaccttttggaatacattgatcacttgatgttctttcgtgatgtaaatgaaaagtcgtcgaccttatcgggaaacattaaaagtcgacatgtaaagatcgagaggtagttgagataacctccgcaaactgctactttgatgcccattctttctaacaacaggcaacagtctgtgtcattgatatcctcagctttcctgaacctaatcactttgccataacatctcaaaacaatcgaaacccttgatctacagttgactttccctacactcggtgatacttcggtacacttacattatgactatacatctactcgagcttaccaccatttctttgaatgtagtcctttctgttgtcatccaagtacaacttggtaataacaacgttggaagggtgaatgttcaatgggacggaagcaccgttggatttttctctggtgaccttggaaacttgaataccgtacttcaatctgtaaacggaggaaacctttccttcttggcccttcttggaacctctgacaatacggacttcatcctcttttctgattgggatggacttgataccatgttgttctctcaactccttggacagaggagaagacatcagaatttgacgcaccgatgaaggagcggtgaagtatgcctttctggattttcttctggaagatgaaacgtcttgactgactttggccattttcgttgatagagtaagtaggaagattgtatggattgtgctgaaattttttgtttgagtaaggagcgacagaatagacgagcgtgtatggaccaaaaaggaaaaattgaaaattacattacacacccttacattagtgcagtcacattgggacacaaactcacgattagggctgacgcgcgggttattgcgttcttgggaggataaacctccatcaggatctgggaggaacgcttcacatgctagtacatcacatgcaatcaagtgtactccggaccccatatatgactgattacataatctgttcactccataacccctccacatgctattatctgtcttggagaacgaggagcatatggggtgaagggaaagtagttctattgtttaaatagctccggagatccatctcatatttccctctcacttctccatttattcttagctcgtatgaacgtagtaatattcaaatcggaccctctctcgtatgatcaggttagggctttggataagatcttcaccgatcacggaattcaagtgaatgtggtatccaaattccatccagattctagcgagttgaaggctgatttatatctcattttgacaccaggaaaagaattggagagcaagttctttgtacgacaatgtgctagtcatatttccaaggttgacgcgatgaatccggttattctatttgaccatcaactgaactcaacattcccggtcctattcaattgcttagttaagaaggggtctttgaaatcaaggcccgtgtatgggttgccggtatcccatttagatacctcttcactcaattcaggggacctaagggtactgatcgatctaggaatgtcaggaattgcccaatactttgactacataataagtttgtcccgaaccgaagaagcttcccagattgttcaagcaatggtcaatcatggcaagcaaaacttcaacaatgagttcatacaaagtttatcttatttttacttgcctgtctctcttcagaaagggcagctatcagtattcgatccattgacagatcctcagacaattcagaaattcaaaaacttgaatctttcctgtctagatgacagcgtgaccagtttagaagagctgatggaagcttgcatctacaatgatagggtcattcattcggtgtctagacaccaagaactggcattcaactatactcatggtactaaattatgatgtgatcatctaagttgaatagaaacagatcaatcattcagggagtaactgatcaataatctcttcgcatctttccactccccaattaatcctttctttctgtttccttcccttggttaattgactgttctggactttttccggtagaaagtacttgagacctttcaatagcaatggttgttcgttacaattttgtagcgcctgttgcagcttttgtagatccttcttcaggcatagttgatctaggaaagtaatgaacatgatttccaaaaacagagtggtagttgccaaagtagtcaaaaagttgacgtttcgcaataaatgcaaggctaatgacgattggccgaacagaaaaccaaagaaacgtcctaaattcaatactctctttagttgagtctcctcgtttatgttttcctcgtcattatgaaaagaaaatgccaatcccgtgtcgctatcattatccttatcatcatgggactcaaaatccttaaggatgtcccaaagagtgaattgaaaagatttcctcatcatatggtcttcacacagttttttagcaaggaatccgtaaaatggattgtatgtatcttccatagtaacacagtgcagtaggatttggggtatttccttttgctgttgtctcttgagccggagcttttccagtttttcaaacgcattaacataatcttcggctgaaacgatgctaatgaaaatggctcttctgacatcagtattcattctctgagttcgagcgagttcttgccagttaggttcactatctaccatgaagtctgagctatcattgacttgaaatttcccaactgtcttctctgtttgcgtttcatctccttcaactgaggtagaatctgtacctttccaagctgatccaattaaccaccacttacctctgtcttcaacatgcaatatatcatcaaacgaaacctggataggttcaactatcttccctataggtagtacctttttgatccgaacaatcatttgcgcagtattttcgacatcaaaaccctttaatttattattcttcaaattggtcatcgtttcaatcaggaactttgctcttgtagactgcttagagttgacaaaatctttattcaaaagctcgagtatatcttttaataaactgatgtcatcagaacgcaacttggatccgcagcatcttatgagcttcagaagaagctcaactttcacttcattggaatctgtcactaatctttccctgattatgtcataaatgagcttacaaccaaaaacattaaaattgtacaaaaaaccaatgaatgaagtcaggttaacaatttctttgctttcaactgataacgtcccctgaaaaaattcctccaacttcgtgatagcaacctgaatgatatgagtaccaaactcatacctatttctataaatggcgctcactaaaccactgtataccagtacaaatccatccagtaaacgcccaggcgtcatgatagttttgagaataacgtctgtaatcacctcagtgacaacctgcctgggattatcattgtacagaagttgtaattgactgactatagtcatcatgttttgctctgtaagtttatttaacgggcctttaacctgtttgatgattttttggacttgttctgagtcttgagtttgttttcgtcttaaggcaggggggacgtattttgatgactgggagacaggtgcaacaaatggattttctttgactcgggggccttcatccgagtctgaatctgctgcactatcggatgtttcaattttttccatttctgccaactcccttcgttcatcagaatcaaattcttcatcatcaccatcctgctcttcactagcggatcctgaactttgttcttgactgccatcaaatatggtatccagtccgtctagcaatccaccgatggcatcattttcgtcattcttgtttagtttagaatcagctttaagaccaagcttccttgcgtagtacttcatttcttcttcttccttttctattagggctctttcatgaggggacaatatgcgaacggtttcattttttgactttgatttatgtttcttctggttcgtgtctccttcttcttcttcttcttcttcttcttcttcgtagtgctctagttgatcttcatcgacttcttcatcatctccatcttcatcttcatcttcatctccatccaagtcagaaacctcatcatcactcaaatcgctgagagaaatgattctctccgtgcttttcgtagttttagttgatctggatttgcccttcaaagctgccaattgggccaaagggtcttcttcctcctccccatcatcattaatcaaattttcttcctcagcttcctctttagagctatcgcctaaatcagatacctcatcatcgctcagatcacttaaattgacgaccctttcagtagattgcccactaatattcttttcagccttgagtgcctttaatttttctagtggactgctatcagtagagagatcagctgcatctgaaacgcttgaatcggaatcaaagtctgcaaatttgacacttttggtcttttctgtattctcagactttgcctttaaactgctcttcagcagtgtttccgcttcatcgaccttctttgacctttgactgtttgcttttgcagatctctgtttttgtttgtgtttctcttttttatcctgtctaagctgtcttctcttatcctttctattgacttgagggcgttttcttttgcttgtaaaatcccgaacgtctgatccattcactgagctctcttcatttgaccgaatctgatccagcaaactaccgggcaatctgatctcgtgtcgattcattatggatagatttagtgacaggagcttaaattatttttcttagagatgagagttcttaatctagtatattggggcggcgagaagtcactacaaggtcgttgtgtagccatctaacaatggttccaaaaaagaacgtgcaagggaggactcaggcaaattaagctctagtgagaagtagaggagtctgagaaagtttaccagttctttgaagtatccattagagtgttgaaccttcttcggttagtgggtagttggccttccgcgagcctactaaccagtggtcgcttggtcaatcttgaggtatctttctacaaacactgtctatgcttctaaaaaaggttcttagccgttacctatcaatcacattccaagtaactgcaacctccttggttggtttccaccgaatgcttgagctcagcacacgaagatttaaagacatttccacggtgcctattacctaatcagtacgttcgcacttctgtagatagcctcccagcgccttccagtctacttcaacttctatccatttttcaggtatgaacagatttagactggatgcaaaggtggtgacggatttggccctttttgttggaacgagtctgtccatatattatttaattagcacgcttttgggagacggtgctccccactcgctgaaatccaaagaatcaaagaagaaagcaaaggcttcattagaacggttaaaggcactaaatcccgatctgaatctggatttaaatgattacgaaaaagtagtactctcctcagtaataactccatcagaaataaatgtggggtttgacgatattggtggattggaacctattattgacgatttacgagagagtgttttggttccgttgaaccatccagagttgttcaatcaatattcgcagttgcttcaggctcctaagggggtattattatatggtccacctggctgcggaaaaacaatgttagctaaagctttggcttcagaaagtggtgccaattttatatcgattaggatgtcttctgttatggataaatggtacggggaatctaacaagcttgtggatgcaatattctcgttggctaacaaattgcagccatgtattattttcatcgatgagatcgactcttttttgagagaaagacaagctatggatcatgaaattacagccactttgaaggcagagtttatgaccctttgggatgggttaacctccacgggcaggatccttgtactgggggctaccaacagaccaaatgatattgacagcgcatttatgaggcgaatgcctaaaaggttttccgttaaccttcccgatacagagcaacgattcaagattctcaacgtattacttaaagacgtcgcctacgattttgatttaatagacttggcagtgaaaacggcaggtgccagcgggtctgatttgaaggagatgtgtcgaaatgctgctgtcaatgcgacgagacaatacatccgcaagaatatgggagcatcagggaaaatgaagaccacggaaaagattaagctgcgtcctttgaatctgggggactttctaactactatttcacccagcgaccctgttcacaggaatgtcatacctgcagcccccaatgtggactgatctataattctagaccctttttgtacatatattcagttctaatcaggaaaaataatgacacccaatatgaaattgattaggtaatatgaaccttaaagcggacagtagtttgctactcaaaatgtagatcccactgttttcttgggtgtcaaatttttttacgcctggttggctgatcacagtggttataaatgtgcagcacagcacgggcttaaattgtttggctgcctcagcaagcggagaagatttgtcaatagtaattggatttcatctctcgtcacttgcctttgtagaatatctttttggactcttcgaagatctctatactgatggtagtatatcgattcaaagcgagtcctagaacgagttaccgatcgaatgtcaatttttaatgcctgttctaactggtatcaaatggttagaaacccggctcgttttttgatcggcacattggcttttcgactcgttcatggaatggggactgtgctgtgacgtcgaaactagtaacccaaaatttcatatgtaaaattcttccctcttgaactgaatttattccgattagcaaacaagaaaataacagttcactcaaatcttgcattgttctcaccggtgaaatcgtgagaacctaatcttcgccatccctgtgtagccaattgcatgcccctatggtgcctgcctagaccttacagctcgtttaaccttgggaaggcctgtagctattatacaccacacatccactaatgcaatctccacagcaacggacaatagtggcatgcgcaaggcgcgaattaagctcctataacatatggtccacaatacaatatgacatgcccgttgctagtatatcttaactctgccactcagttggaaaccatttccaaaatcatccgaatctctcctcttttacgcaacagattttcctttcaataatctgcaatctcaatctgcaatctgcaatccgcggacttataagaaggaataaagtgttcgtcttttgaatgaagttgcttctaactcctgtcgataatccatcataatgcaaacgtacaatagcaatagtcgacaagaaggactacggtaagttgatcgctactctcatgtgctgagcctgtttactaacattttgcctttagactaccttcctttggagaattaagtgctgctactggtcgccccatagaaagacctaccagtccgttagataatggactcggatatggaccaggcagtgcttttcctaccccagatggcactcagcctagagcacggtatgtattccctccagcagcaggtccgccatcagcgggacctccagtttttgctggcttccaacaaccccatgtacaacaacagccgcaacagcgccatcaccaccatcagccagtaccacctccaaagcaacagcagcagcagcaacaacaacagcaacaaccgccatcgtcaactgtaatggctcctcctcttccaatcccacctcagaatgataccaacgttggtccaagatctggattagacccccctcaactcccaccgtatcgcaaccagacacagccagcagttttcgtaaaggagccaaatcaaccacccccagctatgttgagcttccatagatcctcccatagtgaacctctaatagcacttgccgacgcttcggagatgatgtcccaaagaaatgacagtgaccccccgatagcgcaacaacaaaaccaagatgtcggactgctttatgacataagggcgggtgcgcttgaaatagatcaactaaaccagaaaatacagaggatcgctcaagacctgcaaggacttttggagaatggttccgtaacaccaaaggtaatagatgaatttctattgagaccagattacgaagaattaacgaaaatggcttttcaactaggttttatgtcttctacgctccatcgatggatccaggcacatgagtttcttaaacataacgtggagaggcaggcctctgccatgaatagtaacaatcctaataactcacacgcaagtaacaacagcggatcaaataacaatatcgccgtgatatccccaacgtccaagcaatctatgaacaatctcagaaaggagtcaatatccctgaaagtatcacctcaaaccccagtcactaaagcgcaggatactttagaccttgacaatcggggttcccgagcgaacatttctacgaacattccgccgaggtgcctgcaatgtgggtcgggggacacaccagaatggagacgaggaccttacggagctcgaacgttgtgtaatgcatgtggattgttccatgcaaaactgactaagaagaaaggcgcaccagaagcagccagaataatgcaatcacgtagaagacttggattgggttccgagcgccggatctctcttctatctggctccgagcttgagcaagaccgatgaaggtgagagttttgtatgtaggctatgtagtataaggtttgtataagatacgattgtaactattaatcatccgagattgattgcttcgggaagaaaatgccgcgcagcttgtttccgagggttgaaccgacttcgcctagagagaatttcacctattgtgaaagaatttcacgcgtaaacgctacgtttttcaacatccgaccgcacccccgaccccactccacttattccatatgacattataaaccttaaccattggcctgtcggttaccaacactgaatttcgtactagatgaatggtagattgctctttcaagggtatagaagctcaattagagcgacagcctttgctggaagaaacctaaggccactgcaagcttctagaaagctttcttcaatacttcccaaagctggatctgaaaagtcgcactcctctagtaagatcctgaccagaggtgggttagttattggcttagccttagtagccaccactgcaacgatatggtctcagtcgttggcatctccgattagcaatgatgatgagagaaaagttacaccggaagagttggccaagcacaacacaggaaccgactgttgggtagccatcaatggaaaagtgtacgatctgactgaatttctgcctcaacatcctggtggccgtaatgttatattgaagcgggctggaaaagacgcttccaaagtgttcaatccgatccaccccccagatgccatttccaagttccttcccgctgataagtttgtcggagttttggatggagaattgcccgaggaagaggaagtccttactgacgctgagattgaaagacaggagaggatcgccaataaaccacctttaagctcgatgttcaatgtgtacgactttgaatatgtggctcaaaacattctagatgaagctgcttgggcttactactccagtgctgctgatgatgagataacgctgcgtgagaaccactttgcctaccataaagtttttttcagaccaaggatattggtcgacgtcactaacatagaattggaaacagaaatgcttggtattaaaacttctgctcccttctacatttctgctactgctctagctaagttaggacacccagagggagaagttggtattgccaaaggtgctggccgtggagatattatccagatgatttccactttggcttcttgctccctagacgaaactgttgccgctgccaaggaaggtcaatcccaatggttccaattgtacgtaaattctgaccgtgaagttgcctataatatgatcaagcactgtgaagaacttggaattaagggcatctttgtcactgttgatgctccctctttaggaaacagagagaaggatagacgtatgaagttcactgaagatactgatgtggacttgtctggcgatggtaaaacagaggttaaccgttcgaacggtgcagcagctgcattgtcttcatttatcgacaccgctgtgacttggaaggatattgcagagttcaagagacgtacaaacttacctatagtgataaagggaattcaacgtactgaggacgtcatacttgctgctgaacatggagtggatggggtagttttgtcaaatcacggaggtagacagctagatggagcacctccttccctacaagttttggctgagtgcatgcctgtgctgaggcaacgtggtcttgacaagaagcttgaggttttcgttgacggaggtatccgcagaggtacagacatcatgaaagctctgtgtcttggagccaagggtgttggtttgggacgtcctttcctgtacgccaactcagcctatggacctgacggtgtggaaaaggcgatcgatattttgaagaacgaactgataatgaatatgcgtctactgggagtcaccaagatttctgacttgtcaccagagtttgtcgataccagaccactatttggcttgactgccaacgatcgactattcaataacaactatttagacatcgaatttcctaaattcaaggacgaataagcaaaagtgatttacagtagatagtattattcaatatagaaaaatggtgccctgattttccgctttgcagcagggtcggcaacacctctacctacaagccgaacccttagagggacccatgaataatggaagtgactagccaaatctatgtcggcatgcgccgcgtaggtaggtagctgcttggtttattgagcacagccctatcttcttgtaggttggttatcactccgctgccttcattgatagctggcagccaaaccatagcattaattcacccgcataaaaaaacccggggaaaaaattctcccgaaaaagaaagcggaacgtgatgggtgatgcatagtgtgccagactaggagtatcacagcttaatatattctcatctttaattacaatttttcccctattggactaaacggctctgtcaaatgttctctcatggcaactatttaacacccaatgagttcaaacaaaaggcacgatcacaggtgttgcagcagtttggaaataatatatcatttgtccgggctccgccagtgtcgtcagcatcatcactccgatcagaggtttacagtagggcatcaaacagtagctacgtattcaatgatcaaaagtctctagagtccagcaattcgttagatacacaccattactacaacaatatttcacttccccccttaagaccgtcattaaggcattttatgatatccagggttcttgaggacttatcacaggaaatctccttctcaaacaatatcgacaatctgggacttttggtttacagtcaactcaacagtctaaatttgacagacgtattagattggaaactcaatactgtgcgatgtttattgttgctgagcgagataccacactgttgggctaataaaatggatcatcacagtatccccccaattcggctcagtagcagccatgcatccaaagacacagtaataccagaaatttacaaatcagaaataataaaagtccaagagaagacaccacacacacaattttccaggatagttcggcgaaaaattcagggagacttggactcaccagtgttcgagttgaaactgctccctcccaatccaacagattcagaattcgttgactttctcgttcattcgaacctatacaaagagttcaagttagagtccagttttaaaagacaagtggctatggtgtcagtctccaaggctagaaagttgcaaactgaaacagaacactccgaccctgacgaatctttagggttaatctaccttgcaataggcctccagaattactttttaaacattcttgtagcctcattgacattatttgagtttcattacgcagtttgtgaaattttaaccaaggaaagaaagttgtctaaagcagagcatgaaacactttggaataacattagggaaaagaattatgccaagatctccaaactttggtagtcaattctgttcccgcgtagtcattagcatcattcatccatttaatctaccatatacgcattttcctaaatagaattacattattcacccgcattctcctacagatcgatgctgtccgtgcacagcgctttcgattccctcgtagcttatttgcaaatctatattacaacctatttatacttctaggctatttaattcctcaccttcttcttcttaccttggtcttgtcgaatttgctcgtacttacgtttgaaatacttcgttgagtcatcgtcatgcagaatctcatctatcagtgtttttcctctctgttttttggtcaatttgttataatatccagtgttactttcaacaatggtaccaaattgaaagaattctggggtcttccaattgtccttcttataatgtctcttggggtccaacaccgccctattcttaacgatttcaaggtctctcttaacttgtggtgtcagttcacctttaggcatattgaaccatttgtccccagcatgctctttttctttctttttccttctagacaattgtgtaactataggatcactgatcttaagaatcttggcttttgtctcctttagttcgtagttcttaatcagtgttttcatatctgcatctaatcgaaattcactctgcagcttcggcatcttgctcaaagtagactgaacctgttcgaactcgtccttatcatctttgagtcctgccagaatctcattttcatctttttctgcaaggtttgccggaggttcttccttcttctcaagctcattctttaagtactctgcgttgagctcggcgaaaatttcatcaaacgatttttgtggttcactggtactttcttgctcagctgatttggggtcagcaagcagtgattccataggtagctcctctagctctgtgatcggagatacttttgacatttctgtagggcaaaaattattttctaactatttaatttttcatacagatcacgtgaaatattatacaatgcttatgtaacgaacaattctatcaatggacaaataattatacaataaaagaatgaaaagaattacacaggcagtcagcgtattgaccaatcaactgtatggctttcagttccttttatgtacttcaaagctgggttgaacgagctatcagaagagaaaataatgccttgaatatactaacgttacatcacaactccttctctaacttatccataaagacagcattttgaacagtcaatagcttgtaactccatttttttgtctcgttaagttcatttccatactcagtgtacacattgtcgtgaaatgccttcaactgagactcgtatcgctctagcgtgtcagctaaatgcaccaactcttcagtgcccaacttgtcaatatcgtcatctgaaggaaggtggacattattttctgccagagtttcataatgttctttagctcgttccagaatatgttttttcaggttgttattaacgtcaatgtgattgatattgaaaagcgcgccgtagttggaaaggttgtccttggacaattctccggattcaaaccgttctagtaggtctaaatacctgtctctaactgtcttttcgtttacaaattcaagcttttgcttatcgctttccaaagaggggtaccaccatggaaacacttcctcttgagcttcatttggagaatcgatgttatgtatcgtctttatgtgtttcaataacgcatctgatcttgtgaaatgtttcggacattccggtagtagacaataaaagggcctttctcctgtatgtgatcgaacatgtgacattaaagaaaatcgactagcctgaggtatacccttcctagaacagtctctccaattacaacagtgatctttgttggaatcattggaaatatgcgtgtggttgatgtgactcaccacctggtccaggttatcaaacttatcgttgcaatctgtccataaacaatgctgaacggtattgaaattgtcaatgatttcactttctggaataaaagctcgtgccactttactcttagagagatccgctgacaacgcttcatcccattcaaaatctgaatcactcatcgactagaaaatttgcaatacttttgcgccgcggatcaaaactggaagaaaagcaaacaaagtctttatatattatagccgtgatttcagtgaatcctcctagaggccattttttgatagtctttccccttcccacattagttatgccacgactatctcgcgagaaaaatttggtctctgacttggtcgacgaaatactctcataatctctagtcaaaaagcaaggaagacggccatgtcagacctccaacatcgtattttacaggttttggatgcacaagatgttatccaggatacaaaagtacagtttcccgaattagattcgcagacggttcaagccgctttgaactctctgctcgctagatctatgatcaagtacacaaacattgaaaccgattactggctacttacggatgaggccaaggatatcgtccagaatggctcccacgagtttagattgttgcaggaagtcactaagaacttagaaggtctgaagattgcggatgtcggaacagttctaggaaagaacggtaaactaggccaggccaaggcctttaaaaatgggtggatttccaaagatggtgacagattattgacaaaattcaaggacagcccattgccaaaggatgaaactgctcaaaatttaagagacattcaagagaaccaaggtgcgggtgtagacaagaaggaactgcaagacctaaagaagagaaaactgattaccatgagtaagattgtatcctacaaagttgaaaaggcagctgaatttagtctagaaatcgttcaattgaatgctgacatcaccagtgatatgattcagtctgggtcgtggaaaactgccaaatttaagccttacaatttcaattctgaaggtgtctttccacatagtggagctctgcatcctttgaacaaagtcagggaagagttcagacagattttcttttctatgggttttactgaaatgccttctaatcagtatgtcgagtctggattctggaattttgacactctattcgtgccacaacaacatcctgccagagacttacaagataccttctatttgaaagacccagctttagcaaagcgtccagaagacaaagagtactgggaaaacattcaaagagttcaccaagatggagcttttggctctatcggttacagatatccttggaaggaagatgaatcattaaaaatggtactgagaacacatactacagccatttccgctgccatgttgaaaaaactagccgaggatccaaaacctaccagactcttttccattgatagagttttcagaaacgaggctgtggatgctactcatttggctgagttccaccaagtagagggtgttttagctgactacaacctgacgttaggagatctgatagggttcatgcagtcgttttttgacaagatgggagtccacgatcttcgtttcaagcctgcatacaacccatacacagagccatcattggagatttttgcatatcacaaaggattaggtaaatgggtcgaaattggaaattctggtatgtttagaccagagatgttggagccaatgggattgcctaagaacctaagagtactaggatggggattgtcactagagagacccactatgattaagtataagctgagcaatatcagagatttactgggtcataaggtgtctttggactttatcgagagtaaccctgctgctaggttggatgaggacttggtttagtagtttaggagtaacaattacgattgaaatttaattaacttagaaaaacggatattgacaaactgcagtcattctttatcatatttggacctgagtcccctcaaagtcttatctatagtgtcacttctcttggccctatccagcgatgacatatgattatataatcatattttgcagattagtcgctcaatctcagaatatgttaatggaacagggctgagccacaactatcttttcttgaatactgactcaaacgaatggcatgttatgacagatttaccgagctttttaccaataggtagaaatgagaatgtcagtttaaccaaacctgaatcgtcagcaccccaagagagcacaagctctgaacaattagatacagccaatgcttctaaaactgttagtggtcgttcctggactcccaagacttttataatacctgacacaagggctattgatttgttgttgaacgatatgcccccatcctttctagtggttgaaaaggtggacattacaggatttgagatgtatattgtggaacaatgggctctaactagaagagttggtacaacgatcactatctatacaggagacgaccataatgtattgaaagcctataaaattacagtcaccatagatgaggagaacttatggccaatgagttttaaaaaatatgtgaacagtctcattttatcacaatctaccaccttgagagagatttcagatgcttacttattcgtcacaaatttatcccaatttcctaccaacttgaacttgattcctgtcaaggaaggcagcttagccgacatttgggatctgtttgtcaccaatttgaatatgaagcggctgagctgtgcgggcagatcattgatcactttgacaaatccggccaattctattcatgataagttcaccagtagatacagcattcatcctgatgtccctttaatgtatgctgcaagagaactggttcttattgtccagacatttttgtactatttcagactcattcgtccgcttgctgttgatggcatggcctgtactcacacagaagaagcaatctgtcagtggtgggaacaatttggaatcaagagttatcccatggttatcaagccaaaagactttttcagtcccctgagtctttgtggcttgatcgggtttgtccttactataagggaacgtttagcatcttttagcatgagcatctatgttccttcagatccacttttgatcaatgattttaaagtaagtgtaggtcaattccaaaggcacatcagaaagttggcccattccagcaatggcgacggtttaggaatttctcctctgcctaatcaaagctcggagtcggctaaaaacacgtggtatttagacgtcgacacggttgacattctcttgagatatacaagccataagggaagtaataaaccgaatcttatgcatgatatcaacaaggttcgacgaatgttcaagaacaccgtccaggacctaagttcgggaaaatctttacagagctttaaaaacacagttacagatcttagtactggtagaacactgcaaaacttaggtgtccattcagacgtgccggcatgctctgcttttgaatttccaggcattgaagtcctaacagatttcaaacttctagtgccccgaatgaaaggtaaacgtatgaactatctatggaaagggaaaggcaaaccatttgatatagagaggaactgcatcagttcattgacacttcaatatacagctaaatcttggagagaaaaaaccaagcatgaatcattttccaaaaatagatcatcgacgtttctgccagagggaagactcgaagattcttcctctaatcattatgaaagatatgactattacctgagtaatgaagcacaaaaagaaagcggcaacacagaacgtgaagagtttaccattgaaagactgaaggaaaaactgaaatccaaaatctggtttgaagaagatgaaaccacctcttctggaaaggaaaagacaaagagtccagtagccaagagcaagcttagtaagggagaacaagctgataataacgatacagaagcacatcgttcgcagaccgaactatgtaacctactagaaagagagccaaagatcgagacggtgaaccacaatgaaaagttttactcgttattgcatcgcagaaattccataccatcagcacaagttgaggcaaacttaaatactatcagttatcagaaagagtatgctgtggtggataccgttcagagacaggaaccattcatatcaacgagtataaagctaaagcgaagcaagagtttttctgaagttgagccagttgtcaaccaatggaattggtcattctgtccttctgtggaacgtttggcattagcatacattagaataaaatgcaacatggaccgaggattctccgtccaggcttctcaatttaaccaggattatgaagaagttacacatttgctagctacttgtgtcaatgattttgccccattggcaaaagtgtctttggataggaaactatcgtgtggagagggttatcttttcgacatgctaaaaggtatacttgataagagtaagaatcttgaatttcaattgaatgacattgattctttgaatgcaaagctagactatgaattgagattattatctcagaaagtaaaggatgcagagcaaagtcttgtgcaattaaaagatttcaaagtcaacaatctcataagaagcttagacaattgtggtaacatgaattttagcaagcgtattagaaaccaaataaaacaaaaagggtacgatacacaagttggtcaatactccaaagagcaagggtattatgtgtttttccaaactttggttcaagttttgcttggcacaatagtagatatttggttagcattcttccccggaataaactatgagagagtgaaaaagatttggatcaaagtggaccccagaggcagaaccaacagatttattggtcggatagttccgacaaacacatagtatgtaaatgaacggagctttctaactttctctccaacgtgttgtaaccgatcctacattccttcagtttgtgattcaaagtgtgtatcgtctcatcaaaagaccgaattctgtctctgtagatcttatcacccttttcttcactctttgcaagggtcgatttcatatctgttacagaatccttcaccaaagtcagaagattcttgttatcttctagtaaatggtccaatttatctgaaatgcaatcatacctttgaaggtttatcaataacacctcattctctctcttgagtctatctgtttccgtttcagcttctgtttctatttgtgttgcagcattcgagttctgtgatataaacttcgaagtctgttctagcttgtttacagtgccctgataatccagattatgagtttcgcatagttgcttcagcttggcttcgacatcaactgttgaggcttgctccgcttgtaaggtttgagacaattgggctagatatgacttaacgtccgatatacttgcttcagtggtcgattccatggtaactatactcaactcctccttagtgaatggaaagatgctcgtttggatgtaagtacttttgccttgcgcgcacaaaataaagggcgggagatgtgtctgaccagaccactaactacaaattttattctactccaaaattacgtgaaacgaaatacaattatgactgttatacaagaactgccctcaactaacaaatgctacgagatatcaatgacagcaacaatgggatcggatgggtgtggaatctatttcttttgcttcttggattttttgtccttcttttccttcttctctttcttctcctttttctcctttttctccttcttctccttcttttctttcttttctttcttctctttcttgtccttcttgtccttcttatgtttctttggcttctcttcctcctcttcctcttcttcctcagattcgtctctctttcgcttcttttcgacggtgtcctcttcactgtcagattcatcatcagaatcttcatccttaactgattcaggtacagcatcggcatcagcattgtaagctggtgcttcagtcaattcaacctttttctgttcacggacaagtctagtagtagttcttaaatcacgaccttccagggtactcaatctagactcgaccttagccctaaagtcaagaccaacgtcaccagagtcatcacggtcttcagagagtgcatcgtaacgcagagaaacagcagctttagcggcaagaacacgggcaattttacccttgttcttaccggaggcttgtccaactaatgaggcatgatacaataaaccatacttaggtgtgtcatgtttagttttcaaagctctgaacaaagccttttcagcacccagaatctggatagtagaagctggagccttggccaacgaaatcaaagatccggcatgggcgattaaacgggcaccaacaagttctccaaccaggactgtcaaattaggagcaatggccttcattctggaactcagataattagataattgttctctgtaagcggcgaattcaacaatttgttcggctaatgccttgatgttctctaaatctatgtcggtaatttcagtacccatggaaacttctgcagcggtcttaacctgttgttcaacttcttcaggtaaaatttcactcaagtcagtgtcctgagcattggttctaacgcccatagtcaaaatgatacgagcataggccacagaatctgtaacaatcttagccagttcagggaaatgccatccgtaccattccttactacgcatggcatatgtgttcaattccttgtccagatcgtcaagcaaggcaatcgcttgaacaatcattgtatcaactttatccgcagaaaatttcaacttatgacggccgatcgagtgagcaagacccagagacatggttgaaagatccttgtctgaaagaccagggagcaactctggtaaatattctctgacagctctgtacaagtccaaagttacggcatctgagacgacggagaagtttaatcctaacttgttaacggcattagccaacttggtatccgaaacaatcagagtagacttcttatcggacttagcctcttccaaaagcttctgaagttggttggagactttaccatcaataactgcggtagcctcttctaaagcattggcggcagaactgaacttggagaatgcggccactttgaactggttgacaactttgtcagccgagttaagatcctggatcagagttgaagatttgtagatcttcttatctgaagcctttaggagtgcataaccggctgcagtttctgttaacacgtaagccatctttacttgtagtatgtcctgtttagattacctggtaacagaaattttcactgtgatttttttatcaaattttttttctttggagcagagtagaaactttctcgcggtgctcacaaccactgatctttggtggtgtttggatgatcgacttttagaaggcaccttccaagacgcgcggcgccggttgtgatctatattataataatatatttgaaggtctttcacagtcgtctctttgccaactttcctcttagttgtacgacagttttgagggtggactaacgatatgagccctcctagtaagcgagttaagcccggtggtaggagaagaacttattttttcaagcccgaagactcgttaacaaccaatcaagaggaagatgtattgcctcttgcccaatccaccgggcttcagaactctttagagaacacaatgacaccaacaaggcctagaaaacgcgtttccaaaattactgagaccttgagaaatagaaagttgaatggcctgagttctgatgatatggtattttggcaagggacgcctaaatcggattcgatatcatcactttcgccagacaaacctaccacacataaccttccgtcttctcctacaagacagatcccaatttcaaacgttgtctatgatccaattggtgaacttgcagagaagtacaacacaacatttgacaatttagcatcacaaaccccaatcacctctaccaataagatgcagagaagatcttctgattcacagccagcgtcaagaaagaaagtgggcgatttgtttaattttgaacattctccttcaattcgacgaactaaaactgctggattagaaaatctcgccattggtgctcctgttgagggcaaagttggagtaacgaaaaagtttgaaaagcttcttgatgagtttcatcaaagttttagtggctcacctgtagatgtacccatcagctctaaggaatcatcaaaatcacctggtcattctgccagtgagcaagaccaatccggattttccgatgagcttgatatggacgacattaatcacttactggaaatgacgcagccaaagccaaaagttcaaatagcgacaccaaaaactgaactgcccgtatcaaaagacacaataaaagaggagcaagactcttcgtttgatgacactagcgatgatgatgactttgaaatgttattcaaccaattggaaagtcaaaactctgtaaagaagctatcaactcaggaaaagaaaatcagacaatcagatatggagtctgtagaaatttttcagagacatattaaacaggaatatgcaaacgatacaaggcacaataaatgtaaggagaataaagcaaagcttgcggtgccgaagaaagacgtatttcggtatcaagttgtgaagattcgaaaggccaagtataagcttgacaattcaaaaggcgaacaattgatactcacagtttctgatgcctgttcagtgcaaaggaatattgtaatcagggatttttgggcagaattagacattgaagagggggatgtaatccacatcatagggaaggatcccagtctgaccgacaagagaactaacattttgatctggaatcctgatttgctactttcttccactttagtaagtgaatctataagttgcaaaagaagatcttttctcaagaataagctcacctttccaggcgagtcttccattcctttgattgtgggggtaattgttcatacagtttttcaacaatgtcttgccgctggaaacattaccgatgactttatcagtaccctgattgagagtgaattgaatgctaatctattttccatatttagcatcaatgaatcgagagaaacggtgagggagaaaatccaggagcacgttcccttcatcaagcaatggcatgatacatatacaagaagcattccagtctcaaaatcatcgactgcaattggtgggactaaagataaggccatggtttctgctagtaatattttagatattgaagagaatatctggtctccagtgtttggcttaagagggctcatagatgtcactgtggaggcatgcatcaaagggcctaacaatgatggaaggtttgttgtacccctggaactaaaaaccgggtcaagagagtatatctcacatagagcgcaggtttctctttattctttactggttagagaaagatatgatatagactcagattacttctttcttgtttttacaaagctcaagagtgttcaattacataatatcaaacaacatgatctcagacttattgtgcagttgcgcaatgagctttctggttacctcaaactgacaaatgggttgaataaattacctcccctgatcaaacaatccgagtgcgatagatgcgacgttttagttccctgcatggctttgaacaagctaattgaaaatgggacatccgaagacagtggaattctggagcaaaaatatgagctgttgacgagccatttggataaagaagaatacaaattttttttcaaaaaatgggtgggcttaattgataaagaatctttgactctagacatgttacagagacagatatggacattgacggctacagaaaaagaacagaacggaggaacatgcttaggagggttggaaattattgagatggaagaatcttccgtatctaactacaactatcgctatgtcttgaatcgtgactgtaattcatcgaatgcaccattaactctgctcagttctccaagtatgacagaattttagtaagcgatgaagaaggtcattatgcattggcagttggttgtattgatcttataaccccgactacggtaatcattagaactgatagaagaatcgttaactcttccttgaagctgccaggatttaatgcaagaaacaatcaaacctttcaatctgtgctgtccaagagggattttgagatgttaccggcggaggtaaaaataaaactttcaggatagacaaaaatgagttttacaatggcttggcattagccaggttcaatattttgaacttgtttttacctgaatacggggatgagaaaaggagaagaatggttgttgagttgaaggcacccagcttttcaaataaacctcttccttacaacgtttcgaagcttgggtcttttaatcctgaccagcttgcagccgtcaagaaagcactgtgtactgaggactatagtttgattttgggaatgccaggtactggcaaaactacggtcattgcacagataataagaattatggtagccaacggaaaatccgtattactaacctcccatactcattctgctgtggatagcattcttctaaagctactggatgatggtatagacttctaccgtgttggttctgaggctaaaattcaccccttggttcgaaaattcatgccccaaaaacgtggttccgctgatatgaatagtattgaagatttccagagaatgattcatcaagcacctgtggttgccgctacctgcatgggagttggagacttggtattcaactaccgaacgttcgattattgtattgttgatgaagcttcacaggtgtccatgccattctgtttgggacctttgagattctgtgataaattcattcttgtaggcgaccatttccaactacctcccttagtgaaaaatcctgaagctcgtaatcagggcttggacagatcattgtttaagattttgagtgagaagcatcctcaaagtgtcgtctctttgagctatcaatatcgcatgtgcgcagacgtgatgcttctatccaacaaactaatttatgaaaaccggttaaaatgtggtagcgataacgttgcccaacggtctttaagaattccaatgaaagagagactggatcacttactgcttgatccaagtacaccgaaaaatcgattgtggcttcaccacatctttgtagaagagaacagggttatcttcttggaccatgatgacgttccagcaaaagaaagaatgtcgacagatagagtggacaacccaactgaagcagaactggttggccaaattgttgacagtcttatcaattgtgggtgtgacagcaaggagattggtgtgatgtcgttttatcgagcccaggtaaaattgatgaaaacaagacttgtttctcatgtgcaaaatgtggaggtcatgacagcagatcagtttcaaggaagggataaagaatgcattataatatcactagttcgatccaacgctaccaactcagtgggtaatctactaaaagagtggagacgaatcaacgttgccattaccagagccaaatcaaagttactaattctcggcagcaggaagacattggaacaacttgaaactctgaaagcctttttgtcactattgaaaagtagaggatggatttacagactgccgcttggagctgattccgtttacaaaggcctcaagcaagataaccataagacagagccagccagaaaagacaattccaaaatgtcattgaaaatgataaaatccaggccaatattgaaggacattttcaatgacttggtaaactaatattattatcatacatcgtgtatatagacgatcgattagcattttatttagtaggcccacgagcccagtgatttctcgatttaataatttgacatttgatccattcggctgtcaactccaatgagtagttgtttctgttcaaagagccaagagactgaaaagcgaggagctgtatcagaagaccagctagtgatttctgatgattccactcatcctgcaaacttgatctgtgaactctgtaaggttttctataacaacggatgggtgacaggtactggtggtggaatttccatcagagaaggatctaagatctacatagcgcccagcggtgtacagaaggaaagaatggtgccagacaacatgtttgtgatggacctagaatcagagaattatttgcgaactcctctaacactcaagccttctgcctgcactccattatttctcagtgcttacaagatgagagacgcaggtgcatgtatccatacccactctcaggcggctgtcatggtgacattgctgtatgataaggtgtttgaaatttcatctatagagcaaatcaaagcaattccaaaagtcactgagaagggaaacttgatgtactctgataggttggtgattcccatcatagaaaacactgagagagaggaagatctgactgattctcttcagcaggccatcgaggaatatcctggaacaacagctgtattggtaagaagacatggtatctacgtttggggagaaaccgtctggaaggccaaagtttacaatgaggccattgactatttgttggagctagctctcaagatgcatcaacttggtattcccactgtaaaacagaattagttttgtgtatcaatcattatacatatatattgaagggggttgttctctattttaattatgttcaatccaatgcatgccttgtgtcacctaactgtctgccgtgtaatgaagcccaatttatcgtttcttcttcttcctcatctactaatcctatgcacaccacattgttacctctcaataaaaagagtcctaaatcgattgtttgtgtttcttctgttaaatggaatactctttcctgtgctttttccagtattatgtttgtagaaacgtcaaacccctgaagtattccctagaatcattgttagttttactctcaagagagaattattcagttacacttacagtaatcagttttccatccgaagtaatcactctgactggctcttgtgtattgttagtagactttatcaaatcagcagcacgtcgccttcaccctccattcaacacttactctcaagaaacggcttcaacatggacattataggttcgaaggataacgagagatgagatcctcctcgcgtttagatactaagaatgattacgtaacgatactagcggatcagctacaacacatcaagtgtaatggtgggaagaaatgtgactaaaggccctgccttcccttgttagacctctttttcatctacttcactaaagaatggacaccaacaataccagtgtcttcagcactaatcaggaagactctactctcgcaaacactaccgtggatatggatgacgatgatgagggtgggcagctctctgaggccagtttagacaaggaagactgtatcctctgggctagaaggcttgaactggaatgtatttctctcagagaaaagacgagccagcaagccccagcaagttatagaagaagaactttgggcacagctccacaaaaaaatgaccaagaaactgaatcgttcattcgaatgcttgatattaagttgtcccactcaattgacagcttggaacagttgatgagtgaaaaagttaaggctttggaaaaaagacaactcataatctataaagaattaactcaaatgaacgcgtctttggcaaggatagaaagttctatcacgtcaacagagccccaagaaagtagtccgacaccagaactaccagtggaaataaaatctagcagaaggaagacaattaatcaattgcctgactcaaattttcgaaccaaacgtcgtctccaagattgaaaaaattatatcaaagcactgcccagtacttgcctcgtaagggaaatatccaggctcaaagtctttcccacacatatggaattattattcaatagcttttcataataaagataataagcaggcatgtacctatctatgaatgcttgtacctgctcgtcggtcatgcccatgcccttctctgctatcaacttatgttcctgttctaatctccaagttcgaacgttttccacagaatttgtctttaaaattatctgtgtatcaaaagtattccacaccggtaaatacctttccagttcattattcaagaatataacgttttccctttcaatcccaacaaaactaggtgaaatttcgacaattttcttccatctgattagcaattccgattcattatcaaagggagtaaacgaattgaaccatccttcaaaaactactacgtcaattggtgattgatcaacaacaagccattcatctgccggagatctatcacctagtccactgaacagcgacttgtcgtacctgggaatttgccagttgatagctcgttggataatccggttcaaagcatcaataagaagaggcaagtcatgagttccaggtaagcccctacccgaaatcaatggattattgggattttcatcacttagttctttctgtgctcttcgtgtcagataaaaatcatccattgacatgccaacaatatttatacttttatagattgaactcagtcgtgaaacaagatgttgagtcaagtatgatttaccagatccttgaggccctgacactccaattatgaaagcatttctctcactggggtctgttttagctatctggtccagctgaggagttatgaattcgattgatttgtccaaggaagacataaacttgagacgctcaaacaaaaataccagagtttctcgcctgagaactctccaactcactagcttaaaacaccatgaaccacccttcactgctgcaactacaatccggctgaatttcaaaaacatgaaagttagattcattctatacattttagattaattccttaatcctggcaactaactcatcaacatccttaacctttataccagctttacggacagggggctcctccagcttcaaaacctttagcctttgttcaacagaaacgccaaggtcctctggtttaagagtttcaataggcttctttttagccttcatcatcttaggaagcgtgacaaacttaggctcgtttaatcttaagtcagtggtgatgatcaatggcaatttagccttaacagtttctgcaccaccatctatttcctttgtgacagtaacagaatctccttcgattataacctctgaagcattggtagcttgaggccagttcaataaaccagccagcatttgtccagtttggttagaatcgtcatcgattgcctgcttacccaaaataaccagattgaaattgtctttctcaacaactttttgcagaatctttgaaacttgcaacggttcaacttcctgttcgccaacgtcaactaacgtagatgtgtcgaagcctttggctaatgcaattctcaatacatcttgagatttagtaccaccaatagaaacggcatgcagcttttcaacagcacctttatgtgcagccttaatcttggcagcttcttcgacctagaattgggtgttagtggttgaatctttcaaagtttggcttaaatttcagacttacagcaatatcgtcaaaggggttgatactgaatttgacccccttagtttcaacgcctgtctgggccttgttaattctaggcttcaacgaagcatcaatgactcttttcactggtaccagtattctcaactttgttgacattttgtatgcttgaagtttcaaaaagttcctttgaaagtccctcaatgaactggcagagtttacggagagcacgaaagtgaacaatattcctttaattctacagtctcgaaaaaaaagtatcagggatctttgagtaagaagtaacactatacatcatcactttaaaccataaaatggtggatctattaattacaccctagagtatttggaacgggccttcatcttttcaatacgagccttcagttggaaagttacctcagcggctcttctccagctttcatcactagaatccagcagctttgagtaatctgtcccatacaaattctctttatgctctgaaattgcgtggtctagagaaagcctatccactccatcactcaacgtgggactgaatcgtcctggaggatctgctggcaatgctgcatcgcttttaaatgtattcactctaccatttccctcagttttgtactcattttcaaggtctcggatcctttcccttgccaggtctaaatcatgttgaagtctgtctatttgcgtgtctttagattttattattactgtcttgtcagtttcctcatttaacaattcttttgtcttttcctgtaagttattgatttctttcatcagtgtcacacgttccgtttggtgctcttgttgcctccattcatatttctctttctcttgctcccattgtttcttttctttccttaaattttctagttccagtctttcggcggaactaacattcgtatctggtacgcgagatatagaacgggcagttgtcaaagaacgatttgtaaggccgttggttctagaagcaacactcggaatagccctcctagagggggggctttgtttggaacttggagcacgcttcaatggggatgagggtccccgtttgcttggaactggagaacattttgttgttggacccaacgacggctttggccttctatcggtcgctctagtagtggaagatgggatggtggtttgttttttctttgtttcagttatggaaacttcagccgtctcacaaaactccatgatattctttcttttcctatcgtcaatcttgtccataaattcgttcaatggtcggggtcctacaattttcatcaatgttccaactacttcaaacccagcatttcggactggtgcttgtgagtcattgactaacttaagtgccactggtataagcagatcaatatgttgcggggatggggccgttttcgaatttttcaagcaccgaattaagaatttagtagtttcaacttttacttgaggtgtcttatttgccatctgtagaactgtctcctccattacagccgataaagagctcgattcaaagcatgcatttaaggcatcacaaagagataccaatactgtgggttttttctccttcgttctctccaacagtggagttaaaactagtgaaagatactgttcaaattcacctcgcaacccctttgccaacagaaataagatagtggctgtcagctgcacgacttgaacgttagcgtcttttagggactttccaagaatcctaactaacctggtataatcaccggacgccattcttggaactgctacgactttctgaacttcttccagtacttcaacacgatctttccatttagcggatgatgccctagaatccaaatcggaaggtaacaacgatagaatgttttgtggttccataagatcataggcatcaatcttcgcagaagaatcggacacaggttcaatatcaggctctgtcatagatacatcattctcagattcttggttagcttgttgagatcttagaaaccttttctgaacaggcttagtcgattctagactttcgaaagcttttgttaaatctttttgttgtataggcttcaactcggaaaatataatatctttgaacgcgtcaccaatccattggtacaacaccaaagacaagctagaaacttgagctctaacattcttatcagcatgtgaaaacaacttgggaattgaaggaaacaccagttttggagacactgtaacggcaccaaaatcttggtatatcgtgacgagtgcttccacagaaccagcaaccagcttgggtaaacgattctgtaagaatggaagtatgtgatttacaacgggttccggatcttcaagttccacataaagctccagggcttcaatggatttggactttgtaccagctcttgtggaagccagtgttttttctatcaatgagggtaccactacgtctcgcgtcctcaaagacaacgaagggtcaacaaattggataaacttacaaagagcagctacaccagcttcttgtgcgacaacatttgagtctgtgacaattttcctcaataattctggctcagatataatttgaatctctttggaatcatcttggtctatcaacttttggatctcctcgtacgctgtcagtctacatttccagttcttatattgttagtacacattgagctccagagccatgataaatcaaacatgacataccttatgtaggattctttgcttgagcggcaaggatgaataatcaggctcttcactatccatgatggtgcttggcttgtaaatgaaaggtaaacaaatacgaatttgggatttgagatgtttattcgcgatcaatcttgagcttaggggacgagatggagaagtgactgagagagtaagacatactaggcagctatcctctgagccaaaaggtttaatctactttagaactctgtatgaaaatagtaaataaataagtaaataaatgcagcctcgatacagtttccaattatggatagttagagtattctttgtattgggccacatcaaggtccttcacttgatctagaggaggaagggtgaaattccagttctcttcaccatcccgcacttcatagtatttccttagatcaattccgtgagattggtggttggcaacgttgaaccaggggaaaattgccaacagaagctgggagtttgtggagtttctagcggacatgtcttgttggtaagggttcaacagggaggaaccataaggtgattttttctctgataaagcttttttgacttcatatctatcctttgctacttctttggcgttttcagaataaccccagaacctcttggtggaactggtatatgcgtaatagaaaccaccaaaaaacccaatcgtggttgcaattctcataatactaggaggaggcattttgaaggtatttcctttggcaggttcgattttttcgaacaataccatcaaccctggggcacctatggtacccaatgcccatgttaagtagtcggaaggtctaaagtatctcaccacacgggaaaactttgggtcactgtcgattagcttggaatgttagtgaatgagctctaacgaaaggatttcatgtggcaggaatgaattacttacttcataagtttccattttaatgcgttgtagtacctctagcaaagaccaatcaggatgttttcgaagaggttgagaaatctggtcgaaatttggctcggacacgtcttaaaaggttatgtaaggaggtgatgttagatagagacgaagctgtggatgagctggagaaccttggtaatctgaacggatctaaagaacaatcatcactttgggcctagaggtttacagaggtttgggcaatttttactacattacctggtgttggagacacccaaatgctgagacatttgtacatgtcgtcggggagattgtttgaacgaactgacgagaattggaatgcccattgcaggatcataactgatgggatggaacatttatcatgtgcagtaagcaaaagtcgtttcttagtcaatcatatatcttttaacagatactaagtaaccataggagatgtgttatcttagtagaagaatgatttatatattaataatattatatctttttcctagatcgcattggtcaactttgaccaacaactatgggtgcttcaatcctaacaggcttataccactgaagttacagtaattcttcctagtgaaactgattgtgtccttacattaccatgtttttccaagcttcgttcctcatggcccaatggtcaaggcgtctggctacgattagccaactccgagtaaactcggggtaataggaaaccagaagattccaggttcgactcctggtggggaagcttctttttttctgagttgtattggggaaaaactgaggcgcattaatctattcccaacaaattccacaccaactacgttactcatgtgagagcctctttgcagtttcagtacaattaccttccattaatcatctggcatccagtagttactaaacaccctattgatgaccaaatattcactccacgttacctgattacctaataatagttagcgtgattagtaactaaagaatctcgaacaaccgatggccaacatgcttataagcggcacagcatcccactcctgaattctcaattcaatttcctgttttataccacagtgctgaaattaacaaacaatggttcaagaaattaactctgctgaagaatttgacaaggctatcgcctctggtgtcgtcctcgtggacttttttgccacatggtgtggtccttgtaagatgattgctcctgtcttggacaagttctccaaggagtatgagcaagttaccttctacaaggttgacgttgacaagttgagtgaggttgctgctcgttttgagatctctgccatgccaactttcttgttcttccagaacggagaggttgtctccaaggttactggagccaatgctgctgctatcaagcagaccataaccaagttgatttaataatttaagtaacgaaataattagaaaaatggtatggatcatgcacaaccaatgtgtagccttcccttgtttcttgctgaaagatggcgagtagtgcgttggtctcttctagcacctcaccacagcctcggtgttacaccattttcgtcttcttcctcatctctactaggacccttgaacgcaacatggcgagaaagaaatcattaatgtccgcagaggaaattcaagagatggcaaatgtcattattgagaaagaaatccagcctctctttgacactaaagaaccgtttcaaatcatttctgcagtgcggtatgatccaatagtaaacgaggaagggatcacaattgaacctacggaagaatgtttctttctgattgaccgccattgctccagactgaatttgagcactagctattttggatggaaagtccaagtctccaaggaattgctaatggaaaaattgattgaatctgtaaaagctgctggagagagccaaagcttgaaatgtcgagtctacctggacgaacagggaaacctcaatgtcgccactgatgttattcctgctaagccattcgggttgtttgagggattaaagcctcttgatcagtactcttcgcttttgtgggacgtagtcgtttcaccagaaccaatagggatatcgcccttcacttcgtttaagacgaccaatagaggacactataacaagatcagagaggctactctaaaaggtgggccagaaggaaggccgcaggaggtgctactttacaacactgctggacaagtgacagagggaagcgtcaccaatgttgctttttacagaaagtttccttcctatgtcggtcctgaaaagggcacgctgaaatggataactcctcccctaagtactggccccctatgcggggttacaagggcagagctattagcccgtgaggacatagtcgaggataggctgtttctcaaggacattaaggatggggaagatgttcttctaatgaacggaattcaaggcgtcgttcgtgggaaaatccgaatggtctctaagagcgcttgaattctcttgtcaggtatatatgttaattctattcgttaagaaatccctcaatttcgacatcactgtagcctaaaacgtagaagatgtcagccaatgattccgaattgagtttggcaggagcctgttcttggactttgggtttcgcattccaggcaactccaagaccagcaattttcatcattggtaagtcattagctccgtctccaacagccagaactgagctaaaaggtatatcgttcttggttgcaatttctttcaacaattcggctttacgtgctccatcaacaacttctccaatcgtagtgccactaagtatttcctttcctgaagcatccacttcagtcttgagagtgttggcgtaggcatagtctagaccaagctcattggaaacatattcagcaaggggaacaaaacccccactcaaaactgccagtttaattccagctttcttaagacctttgcagagttcacgagcaccaggagtgaacttcaattgtggcttcaaagaattccaaagatcagaagactcaatcccacgcagtagttccactctttgagccaacgactgtttgaaatccaactctccattcatagctgctgttgtgatcttctccacttcggactccacgttggccttggcagcgattaattcaatgacctcctgctggatcaaagtactgtccatatcaaacaccaccaatcgaatgtctttacggacttcaagctcattgaataccagatccacgccttctatctcggttgtcctgactgcatcttttgtggagtctagatggtttccgtcacaacagtcattaatttcaatctggagatctaaagctttattgggtgagagcatgctaattccatgaatctctgcgtgatgaagtgtccgcacaaactccctaatcttgtcaatactcccatcagggaaggatttgccctttgaaatagcagttaaacgataactcattgagtgggaagttgaaaaagtggagaaagaggtgtatagttgggagacatggaaaactagttagcgaaatatttcaagaggttcgcataaggagtccgccatccatccttctctaactctaccgttttctatgagtacttggatcaagggcccgatatgcggtatagagaactgttcgtcccgtctatataggtcggtggatggccgccgagtatgccgaagagggcatgtgtcggaacatcatatggatatcgatgatgacgatggggcctttgttgtaactagaaggctcaacatgagccaaggagacgatggaactcttttggcaggcggagcacgctcatcagtattctctcagcagcagaacgaaggggctggtgctcctcgtgaaagagctcatggtttagatggtcgcaaggtctgttggcaatgctaccaatatgtgcttcgaaaacaagcgcaatggcttattgaaaatcatggggtacctgcggaattcgaaaccgtagtcaaagaattatggatcttctatttaaaagggtatgaacccaccccaaaggaaaagatcgacgatgcatctgaaatagaacgacaatcaggaacagaaaatagggtacccagtctgctacatgctataagcataatatatttagcattgctgagaatgcaaattccaatatttgtcaacgatctaatatcatgggtttccacagcttctttaccatatatgagggcattttcaatactccctcgtacattgcaacagagtattcctacccagtacattaggatatttgagccaattaaaccgccaataagaaatgaactttactggatgatacttcgtgtttatcagttcattcatagagtggatcctaacccgttcgttgtggattgtagtctatttctattcaaactgaatttagagctcctattacccttggacgtgatgttaatggttcaaaattgtttatctgatatagatgagaacgtttacgaactaccactgttgaaacgggggatccacaccaattaccataatgacgtgtttcttgccaaagatcttgtgaaaattccagagttgcgtatagtggggctcctaatatgttgcactaagttctatttcttcaacactgtttccactagggtaaaagtggatataacacgatggtacacactgataaatcgatacaatttcacattcaatgccggtcatctgtcggaaatgatattcaaagattctgatgacaataagcttgccaagtgggacgaagaccaagttgatagctacttgaaatggtttgaagaaaacctgttagagcaggagaaggacaaagattctgcaaatatggaccctgcgcagcggcgcttacgggaagtatttacattacaaggcattgacaccggagagaaggtgaagaagtcctcaaaagccttcaactccgctgaggagaagcccacgctcgttgaactgtaccaatctttacttgatggcattgaaaacaacgatccttctcggtctaacgcgtcggcgagtccaacgttgaactccatacggcagcttcatgactttcttatctcccgcctatctatcacttttggagtcactgaggatagactcggtgatataacacggctttgtcaatcatccattgaggggtctggggtaaaggcaaagaaatagaaatagaaatagaatacagggccgtgccacttagtatgacgtcagggatactgggcatttttgattgtccccgcagcctgaacacccaattgttgattcaaaatgatcatgaaatgattcagtccgaactgccgtcaactgttgtaccgtcttttctttttctttttccgtcagccttacaatgtatcagctttttccgctggctgcaacgcacttccaagagattccaaccataaggcttttctttttctatcctttcgagcaagcatgacagcaaacggcatttttggtttttcaagctttcccgctggaaatgaaatttccgaagcacctgaccaattgatatcaactaatcaagatgtagcagtcaatagggcaggatgaatatgtgcttgcgccgcaatcttgtttcatctcaatcgtgccttatctatagggttttgctgctgccttctcactttgcttttcttttttttcgggttatctgaatttccctgcaaaaaaacgccatttcaactgttctttttcggaaaatctgcataatccatgcttggcggggatcggtggattgagtctcacgaggaaacaaaccccattctcacttatcactgacttggtcagcgcgtccaatcttcagcaagcagctttgtataagtacagccctgctgccctgcactcatatttctcttttctaagttttttgacacatacaaaactctcaacacagcagtcataatgaagaacttcttcaacagctccgactccgaaaagcatgaggagaaagtaaatgatgagaaggtacagagtatctcttattcacagtcaattctgtcactaccggacttagacccaacactttccagacatgctagtgaatatgaggcagatctttccaagattcagccaggtgttgcaggtgagaaaggtcaccaattgaagagggaccttaaggctcgtcatatttccatgattgctcttggtggttctttgggtaccggtcttttgattggaaccgcaaattctctagctactgctggtccgggatcagtcttcatcacatatagtttcgtcggtctcatggtgttcttcgtcatgagtgccttgggtgaaatggcaacctacatcccactagctggtggttttaccggttactctgatcgttatgcccatccagccttaggtttcgccgttggttactcatacttggccaaatatttgattgtcactccaaaccaattggttgctgggtccctagttatgcaatattgggtctcccccgaaaaggttaatccgggcgtgtggatcaccatctttttggtgtctgttgttttgatcaacttgtttggtgtcaaattttttggtgaattggagttctggttgtcttctttgaaagtcattacggttctcggtttgatcattatgctctttgtcttcatgctcggaggtggtccagaccatgagcgtcttggttttagatactggaccaatcctggtgcttttgccccatggaagggaattgcttctattcctaaagccaaattcattgcctttgtttcttcttttgtttacgccgtttttgcctattcaggtactgagttggtgggtgttgttgtggcagaggcttccagaccacgaagaaacgtcccaagggctattaaactgacattttacagaatttgtgttttctacattctatctgtcctgttgttaggatgctgtgttgcctataacgacgcagagttagttgccgcaagagcaaagtcaacttcatccagtgcatctccattcgttgttgctatcaatgcacaaggaatttcaggtcttcctcatttgatgaatgcttgtattttgatcttcgttttctccgcttgtaattcggatctttacattgcaaccagaactttgtatggtctttcagtccagagaaaagctccaaagattctttccagaactaataaaacaggtgttccttacctgtctttggccgttgccttctgtttctcatgcttagcctacatggcctgctcttctggttctgcttcaattttcggttatttcgtcaacgtcgtttccattatgggtttgcttacatggatttctctgctaatcacccacatttgtttcatgaatgccatgaaggctcaaggtatccccagaaaaagtcttccttacagagctcctttccagccatacgcttcttggattacactatttttctgcattcttgttgctttgatcaagaacttcacagttttccttaacggatttaactacaaggacttcattaccggctatattggaattccttactatttcatttgtttctttggatacaagtttatcactggagcaaagcgtcacaagtctgctgaagtcgacttgctaacacacaaggacgtcattgatgccgaagaagaggaatatgcatttgcagaggccgaacttaaggcagaaagaggtaataagaaagacgcccagtggctgtacgacaggatttttggatggattttttaaagtgtccgttacttattctttcacagtttccccttctctcatgcattctaagttattatatcgctgttttgtacattaatgacaaatttggtcataagtgcctctttatcgcattgtaaacttatacttatacttaattcttatatatacacatttcacctcaggtccttgttatcacttctcatatgtttgcctccgttgtaatggccaggaaatggaggtggtgccatcatgggaacacccattcctgattgcgataacggaggcatgtatccgcgacgttgttggttatgcgacatcatcatctgtggaggaatgagttgcggttgatatggaacaaagtgttgtgatcccgtttgaggtaccccagggccacccgaaggaccctgacctggaatcattggaatcattctaggaatcaactgttgaggaagtggtgatgtgttatgaatgggagatgtctgaccacctccatagaagaacattctattatcgggcatcatcggtatctctggattgataggaaacaaaacacgatatgattcttctatcgttgtctcccatgtaggtggggttacaaaaggtttctcaaatggagctttgggatcttttctatgcttctccaagaataagttgaagttatctttgagaattttctgtttggccacagttggaactctatttgctccaaagaaagcttgttgagagatgtttcttttagggcgagtaaaagatccttgtgaagttccagaagcgggaataatgcgatgaggggcatgaaaatctgtttgtccaccgaagcccatgggcgaaaacgatgcagtattcgggttcatcttgaacggttttttagtgctggtggtggtggctgcggttgcaggcttgctactctcatctgaaactttggaagcactacttggtgttttcgaagtttcttgtttgttcttctcctttggtacagaatcttcagcaggtttttttggaagctttagattagatgaaaattctttgagagactcgatctccttttgagccttggttttgggctgctctttagaatcaccagttttcgaatcttgaccttctttgggcttctttgttttagaggtgtcttgtgttattgcagagctttgcaagacagcaggatcgtgatgaaagttagcagctctatggttgggaggaacatatcttccggctttgtactgctttaactcagatggctgcgccttaacattcttcttcagcatacccaacaataattctcctcctttattttgagagttgtcatcatctcttagcacaccagaatacttgtcttcttcgtcaataccgctatcgtcaacaacaagacctctttcctcagcaacgtgaatgttcccattgtaagactggctttcaatctcctttgcaatacgttccgcctctactagttttcgttcgtaatctgggtcatccctattgattcgtgtagtatagagattctcgtcataagtagacttgacaccaaatttacgttcattaacttcgaattgatcccaattggcatgggtatcatcttcaaggttacccaggtcggtatctgggccttcgggtacccacttctggagctcccgctctttcgattgggactttccagaaatgtccgtatccgtcttgaaagcctttttagagtcagtattaccctcagcagcctcagcaattgctgcgggataggagttgtgagcttttgaaaaatctaattgctcaatttcaacggcgacaatgtcctttgccttgaacacgagggtctcaggcaactcttcagcatcattctcttgtgatccatcgatcaactcgggatactttacaataacagacagctctgaatcagcagcaaaatcgttgaaggaaaccagcattcccgaataagaagaacctgagcccacagtcacaataactttggagcctatggagtgtgcaagggcaaacaacaatcgatcatcgttattctgggctgcaaccttagattgttgaacagcaggtttctgagaagattcttcctttccattgtacttgcgatttgagcctggaccggacccattgaagttacgtgagttggatctcctgtggcccgatgtacctgacgaatttggtcgggcgttcttgatttgggacattgaaggcgatacggcgaacacaaaagggctttcaagtgagtgttgcagacactggtcctatttccacgaggaacgtagcagtttgagtagtcacgggacccctgaacagtagagacaggaattgatgaactatgtcagctatggtgatgttatggcagacaagataaaaagggattgggtggcgcacaggctctggtaggtaggccagtaagcgtttgcaaggggagatagaaagcgtagaagggaagtggagggggggcaggttgaggattggtggtcgcgcgacctaagtctccatctaccttacctggcactattcaattctttagatcgttatttcaacggccaggcaatgaagattgagataactaaagaaattaatattgagagcttgccattggagaaggacctcctggttgaaaaaatcaagtcagctgtcgaagaccctgagttggaattggactcagaattggtgaaaaaggtgatctctgacattttgggtgaattgatcagcaaatcctcattgcacaaattctttgtaaacgtggtcagaattcaaggagtcgaaggtcaaaacttaaacatatgcagcacttcaggtggccattgggaccaacacaaagatggtctcttgaatttcaaagtggaagtagaaggaggtatcttgatggttagtgtcgtttggctcaagtcctaatagtgttttcccgcgcccagtcgctcttcaaaccgtacagaatatcttccccagaggatcaccatctggcatacctcccctagcatcaagctctgttcgcgatttcttatcgttcatcatcttttcacgaccgcctgtcgcacgtgcgtaataacttctctctaagtcctctatttaaattaaatatttcccaactgctcacgttgagactctgccccccaataatgtccacacaaccactgttacaatcagctccaggtaagtccgaagttttgtagaaatttcaaagtcctcgtgttcactaacagtctaaaggaaagagaattgctttgcctaccagggttgaaccaaaggtattttttgctaacgagagaacattcttatcatggttgaatttcacagttatcttgggctccttaggtgtgggtctgttgaattttggtgataaaataggaagaatttccgctggtctgttcacttttattgccatgggtacgatgctgtacgccttgataacgtatcactggagagccagtgccatcaggagaagagggtctggaccctacgatgaccgttttgggcccacgatgttgtgcttattcttacttattgccatcgttgtcaatttcacattgagaatcagatcctagtgacaccttacatagaaagatactttaatgacatccgacatctatttgtgtcacttagttttctgcacctggctcaggccgtagatgtcagctacgcatcccaaaaacagtttcgcgggcgtgagttagggagacgagttctaggtcaacacggagtaacacagacccaaacgtgtcaacaggcctctccttcgcattaccagcaatgcatgctaaggttagggctttatataaagaactaatctaccttgctcgcttccaccccaatgagaagaaactaaaggacagcatcaaggcaggctttctcaagaacaaaaatataagctcagaaaatgaaactgaacttttcggagcgttggcccacggtcgctacatgtgtcgtgaattgactagcctttacgaactccaaacgtacagagccgtaaagaggaaatattatacatagacacactcaatctttatgtacaaatttagcagtcccagtttgacttccagatcgggcgcgcagaatagtatatttcaaactggaccatgcgctgcgcggcctgccagttaacgcctactcggaaggaccaccccaccattcaaatcacgcgaaagctcgctggattaaatttctatcggtcgtgtatctactgagtttctcttcaactctcactctgaaaaaaaagttcaatctttgtacaagtcagttcaacaaaagtctataaccatcatggtatgttcaatcccaaagggagtgctcaactgagaggtaccagatgatatactatgtgatctccatgttggcttaacttccccgatttttttcatttagaaacaagttcgatgtactaacaatatttgtagagtgacgccgttactattagaaccagaaaggtcatcaagaaccctcttcttgctagaattcagtttgtcattgacgtacaccacccaggtaaggctaacgtctccaaggatgagctccgtgagagactggccgagatctacaaggctgacaaagatgccgtctccgtgttcggtttcagaacccacttcggtggaggaaagtcctctggtttcggtctggtgtaccagtccgtctctgatgctaagagatttgagccaacctaccgtttgatcagatacggattggcccagaaggtggagaagccatccagacaacagagaaagcaaaaaaagaacagagacaagaagatttttggtactcaagagaagtttgccaaaaaggctgccaagcgtgctgccgaatagtcttaagatacattatattctgtctaacacttctaatgtacaaaatttccaaaaaaaaaaagatcagaacgagtactccaatggaattattctcttattcgtacaaaatttatctacaccttgatccccttagaaatctccagctttttgatctggtcctccatctgtttgatttgctcctggatctcggatagatcatggttcaacctggcacgttccgtgttgatattttgttcccattgcttgaatcgttgttcctctaccttgacttggttgctgaaagcctgtctcagagctttctcctcttctaagaatttaggattgttaatcctactaatctcgtgtgatctctctggtacatcatctgataatcttaacgatctgtaggtctcgtagtgtaattcttcagtggacaagatcaaatccaacatgttgattctcagcagtaaacttctcaacttacggaaatcacaatgttgatcattctctacttccacaataccccatggatatttcctcccggcaacaggggctgctcctggagtgacttcatgtaagtcttcagatccgatgacggcaaagggcatactttcaattaactgtctagcatgctcggcagcgccttggtcctcatgatcgattggaggagaatatattctaatatcctgcgcttcaatgatggcacgaatgttgttcttaaagtccaacatttcatttggggacaaagtatctgctttggcaataactggaatcaaattgcacctactgcctagcttcttcataacttcaacatcaagaggtttcaaagtgtgaccagtgggtctaatgaagtataaacacgcatggactcttaaatcatgggctctagctctctctggctgctgctcttgtttcatgtacagatcgtgttgatcatcaataaaatctacaattggctgaaaagcgttccggttgttgatattgtctccaaatcctggagtgtcgatgacgttcaatctcaatgtgtaattcttctcctctaattcggcacgcgtgatctcgatctcaactgttttatggatatctgatttgtgacgaaccttagcatctggagattgctttaaagtggtttggaataaagtgttgataaaagtggtttttcccaatcctgactctccagctaccatcaaggtgaagtatccaccatttttggaggccaatttgtatctgaaaagaagtgttagtactggaagtaatcaataatacagcatgtgctacgcaaaaataattaacttacctctgattgggcaaattagatataccgatttgttcagacatgtttgataactagggtacttgaagggaaatggtttataaataagtcaaacgttgaaggagtattgtcaattccttacgtgtctggcaccagtcgcgagaagagacgatcgatactcagatctcattggtacacgacctatctggcacaaaccatgatgtattatctagcgcacattgtagcagttgtcaactgatttgcactgaagttggaggttgtgtcttgtctttgaaccactgcaataaatgagcttgcagaacaaaacggttctaactccgttcattaagagcctacttctcacaccgcctaattttccgccttcagatctcactacgatcctgaagctggtggtccaaggtctcgcatcagacgttcagctggctgcttttttgactgctttgaaaatgagccgtttggaccataatcctctttatgttgctgctatggcttctgcattattggaattctcctctctgattccaatttctgactcagagaacgtctggttcaccgatattgttggcacaggaggtgatggacagaacaccttcaacgtcagcacatcagctgcaatagtagcagccggtatgggacttgatgtgtgtaaacatggtggtaaggctagtagctcagcatctggcgctggtgatctgatgacgtttttgggagtagatcaatcaaatgtcaccgcagagacatttccgagacttcgacaggcatccaaattttcttttttgttagctcctaattttcatccagcaatggcaaaagtagcaccagtacgtgctcaacttaatataccaactattttcaacctaatgggtcctttgataaatcctgccccaatagcgtcgagaataattggggtttacgctgaagatttgggccagttgtttgcagaagcattcattgtgcttgataaatccagatatggtaaggtaggaaagactatggttgtatggggatgctgtggacttgacgaaatatctccaattggtagaactaagacttggaccgttgaccctgaaactgaaacagttaccgttggttacctagagccatctgattttggtttggctgaacacactctagataccgtccaatcaggaactccttcagctaatgccgaaaccctaatttcaattctgcaaaatcaacctgagtattctgagcccgatcatcctttggttgattatattgtcatgaatgcggctgctttggctgtagtttctggattagctagtgactggaaacacggtgtaatattggctagaaaatcaataagctctggagccgcattggaacagctccgatcctttgcagatgcttctagagcatgatagatgtgtaatgagaatattaattaagatcatacgtaatatttacaccaaatccagttcttcctgctgaatttctttcttgatactgttgaatcgcaactttagtacttgagatgttattaatcgatttttcagtcgaatggatgccaatactgtaaatgcaagagtcctgaacgttattttctttcttttgagagaatattctggataaagtccagttccatcgccaatctgctttatatgcaactttagagaacttgtcagatcttggttcaaaagttgaacaactctatttgtaactatcagatcctgtaacttggattctttctccagtaatttgtactggaagagctgtaatctcttttcagtgattgtcaggtctttagctatcttcgaatcgtccctgagcttgcattttggagtgtgattctctttggatggactaataggagacatagggagctgattgttttggtcttgtagtcttgattccaaatcgagtttttgtccaaaaagaactctataccgctctagcaacttttctttctcttgtttgtactgaagctctttttcttgaagtattttttcattcattttaagattagacttcagtagctccacgtcctcttttggcacttcattcttttgttgttcctgtagtcgattagctaaacgactacaatgctttttcacagtgtccacctcatcgcttaacgattgattcttttcagttagttgctttttatcctcctccattgaaacacatagcttttctagtctttcagctacagattccacatcagtgtttctgtttttaattttatttgactcaagaatctgttcttccagctttcgtgtcagcaatgcgtttgaagctttcaaatctttcacctgagtctcaagtagggattgtagtgtattatcattggtacgaaagtcttggtttagggaagcaatcttgctttcataatctcgtcttatattgtctgcctccaatgatttcatgcggtattgagactccaaagaatctctctttcgttgaagagataacttttctctctcatattcgattctgtcctggtctctatattgctctaattgttgtaacttagtgtccttttgttgaagctttatattcaaatcagctttaacgcttgaaagctctgtagccttttcattgtatgcgtcttcgtactcttggagtttgcgctgcaaattcgagtagtcagtagacagttttctatactcagtttcaatgtagaggggagtagaaaatgtgtccctttctttggtcttttggatttcattttttaacaatgacacctccaatttaagtgaatccaactcattcaataaagacgacctttccatttcgtagtttttcttcaacgcattatagtcagcttccgatgagtgggcgcttgagtaattctccttttgtaaggaagaataggcttgattgatatgctctagctccaatttcaacttactggatttcgattgttcatgctctaacttgtcctccagatcttgaacatattcttgatactttattatcttatcaaaaagatcatccctctcattttctagacgcttcacttccgtgaaattggtctgttgggttcttgatgtatcttcaacccgtctcaaatctttcaaaaggtgttccttgtctttccgcaaaagtttattttcggcagcaagttcttctaccttctcattaagtgcaacatctgttgatttcaatcgttccatttcgtgtagctgttgtgacagcctatggatttctctttgattctctagtagttcactgtctttttcttgaagctttagttgataactgcggcgttgttcatcaagctctgattgatacttagatcgctgttcgtcaagcagcgattgatactccgatatatcattgttcttttcagccaatttggtggttagttcgtgaagcctgccctcgaggtcaatgtggggttcttttatatcctgaatgcgggatcgaagagattcgttctcattttgaagagtatcattaattttggtcagatcctcaagctcttttgcataggatgcaacttgattctcagcattatttctctccgattcgctttcttcaagttgtttatagagttcctcagctttctcttctgcatcctttaaccactgctgtgcttcttgttctttgttctgcccctcgtcgatagatgagtgcaaatgctcaagctgaagcctgtaacgttcacactgtgcctcaagatcttcattagcatcgctcatctgtaaaagttttgagttaagatgatcaatatcagctctgagtgtagcgttctcatgttcaaacttgggactactatgctgtacgggggcattttgaagttgctggttcaaatcattcagtcgcatcaacttttcctttaacgagatgttttcctgcaaagtagccagttgatcttccggggtactatccaagtaatttttcagagttgtcaattgaagcttcaaattcaagttctccgtctctagcttttgcacattgacatcagtttggcgtactaaattttctctaaaaagactgtgattgtcaattggtatattggtgttaatatcgctgagaatattgtgtggaggtgcagaaggcatgaagtcatcgcttaatatcgtgtcattgtcctgttcgtcatagttaattgaggatccgtttaaattatggttgtgtaacggtgatattcgaaaattgggatcttttgaatgaattgttctgttacttgtgggattattttcgttattactagcccgactaatgcctatgggcgtgaagtccatacttgaggacttttttgggttctttggggtccccaagaagctgttgtgtccaaacatcgaagagctggcactgtttacaaatggattaaaaacctggaatagccaaaacgcgtctcgcaacggacttagctatcaataattcgcgaaggccattagctatgctgttctcccgtggcagcggaggcagttgcaattactttgttgatagtgataactcaacgaggacatcaatgggaggagagctggattgaaagagtatttaatgtccctgaagtagcacacaaacactctgtgtagtcgggaaaggtcacctttttttgctccttagtttcttctcaacttccttgattctatgcctgaactcccctgtaatcaccgataactggtctagtttttcaaattcagattctagctcgtcacattgtttcaaaagtagctcatctctgctgatcgattgcttgaccctacttatttccagatcctgttgttccttatccttcaaaatagaggcttgggtagtttctgccatttgctcaactttatcctttattttgtacagcacataatcaaactgtactgctagctgctttacctgaaaaggatcatctctctcattgtcggacatgtttctggaacagttaatgataaagagttgaggattagataaacccctgtagcttttcattcgcttcctacacaggcctgtctgtcctcctactggctttccccatacttcgtccctttcgcgaaattttgccaactgtatctcttacacaacttccgcaacagtagttatcggataaacaaccttcctcaacatgtcgatgtctttaagtcaggttccaggtgtcaatgggaaacttcttcgaagaattcatcgagcctgtaagcctacgctggatgaacccaatcttgccttgaatctagagatttgcgatctgatcaacgaaaaacagggttcgttgcctaggcaggcagccattgccgtggtcaaactcgtaaactcgagagacccgcaagtcagtgagctctcattgtctttgttggataacttagtcaagaattgtggttatccttttcatttacaaatttctcgtaaagagttcctcaatgagttagttaagaagttccctgataggccccctccaaggtacactaggacccaacgtttgatcctgggggccattgaagaatggaccgaaacgatttgcaagacctctagatataaggaggatttcggcttcattagagacatgcatagattgttgggtttcaaagggtatatatttcccgagatcaagaaggaagacgccgctgttttgaatcgttccgaccatctgaaatccattgaagagttgcagaaagaagagagacttgcgcagtcggccaagttgcaggagcttattagacgcggtagacctcaagatttgaaggaggctaacaagcttatgaaggtaatgtctggattccaagaagacaaatcatttgaagtcagtaaacaggaggttgccgagaatatcgagaagttaaagagaaaagcagatatttttggtgacatgttgaacaatgctacgaatgtcggtaagattgatccaaccgatgaaacaatttctgaattgtatggaaccctcaagtcatctcaatctacgatccaaaagttagcacaagaagaaagtgatgatccagaggcagtcaacacattgttgtccctgaacgaccaagtctactccctcctggaaaaatacaacttcctaaaagagggcgatatatctaatgcctctaaggttaagtctggtggtggaatcaacttaattgattttgatgatgatgatactgggtcagtttctccagttaatgccaatacaaacgagtcagatgctgtggcagatcttttgagtgatttaactttcaacgagaggcaggcatctacttctgtgaacaactctaattctatcaacgatttattgaaccttggaagtggaaccattcatttgggttctccaggccctcaatctcaaattcaagaagcacagtcaccatcactccctcaacaacagtcgaactctgcacttgatgacctgcttaattttgggtctgccgctaaatccactggaactaccactgccccagccgctttagacccattcggtatggatttcccatctactaccaactcagttgtatctcaaaagaggtttttgttgcacgagtcccaccatatcaagattgaatacgaagtgcagtctgtcaacccatttcacttccgcttcttttactctaatgtggctgtgcagccagtcacatcattccaattcctggtggccgttcctaagctttgggacttacaactgaagcctcaatcttccaacttcttggcttctaacactaaggatgccatttggcaggatgttaccattacttccaaatccggcgattcttccgctaaggatgtcaagataaaatggaaaattgattatgctgtcagtgcagtaactgccgttgaagatggtgtagccgtcattccacaatcgcagtaacagttagggttgcaatttgtaggtaaaagaagaataattacattgattaattatctaaccctatttatttgtatcagtagtttgtttagtatcagtgtttggggaagctgagaggtttgaagacgctgatgctgactcctgtcccctgttggctacttggttcatcttatttctggcctgcattgctttaaatagagtgatctgttgtctttgttggggagtgaggttgggactgttttctagagcatccaacttttccttggtcaagctagcaggagttgtaggtgatgcattcgatgttaccggggaagctgaaacaggaggtccagctgttgctcttgtgggtgtcggcacagtcctcacttgaggggtagagtggccgttagaagaccgctcccgttgattctgtaagttctgaatatatgcaaccgcaaacttagttacttgatccttcgacatgttggggttctgtgcttgtatttgatttattagggcgttcacttgagcaggagtaaggttaattcctcttgagggtgatggttgctgctgtgaggctgtagcagctgactttgatggcgtagtcgaagaagaaacagcatttgctggtgtggtgacattggtattcgttatgccggcgggtcgattaggtacattggatttgtttactggtgtcccggcactagtttgcatcatttgtctgtgtctttgtgcttgcaagaaatgttgtagttgctcttgggtaaaagagttgttgggtccaggcctgttgccattaggagtaccagttctatttgtgacaggagtagtattctgagaagtagctactctagatgatacttggggttgtcttgtattgggagtaccaggctgggttgaaggaacgccaggtgctggagtagtggtcttaggcaaggttccttttggaggaattccattagtatagggatgagtgccagtttgctgtgctgaagttggcaggggagcattttttccttttgagggagataaagccgagctttgtgtatgtggacgtgcggaagagaaggttccagagttttggtgcatataagcctcttgaattgccttgtctctatcatacttgagtcttgaaagttcttccggtgtaggaacatttgttctcttgtcatcactggtatgctttctttcgacttgactcgaacgattgatattttctcttcttctcatacattttctcattgcatcaagcattgatccccatcttaatctgcggtgacctctctgaatcgattcaataccaactcctagaggcgatattcttctcttagtggtgctttgggtcttatgtgccgcctctaaccaagcttgggctgattgagcatactgacctctcatatcagtgaactggaacttatcgttcaattgaatatatctttcaaaacattgccaaggggttcttctctctatgtttgccacataagccctagccggtcttgctgataaatgagcagaaataatatcccagttaaaagcatactcagcaacataccgaatcaagagcttgtcatcttgaggaagccaaatggtgggtgtcctcaactccaagttcttgatagggggtggttttgggggcttgagaacattgtaccgtcgctgactcgaagctccaaacaaacctttctgatagtctagcgatgcactgagttcacttgcaggatcacgccgaataacaatcttgtaccattcatcatcctctgggggagccaacaacgtagatatggcggctataggagctttctcatattcgcttagcttcttcttggagtcagaaagattgtcatcaaatatgaatgacaaagggagcttttcaacaagaaccaaatcttcttttttaaagtcatctagtccaatgtgtagcttaaaaggttcggcattctggtttaatctcttgtaatcccccatggaatacgtaggaagagcggggggaatgatttcgtcttttggattgggtcgttccaaaagctttgctacatcaattgtcgcattttcttcaaaaggctggttttgctcttgatccatggctcgaggctcctcttgtgcatccttaaatatatcattatcatcatggtcatgttcgttttcattatctacctcggtcttcattaccttcgttactgttctttccttaatctcttcatccgtcaaaaaaataaggggtttcctttgaatacagacaatttttccataagtccaataatccgaaaccgcttgggccagctgtacacaagaagcggctttaaattttctttcttccatgatatctactgaaagccacttcatttcagcaagaagatgatcccaatgagtgggtgactctctggtgaagggatctataaatctttttggttgcctcaatgaccattttcgttgtcttttcaactcttctattcttgaataaaggactgctattttgccctctaacaacgctgattcgtaggcatctgtggttagagatttatgggatcgaggaagtagttttgccaatggaaatgtctgtgttagataataaagctcggtcaacgatgcagaatcagctattttgtgaggatatatttcagggagagcttgaattatcgtcttatttcgatcaagtaattcaaaatttaaatctctatcagttggatcgtccggtcgtatgggaacttcatcttgtgcatactttcgaatcaaagaggacaaagtaggtgcttctgattccgttacttcttggtgcatcatggtcatcttagattccttatgggttgctttctgtggctcagctgaagtactggccgttttctgtttcttgcgtggaggttcatccttagtggtctcttcgtcttccttcacgggccagtggggagattccaactggtctgcagtagagacttccttagagacgggaggctgtttttgagacttatcgcctgttagtgttgtaatgttaaattgccgtccctgctccaagtcgttacgttccaagaatcgcatcaggttttccccaatctgtgatacctgagaaggggagattgggagcagaggaagacgtgatacacaatacaattctgccaacttccgtttcctctcattgagaatgcgctgcaaagggtcgtcattagtaccagatccatcctctggttgccgtttaggggaatcgtgtttggatgatgcagttacatttgagtctagactgctcattctggcgggattaggaacaccttggttgaggttgaggaaggtacatcgaccggaattctgcgctcgatagcactgttaagaaaaaaaaacacaacgtttgtttagatatgcttatgtaatcgtgactatattagatacttccctgaactgtcagtttggctttacgtaaccattttcgggttctggtaaaacaggtcatggagtccgtgtaactcggggatttccaattattgttgtaaaagacccatccttcaggtgatttgttgtcgttaaaactgaggtcaagtaaccagtctgggtcaacccaagaccatttcattattagtaccttaccatcaggtctagagcttgtcgttggaattggaggaaattcaaattgagttaaaccgtgacactcttcaagaaattcattggtaaatgcagatctttcgaaaggaaggaggtaggatgaccaatccacacccagccatcgacgttggttttcgaaaacctggaatgtaacaattttctcctgcaatgacatgtctgctgtgtgttctgcagaactgagacctctggcaagttgagcagctgataattgtgcatgtagaccgaccggcagtccagtagtaacagctattaactttcgaatatacagcgatctccagagtaaccttctcgtagcaatgttccatgaggagtgataactaagtaacaacacgcctaacgataggatagcttgtttggtggatagaattgacgtcattgcaaagatgtacattggtgatagtgcaaacacgccaataaataacttaaacaattgtctgctgttcagctttttcattcttgttagtggttcaaaaagagcatcaaactttgtgttgatattggataaagtgtccacgatttcttccagagttggcggttcttttgagtcacgataaaccatctgtgtaaaccaagccgtgctagaaaatataatagcaagcaatagaggtaaaccataaaaactaaccagcccccagtatttcacgattgtgataaaaacagagatacaaagaaaattgtaatagggatccttgtttgtccaagtcgcaaatgaaaggatgtgatcaactaatagcaaaagcggaaatgatccattgagagcagatgctacaagtggtgatgtttttggaagcagggccctggtttgaccaattctggaggaattacattgtggagcaaacgctgcgtatatttgattgtaatgctgagtggaaacaggttcggtcactgctggttctttgccatctttactaggtggatctgccattggttagctcgttaaaaaatcagacgaaacgaagtaaactgcagtacatggatgaagataggggaaaggccgagtagaggggagagcaccacccaattaccccaaaggctaaaagagaaatgcgcgaaaacctggacactatcagaaactcaaagaaatacttgaagctctctcccttgatttattctgtcttattaacaaccaaattcaaaatgtctacagagaacaaagcagagacaaaacaaaccaacttcaaagctttggaagaggatgacgagtttgaagatttccccgttcaaggtaagttatcagcagtgtcagatcgagaagtggatcaactaacgactgaaatagattggccaaatgacaagaccatcacagctgaaaaacaagagcatctttgggatgagagctggaatgatgacgataacgaagatgatttcaccaaaagattgagacaagaactcgcaaacgctgaagcaaagaaatagactggtaactatagaagcattacttatcgaaattgaatgcgtattttacaactgattgatgtatatactctctcatcattgccattgatcagtctgtctttaacttagttgaaatcaggctaattttgctctaggcgttgcctcctcatgtcattcaaaccttccatcttgatgtcttggacttactaaacgacgtgtactgcgtaatatatctcaagagtggcaagaactccagctctcgagctggatctcactcactctatctacctcctttccattccagtaaataaccatcatgtccacacaggaagaggccgcagagccccagatagatcaggagattctcaactcgtctaccaatgacattataaaccgtgctaaactactagataatgagataaagcttttcagatcggagctattgagacttaaccatgagaagcaggtcatgacagataaagtcaaagataatagggaaaagataaaaaataacaagcaattgccttatctggtgggaaatgttgttgaacttttggaccttgaagctgaacaagacgcttccaaggaaggtgccaacgttgacttggattctactcgtgttggtaaatcagctgtggttaaaacttccacgagacaaactgcgttcctacccataatcggcctggtagatcctgaaaatttaaagccaggtgacttaattggtgtgaataaagatacatatttgattttggatacattgcctgccgagtacgactcgagagtaaaagccatggaagttgacgaaaaacctacagaaacatatggagacattggtggtttggataaacaggtggaagaactcattgaagctgttgttcttccaatgcaacaagctgacaaattcaagagtctaggaattaaaccccctaaaggtgctttaatgtatggtcctccaggaacaggtaagaccctactggctcgtgcatgtgctgctcaatcaaatgccacattcttgaaattagcagcaccccagttggtgcagatgtttatcggagatggtgctaagcttgtgcgggacgcttttgctctggccaaagagaaggctccaactattattttcattgacgaattggacgccatcggaacaaagagatttgactctgataagagcggtgacagagaagttcaacgtacaatgttggaattgctaaatcaacttgacggtttcgggtcagatgaccgtgtaaaagtgcttgcagcaactaatagggtggacgtcttggatcctgctcttttacgttccggacgattggacagaaagattgaattccccctgcctacagaagaatcccgagctcaaattttacaaatacattctcgtaagatgacttgtgatgacaatattaactgggaagaattagcaagatctacggacgaattcaacggtgcacaacttaaggccgttactgtggaggccggtatgattgccttgcgaaatgcacagaatgttatcaaacatgaggactttgtggatgctattggtgaagtccaggctcgtaagtcgaagtcagtttctttctacgcttagatatcaataacatataatacaaaaaaaaccgaattaactctttttagaatgggggaattgttgttccatttccacgatagctttagagagttgagctttagtaagtagaatcaatgacatttttggttcaataccgtagtcagtgaacactctacgagcgtcggactcttgaactttacggttatagttaaagtatccgtaattggttgagttcttctccaagacagtgtcctcataatggaaataatccatctctttcttggaactgtctgctgtcttggtcttcttacgtttattagaatcgtccaacaatttgtcagcttcagaagctaccagttgatagaccttagatacgacaataaaataatcgagctcatactcttcgtgagagtcttcagacttctccatttcttctagcaacatcttgtacatgggagggacagtttccacaggcatattgatcagtctttcactgaaaatgaggccggtcttgtacttggaattttgtttcagtaactgtctcaacatgatattgaattcagtactcttgcttgtctttgctaatatataatccactaacttggagaccgctgtttgtttcaagttcttagtgaggttcaaaactgatagtatggagaatgggtcaccgccctttccatccgttttgacagtagttccaacatgaccttcttctaaaagaaggtctgttagtgctgacaattcgatatccacgttatcatcgccaaacagctgtcttatgaagtttttgactgaatgaaagtctatctcggggttaaagtcaaaaaaatcaaaatccacgtccacaatttctggttcttcgtcattggtttgaagctgaggttgctccaattcttcgtcagtggagctgagatctatatccgaatctgagtcttcttgtactctttttttgctcatgggtagttgttctcgtacggttttcagctagatttttttttcttttatttgggcttcgctatctcatcatctcctaatatttttggtctaattacctttaacataatcttcccatggatatagggtactcttcggaagacagccatgatggacccgaagaatccaaaacggaagttatcatcccaaaagatgttataacggatgtgcttaccgagttggatgaaccgtccactgctttcactgtcagcaccgtaaaaccgttgtacgaagtgccagaagaaacgaacaggaaattcaaccctttccagagagaggctgttgatgctgtgacttttaaattgcagaagagatcttttaacagccaattaaacggttcgaatcgggcaaagagtaagaaacaaaagtctacctccaaaggtgacatcgctatggttgaggggcccaatcggtataaaggatcctggggttccagctctgacgaatctgagccttattcatattctgagccagaagagattaattctaaacctgactatgaaaagactgttcaattgactgctaaacctttggaagacgagtcttccgtgatatactccaaagaaccattcatgcacattccaaggggcgttggagttgacctcacgaatgagccaggaaccagggaatgttttgtaccaaagaagcggatatttcaatgggaaggtcataaaagaggtactaataaactgcagtttttcccaaattctggacatttgttactatctggaggtaacgatagttcagtactactgtgggatgtctatcataatcgaagtcttttacaaggctattatggacacactaagcctgtaaaggatattagtttcaataacaatggtacacaatttgtaagctgttcttatgataagacagttaaactatgggacacagaaacaggtaaatgttcgaataaaataaaactagcctcgttcccaaatgttatcaaactgaatcccaactcagataaacaaaacgaattactaattgggcttacggatagaaagattcaacattatgatttacgttcaaatgagatcattcaaacttatgatcatcatcttggcgggatcaacagcataacttttgtcaacgaaaatcgtaactttatgacatcttcagacgataaaaccgttctagtttgggatttccagattaatgctcccatacgattcatatcagaccctcatcagcattccatgcctcaaatagcattacacccagctggtaagttcgttgctgctcaatcaatgaacaatacaatagtggtatttggcgccacaaatagatacaagagaaataacaagaagttgttcaaaggacacaatactgcaggctacagtattggactagcattctcccctgatgggaaaatattaggcagtggtgacacctatggtaatgcatatttttgggattggaaaacttccaggttggtgaccaagctaaagttagattcaaagccactgagttgtatcgatatacatcctcaggaaaccagtaaagtggctattgctggtttatcaggaaagattcattacttagagtaagctatattgtatactaaatccatttttggcaataatatgatctcagaaatccaccctcactatctcaaaacttttttttttccggctcctacctgatctatctcaacgtatttctgcaacaagtagagctcatcacgctgcaaagatgaaagaagtggtggttgatgttgctcctaaaagaataaagggacttgagttcaatgccctgagttctgatcagattattgcgcagtctgaagtagaggtcaatacaagaaatcttttcaatctagagaaaggaagagctccagcgaaagatggtgccttggacactagaatgggtgtctcctccaaatcaggtgagtgtgctacctgtcatgggaatctggctacctgtcatggacattttggtcatataaaattagcattaccagtgttccatgttggttacttcaaagctgtgatccaggttcttcagacgatttgtaaatcatgtgcaagtgttctattagatgagaaaaccaagagaaaagctttggaggacttgagatctcccaataatgataatctaagaagaatgaagattatcaagagaattttagaacaagctaagaagcagagaagatgtctcaaatgtggagccttgaacggtgttgttaaaaaggcttcagcgggtgctggccctgcttctttgaaagtcatccatgacacgttccgttggattggtaagaaaccctctcaagagaaagtagaatggtatgaagatttcgataatttgctaattaataatccagatcttgaaaaattcttgaaacgagcttatgatgatttgaacccgttaaaagtacttaatctttttaagcaagttgatccctctgactgtgaattattaggtattgataccacaagaggtggcaggcctgaaatgtacctatggaggtatgtgcccgctcctcctgtttgtatcagaccatctgttctgatgtcagattcaaacacgtccaacgaagacgatttaactgtcaagctgaccgaaattgtctggatatcaagtttaatccgtgctggtatcgagaagggtatatctataaacaatctgatagaacaatgggattatctacagctatcggttgcaatgtatatcaattctgatgccggtaacatgtcgatgttaccatctgcagctggatctgccggatccaagagtagtaaaccaattagaggcttttgtcaaaggttgaaaggcaaacagggaagatttaggggtaacttatctggtaagcgtgttgacttttccggaagaaccgttatatctccagacccaaacttaaggattgatgaagttgctgttccagatagagttgctaaagttttgacgtaccctgagaaagttacacgttataataaacataaacttcagcagttggtcttgaatggtcctgatgttcaccctggtgccaactaccttctaaagagagatgagcagaacagaaggaatttgagatttggaaatagacagaaacttgccaatacgcttcaaattggagacatcgtggaaagacatcttgaggatggcgacgttgtccttttcaataggcagccttctttgcatagactttccattctttctcattttgcaaaaattcgtccttggagaacgtttagactaaatgagtgtgtatgtaccccatacaatgccgattttgatggtgatgaaatgaatttacatgttccacaaacagaagaagcccgatctgaggccatgaatctcatgggtgtaaaaaataacttattgactcccaaatcaggtgaacctatcattgcagctactcaagatttcattactggatcatacttgatatctcataaagatacttttttcgacagagcttcgctggtacaaattttggcatccatgtctgatggcatagaacattttgatctccctccaccttccattttcaaacctgcatatttgtggaccggaaaacaagtgttcagcttgttaattaagccaaatgccaagtcaaatgtcaacataaatctcgatgccaagtgtaagacatttatcccgcctcctgctggccagcctagtgaaatgtcacctaatgatgggtttgtcatagttagaggatccaaaattttatctggggtaatggataaatctttactaggtgatggtaagaagcattccgttttttacaccattctgagagattatggacctcatgaagctgccaatgctatgaacagaatggcaaaactctgtgcacgataccttggtaacagaggattttcaatcggtataaacgacgtcactcctggagatgagctaagcagagagaaagaatgcatggtagaagaagcatacaaaaagtgcgatgagctaattaagcttttcaaccacggaaaattggaaacccagcctggctgtaatgaagagcaaactttggaagccaagattggaggtttactttccaaggtcagggaagaagtaggagaagtttgtattaaagagcttccttcaagtaatgccccacttatcatggctacttgtgggtctaaaggttctacattaaacgtttcccagatggtggctgttgttggtcaacagatcatttcgggaaatcgagtccctgatggcttccaagatcgttccttgcctcatttcttgaagaattccaagacaccccaatctaaaggttttgtcagaaattctttctattccggattaaaccctccagaatttcttttccatgccatttctggtagagaaggtttggtggatacagcagtgaaaaccgccgaaacaggttatatgtctcgtcgtttgatgaaatctttggaagacttgagtgcccaatatgaccacactgttagaaactccagtagcggtgttgtgcagtttacctacggaggtgatggattggatccgttggatatggagggtgatgctaaacctgtcaatttcaaacgaacttgggatcatgcttacaatatcaccttcaataatgaggacaaacccttgcttccttacgaaataatgaaaattgctgattcatttttggatccattgaaggatcgtttggtcagacttgataaccttggtaacattgtgaaccctgaagatgctgacaacattgagtatattgaccagtttgatgccgagagaacattttatgatacactaaaggatttcctgttccagaaaaccaaacaactcgcagctttaagagaaagtaaagggtttcctggtttactgcaagaaccagaatctttcgttgatgaaagtcccgatcactcagttagtatcttgattaatcaactttatagaattactgaggctgctgtgacaaagtttttagaactatctgctaccaagtacaacagagctaaggtagaaccgggtactgctgtgggtgctattggtgctcaatccattggtgagccaggaacccagatgacattgaaaacattccactttgctggtgtcgcctctatgaacgttacgcttggtgtgcctcgtatcaaggagatcatcaatgcctccaagaccatctcaacccctattattaacgctgtactggtgaatgaagatgacgagagggctgccagagttgtcaagggaagaattgagaagactatactacaggatgtggtttactacattcaggatgtttacaaagaaaaccaggcatatttgcaagtcaaggtcgatctggaaacaattgaaagactacagcttgaacttaacatcgatgaaattagactagccatcgtgaaggctcccaaactgaagctagctctggaggatgtaattattacaggcagaaacaagattagtgtctgtgtcagtgatgctttactggactccatttcaaagactgcagctgctaaggggatcgacacaagttctactatggcgaatgaattattctttagaatgcaacacttaaagcgtgtgctgactaaggtagtcgttaaaggactacccgacatatcaagagctgttattaacattcgtgatgatggcaagaaggaactgcttgtcgaaggttatggactgaaagaggttattgcaaccgatggtgttgttggttgtaaaactaagacaaaccatgtgctagaagtttacgagaccttgggtattgaggctgctcgatcgtgtatcattaacgaaattgactacacgatgtcaaagcatggtatgtcagttgatcctcgtcatattcaattgttgggagatgttatgtcctacaaaggagaggttttgggaattacaagatttggtttagccaagatgagagattcagtcttgcagctggcttcctttgagaagactaccgaccatctgttcgatgcagctttctatatgaagaaagatttggttgaaggggtttctgagtgtgttatcttgggacagacaatgactatcgggacaggagctttccaacttgtcaaaaagacagaaacacaaagagggcagttagttgcgaaaccgacattatttgacgatttatcagagggtaaatccatttctgtggcctaaacctactgaatcataaattttgaccttaacctaaacttaacctaaatagtgaacctgcaactggaaaaacaaaagtacatagaaataacataaaaacaataggcttttagtgcctctctggccagtccaacgcacggtcgatgatcagtacagctccgttagaaacaacttcaatctgtctcaaaggaaacttaggctggtcatctacacttatgtagaaagttctgtcagagttgaataaatttatggtttgaccattcaacgtggtcaatacggcggtcccaatgttggcaccctcttcaagatttaatcctttatcagaagtgacaacaacatgcgactcaacaaagttgttgatatttgcagtcgaagtttcatcctttaggttattagtctcggtgatctcagatggccattcccatggcttcttagataactctttgatagcagtatcagtcggagcaaagatgagtatctggttagacttcaaatcggcgccaagctcatttgtgagatcaatattatcacgaatgtatgaagcaaaaacggaaacctctggtagctgggttaaagtagtggcaagtaactggctagtctttggtttaattactgtatagtcaacatcttcggagccaccaaacgcctcggtattagcagggatgacaatgtcatgtttgagaaccccttgttcttcatcatgttcgtctctttttcggagaatatcaatcaaagagtccccttcccctggagttttaatttgaaggttgtcttgaagaccaatgaccctctttcgttcacgactttcaaggtctgtgtcatcagggcttattttggcgtccccaaaacgactaaagtcaacgacgtttttagattgcacgttcaacagtagagcgcaaagtacggctaagtattgtaattgcatgcttccttgttagttcaagcgtggagagaagtaggcaatcttcggctggttctgggctgacagggtaggtgtcgcgaagtgagtgataatgcttatgtcatcatcactttcttcaaagattcttcccacacaaaccaaatcagaggacaaccacacatgagagatagatacaacgcctacattcacaatagcaaaccctcacaagtactgtatcaagataagttgcagaatgatgaacttccgtttgataccattccgttgaatttcgctaattattactacagtggtaacgctctgcaacagttaagctgggaaacagaacaggacgaagaagacttgttgaacgagtttcaaagtaacgcatcagctgcagctataaacatgagatttggaaagaaaactaaaaaaagaaactggaatgatttaggtactggtctttttttgggtgaattagaaggttctaatactaagaactcgaatctggaggacgaaacaatacttgaaacggtagacaaatcgttattcgaacccacctctctcaaagaagattctctggggcaaatcaatgttccttggttgtcgataagcgaaccttcagtgagttttgatgattccaactctcacattatcaatgcagagtctgaaatttcgaatccagtggtccaattaaacgtgactacccctgaagtctctaggaaaccatctctagggagaaaaaggaagacaaccgtcccgtccacatctaccgtgtatgaaactcccatatccagaagtatcagatgacgtcgttgtgtttacacttttcctattcgggtaattttaattagtacctgatccgatcccattgagatggctggttttttgatctgttgaaatcaatgaaccgtggtttgcgccctggggtgtatatataacggtgtgatgctgtactattagtactcttcaatccaattatgaagctcgctgcactctccactattgcattaactattttacccgttgccttggctggctatgctccacccgatgattggtcgacccttactgccaaaggagtgtacccaggtgccttctcatcctattctaatacattcggtataatagttgaacctttgacgagctcagtgattttaactcctgctactacgactcatgttgtttcacagattgatgacggtcaaattcagcacactaatacagcctatgtaggtacagctcaccaagttgtgtctcagattggtgacgggcagattcaggctacggcttctgctgtcccattgcctactgagcttgcttctcaaattgctgatggacaaatccaagcaactactcctgctggagctcccgccactccagcttctcagatacaagacggtcaggttcaagctacttcttcggctgatgctcaccctactgcacactcacaagctgaagacattggggcccattctttaagcagcactggtttgattcctggtacattgactactgtcttgacttcaactggaagtgacaccacactgacccttgtaactgtcgagactgaagttgtcacttacacaccagaagttacagttactgtgaatcggaatgctgccaaagtgaagagggataacattgaatctgcttgcttaaccccacaggcccttggcctaaccctaaaggattctgttttattagatctccaaggcagagtcggctccatcgtcgccaatagacaattccaattcgatggacctcctccgcaagccggtactatttatgctgttggttggtccattacgcctaatggatatctggcattaggtgactcagaagtcttctatcaatgcctgtctggttcgttttacaatctatatgatcagcacattgctgagcagtgtgaagctgtccacttgaaggctgttgatctcatttcatgttagaagggagaaaaagaaaagttatatcaagatagacttacaagacattcgaccaatgcaataagacagaacgcctgaaggcgaatcacagtgacccggttaatattagatattttgtatgtataaatcatagatattccaatcttaaatcttacctattcggtagatgctaattaaaagtaaatgtcctgttcttcatcgtcatcatcaccctcctcgtatgtaacgattaagtttcgatctcgtgccttttccatcatgatattccagtcagagttccaaatgtagtacatttcgcttgtagctatgagtaaaagtcctgtgcccaacccaatccacaatccaaacaatctcaaaccgaaatatctactagaaatgtatgaaagtggaattgcaatgagatagtacattgctaagttcaggaagcttcctatcatttgaagtccttgggctctcatcatacaagattcaacagctgctaaaccgtcgaatatctgaattgttgccacaagagggagtagctccacaatttccttgatgacctcggggtcagttgagaaaaagcgtgcaatataacttctcccaaacatcatgacaaaacaatttaatgatgcaacaatcagggccccatagagtccaactttgagtgtaatcttagctgcggtaatatttccagatccaataaaatttgccactctcgttgcacttgcgatacctatggcaaaggggaccatataagttagagaagccaaagttgaaacagctgattgagctgctaatgcagtagttccaaaactggaagcaaataaagtgagaatctcgtatgcaaagtactctgcctccaacattaagattccaggaatggcaagttttgacaagtctgtccattgagtcagggcttctttagtaaatcctccccaacatttcttgccgtcgataaagagaacatagagaacgagaaaggaaaccatgagccaaaaattgatgactgtagctattggagcacccacaaaacctagtccgatgtaccgattccataccaaaagataagtagtcagtaaattcaagggcgctgtaatgaataagataatagtaccagcatcaaatatagactgggcctgaagaaacctcttaccattctcgaacatgatatatgccggtactccaagaattgatactcggagatattgctgagtcaacttcaatacctctgggtcactcacaatatgcttgagcaggtgtgaaatattgaaccatataagagaagttggtatgctgatggccaatgcaaaatacgtacacctttgtagatgtactccaacggtgagtatattacctgatccgtatgcttgagggcaaagtgtgtccaatgcagtggaaattccttcaaatactgctaacgtgatggtagcagtcatggaacctaaggaggcagcagctagttcaatcttaccaatacgagccactgttaaaatgacaaccactgagaaaagttgctctagaacaaacgttataatcaatggaatggaatatctaaccagtttcttggattcatattcaaaatcaacggtctcagtatcaaaatcttcctcatcctcctcttgctgatcaaccaatatttgactaataatggatgaggcccttcttgcatgctgattacctttaaaaatcaaaccggtacggggcaacaaattatcctcctcatcaaaagaggatctgatacttctacgctctgaaaacctcctttcgttctcttctagaagccaattatattgttctggttccggagaatgctccagagtagatggtaatgaacgaaatgtgcttaccgattggttgtcatccagtgcactttctctttcactgttcaaatgtgagctggaacaaagagaaagaaacgaacgattatcaatcgcattgttatatacaaataatggagacttggtacttggtggtacaaaggttaaaggaagttttctcctggttgaattcaacctgatgctctttgaagcctgagcacctctattcagagcatttaagagctttccaaacactgtttcattattggtaagactgcttctccgggagtttctccttttaatgactgatctccttgggatgtcattctcatgttcagattcctccaagtcatccaaactttgatagttgaaccttgtcatggaaaatccaatgcaacgactggattcagttttctttggattatacggtgcaatccaataatagatgccttagaaacgctgtattacctccctcctatgttgcaaaggattgtagttacagttggttgttgcgaaccttacctcatcacaactataacatcgcgaactaggtgggagtgacagatgaaattgagatggaatcgctaaataaaacgcaagtatgatacatttaactatacatgtgacctaaaaaacccctactgagcttctagtagctcggaacccattataacaaaacatgaaacatttaacagaaaaggaaagtggtcaaagcgacaagagtcataacaaccactgggctagcggcactgagagaaacaccagagttgataggatcaacaacaggagtagagttggtatggttggaagaggagtctttgttagacaagagactctgaattgggacttcttctctcttagaaacaccaccagtactgaaaacttcaatggtaactttggctcctttagaaccagtgacaacacaagagttggcacctccagcaccatttgagctttgagaacttgagacctcgttaacgccgttcttggaaggatcgatttcacatggaagtccattacactgaccttcggaacaggtgattttgacaccgaagtcaggcttagtgtttttgaaaggagtagcatcttccaagtaaattgggttccaaccaattttgacgaaggagttaccagagtcgtcgacgtttccaccggcaacgtaaggagaccagttaccgtatgggttggcagtggaaccccagacacaaccgtcttcggtggaaactccaggtgggttgatgtagtagtgtgcagcagttgaagcccagtactcggtacctggaatagcaaggtcctcggtggaacctccgtcaacgttggttggaatcaacatagcttcgtttcctggaaggacggtctgacagaaggcaacgttggatccagctttgttgctggcttgcaaagttcccttacctgagtaacaccagtctttgctggagaatggaacctcgatctcaccattttcgttacagtagataccaccacgctcagactctgggtaagaataggaagtggccgatgggtcccattgagccatcaactggcctggtggacaagcataaggacaataagaacctgctgtgcactcctggtctggactcagagcccagcctccatttttggagtttggtgtaacagcgaccaagtttttgtcagtggggaatttgcaggtagtagctctcttctctagagtagctctttggtgctggtggtgctccttgaaagcggttgaagctcccattgagacactggctagagtcagcaaaagttggctgatgacgacactgttgaattgcattttcttaaaggaatgtgatatagttggtaatactaaaaaggaaggaatgaatagtcggtgaagtgatgcaactaccagatattatgtcaaagttactgtgtcttgagaaatatggggagggagtcgaactgatttcaaacacaatatatatacaagggcttcttttcttttttgaaagatatgcaagagtttcctgggacctttttgaattatttgctaacacattttaccagtggctagagtgacattcagtaggacaaggattcgcatcttttctttttgttgatccaaagttgaaaaaaccgttgcaaatcagtcttgggcgcgcacagaagagattgcatatgcatttaatttattagatatatgaggttatgagtttcatgcacttcgaacactgagtctagactctaaacctaggaaccacctagaatctgggctgaaacctcagcaattttcctgcacatatgatttcaatacaatagaatcgggcaagcgagaagattcaattaatccttacattcgtgctcactctattggactaccaatttggatcagtatttcagatcacttggcagcagcttgaaagttgcaacatcgggaggtcactcttttttccctccagtctgtgacggctggctaggtgtcgactttgatctttgccgttggatggtgagctaagtgaaactcgtcaggcctcccctggtagccactagttacacagcttttgatctcaaaaccatagtgacgaacaatcaggtatttgccgctagaaatctgccggggtatggtaatccttttgcttatgacgcactgcctcaatttgactaaatagttacatgaagtgaagtgcctaggttaattttgcactcgagtttattcccaaagtggtttttggttgcatgaccttccggatcattaagacgaattggtaattatactgtggtacacgtctgcttttcagatgtgatggtgcgaggaaaatttttgaaacagcaagatttttcgtacagatttacagccccacggttgtgtcagaatcgggcctggaatcaacacaaaaaaaaaacaggatgagtctatttgaaactgtcttagtcattgattcaaacggttctagaatcaccgtactctccaatggcactagtagctagctgagtagcctttacatcgctaatctagaagctgcctgaactgctaattgttgacgcaactatatgtactattcgaggctttgtccgtttttgttaattgcgggatttgccaaaaaaattagtgaaaatttttccaaaaagtcactgctccacgggaggctcgaactctcgaccttcagatagcacacctatgcagtatgagactgacgctctaccgactgagctagtgaagcttggacactgagttttttttgactcttaagtatatgcgcaaggtctgtcctcgaagtttaaaccttttcaacccttgatgaagtacagtttaaaaagattatttatcaaagaatattctttttttactatactgactagctcgggaatatttacgcttgaggaagaaactaactgatgaaggattcctataattaaggcctatacaatatttattacgttttaataccttggagcattgctataaccattgtcataggcaccagcatgagagttgttgtattcacccccagctctgttgcttcgttgctttatctgtcttcgagagctcatcaacgtcttgaaaccgttacacaatgaattggtgtcggggtatacattgttggccagcaaataaccatcaggaagtgctttcacattccatatcttgatttctgaagttggatttagtttgaacaaaaggaagaaccaacctggagcctttctgttgaatgtaaaaatgtagtgtgatcgattcccgttagccttcgaatatctttccagccattctttgacatagtctaaactatcactcataaacttatcatgactcaccatcagttcaactttattggcaacattgttgacatattcaaccagaagttcatctagatcgtggtacctgtattttccaaccaggagcacacgaccaatggcattggcatcatctttattctcttcgagaacgtcaatgtgctgatacaattgcggagcaactttccaagagattgtgatgtggttgctacccttcgaagatggtctaataacaacgtcgccgactggtctagctgccaaataatcctctgcttctttggacttcatgttgtggaagaatgggtgcttaatcactcgagattctcgactctcctctctctgcttatcgatttcttcttgtctgtctctattttcggattcaatatcccagaatttagggttcctgttgacattgaggccagctacttggttctcagtaaactggcgcaataaggacaattgacacttgaaattgtagtaatctacatccaaaatgcaggccctaacagtttggcccacagaatagacttctcttggatcacgtctatcgtttggttcaagaatatcttgtctttggatatttcctgcaattaaagattgagtagatacgctcatgtaacttgattccacttttcgaacataaactgggatcaccatacctttacggaaagaatcaacagtctcacgcgttaatagttggaatatttcagcttcgttcaaaatgtggaaatcccttctaatctccctataacgagattgtaactcttcctttattatctgcaaggtggaacgcttcttcagttgatgttttctttcgagctcagttgcgtagtcatccaaaatcagttcgtcaagcttaaaggttaaatcgtcctcatcctttggtgggctacgagggaaaaccatctcgtatatcgcatttctcatggcactctcatcgtcatcatcaatgtcttcaatatcaagagcgtcagcagccatctttctggccaacgagtagtcttcagggtgaattcttgttgagtcaagtagatccatctcaccttgaggattacgttcaacatcaggatcaaacactatatatacgaacgaggccatattcaagaaaactgtcttggaagttaactgctcggtaatcaaatgagcacggttaaccaagttagacccaattctttgaatggattggataagcccagcagccttacgtggtcccagtccacatacatagggtagggccaatgcgtggtacggagctcttaccgcttcgttgatgtctactccaaccaagttaacgatatcaacgatagatgtttgcacagcatcaatgagcttttctctgggtaataaattttggtgcttatgaatgtgaagggagtacatgctttcatctagggccaaatattccaaaaggggagactggatatattttgccagaccaatacagtactttgccaactgaggtctgttgggatactctgcggatgacttagaagagtgctgatataaacgcgctgtttcatcgttcacatagatcactctgataaggtgtttgtcacttcttccatcttcttccctatcatagccatactcattatcatactctatagttaaacgttcctcattgacaagttcgttgactttgtcaaagagctttttggtatgaatattgaaaccagaaataccaatgatatcaggattgatattgttggatttgatatatcttgtcagactgtctgaaaaatcccggctttgaaaatcctcgtcaaatttaatttgtgattttacatcgccactgtcatccatgaagacaccaagtacagcatcacctctgttaccttcaccaaatgagagagttaatactcttggaatagtaccctttgcatatgttggaggttgatatggtgcttggtcgatctttttggtgaatgagtttttaacttgaaagtatagaacacgttcgcaatcacgtctaatggattcctttacatttagctgaacaagtggaataagtttgtccaaagattgtttccaagcatcgttacgaagagcattccatttttctgaaatttctgaagtaccatcagattttaagatattgtagaaatgatcaacaactgttgacaacatagggagctcgactttgatgttcacaagtccatcgttctcagcttgaatcatgcgcagatacaaatctggagttgcagtgagggcactgataggcctgtttttggcatacttgaaatcaaagtaaggggattcaggctcaatttggagctttccccgctcagtgagctctatattaataacaccaaaagactggaaagcagtcctaattgttttccttataaatggctcgtaagaaagttgctcagaaaagaactgttttacagcctggtaagccttttctgatgagatgaaagtagttttgtccttttctgttgacataatgtctgctatcatatccattggagactcaatagggtcttctacttgatgcaaacgtttactctgcgcaaggttctccctcatttgagagatattggcaatagattgaacaacagggtaaatggcatcttgtctgattcgatcgtagatagcatacttcgagtactttctcttcatctttacttcggcgaacgaactttttgttgtttgttcttcatcttcgccacttccgtttccttcaatggatagttcagcaacggcagttaagttcttaacttgcgaagaatagttgaatgttaaatagtcatcaatgtcttgcaactcggacaacgttcttgcagacccaaaaaattcttcatatgtaggatcaactacatctagatccaattgtttatagattgaactcagagcagcctttttgtcatggatcgagtggtaatcaagatccaactgaacaatcctccacaagtcatcttcattcagcaatttgactatgatggtattattggaatcatcgttataggtatgaagagcgtagtctcttctatgattccaaatgaagggaacttcaaatgattcaatagcaataaaatcaacaatcttcttgacagaagcctcaaatttttcttccaagtgagctacacttgagtgagcttgggtcaaatgctggaggaaatcccttttctctaacttcaattgctcgacaatccaatctcgttcattggagtaatcaacatcggataatttatagttcttgatggatttcctataggcttgaaatctctcgggaaggtctgtcactctgataacgttgtcttcatctgtaagcattttttcttttagttcagagggttcaaaaacatcagctaaagaagttgtggtgcccttaatttcttctccggcctcgtcatactcttgatcttgttgtggttgctccatttcttcctcagcatccagagtccattgatagtctgtaccatcaccgaaaatctctataatctcttgatattgttcaccttgcaacccagcaagttgtggagcggccttggcagatctcattcttgcaagacgctcatcacgggcctcatcatcctcgtcgctgaactcatcttcctcaataaagtcatcgaattcgtcatgtggcaggtttcctgatctctgtgtctttgtagtgaggttatcttctaaaccttcttcttctgaaccctcttccactacgccaccggggccttcctcatcactaaacatatcgttcaaaccccttgagtcggagtcttgggccttctcgtcttgttctgccctcttcaatcgcttaaacttgacgttctgctgctggccaggaacagctccagagttttccataagcaattgtaggtcatcttcgtcgacttcttcaaccacttctgcggatctcttcttgtgtttctttctgtgttttctcttggtggaagaagggataccatcttcgtcgttttcatcgtcatcgtctacaataaacccctcacggactttttgcatttcttcttcgtcgtcctcatcatcgtcttcttcagaagaatcaactatgtttgaaccttcgttgtcactacctgaaccctcctgagcatcttggtctagtaaatcctgcaccgtagaagcatcggcatcaatcgagtttcgggtttcattgatgtcttcttctgacactgaaggagaaggagcagacattttcagcaagagcaatgaaagtctgaggtgtctggtttaggcttgtttttatgatttttcatgttcatcgaggatatgttggacgggccctccaagaatattagtcgacacacgacaattattatacggtctaatattacattggtattcatatatacgatggtgaaagaggttatttgtagtggcggtttagtttctcgttgaattgcttgttcttatcgttaatgtaattggtatctcctccactaagagagtttctaattttgtttttgttgatttttcgcagagtacgttcgtctttagccttgacgtgattaatcacggattcaagcttctcagaggatggtttatgcacatagggaatcccttgagacctagttctgtaatattcttgtttctgtgtattgtattcttcttgagacaacggagtgagtgcttttgaaagatccttggtataagcacgttcggcgatttgagcgtagtcatcgggtaaatcagatttttctaatctatcattccagtcctcgtcttgttgtatagaataatcccagttcttcaatctttttttctgctcatccagatttattagtttttctttgctcttgactgtttttctttcaagtcatccacttgaaccttgatagattccaacttgagtttatcttgatgtttagcaagctgagatctgttcttggcaacggtggattgtttttttgtttcagcttgttaagtttgtcatttattgattcccctgccatagtagaggggggacggatatgatacaaacggatgagatataagtcactcagagttggacttgatcaaacctgctagaacactctgtgatttgaaaagttgaataaattaataataggcaaacaccaactaggaacctacaccaagttatgaaggagcttggaaaggattataaaaaatgcgattacctaatacacacacgatgcctgagcggttaatgtgaaatttcccggccatcgatcgccccacaatcagactattttcgctcatacaataaaaagtctcctgtttccacccgagtatcaccagaacaaagtaacaaatacaaaacaatggtgacaaaagagtctataataagtgatctggaaaaggaaaatgttggcccagaattcggcgagtttctaaattcactccaaaccgatctgaactccgagaaacctttaattgagcaagtcaagtctcaactggaaactcatttcaacttgggacccgaaacccaggagttctccaggaaaaacgacaatgctcccgttgaccaactgctgacaaactactataacaactatgaggtcaacgtgctggaatttgtgcttcaaatggggttctgtaaagatctgagtatccccctgaatgtatggttcgtactggatatgatctcgcaattgagtacctccaaacaggacttgcccttggactattatttagtcttgaacaatagtcacaccggaaagtatagtgactttgtacgttaccttatctatgaggctgtaggggcagagattcattgttttgaacaaggcgatatgccccaacaataccgttcctctcgctgggaggacaaagttaagggcccagctctcgccaataggggacctattagaggtaatgttggggctggtgatagaaaaatcacgtttcatctgttgtgcaagaagactgccaggatgattttggttggggatgaccgtgaaacagactttgaaatgtctgacaggtcttttgtaactctattgctagattattatcagcgagtcggtaccaccaaaaaaatcgacctgttattgttgaccaataactatgacaccaacatgaacaacaaattgcaacagctcaaaattctagagtctctgaacatgctcaagtctaactgctatgtattagactatcagatcactgcggaccaagttactgcaaactttaactcatacgttgagggtattccagcatttagaagacatgagattgccaattttctgaagaagcggagaacaccaaagaatgccgacgagctcattttcaagtacgttggtcgttggaatatctgttatcagaaaaagtttcatcaaggcaacatctccatccatcaaatttctggttatcttgattgataacaaataagtagtgtacccacctaggcttactatgtagttttttgaaatttagggtagatcttaaccatgtacagagagtttcgtcttccgaatgcaactagaggactgcattttgccggagatgacaagtccaagcctttaattcttttcataccgggaaatccggggctcattgactattatcacgagttcttgaaacgtttaagcctggcgggatatgaagtgtgtgggacggatcatcttggatatcatgaatcagattccaagatttacactcttgaagaacagattcagcaaaaattagagcttctgaaggtcttgagccttgaaaggaagggttattccacacggaaactgatcctgattggtcattcaatgggttgttggttactacaaagaatttacattgcagtgattcaagatgagacgttatcccaaagttaccaagtggtctttaacggacttttgactcccacaataaatgatatcggtttgtccagaaaaggggtcccctttacatgggcgtatcagaagtcattgattccatcagcagtgtgggtacatgggcactttgggagggtgatgtcatggtctggattgtctcgataccttaacccattagttcataatgtcgtttcatgggttctgaagactgaagactctcattgcattgatagcacaattgatttaaccacaaataaccaggttttgaaccagacgttgtctatggcgtacgaagaaatgcaacgaatcgacagcgactacgagatcaacaccacatttctcaacacatgtcaagataaagggacaacttgttggttgtttcatgttgaaaatgatccttggtgtagctcattaacacgggatcaactcactgaattttgcaaacaattcaactttatcagtatagacattttacctgattgtgcacatagtttcacattgaacccgaaccacagaaaagaggtgctgtcgatgttacagaaacagttggatcaattgagctgttagaaaagcacaattcatttaggaaatcacatggtatcaccttgtaccagttgttagctaatggatttcaagcaacacgcacccttccagccgaaatagttgccggggccgaagttttcgcaccattaccttctaaaacctcctttctcaccttctaatccccaacctccccacgaacttattctgcgctgacaaaccttagtaagcaagaagcaagcaaaggcattttcaatgttcaaactcaattccaatataatctctaaacagctacttgtatcatcatccagaatgtattccagtatcacagctcgagctctcgtctatgacacttacggagaaccgaaagatgtcatcaatgtccataaatacgaggtacatgctccacagggaaacgaaattgtgcttcaaacgctagcagctccgattaacccctctgatatcaaccaagtccaaggggtttacccttctcgacctgaattgaccactgaattgggcaccgagaaacccagtgctgtgggtggaaacgaagggcttttcaaaattgttgctgtgggagaccaagtgtcaaattttcagattggagactggtgcattcccaagggagtgaactacggtacctggagaacacatcttttaagtactcaggataagttccaaaagctagacaattctgcattgaccaagactcaagctgctaccattgctgtcaatccttgcactgcctatcaaatgttgacaatgtatgcagatctgaagaaaggagactggtttattcaaaacggtggtaattcacaagtcggccaatatgccattcaaattggtaaagctttaggattgcagtcgatttcgatcgtaagggaccgtccagatattgacgaacttaagcaacaattgtacgatctgggcgccaccaaagtcatcactgaaaaagagaacgctgctagagaatttggaaaaacagtcaaagagtggacgggtggtaagccaatccgtttaggtcttaattgtgttggtggtgaaaacttgactaacatggcccgtaagctgggtcaggatgctgtattattgacctacggtggaatgtccatgaaacctgtcactttgccaaccactctgtttattttcaagaaccttacggctaagggattctggatcacggagaacggtaagggagatcctattttgaaggagaaaacagtcgaggcagtattggacttgtactcgaaagggctactaaaagaagttcctgttaaccagttcaaattggatcttgagtctttgactgacgagaagtacttggaaactttccacagtgcactacagagccatggtaagagtcttattgtatacgagtgattgtagttaatcgcgacagaaatgtacttagtcagctatcaatttagaacccagattttttctcttaagtaatcccttgctttcgtgtgattcaatgtcgcaagcctccagagccttgaaggcttatagaaacgccttgagagcgacatcggttgcattcaagaatgatgtggccacactcgacgctgcccgcaacgaaattcgtactcatatgaaaagtcaggaagacccaaagggcaccaaccgttccatcgatgaaagactaaagttattggacgaagtcacagtttttctccgacacaacattgtacaaggtcgcaaggtggacgagggcaagtatcggctgaatattcacaaggatacggaattgggtgacaatgatgacattaaaaagaaaaaggatggtctttcaaatggaggattcactggatgttgtggaggcagcggagctaaaacaacatgagttgaaggagtttagtcctaaaagctgggctatttaggttttgggagttgaccgtgttgtatataggtcatttatgacagttcataggtcttgacaattataaattataaacttttaattataatataataattcaaacagtatttttctttaacataagttatttgcgaattactcatcctaattcattttcttatgagtagggatatcgttatttcaaaggcattgtcatggctattacgtcatggggcacaatcagagaagctaactattgataaagatgggtttgtccccttagaagaagtgctcaaccacagacgaattaagggtacccgggcgtccttcgaagacgtccaaagaatagtggataacaacgataagaagagatttactttacagaaaagagacgataggtggttcatttgcgccaatcaagggcattcaattgcgaatgtcaacggtcatgatttaaaacttctctctactagggaagatctacctaaagaaataattcatggaacttacctaagcaagattcctcaaatcattgcatctggaggtttatccaaaatgaccagaaatcatgttcattttgcttcagggctgcccaaagtcgactctgacgtaatttctggaatgagaaatggatgcagtgcactgatctacttggatattgacaaaattttggggcagcaagagatcaaattttacatcagtaaaaacaaagtcatattatctccagggaacaaggacggcattgtgccaacatccttattcctcaaagtagtgaaacgtagtgacaactcacctatcgcgatatgattgcatcattcaacgggttcgcttttccattcaagcagacatgccagatcccttactggtgctgcggattgcaaaaatgaatgctttaacagttcatcagtagtcgctctgtaccggacatccacacatagacaaatgctcaaaaactttttcaagtaaatagatacaccggatgaatttttgagctttggtgttccatttgtagcaattaaatacagagcttttaatggttcttcattcatatatggtggttctccttcgatcatttcaatggccataatacccaatgaccatacatccaccttctcatcgtactccttttgtttcaccacctcaggagccatccaatatggtgtaccaaccatggtcgctctcttggtcttttgatcagttaatttggcacaaaatccaaagtcagtcaatttcacattgccctggctgtccagcagcacattatctgactttatatccctatgaataatatgctttcggtgtaagaactgcaaccctttcacagtttccaaacaaattgtggcaatctgagactctttcaaagaattgttattctcaataatgtctgtgagtgaacctccttccatgtattccatgactacccacaactcgtaagaattgcgcaagtatgcttccaaaaagttgacaatgttcttatgtctagagtccttcatcaccaagatctcatttacaatcaactctttacgggcttgcttttgtaaatcaatctgcttgatagccacgttggagtttgttctcttggattttgctaaataaacagaaccactagccccttggccagctttctcaatcatctggaagtaaggcacaggatccgtgtcatgaacaacaacgctacgaagcttagacattatttgtgcttccgtcattgtagaaatacgtttctccgattttcgtagaggtgacaacttctgtgccgttacggctgccgccactgacattggattattcgttggagctttaggcacctgctgagttttttgaggcacatagtgttgtggctgctgcggtttctgagttctgatatcatttgaagcaacaggaggctttggtgcctgtctctggtgctcagccttcggtggggagacacggcgagcaacaggtgaaatatgaaggggagaaacacctccaggggagactccaggagatggagaagaggcatatgggttgctttcctgatagtatctttgctgttcaaacgacagtttagcctttggcttctgctgatagttctcgtctgtcctcagttgaagttttggtttaggagatacaccatttggttgacctgttttctggtctgtgaatggtgacctggtgggaggaggaggagctcttcttatggggactaaattttcagattcttttcctttaggtctatatgggagaaccttaggggggatgtttgaatctgctggactatggggatttaatacaggaaggggaacaactgggggaggagtagatgagttgagatgcagacccgagctggagggtggttttgtccatttcaagaggttttcattgaatattttgtccttttcatcctgagtgttttgatcgctagtgatatctgagtaaaaattaaggacatcaataacggcgctgggattctcgttccagtcctcattagtgatatgagagtgttccaacaggcttttccactcgttaggaagacctgtatatttcccactagtaggatcgaacccgacatgagttttatgtgtgaaattggtaggtttggagacaggagtaccacctcccgagtttattgggcatttggccataatgacatctatccaatcataaagctcttggtctgttttgaatgacacgtatagatgcttatcattggagttgctaatttcaaaacaatgagaacgaatttggtttcttaccaagtttgcaacgttcaagtaagggatgctataggacaactcgtcttgccgtttattctcactcttataaaagtctaatgaggattctccaagaaacataagtcgcttggaccatctgaaggacattaaggagtcaccttccttgatgttaacccatgtttggcgccttttcaagtcgattttggtgtgataatacggatagtttgaatttgcggagccttcagaagaattacttccactcttaaggtgggcatgataatcctgtgctggtgctggaggagctcttcctggattagagaaagcatctgaagggaagtactctgtagcggagaaagacatatggacttttgtgttttatttttctgacgctattagtttctttgcagtaagaagtcagcactgttgtttcaaacttcagcttttcaaatggggagaatgaagggggggatatggaaaagaaggcaggttgtgaaggataaagcagcagaactcacagtatactctcaattctagaaatcagataaaacttcaaactgaaacgtgtagctctccgactttacgtgcaaggaagagatgagggtaataaatttaaaatcggagttgttgacgtctttaacccaatcgggctcgatacactatctggaaacgcggtttagcctgatactcgtgtggtggaaggggttattttaattttgcaggactaatcccaatgcggaaatttcacctagactgcgtttgtttcaccgaaaacaaccttgatttgaaatttgaaaggttgtggagttcgaaggagttgccttgcatgaaataaattggaagcatagttgcagcccaatagggatgtttgatgatacagacatcaatggtttgcaaacttatatgactagatgttggatggcctgtatatggtgcctctactttttgcttactagactaagttagtgggttggttagagtgtacatggtgtcagaacgatctatcagtttacagcagacactaagtaagggctaaggagcgtttacctaaggcgtcaaagaacggaaggttattctaggaaggatctgtgtcctgtctaagctttagattacacacggatatctattatgtgcaagaagtttccgccataaacctcgaataaccgaataaccgctcatatccgaaagtaaccgcacatttccgctatggggggagaacattcacctagcttatccgtaacaagatcatgaggcattagcaaaatcttcatgtgtactgtggtatatatagacctgtattatccttccgtaaagtcattcaaaccaatttcaagatggccccagttaaacaagactttaacatagacgttcaaacaatcgagaacactgacatctctttgtctgaatacatatatcttaggatagcccaattgggtgtcaagtcgatctttggtgtcccaggtgacttcaacctgaatcttgtggatgaactagacaaagttccccaattgaaatggataggatgttgtaatgagctaaatgccacttatgctgctgacggctatgcaaaagcatcaggaacgataggcgttgtggtcactacttatggtgtgggtgagctaagcgccatcaacggtatagcaggagcattcgccgaatatgctcctgttcttcacattgtaggcacctccgctatggcaacaaaacgacttgaacatgtgcacaacattcatcatcttgcagggtctaagaatttcttggatagaccagaccattatatatacgaaaaaatggttgatgacatctgcattgtcaaagagtctttaagcgagatcgaaaatgcctgtggccagatagataatgccatcgtacagacttatctgctttccagaccaggatacctatttttacctagaaatatggccactatgaaagttccaagagaaaggctattcaaccaaccattagccttggaaagagttgatcttcaccccggtgaaacgctacaagttgttgagaagatcttggaaaagttctatcatgcaaaagaaccggccttgattgtggattatttaaccagaccctttagaatgatggaaaactgctccaagttgatcggtgctttggagaataaagtcaacattttcagcagaccaatgtccaaaggctttgtcgatgagagccacccaagatatattggctgttatattggaaaacaatccaagcacccaagtactagtgatattctagaaaaaaagagcgatttcattctgagtgtgggaacgtttgatgttgaaacgaataacggaggcttcacatccaagcttccccaagaacatttggtggaattgaaccctcattttactcgtgttggaactcaatgcttttcaaatgttaacatgtgccatgtcctcccactcctggcaagtaagctgagaggtgatttgatcagcatggccacagttcatccaaatgatttcagcctcagaaagaaagaaaaggcacaggataaaatgaaggctctcaaccagagccatcttgtaaaatctacagagctactcctaaatgcaaacgacactttgatagttgaaacttgctcatttatgtttgcagttccagatatcgcgttccctaacaatacacaatttatcagtcagtcattctacaactccataggatacgcacttcccgccaccttgggtgtcagcattgcaaagcgtgatttcagaaaaccaggaaaagtcgtacttattcaaggggatggctctgctcaaatgaccattcaagaactggctaccatggtcagacaaaaggtcaaacccaccattttactcctcaacaacgaaggatacacagttgaacgaatgattctaggtccaaccaaagaatataacgatatagctcctaattgggattggactggaatgctgagagcattcggcgatatacgtggccattccaagagcatctcaattgacacatgtggtagattagataagctcgttcaaactcgagagtttcaagaacctacacacctaaattttgtggaacttatcttgggcagaatggacgccccggaaaggtttgccaatatggtaaaagaaattgctaacttagagcacgcaagtaaaagtattcattagtaattaaaataagactacagatcacgtgccgtaaagggtaaaacctggccgagggccagccttatcatgggtgtttttttatcttgtcaaatgcgtattatatttgctcctcgctcgcccgtttggcttctcctctctaatctccacgtgacccaaaacctgacgtctaatagtaccccacatttgaccccctgatgttgagttgagtcatccatcacagaaccaaccagctaagagtttggcttcccggaaaaatttcccgtccaccgtctccgtctcgtaaactcttctttaaagggtggtgtttatcgtcgattgactcagtgattagcctttgccctttttctctcgatagggaaaaacctcgcgccaaaaaaagctatcgatccctctttccttaatctctcctttttttttattgatagccccagtgtttactagcaaactctgactatttataaacttgaaacagaaacacaatgaagcaaacgtattacgatccaaaggtagctgagccaattggatccgagtcaatggatgatagtaagctggacgacatggttcaatcgttgcccccagttgaccctttgttagatactcccttcccgttcaggagtgcagacgtggaacaaggtgacacgtttgccacagagaacaacgctgggcctacgcagtccgcaaggactaacgtgaacttcttgcccccacatcaatcattgttcgatgccttacagagctctaacctgaacatggttgaggagattgaccctttgagacgaagcaaccaaccggaagaatgttccccttcttgttggaaccaggagttctccgtgactgcgtggcaaatggtccaccgagacgatgtgaagttgcaaaatctttggacccacacaaaaatgtacggaacaggcagtagacgtgttccaggtacggggaacggtgaatcagtgctgtccagctcagagtacgaggagaccgaccttccagatacccctctcctcaacgaagacgatatagaagagcggaacgaacatgatactattctgatgattgcagaagatgagaatttgaaagacaccgccaccgtgagttccggcagacagtcttcatttgtgatgccaaaagtatcgcttccggattcaggtgcctccaactccaagtcaataagctggaatggtaaacatgctaggatcaaagtgcaagtggtcgggaactgtgccgagagattattagcacgtttgataccctatcgaaagacgttatggatgttggactttgtcgaaagcggagccgatattctggtcttgcttttgaacaaggataatgttgtacttcctcggatattgaataaaccctttctgccaataataattaaggatgacgatgcagaattcagttcatcgatagacaccacctcattatttgataattataatactaagagcacggcaagatcatcatcatcatcaattatttcggagccattggaactgaagtctatagacgatgatctgtttgacataatccacgctctttcaaatatggagctggatttctgtggcgaagaatctttccagcacattagcacacaaacgtccaccatagcttcctccaaacaagcaagatctagaaggtcttcgtccagacttgcacagcgccgtaagcttcacaagcagacacaaatgagccagtctcgtgaaaagcggtctcaccaacgatgcagttatgagtatatcaactggataagacgacagcttacccttggccttacattgggcttgatatccatttcttactgtatctggtcgttcagtagtgatcacaacaagttacatggctatcaccatatgaacggagtgtggatgcgctgcactgtatagctacataacagttttaattttttcaaccttttcgaaggttagataatttcacctccttgtacgaaaaaaatctcacctgttccccgtttgctccttcgcgaagctagtttctttttagatctctactcaaaccttcttgcaataaataaacacaccaatcagcaactatgcgtcgccttaagctaagtattagaactcagctaatactgctagtgtgtatggtggccatattatcgctggtcatattggcttgtatcaccggtgtgtatttcacctcgaatcttaccagtgcaagaagtgaaagattggaagtcatttctgagcttaaggtatcagagctgttacaaagtttcactaatttgtactaccaggccttttggctctcaacaagggatacattggaggactcgttgatatcttcgaaagtgggtaactcgtctgctgacacgtccacagcagcttcggctacgatacaaagttttctcaattcaaatgaagatttcttacagtgcaagctttattccgtcaattttgacacactttcatttgttgaaacctcaagggacctagcaggtaatatcacgtcaatgacaccatctcttttcccgttggatgaacctactccggctgtgttgcaggttttggggagttacggtgggtaccttgcaggcccttctaataacggctcggcatttttcgtctccttgacgttaccaatatacataaattcctccattatcatcgactcaccagagctttctgggtacttgactgtcatgtcactggctaatagtttgatgtctgccacaagttattctacggtgctggacgccgctgacatttctttcacacaattaatactaaatccacagaatgcaagcatcatacttggatttaaatatgtgtttccaccatatgggcatgacatagattctgtcgacgttctatatcctcttgatgattatgcaccagtttatcagcttaaccaacgtcaatatactgctgatggcacgttaatttcaacaaacaacctgggttcctcatccaagattaagaatccatttggtgaatctgtggctgtgggatactctaaagccgatctttattttgcaaattggactgttattgtggaacagtcacgatcttcattcatggcgccaatcgtaaagtttagaaacatcattataggagtgtctattggaatggctgctttcttctgtcttataacgtttccattggctcattggggagtacgcccaatattgcgattacagaaagcttcagaggcgatcaccagaggctgggggctacgtaccgggaaggataagaggcaaacgcctgacaggtatacgccttatgcatcaatgacacctgtttccaattctttccctaacgacactgatcctaactctagatcttccacaacctcaaaagaacacagttttttcattccagaaaggatcccagaaaagaatagatttttcaaagatgagctttctgagttgacaaacgcatttaataccatgactgaagagctctacatgcaatatactcatcttgaagatagggtcaaagctaggactaaagaattagaagtggcaaagattgccgcggaagcagctaatgaggcgaagacagtattcattgcaaatatctcacatgagctacgaactcctcttaatggtatcttaggaatgactacgatagcaacagaatacacagatataggcatgatcaaggattctttgaaagttatttacagaagtggagagttactgcttcatattcttactgaactgctgacattttccaagaatacactaaaccgatccaaattaaataagaaaaactttcagatcatggatgtggcattgcagataaaatccatttttggcaaaatatcaaaagatcaacacgttaacttgattatcttcgtcaaacccaaccttttgagaaatatgatactttatggagatgccaacagaattatccaagtagttatgaacctggttggcaatgctctgaagttcacgcctgaagatggtacagtttccctacaaataaaggtcgtgggtgagtatgaccgtgagcgctccaagaggcatgattatggctacgtttttgtaaagaatccgcatcataagtgtgcaccttcaatttctacagggagccatgttaaatcagacagcaaagatcaaagcatatctcacctcaaagttgatgaagaatctccttctacccccaatacaccgaatacgccaacatctgtgatgcttaatacgaaaagaagacttttgcaagtcacaggacggaacaaacccaatgacacaaatttacaggatctacacagtgatttaaatcctgaaatcactttccataatgagaaagaagaattttcagattgtggagattctatcactttacatactttagacagctcagactatgttaaagttgtatcaggctttcaaaaggagggtcacggtgaacaattatcgaatgactattcttcagatactaatgtggaagcaacaggaactgagcttaactcaaaggatgatgacaataccgacgattctatttttgataagggtggtagccgaaggttggatgctccaagagaatggacaattgaaatcaccgtgcaagacaccggaactggaatcagtgaagaactgcaagaaagagtctttgagccatttgttcaaggagaccaaactctttctagatcgcatggtggtaccggtttgggattgtcgatctgtaaacaactggcgaaaatgatgaaaggtaccctgactctgcaaagtaagttaggagaaggtagtaagttcacttttaggtttccgattactcaaactggtgaggttttcaatgagggagaagatcaaactttcaatgacgaattcaatgaagacagcaaagtgaacagaagggtgagctttatggagccaaaatttgaagcagatgaagaagtcgaagatgaggatgcagatgaggatgatgtatttgaattatcaggggagaacatctgtaatagtactgtaactgcggacaccgaattaactaataagaacaacaaagaccttaataatcacaataatggacaattacctgacaacattaaagaggaggatgaatttgaagaaatagacggagacgctgcaaaagttgaagccaaatcgatggatggaaatagcccctccaattcgtcaccaaaactcctgaatatttcatcgaaaagcatcaaacagaatagagccaatgcggagagtttgaccttgaaacttgatggaacctcagagaagaaaacacctgcctcagcagagaaaaccaaagataggcctagcttgtcagcaatgccttcttcaggaacactttcctcactaggtaccagcaattcgggaaacgtttcaattgataccaatttgaggattctggtagcagaagataaccaagtgaaccaagaagtcattcgaagaatgctgaatttggatggtctgaaggatgtgaccatagtgagcaatggtcaggaggctattaacactatcaccgatataactagcaagggaggttactttgatattgtcttcatggatgtacagatgccaattttggacgggttgaaagccacccagcatataaggaaggagttacactacacacacccaatagttgctcttactgcctatgtagacgagtcaaatgtcgccgaatgcctcgactctggaatgactggtttcttggctaaacccgttagaaaagtacaactaagaaggctaattgcagacatttgctctgcttaactgaatttagaacatactgaggacggctgcagatgtctcctccgttcaatatgccaaagtcctccactgggttaatgttagatagaatgaaccatagacgtaataaaccattaccaaccacgtgaccagtacagaggattttcctccattcgcggctgtagtttttcccctacgaaaacaaatccttagagagccagaacggaaggaatcgttcagggaacaacaaatcagcttttgcacaccgtgaaccatctcttgttaggaaatgagcaattctgagcagcaggaatcgaatcctggttcgattgcccattcttcggacccacatgaagatctgcagctagatttgccgtcgttgagctctttcctcaatgttgaccgatctcttttggagggagtcaacgagctgctgttagcacagatcaatgtcaagttcaacaattgggaatctctcaaggcagagaagttgattgttgacatgaattttgaacaatttaaacatgagtcttccaagagtttggatcatctcaagaaagaactgaatgcttcacacacaaagaatttggagacggagaagttgctacaagaagagaaggagtcaaaggataaattaaccactgaattagaatctgcgaagactaatatttcaaaccaggagaaagttattgccaacttgaagttacaggcggagacagctttagatgaaaaacattcggtgtttgaactgttgaactctaagcaaagccaggtaaacactttgaaagctgaactagatcagctaagttccaataactcttcgctgagaaaacagtatttcgaattggagaacaaaagtcaatcgctgaccactgaactgtcgagaaataaacatgaactttttgctttaagtcaagaattagagctcacaaagaagaattctgagtggtatgattccgagctctccaataaagtacaagagttgaaacgattgcgtctggaaaaaagggaaacagtgtctcagttgcaaaaagaattggatacgaatagaactggatttatctcgactaaagcaaaatatgacagcttgtatgaatcatacaacaaaacagccactgaattggacaaggcactaaccgatctcaagcgagctaaagacgactactctaagaaggaatccgactttttcaaggaaatgtcaattaaagacaaccaagtacgattcttagaggagtctaatgagaataggaaacagaggatagacgagctggattcgatcattgctactttgcaaagcgaagttgataacaactccagcaagatcaactcccagctggaggagaaggaaaaactagttgaagctcaggaattacagatccaacagttgacagaaacaattgaagatctgacaaaccagactgaacatagccacggattcctgaacgaaaatgctcaaagagtgttgaagcaatcttcaagcaatttatccttgagccaactctacacggatttccaattaatgaaaaagcagctgagcaatgaacgaagattgaaagaaaaatgcaagtgcagattgatcattttattgaagaactatcgaaaaagcttccaataattgagtctaccaaagagaaatgctctttgatggaaaatgaacttgtggagtatagcattcttcttgagaaaactagatttgagagggatgatgctaagagacaggtcgcagcttggaacaagtccatagatgaatacgaggatcgtataaactccttggcgactcaatcagccgacctgaaatcccaggtcagcacgctagtggctcaaatatctttaaagactgacggttcttctccattaaccacggaagaaaaagagctcatcaaatcattgaacggcaaaactacatcttttgttaacggatcagataccgataagataatatctgaaagacttgtaaaattcaaggatattaacgaacttgtgaataaaaatgctgaactaatccaagcgttgagagaactcggaaagaaattagagaatcaagaagcgcaccaaaaagctaacaaggccacatttgaaagtgaaactttaaaggaagttagggaaaacaacattcgtcttgaagatgagcttaagcagactcaagaaaaactgttactcataatgaaagagcgagacatgttccgagatattcataagttgcaaggtgaaccaacagaaagtactcaaacctcatctcaatcagaaaaagaagtcgtagctctcaccgaggaattggatagatcaagaactgaattagtagtgctgaagaaagagtctaaagcaaccattgaggaactcaacaagcaaatcagatctctgtgggaagccaagtctgatattaatttacagctagctaaggctaattcatcggtaacaattgctgaagaaagactaaaggcatcgtatgaatcaaatagattcattaagctagagcttgatcaaataaaaggtgctaatgaatctctgtcacaatctttgaactcaaccgaggagaataataagaaattgttcgaagaaactttatccctcagatcggaggtgtcaaatatcaactcggaattgaggagtcttcggtctgaaaagtcaatatggacttcgtttcaagaaagaatcaaagacgaaaacaaacaattgcacaacgagaaggcttcgctgaatagtttagtgaacaacctacagttgatgttatccgaaagagagaatagttacactgattccattaagcgcttatcgacctcgttggattcagctgaaaaggagcttgaaaatgctaagcaaaggattatcaatcaatccaccgagatatcccttctagtgaaacggagagacagcgatcttgaaattttacgggccagaattgattccttgactgcagagttaagttcaactcgtgaatctctaataaaagaaacagctgctctggctcgtgccgaccaaacggttgaacttttaaattctcaagttcgggttctggaagagaaaatcaaacccattcatggcatagcctccagaagattatcagccactagcaaggacttaaacaccatcgaggagtacaaggaagctcttgaaaaactggaatctgatttggagattgctcaacaatcagcagatcagtttaagaatgtagcagaagcagcagaagcagaactaaccagacttggttccagctttgatgaatacaagaatgtgtatgagaccaaattgaaagagtattctgaggagaatggcaagctttcatcttctaatgaagacttaaaacagagtatagaaaaggtcaaagaagagctccaagattcaaagacggcctgggacgaggaaaggggcacacttctaaataagatcacaaatttggaagtagacgcaagctcagtcaattcgttcaaacatgacctagaggccaaagttgaactacttcagacggaattgacacaactaacggaagaatcaaaactccagaatgatgacttaaacaaaacaaaaagtgaaattgatgagctaaacaaggtcaaccaagaattaactctttataagaatagcactgagtcccagattaccgaattgaccaacagggctgaaacagccgaaaaaggtttgaaagaagctgaaataagttgggaaaatcagaggaacttgctgctaggggagattaaagaaaccaagaataagatcgacgaactaaatgttgaaaacagaatgcttttaaatcagttggagtctgcaacggatagtactggtggttctcaactgaagaaaaatgacattttgactggggacaatgacaacaccagccaactgatctccttcctcagggaccagaaagatcatgtctcacgcgagcttcaacaatctcaaatggaagttactcgccttcgtcagcaattgagcatagctgaggaagagatagaacaatctaagattgaagcagaaaagcttgaagggtatgaaaagttatccaatgagttgcaaggcgaaattactaaatctgctgagttatctaaaatagtatcagagttgcgacagggaaatactgatcttagaaatgaaaatcagagccaagtaaaccgtatcacggcactgtatcaccagcttgagcaagaaaaggcaaagaatgagccttttgagatacaaatcaagcagctaaaagttgaggttgaaacaaaaggcaaggaagccacaatgaaccaggagcagttagaatattggaaaactagatcgcttaacttactgaatgaagttggctctattggaaacgaagaatatgtgaaggaggccgagtccctgaaagaaaaactagccgaagtcgaaggaaagcattctgaacttagtgccaggttcaacagactcaaagatgaggctcaatcaaagttgaagaggcgcaaagaggattatgaaatgcttcgtagagaacacgaagaattgcgcaaaacattggctgatacgaatgccgaagtttcttctctcactgagaaattaaatttgagttctaagaccagtgagtctttgacgcaagaacttgaacaattgaaatcgaaacagacgtcagccgatttgaattctgaaaagcacgtggacgagctcaagaagaagcaagaagaagttgaaagactgcttgcagaaaataacaaactgaaagaaactcaagtgcaaagtcctgaaacctctgaagaggtcgaggcacttaagaaagagcttcaagaagctaaagaggctgttaagaaggcttcgagccaagctgataaggatgatagcacatctattgacactcttaaagctaagttggctgcggaacatgaggctgatgtggcagctcgtattgccgcagctgtagaagaaaccaggaaaaagattcgtgcacctgtggaagagcgtattcagagtgtaatcaacaagaggtggaatgaccgcaagaaagatttggaaaacgagtaccagaaaagaatagctgaagcatcaaagaaatcggaaacttcaggcaacgttgaggctttgaaaaaggaatatgaaacaaaattggaagaggtaaagattgccgctcgagaggaaggccgtagtgcggctaggaaggaagccgaacttcgtactaacctactgaagcgaaaagccgaaaaggcagaggctgaacttaggaagttaaagcaagcccaggagaaagtctcatctcagcctcaacctctacctatagaaactgcggttttagatacagcgaccgattccaaagattcaaacggtactcaaacccccacaaaacgagctgccgaacttgattccccaggctctgactctccagggaaaaagaccaagaaagagtaactcatcagtatctattataatgtacatctttatcgtattacctaagcatatcgagatccatcaacgcgggttgtctactaactatctctacgcgtaattactcctcttctttttcatgtcagaccaattcggctcaagctatgtagatcctagagagtaccatagcgaaggagaagagtacgaaattaacagtgatcaaggtaagtttcatttactttaggataaaaatgtcaacactaacatccaagacgatcttaaatccaacgaaattgatggaaattataaccagaatgagagcaaaacttcagaaatggttggatattttgatcagcaacgaaagatcttagagctggaaaaaaaattgaaagagaaggagaaagagagaaccaaaattggagtctttgcacaaagagtggccaccagagatgaattgaagagagagcaagaacagacattggagaacgtaatgaaacagagaacttacacatttgattctggagagttgtcgatacagaagagggaaacgaatgaaaaggaaaagtttactggtttatacatcaacgtgagatatttagataaaggggctgtaaacgcaatgatggtggataaaaagatacttagaatagagaaactactggccaaagtttaccctccactttatcagcccccattgtacccgaattgggttgttgtaggtttgataatacggaaaaacgaaactaaattgactatgaacaagacttctaactacaagaaaatgactatttccaactttagccaatccgtagatttgatgttatttggcaaagctttgcagaaatactggaaacttcaagttggtgcagtcatagcggttctgaatccgggcatttggaaatataacttcaagtctgcggacaacattatgcatcaaggtttcaatttgacgttgaaagataatcacgactcaattctggaaattggtaaaagtcgtgacttggggttttgtagttcattgaagagagatggaaatgtttgccaaactcctattaacattcaaaagagtaaacattgtacctatcatactgagttggcaatgaaaaagagtacatctaaaaggctagaattaagctcagcattccgaatgcgatatcccggagaatcaaatgaggaaaccaatgctcatcaacatgtatatatgaaaaagggagggcgccaattgcaagggtttctccaatcggatccattatctgaacgagaactgaataagaaagagttggcagctagaaagcaattttcagactcgttatctcaaaaagcattcatggaggagaatttcaagaggactaatgttaacaaagctgaattgaaaagtaaaaaggaaaggcaactatttaaagagttagaaatgagaagaagttttgttgagaagggagctacgttctttaaggatgaggagattgaaaccaatgcagagaaggcagaaaagattaggctttcaaaagctgcttttagttccggcgccgtcaataaaatcggattcaatcctacgcagaggttattttcgaaaagtaacaatcttggaatcaaggccaaagctgctaccaacttgaaggactttttacatgaatcagaaaccaaagaaaagcatttgaatctttccaagcatgacataaagaaaagaagaaagaaagctttggaagtcgttaggcggtttcaaaaacctaatggagcagctaacgtagaggccgactcagtttgcgggaagatacccacagaggtcacacttccggattctgattctgactctgatttttgatagtgcatataataccgtgtagtattaaaaaatttagccttgattgtccaatcaacgccgtctgccttcgatttcctgatctactcgtcaatataccaaaccatgtaccatgtagaagaaacgtgagaaatcttaagtgagatgaaaaaaactaagatacgaaaaaaaaaccaaatccttccactcataagtcaaggttatggagattgaagaatgctccaactccatatcttaactcagctccgaagattgtccagactcaaatcttatagaattgccactcgaggaccatttgttcaaagaaattgcatttacaggcagttccatctcacatcaacttcatctgcaaaatttgatagcaagacgacaacattcaaggaagaaccgacttatgatcagaaagctgatgatttgttgctagaattgaacaacatatataaggataggatcattggaaccaaattgaaacggaagaggctaactgagaaggtcctggatgtagtaagaagcctgccggatggagtgtttaaaccagtaactattccattcatgtctaaagttatcaactttttgggtccctctcagtttgattacgaagaattaatatcagttttacaggctgtagtttctgggttggactcaactaatgtcagaacctgccaatacattccaattttttgtaacgaattggtaaactgggagagtttcaaaaaggacccacttgtcaggttacaagtagttgagatatttatcaattatattacgctatcaaccaaccggacactacttcacaagtacttagactcccttgattcagtggatagtaatgatctagtgaggattacgttggaagcgttcaagacacgagctccagactcaaagaccatggtaaaattggctgaactgagtgatttcaaagacaacttgattttgaatgagatattgataaaatttttagaggcttgtgacttggaactgggaaagaatactcaacttgaggatagcatccttgcattcttaggtattattgactcgaagtgtagaaatgacttctctgcctacgtcaatgttctttatttttgctcaaaaaataatttgaactctttggctaaaacaacgttagggaaaattgaatcaatgccgaataataaagtcatttttgaatctttatcaccggaggacactaacgttttcattctagtggctaccagatattctttcatacctttggccaaaagggcaatcgagcttcataagttcaacgctggggattcaaatgactgcattacgacgtcaattcagacactacttcaaggtgagcctatggaaagtctagttgctaagttggagcaacaaattaaaagtttggagaatgacgaatctgaagaagcttatcatctgcagtcagttgaatcatacaacaagattttggaggcagtattaaacttgaataaatctgaggagtacattgtagagttaacaaattggtggaaaaccgagcacggattggaacgtaactctgatagttttgcccttttaatttctaaatctctagaccaaaatgactaccataagggtttgaaatattttgaagaaagtctggacgaatatgttcattggggtgttgatgaagaaggaataaacatgactcacctctacagattgttatcaatgtatctcatggaatcttctgatgccattggtgaaaagttcacgatttttcaaaaagtgaaaagtttcggccataggctggacaaggagacactagcggttatggctaagctgatgctaaaccaagcttacattggagatcttatcgaactcttagaaagagaactaccgccttttgaaaatcccaagagtgatcgctatcaagtttttcaatattcctcgttgtacaacctactaatggactttgtgttgacctacgaaaaagattctgagataaattggttggtttatggacagatacaaaagtatttccacgttccacaggaatcatatattccagtaatgaaatttttctgtgagcatgagcgccctaatgcagcttatttgatctttcataccatgagaagcttgcacaagaagaaagggctggatcccccaacggaggaaatctacacatatttattttcagagtttggtaagcagttatacgaagaaggcgttttcaaattgcatttgttcttgaaaatggaccaaaaggtgaacgttgacatcaacatgttgaattcaattcttgaaggctatgtcaatttacaagatatattgaaagctcgtgacgtgttcaacaacgcactttctttaccaaaagagaaaggtataaatgaaactaccatcaacttgatgctgaagactaatacttatatctctcttcagcacacaaaaaacttttggaataatttatcccagattgactacacaccaacagctagcaacttaaagcagtatctaattgctcattgttatcatggcaagtattctgaggctttggaagttttgcagacttcaagaagctatggagatttcgaaattgactcaggcttgctagccactgtttacaattggacattgtcacccaaggcccgcttgcagttgaaaaaatgggccgaaagtgagtttccgcaattatggaagcaggtcgagtctcgtaatttgatccaagaaaacacggagttacccacattgattgatgttcataagaatataagatctatagagtgaggaactttaacagcaacatatgtacatacactaaataataaagaattaagttacgcaatgcccagcatcgctcttgttataaaaagaggttaccaatgtttggatagtcgatataaccatgacagatagcccaaaagccacacataaatatggcgcataccaattaaggagaccctttctattgggagacatcttagcataacataatgggggcagtatatatgccataattgacgcagaagttgcgcctgtgagttctaaaattgcacctaaattacaagtcaaaagtgatacaaacatggcagaaaaggagagcagtgttgtaataataaagtgtgatttcgtggaaagctcctcagcatcactgccattcatgacatctttgacaatatctctaactacaaaaatctccaagggaaatgtagtcagcatgttgaacccaaaacagaatcgagctatattgacgacccaatcgtctgcgggaaaattgttcagaatatttcctttcgttttatctttgaatatagcaaatccagcaatacccataatggaacagcataccatggcaatagcgcaagatatatgagttaattgtgtaaacctatccaatgtagcctttttcatggatctgtaaatgaatgtggtattatggtggcatactagcgcaaaggaaatgacacttattccttgaaacataccgatatcaaagaaccaatttttcaacgacattgaacctttgagttcagaactgacaactggaccccttgcaaggacaatgatgacaataacgagcatggatactagtgccaacccagaagctttcgataattttgaaatgtctctgttaagtgcaagtgggtagcttatgaaacatgtcgttaatataataatagagtttctagaaagcaaaaaatccaagaatcgattcgattgaatggctgatttgaaaacactccgtataacatgagggatcgtgtcaccaataatcacgcaaaacgccatagacccaccataagcaaataagccttgagccagtaaaataacgtatttgcctttgttcccaaaacaatgatagacgctgccttggtaagaatgggttccagataatttcgtgtttataatcaccaagcggatcgtccaatccactagaattgtcagcaaaaccataatcaggagtgcacccaccatcccacagtttctaaaagcataaggctgacctattataccagcccccagtatgctgtttgccatgttcataaaggcatttcccatattggatttacccttttgggtcatgattccttccaattccaattcttcagaatcgtcaatagcttcttctatttcaaagctatcagaaggatcaccatgcggttgatccaactcagaactgacctgaggtaagttctgatatttggacgttgacataacgatttgtttgcaaatgttttagtgaaaagctgctcggccaaatcgatcattttggaaggaccctgtcaagatgttaaatgtcgcgaatgaattcattcagtaaggcttccagcccagatgtataaagatcgtaaaaatatccacactctgggactgcaccgattagaatattcacctgttctgaagtggaggccatatcgtttgttatatatggaccagtaatgttatttggttgggagaaaatgatttcattaaggtagggttgagcggcagtgtttttgtagtcctctcggagtcctagattagagatctccagagtacaagttcttggtttggaagatttctggagtagatagtccttggcgtttacatagttgagcattccaactaactgagcactttcttccagtttaactggagataaatgggattgtatgtatctgacgtaattccaatcgaatgattcatgagagactagtctcgtggataacttgagttccacagcagaaacgaatagtccataactcttagcatttcttttgtctaataaggttctcaaattcactggaatgctacagtttaaagagagttgagtaaactgagaaagcactgaaaggttcaaatatagccagaaactcgtgaaggagaccgattgcgccttcagtaaggacttcaacttaatgaattcttgggtatttattgtgattagatgctttaacgtcttgaactcgttatcttttatgggagacttgacactgatattccaacttggatcatccgtttgatactgagatttctctgtgaatggcattttgcctagtttcccaaaccaatttgacaaccacttggggctgaattcactgaacagacatccgatcaggtatctagttgaaggtgttgtgaattttgagagttgcgactcctcctctaagtctttgccaattggttgattattcaatagacagaccaattcttcgtggaaaaaagcagcagaattcccgtctagtagcgtatggtcacactgtaataataaccattgagaattgagaacgactagtttccacaagggcttgttgattgcagttacaaagcagtatctatgagccataccgatctcctccacaatatcactacccgttttgaactccacaacatcatcaacgctccaatccgatatttcctgcaaatataggtcgttggtgccgtcttctttgaacacattcagtctcagctgtttacggcttgccaccagtttctgaattccaaataaaagaacctctttatcaacgcattcactcaattttgaagccacaatgaaacaggagtatgtcttcagaacgtttctctgatagttgtattcttcaattggcctcaaagtcctcctgcccgcttgactcgtagtaccttccattgaagtatttctaggaaatgcctgatttctcgaaatattatgataaaccaatactttcgtaatacaaataatacaatacaatactacaaactacttatttgggatcgacgatgaaatagttaggatcgtctttatgagcttcatactcagcatcagagatggtctcaagagtgcttacctcttcgtactcaccatcgtcattatccttagctatcgaggaactagctggaacgacacccgtggcaggttccttcttctcgggctctttcttggatccaagagaagcctttctctttatgcttcccaagaatgacaaccgattctttttcttgatgtcttcatctgccttgctagtggttgtgggaacatcttctaccacctcagtgaatagtggtttggcatctttattgagagtttcgtcatcaatcttgatttcgggtgaattgctagcaaaagactcgtttcttttaatgtctgcagttttcttagccccgttgcccacctgtgcggcatcagatgcacctttagaagcagtattggtcgaagaagaaacaactttggaagcaccagaagcagcagcaccagcaccagaagcggcggcaccagcggcagatccagcggctgcaccagttgcagcacctatagcagcaccagtggcaactccaccagcaaagaaggaacctgtcgatgctagcttcttactcagtttgcttttttcctttttcagctgttttactctttgcaattcagcaacatcctccttgagtcgcttttcttcctcagctctgtctagcttctcttgagcatactgttcttccttctgctggcgctctatttctttttcctttgcgagtctttccctttctagctcggcctccaacgttttacgttcgtttgcctttgcaacctcacttcttattctggccttctcagccaaccattcggatttcaaagactcgttgtgtttcctctttacttctctcgatgctacagcagcaccagtaagaaatccaatcttggaagcgtgtttctcaattgcactacccaaggcggagacatgactttgaagcttttcaagtttcttcgtagactttgtatgatcaacacttagagcagcagctttagcatcgcactctttttggaactgttcagattcatcgacagttgcttgcagttttgcttcctctgcaaccaattcctctagctcagctctctttgcgttcaatgcttcattcttgtcaaaggctttttcttcaaggtcgtctgcgatggctttttcttcctcaactttgactttgagctcctcaatttttgtcttctcgtcttcctgacctgttgtggcattcagcagcttagtttcaagatcttctttgtattgcttagcattttcttctagcttggtcttattagtttcatgttcttcagccaacttttcctcttcagccaaagctttagtacccaagtcgtctatttcttttctagtctgagtggcaaattcttctagaagtgtggcatttgaaagaatggtcgagctaagagcagcaatgtcagtgtcgaatctggcaacaatgatgttgttttctctagtcaactgagtttggtatttttccaggttctttgattgttgcagatccttttgttcgtggtattgctgttcagtttgtcttttcttcagctcatcggctttcaggtttaaatcaacttgtttgtcgatctttcctaatagaggtttgactcgagcctgggcgatactgtagatctgagcttgggttagcaacaatccacctcccaagtcaacgacttggtcagggttctccacatctttcttttgcaatgagctttcagcaatctctttgttttgcttgtacctgttgagcaatagaggtttgtctttcagggttttctctgcatcatcttcagcgggtggctggagtaaatctggtgtaatgacaacgggttccttgagtaatttcaactcagcctctttcaatttcgcttgagcttccttaacagccttggcgccttcttctgtatctttgatggcttgctgagtttgcttggtgaccttcttgtcagcaacatctttctttgcttccacattgtcaaccttgtcatcttctttggcttcttgactctctgacacctgctcttcttgagcctctggtgcttgctcctcttcttgttcagcttgagagccttcatcttgaggaatgtccccagactgtgtatccttgtccgcaacctcttcctcagcatcctgaggaagaacatctgtggccggttcaggttgctcttcctgattgtcttcggcagtgctgcctttgattgagatatcagatgcatcgagtacagactctgactcaattgggtccactgtagcgttcgcatcatcatggtccaagattgtctcctcttcggcgttgtctacgtcctctggtttgacgtcggccacaatttgtggaggataggactccctctttggcgaggctgcctttgcatcagtacgaaaaggagaaacccatgacttggtcccctttgtcttctcaacaagatcacttagcctggtgtgctgcttaggaggattctttgaggcttcctgctctagctgaatttgggcaattggggtggtcatgataatctgaaccagttagtaaaactgaaatacatccacggaggccacaatcaaagggctgggcacttaccacttggaattcaaaccttcaactttacccttcaatttcaatggttgggaaaatatggagcaatgaaagtcaacaatttcttaagagtgaggtgtctgacgttagtgaaaacaccctacttcccaaaacggcaataccccaattgggaaggcgtgatgatggttgaaactgacatcacagaggccatcctgcgattacataatgttgatctattcgcgagagcctctctcgacctactccccacaaacgataagatacgaagatacataggaaaaaagtactacggactcgcaagttgtttttggcaaacagtttacggcgatcatttttgagttgccgttatctttcaccacgcatgttatcaggctaccctgaacctcaatactccaaaatcccttcttcccctacactcaactcggtcactaatttggaaatgtacaagctaaaggcagacggtttggcatcgaattcgatcctcaccacagattcacacggcaatttcgtcgaggaatccaccggaaggaagatcactcttagaggggttaatcttgatgctaccgctaagctacctctaaaccaaactacgtacaaacccagaggcaagaagatcttctatgaaggcgacacagtctcgttcgtggggcgacccttcccactagaggatgctatgatacacattaacaggatcaaatcatacggattcaatacgattcgattcatcattacgtgggaggcgatcgaacacgaaggcccaggaaaatatgacgaggattacattaactacaccatcgagttgctcaagattatacatgatgctaaagggttgtacgtattcattgatcctcatcaagacgtgtggtctagatttactggtggtagtggtgctccattatggactatttatgctgctgggttggatccaacaagtttccataatacagaagctgcgttcgtacaaaacaactctaaggatccccagaattataccaaaatggtttggacctcaaattactacaggttggcaacccaaacattgttcactatgtttttcagcggcaaaacgttctttcccaagtgcatcattaatggcgagaacatccagtattatttgcagaggcatttcattgcttccgtggctcatttcttttctaggctcaaagaaactgctccttatgtattgcaccaaaccgtaattggggttgaatcaatgaatgagcctaactccggacttttgggtttcaaagatctttccaaaattccagacgatcaacaactgcgaattgatacaacccctactgtattccagtctttgatgacatgcaacggtattccttgtgaggtcgacacatactatatatcggttttcggtccaagaaagtctgggagtcgcttagtcaatgaacagggagaagttttgtggttgaaaaatgacgaggcagatcggaaatacaacttcaaaagggaccctggatggaaaattggccattgtccttatgaactacatgggatatgggattccgatgctctaacgttaatgaagcctgattattttgctgttcatccgttgaccggtgaagaagtagatattgattatttcattaatcacgagtttgtggaacattataaggaatataaagctgccataagggcaatagacccagatatctttatgtttatgcaaccaccagtaatggaggtgcctccagttttagtagattctccagttattgacgacaagacagtgaactgtcagcattattacgatgggatgtcacttatgttcaaaacttggaataccaagtacaacattgatactttaggtataatgagaaaaagatacagcaatccaatatttgccattgtatttggagaaaagaacataaggaagtcgcttcggtcccagttgggtgagatgaagaaagagagtcgtaaaaatttgggggctaaggtgcctgttctaattacagaaaccggaatgccatttgatatggatgataaagctgctttttcgaacggtaattatacttcacaaacgaaggctttagatgctcttggatatgccttggaaggaaacaatttgagtgtgacctattggacttatacttcgactaactgccataagtggggagatcgatggaataacgaagatttttctttatggtctcacgatgatcgtgctgcttcttttgacgatgatagattcagtcttagaagcaattttttgtatgaaagtgaagacgatcaaactttcacgaccaccctaagtaaatcaaaggacgacttcaaggtagtccaaaccagggaataccacagaggtgggggataccaatcaatatggaacggtactagagccctgaaagcaatattgagaccatacccagtatttgtcaatggtgttgtaaaatgctgtgagtacgatcttcaaggctccaagtttcaattgacaatcgactcggaccgtgtgcattccagtacaaaagcattaacagagatatttgttcccagagtcatatttcatcctagcaagatcaaagtatcctgttcatcgggaacatttgtttatttaggcaatgattcagttcaggtattgcgatgggaccatgatattaatgcaggagatcaagagataactatacacttgagtgattcagatgcagaattatctgagaaagtcggaaatagtcgattaagagatctgctgtgtggctgttttaagtctgttcaaaacatcttatgttaagaggggaaaccattatgcgggcaaatgattccttagtaaccatgggccttgtagccagcagctatcagctccagtcaactacctagttatgtagttttacatacatgttttcgtgcaccactcaaaagtgttctcgaacacccaacgacctgttggttccatctgaaagacatcatcgaaagacacttaacgaaccccagggtattaaatagcatggtattggcagatcttggaaggcgtatcaataacgccgttggaaatgtcaccaagtccaatgttgttgacgctgacgtcatcagcaacatgttaaaggagatttgtaacgccctattggagtccgatgtgaacattaaactagttgcccaattgagagagaaaatacgaaaacagatcgacgcagaggataaaccaggaattaataagaagaagctgatccagaaggtcgtttttgatgagctggtgaaacttgttgattgcaacgaagctgagctgttcaagccaaagaaaaaacagacgaatgtgatcatgatggtcggtttacaaggtgctggtaagacaacaacctgtactaaactggcagtgtattaccagagaagaggattcaaagtgggaatggtctgtggtgacactttccgagctggtgcgtttgaccagctgaaacaaaacgctaccaaggctaagattccctactatggttcatatacagaaactgaccctgtgaaagtgacctttgatggtgtggaagaattcaggaaggaaaagtttgaaataataattgtggatacttctggtagacacaggcaggaggaagatttattcgaagagatggtacaaattggaaaagctatcaagcctaatcaaacaatcatggtactggatgcttccataggtcaatctgccgaatctcaatctaaagcatttaaggaatcatccgattttggtgccattatcataactaaaatggattccaattccaagggaggaggtgccctttcagctatagctgccaccaacactccagtagcgtttattgccaccggagagcacattcagaatttcgaaaagttttcaggaagaggatttatctcaaaacttttaggaattggtgatatagagggtcttatggaacatgttcagtcgatgaacttggatcaaggtgatactatcaagaatttcaaggaaggaaagtttactttacaggattttcaaacgcaattgaacaacatcatgaagatggggccactgtccaaactcgctcaaatgttgcctggtggaatgggacaattgatgggacaggttggtgaagaggaggcttcaaagagattgaagcgaatgatttatataatggattcaatgacgaagcaagagttgtcaagtgacggtagattgtttattgatcagccttcaaggatggtaagagttgctagaggctctggtacctctgtaactgaggtggagcttgttcttttacagcaaaagatgatggctcgtatggcattacaatctaagaatatgatgagtggggccggcggtccagcagggatggcttccaaaatgaatccagctaatatgagaagagctatgcaacaaatgcaatcaaacccaggaatgatggataacatgatgaatatgtttggtggagctggaggagctggaggagctggaatgccggatatgcaagaaatgatgaaacaaatgtccagtggccaaatgaaaatgcccagtcaacaggaaatgatgagcatgatgaaacagtttggtatgggctaaacaatagtgtctagataggggtacctagtaacaactgtatttaatatcgtcatcatttttcgttaaaattcaagttgagatttgtcatcttgatcaactaactgatctctatttcttttcctagattgcagttcttcttcattaagtttctttttgaaattattgaacattttaatgtattcattgagactagtcttttcccattcatgtttcacagatttgcctgggtggtccgtgtcccattcttcaatctctgactgtaaactacgaagattaggagattcatcgggccagaactccttaactcttgggtcaaatggaacgcacacgtttcctgtcttggggtgaatgcaaaagggagacttcaataaatgccccatcagtttggaaacctcaatatccaaacgagggtacattgagagaataacaatatcagttttccaatcacgtacagcaaagcccttcttggcttgggtatcaatatctttccatttttctagactagacctgcctggcttctcagtccagagtttcgccaatgactcacgagtagccgcatcggaaatcttctttgcaaggtcttctatggctcttttgtcatccctccagggatcttgttcttctagtataacttctttgaaagatttgagaagtataccagtagacctctcgatatggggatgcaagggccttctgaacgtcagatttctatttttatgacctcccttcaaattcaacacgtccagatagtcaataactgcttttcttagggtatcgttcatactccttgccctttgatcactgacccagcaatgtgcccctcttcgtccagaaaatacccagatcatgtgctcaaatccaaaatcatcccgtaatgctgtatctacaatctctatggcaacattgatgaatttccagcatttgtggcagattcccgtcttggaacaacatgttctaatgtcatcgtagtcggtcaaatcgatatcaacaacaaactctttctctataggtttcatcatgtttttcgatactgttttacgtttgctgggatttatggagtaaactgccccaatttcgaatcttgtaggagtgacccttactacagtgtctttgaactcttttgcactgacgaacgaattgtatctctgatatgcaccacttttaaactcgaaagcaaactctctcatggtgaaatctgtttgaggaatcggagaatggttcaaccattcgaaaactggcttgaacggcaataagcgttcatagtaattcctcatgtcatattctgatggtgtataagatgaactctcagcctttatcaggtttgcctccataggagaggactccttggtatttttgttgggagacgattgaacacttgaaacagctggtgagctcattgcaccactgctgatctctggcaatccaggcatacgacttgttagacaaaaagactggagccctttggagtttactttaacgcgtttggatatctcgcgtctgtttttacaaatgatgttgggatgctactgaacaaaaattgaagggaacccgcgcgcttagaaggctaggtcggccgcgcgtggcgcacccttctggggatgaataaaaattttatccaatctgcttttaagggtcgactttacggaaaaagtcaagtgttccgtgaatcgaggaatctatgcgacggctgttgtgggggtgtacacatctggtacaatctaggaataaaaccccttccccactaaatatttcacttatcaggttcggagttgaatttaggataattccttcgatgtttctccatggattgtatcatcctttataggtaacttttctccatggtggaaagtagtacctgaacctaaatgtaaaaaccttttctgcgaagttgtttctttttttctcctcttataccttctctccaactgttggttccaagatgagtaatgggggtggacctggagcaccatccaagctttctagagagacggtgagtctaggtaatggaaaggcttataaagtccaaaagattaggcaacgaaagatttttagttgtattccatgccatcagcgcaaaatcaagtgttctcgtgaaaagccaatctgttccagttgcatgaaactgttttcaaatgttggtgatcaatcaggggatgcttctgaatattgcaagtactacatcaacgataagaagacaaacttattgaaagacactccagagatagagtttctgcataatggaattgtttccagctcgtacttaacagctacccaaaatcatcaatcacagccacacctacagtcacaacccacagtcgatttccctcaaaacactgccatcatttctaaactgttagaaggacttccagcttcaaaaaatagatactttgaacttttacagatatatcaatattgtatacaccctttgtgtccagttgtcaacatgtcagagttcatggataaggctcaactattttggaagtatgacttgaaagatcccaaaaaagcggttcaggttatcaattcatcgaccagtacagatctagaactactggcaggaccccaattgctcagttttgtccaattgttatatgctgtgtttgcctgctcgtctttagccgagtctgcctttaatatttatcacaacctttcttcggagacgaaaacatattacaaagcatgcaccgatgtcagataccacctggagaataaatgcaagcattatgatctggaaacgttccaatcgttagttctgattctcattttaggtctcaggtggaacgtagtgccactcgtggaggaagttggtaaaacaatcagagctgcccaactatacaggctaaacagagatccaatgctgtatcataaattaaagaatgaggattctatcatgttgcgacgtactctctggtggttgatattctccctagatggaagggtttctcatgtattgggactacctccaattctgcgattggacgattttgacacttccatgtcaatttttcctaatgatatttatcgcaggtccatctgcacagccgagttccgttacagttgcatattgagtgtcatctcccgatatatgaatggaatgtctgaatcattaccccaaaacacagttaacttcttgactaggaaaatttgtgatctgagcgctatgtgcgttcacaatattgaagagctgaccaatgaactggaatgcaatgctcaaagtaacaacatgacttctcttttgcactacggaatcactttattgtcgattattccggacagagcttttttccatctatacaatagtgctaatagctctggcacatttgacccaagccagttcaacatgcatctactgaaagttgattatcatctaactgcgtctgacttttattatctgaagtactcatacaccgatctgagcaatgctttattaccatctctaatccactatattgccggttttatttctctttatgacagcacttggatacagaagcctctaggtcagaattccgtcttgagggaattcagtcacttgaattggcatctgtattcttacgttcccatgaacgagctgatctacttaatgatcattgtcattaacaatttcggtcaaggcgactcgcaaatttatcctgaaatcggagcatttaactacgatctcaacctcaagttatacctgatcaacaaggcaatcagtattctagaaacttactggaaaaaccacggagaattgggtaagttagtagacatcttgttggaatcatggagtttcataaagttatctctctcaattgatgtatcaaagataatggtgcttgagagagacgaggaaatagcccatttcattccacagccattcactaaagcatacaagtccacctcgtggctcaatcctgttcctgttggtgtagacatgttggatccgagcaatatggaggcccaatcgcatcgaccaagctccaaatatcatcatggtggattctcccttttcgaaaagcagcctcaatacgatccattagagttattcatcaagcatactggcgaatcagcatctatcccacaaccaattggtggcactatatcaaacctagacataaataattcccaagtactgaaacagttagaggtgcatcgtttccagatacgagcaaaatttgcagctctgggcgaactgtacgacagggcaattcattccatttcggacaatcctaacggcgagattgtactggatgtaatgtcctactccagagacattgagattgccatgctacagctcatcaaggctgcaggggtatagaacctgatagcctgaatagttaattacataagcaatgaaccgtactgcttcaaactattctgtaagcagggaatgaatcccctatcattcgcgcttgctgtagtagagccaagaaaactaatgaaagtttcccctctgtcttgctaagggtaatcatctccagccagctgctacccatatccctaactagtgatggcacctttggactgtctgcctagcaagtgctatacgctaactcttccccagagtgcggatgctcgagacaggctggattgtcgaactggtgcttcgtctctgctttcaaagtctcgtatcgtcgttcacggaggtctgactttgggactggaacttgagtccataaccatagcaaatataaatgaggcactgtcaaaacaacttccatcatccttagagatcaataattcccttttgtcaaatacagtgttcgaattgaatatcccagaacgcaaatgggagactgtccgagtagatgaagatgtcggacataccagcagaccggccccaagaatgtttcatactatttgtctccacaaccatgctatatatgtccatggaggacttgttcttgatgagcaaaagcaattcactccatcaaacgagctctggagattcgacctttatcgtaaaacttggtcctgtttgcttgcgtctaatgatgatgatgatagcatgtttgatcagtcatctttgccccgattcaatcacaagatgattcgactcaaagacctaagtgttattggtgagccaactcaccatggttttctcatagtcggaggtctaaacgcccttgacgaaagaatctacagtttggaggtttatgatattgtttcaggtatatggaaaatgcttcctggactaccagttaatgacagactagcaactatatcgtcaaagccaatttctccactggattccagtccttcatcccgccaagcacattccaaatcctatttatcttacacccattcagaaaatgccatattctccagtcctattgacgtggacaatcccttgtctgtagaaaagttagcagtccttacaagggtcgatccaggtgcacagttaaatcccatcttatcatactcattgaacgatacagagcctagagggtcaagattattgctcaacagagagcaccatacagacccatttgacccatcaattcccaaacaattgcgatatcccgaaggagaaagctttggtgagaatttagtcattatgggcttcctccctggggatttaaatatttccatctttgtttatagcaagtcctcggcaaagtggtcacggttaaacgtcttctgtgagcactctacttggtcacatcggttttccaaaggttatttgtgggcctctcaccataaaattattcttttaggaaatgagaaaacaaccagaacttctccaagcattcagttctttaacctatttgtggctatttctttgccagtcaccaattcatttagctcactgatcgatgaacaactgtccaagaattacttaagtgccaacaactttatcagcacttctgatgacttcagggattcgcctgaggatcccaacaacgtattcaacgaatattcaaagtatgctgccccggcagtaaatatgacctctatcaaatcagtctttcctcctgctgccgtcactgtaggtaagatcgcttttgccacaactgatgaattatccgactttcagttaataaccgatgagggagatcgtatttgcatcccactgaacgtatgcatgaaacgatggggaatgttcttcaggagggcaatttgcaagggatacgttgaagccatatacgaatttgctaagaccgccaccgaggatgacatgttgttgtttaaaaaggagttttacacccaaggtcgaacagagagacactctgtgaattcgtctatcttcccatcctctgacgtatcaagtcaagataacttgcgtcttaaaaaagacactgggagacctgagtttcgattgccctttcagaaacatgagatcctttccaacaaaggtacaccacagtcgtctactaacaactcacgcaagaactctgtcatgtcttatgattctagtactagcaatagttctggcattgacatcaagctcttcgaaagttcggctattccaattcagttgcctccaccgcaggagccgctcccggctcctatgggtcgtagaaaatctgcctcctttttcgagtcggagaagaatatatttggcccgaaaacgccaactcttcctcatagtaggacacactctcctgcatcttctcccaagagctcaccgcgcgggtcgttggtgcattcgaatagggatggattgatgcctagtgtgggcaatgaatcattacaagagacagaagagcaaaaaggtcacgtttctgatgcacccccaccctgggagcataaaggttctagcccccagctcgacgaaggcgatgatattgcttctgctcctgctgggtcaccggaatccatcgtccaagatgcaatcaaacttgctattgactcgatagaggtcgaaaattatgatttttcgacgttgcagcctttcctgtttacttgggcaattcctcgttcgctttacctgccatttccaacgaaaactgtgaaagctttttcagagtttttatacactggacaagttggagcaacttgggagttggtgcctacagcacttgacgttctgttggtggcaaagttctatgaggttcccctcttgtatgacttgattttagaaacgttgtaccgtattctttctcgcaaggaggtacaacttgttaaagaggctcaaaagctcaagaacgagtatgtcgatgtgatgagtgtgaatcgtggttacattgtggacccgcctcctattcccagcatcgacgagttcactgagtttttgaccaagtctgacgacggctttactgatcttagtcttttgaaaagggcatccaaagctagcagaatgatgagcgatagtcgcggatctagccgcggatctagccgcaagtcttccctatcattcacgcagttggccgcctttaaagagaaaagaagggaagagaaggacggggagacggaggaaggggtagatagtgaagaactagcagacgaagaggaagtggatgatgatgagcgagagagtgtggctgatttgagcgagatagaggcgaaggaggaggagggcgaggaggagagagaagaggaaaaggaagaagaggaagaagaggaggaagaggaggaagaggaggaagaggaggagaaagaagaagaggattcagacgatagtactttcgaagatatcaaagcctaccatttagacgactcaagcaacgaagatattgatgatggttctagccctctacatgatgtgttggcttttgctcagtctaagaaacaaagaccagaaagccttaaagactcgagcgctagtggactctccaatagttcagacagcggaaaagaaagtgatagcaatgatggtccttcttcacaacagtcgccagaagagtacctcggaactaaagataatgtggacaaagtgaaagctggaatcaaccccactcccaccctagaatctacaacgagatcagcagatgcagttcctgtcagtattatagactatatttacgaagctgctgtcttaggcaatgatttacgtttgctattacgggcgttgaatgttagatacatgattaaaggatttgaaacggagaaaccatctatcaaaaggaagattgaacaaactagaaaagagactgcagcacggcaggaagagcaactggaacagggtaccctcctccctcaccctcaccttagaggccaatcgtctccctttgcacattaccaaccttcagaggatgaagaagccttacagggaaatgttaatccacacgaaggcactgaacggtgggaaagtagccttaagccaaccttttccatcaagtcttcagctcgattgcctcttgcaaccaaatctaatgtgggtccacgagctgttcttagaaaagctcactcaatggccaacatcaacccagtagagcctccgaaaattttgaagagatcatttttcaagaagaattccaactcataactagcttgagcaaatagtatgtaccatgtaatttgcgtgctgtattacctaactttgttaaagactacttacatacgggccaccatgccgagctgcatgcgtgctggttttcgcgaagccagtaattcatgcaatacgtaaaagtagctgaaagcacgtgattgggtctcggggcaaagagagatcttagtatggcatatgcgaaggaatgtttgacgatagaatgtcatccgttgaaaagtaacccacggacatactttgggcatgaaaaccctgggaggtgctaatttttcctgcgacaccatgtacgaattagttgaaaagggaaaaaaaacggaaagaaaagcaatctgaaactcacacccatgagctaagtcagccatgcgcagaattgaataaaacgtataaactattgcgattacgaaattagtatgctgccaactctaattctcgtgtgacagggggacataatctgttcctcgttcctcgttcctctgtaaggtttggcttttttttgcttattatctagcctcgggcaaaccctaatcgatgccgcgggcaaagtgggccgcgttccgtgggttgatgtgcctgccatcaaaatagtcgccaagtttgcatggcgatgcacgcacaaaatatgcacagcaattccttgtcacgtttcaaaatgtggttacgcacagcattcttcccccaaatgctgccttctttgcagatttttaattaacctttctcctttcggttagttctgacatactcgcccatatgcgaactgcattggtaatcgtctgttggttacgcaacatgcgccggaatttgcctgttaaaacagattctgcactacacctttccatttataatgatctagtcttcttgtgggtttaaggattaaatatccaattgtgggttgaagcacagcgagtctgactttttttttctcttaccgtttttcttcttcttctttacattattcttcttctatcgacgttcagcacgttctttagcagaaattggctgtttttcgttgagtttgtttttgaaattcaccgaagcagaatttaacgccgatcagtgttattttttttcccctattgtcaacgttccgtactgactccagaaaccagaaacggtgcccacccccgccccttcccccctccgaaatccggcgtccggctataaccatccactagttcgatttcaagagatttgcctacataagggctccaaattcttgtttgcgttacttttgtgggtttgaaatttcagagaagaaatacctggagctagatcaagcaagaagagattactctgacctggaggccaacttttccggtgcttttcaacttatttcactcgaagaattgaagttgtaagtgctaattagagtttccaactaaccgagcttaacaatacttctttattgattctgtgatcctatcttgtctttctcttcaatttatcaaaccacagcttctgaattgattcttttagaagcactaaactggttcatcttagtttattttttccatattccctcctcctgtcttgcatgcacccagtttttttttactttttctgaatgaataacaagcttccaaaatctggagcgtcgtccaccaattacagctctaagccgtttaacttgaaaagcatcttacacgaagaggacaatgactcgaatatcggaccttctgccttgcaaggcaagggaaagagttcacagggatcatcactgtcaggaattgactcacctacgtctgctacttctcaatcaacctatcaggcgcaagatatctcacagagttcaacatcaactgtcaaacaggtttcccagttcgaagaacgtatccagcctggccatgcaatgggaagccatttgaatagtccaccaaacactacagcaaaggagacatccgaccaaaacaccaaccttccttcgggtgaatcttcaccctcatcaaccgcgggagctgatatcgatgatatcatcaaatctaacaacttgatcacttccgtacaatgggatgaagagaacacagtcgtttaccagtatgttgtccaaaaaatacctctatcaaggcgggctgataatgattacgtcaatgctacaaaactattgaatctcactggaatgcgaagaggtagacgagacggtattcttaaactcgagaagcagcggcaagtggtcaagactggtacgatagatctcaaaggcgtttgggttccgcttaagagagcgatcaagcttgccaaggcggaacaggttttccagaaagcacggttgatattcgtcaccaatattgctgattattaccacactcaaatagactcattggggttgaatgaggaacagaaaaggttggttctagcacgtttacgtcgcaaaacgaaaacaaaagaatcttctacgaagaccctccaaacgtatcagcttccatggttcagtcccgctcaaccaactttcgttactagccaccagacgcccgtggtgcatcttacaggctcaacgataccgagtcacggccaaagacaagacttttaccaatatggacagtattcttcgccatacggacttggagtacgtgctgacaatgtcggagcaggaattgcaccgtcatatacatcacatgtctccaatccgcccttatctggcttaccccaacattccctcgtacccctacctctgcccaaacattcccttggttctccaagcatggtgccgcccattaccccacagtcagctgcgactaattccgccccacaacaaccatttcaagtcaatccattcgtagcacatcatggcaggcctcctttttcaacaacaaactcaccaagccaactgcctacaatacttacgccgagaatggaatcttcttcgatgtcgtcagcttcctcaaatgaaattccctctccttatcacagttattcgcatggccaacaaccccaagacaaaaacaagaactacgaccaacatcacagtagttatccatagatattcattaaatacaagactcactctatagaacagaatcattttgtagactcacacctcccacagcccaaatctctgactcatcttcgaatcgatcactgaacattgtttcagcatcccctccagcctctaaacggtctctttccaccgaagcaagacgagagccaacccttctagtgtattcagtaacagatctgatctgctgtggtgaaactgcggatacatcactttcctctttggctttttcagcccaactatgcatcagtgtcatctcaggatcctgaactagacggagtacttccaaaaatgccttctccgcagctaacttgatgggaatgattggatctctcacacacttgaaaattgatggtattagtaagtccaagttcggaacgataacttgttcatgcttgtgacgtgatgctgttcgaatcaccactaaagccaacctccttgtgtcaggggaatgtgaaggtggattagttgatagtgtgcatagctgtgcaactatttctctgagttcagctggtggaatctcaaacgtactgtatccctcacgggtctcatccaaaagtaaaagcaattttcccaaagccatagtaccattgtcactgatatagggcgacggatgatttgaaagcaagattgccactggaaccaccttctggatataacccgtttcaaaaatagtccaaggtgagtctttgaggaaggcattcaaagtcaagactgcaaactttaaagattcttcatcgtgagtaatctcaacatttcctgagttccaagcctgaacattactcaaaatcttcgactggataatgctagatgcctcttcattagataaaatcttcgaaagcgaccccacgagacatgcatatgtaacagccagcttgttgttagcagcagacaactcttcttccaccaatttcataaccaaatccttagaagcggtactgatcttattccctgctttgctcacaacttccaacaaagctttcagcatagcagtaacaactccatcgtctttggcactctttgcgttagtgactaactcagaaactaaggggtcaatccttggttgaaactctattaaagttcctaaagccagcgccgctctagtacgcaacgtttcatttgaaacgtcagacaaagacttgacgaaggttctttgcaattggggaataaacggttttaagaactgaggaatcttggctaataggacattcaaagcatacaaaattgcggccttgacgtcactagaaaacctttctccaacaacacgaattaaaggtcccaccattactgtgacaaatgatttaagttcctttgctggagtcttttcagatatatctccaatagccaaagcagataactctctctgttctggcgatccatacattaaaccttgcgaaaaaattggaagtatacaacttggtcccttaggcaatgcgaatgccttcaacaattggcctttaactccagttgttgataaagcacgctgtgcaggtttcaccaagttttgcagagattccttgctttgatgcttgacaatttcgtgcaaagtggtccaagcatcctttaccaattcgtcgtcctcattgtctagcatatgaattccgtaaacgacaatatcctcagtataaacagagtaatctagcgtggtggatttgaagaatgcaggtagtcttccaaataccaaaacacgtttgagtttatccccatttttgactaatgacagcaagtgttgcatcaatggatgtaaaccactttcagaattgacggaagccagcacacggtcgaaagcagtttcaatactctttttggtttcaggatcgatggagtcgtccataagaccatttattaacgcatttaaaatgacggagagtctgttgtaaagagtagcaccagcgacctcagctaaggatcccagggcatttgctttgaaagtgtccatgggttcactcaatagagttggaagtaaaatggggaatacgacctccgatttagtggacatgatctctttcaaagcaaccaacgcgtcttccgagtcatcatcagactctaacattctcaataagtggggcaccacctcgtccactgcacgttttccgatggattcctgtagaacatcaaatgcttgagcagcagcttgacgcactagtggatttgcatccatcaatgccgacctgataatacgaacgaaaacatctttgaactcctcaatagtatccttagaacttgattcgatcagctcatagagagcgatacaaattccctgtttcatgccagtatccccagataccaaagagtcttccaatgtgggcagaagctgagcaagagcatttcctccaactctcttaacagtctctcccagggtttgtgctgcaatctttctttgaacttcctcagagctggcaatgtgtttaacaatgataccagtcaatactggcagaatttccttaattgtccgtggagtgtggctcactaatgacttccaaatgtcaacggatgcgttacggacagcagctgatgtatcggatcggcatataaacaatgcagccagcactctatcacgacgttcttgacccaagttggctaccaagttacggttaacctgtttggttaactctacctggtcatcattgatctcagtctttcctgaaatacccgtaacttggaacagtagatcgccagtaagttgaaccgaggagagacggatgcggtaactgatgtctgacatcccacgttccaattcgggcaacaacagatcgactgccttgttggaataattcttgataatcagacgacccgccctcaacgacgtttcctgaatctcctcattatcgtcagccaatccattcagaattgctggaatcacactacctaaataaggggcaaactggttgccaaaacaaacgggcaagaagagaagcaatggaataaagccagcacgaatgtgttccctgctgtccattgatttctgcaaaatctcgggaagaatttcgtccaattttccaataccgagaccgttgatgacctcggccaaagcttgagcagaacctaaacgatcccctgctttggttggatcttgtagggtattcattagacgaggaatcaaatctgggaaacattcttcccctaacttctctaccaaggagcctagagcacgagcagctgtagctcttgttgtaggcacagggtccaccatagccgattctaattcggaaatcagagtttgcaaataagggagcaagtcggaagaatcgaccaaaatagacatgttaccaacgatttgacaagcctttctcttggtagcaccggatcttcccttcatacctctagagataatatggataattagtgctaaagaagggccatcaatgtagtgaacaaactgagttttgatcaacgaatccaatgcttcctcagtgtacttagttggatctccaattgccttcaacaaggttggaaccaatttttgaatctcgggattacgaataacctcaccgaaccttcttaaggcttgatcagcagccttgcggacttctttatgtgagtcatttagaacaccaacaatctcaggtacaatgatcgataaggacgcagacaattgggctgggtctaaataggccatagcaccaagtaattcaacggagcctttcttggatctccaagcaatttcatccaagttttcgatagctaagggaatcagcttcttcacaccaaaactagtagtatttttcatgataactttagtggctgcatccgtggcctctctaacttctgtttgagagtctcccaggtttttaaggatgattggtagaacttcaataacatagggttcaaagaattttcccaatgcttgggagagacattcaaaggccaaagagactccctgtcggcgtttccagtccttcttatcctcagctgcatcaactaaggttcgtaatatatcatagtctgctaaagcacaaactcctttacccttaactagaccagcaattccataagcagcaccttttctttctgccaggttgggagcatcaaaaagtttggtcaataatgcatcaatgtaaccacttaattttgtatcaaataaaggaactaacggagccaaacattgagatacagccctttgaacctgctgcactggggtgtctaatgtgtccagtagtcgttgaacaatttggtccaatctagggtcagcagccgtcaagtgacgagcaagggcaccataaagaatggtggtactttccttggtttttccttgagctttacttgttttgtccactttttcagctaatacctcttcaaagatgggggccaacgtttcgatattttcgaatccatgcatttgaataatttgcacaccggcatctaataactcttcaccgactacgggctccttatcggctaaagcgcctccctttgttaaaaactcaaatagatgtgatattaatttagaatcagtaatgacgggtgtcagttgagttaaggataaagcgacaccacttctttcctcccatgtatctttttgaaccttagaggtccttattgggagaccatattcatccaatttgggagcgggaggttgcaattttatttcgtatagctcaataagtttttcaacgacagtattcacaacatgaggattagaatcgcaaaagttactagtagcagcagcgatagatttggctacagagagtcttattcctgcatcctcgttgccaagatatgggagcaaagacagcggtgaatcttcagtcaattcaaagtcattttcatcccaaatggtcgatgccaattccacattattgggatcattgtcaaacgtacagatccaaatctctggtagatacttttgaggactcaaatcaaactctgaatcgaaacattccaaaatcgttccacggacaaatgacagaggagataaacaacccttcaacaggattttcaggtctgaatcggatatgttgagtgcaatgtgttgtactagagacaagagacagctcctggcagtcttgcgtttagatgggacagaaaggagggacaacaaaacttccaatattgagcttctagggatcaattcatcttcaaaaagctcactatggatggatattagctcaatagccaataatagctgttcttcttcagtatcttcttcaacaaattcaaagttcgcttgagaaataactttttgagagtttttgatagcaacagtactcccgttctccagcactttggctaacagaggaataataaacatcagtgacgaaatatccagaggagattggatagagacaaacttgatcttaaataacactcttgaaactagttgagccaagtcttcctttaagtaatcgtcttcaagtttgatcttataacttctcaataaagcaagggctgcagccgttttagttgctcccaatctatcggatacaacactggaaagttccaagaacgtgtcgacaggttggcttcccaaaagaatgtacacctcttcagtttttagtatgcttaaaatactttgaactgcaacagggagccaaagatcttttccattatcaacagtagttgcgattgcactcaagttactaattactgtcaaacccgatgatatcttagtgtaaagggcttgaacctccttacgaatctgcgactcgacgcgtagttgctctgaaacaattgcttgctcttcttttgacagttttttggatgctgtcttcttcttggcaagttcagctttgacactttcttcccattttcgggtctcgtagtctttagtatttcgatcttcaatctttgacttggactgggacaagacatcaacaactagttcgccttcaggtgaattccagatctctaacctttgggaatcaagattttccaatagtagagggttcacgctttcttggatgaactgcacaagaagtggggttgccttggaaggagatataaacgaaattgtggaaattgacctggatatggctacaaccatcattttggcgctagcattgtcacctctattgatgttagacaataaagagtttagcagtctttccacaataatttctgcatgtttgtcaacaatcaatccaggatctagagaagctcgctgtgttagcccaacccaaccattcttaattttgatcctctcatgataagaaagaatcaaagtattataacagttgatttgtaggtcttcatgggaaagagtatcaactggaagtattatagaattgacaagagctgatgctttggaaatgttcaatttcagtggatcgtcatctttgagatctgactcgagaacatcatcaatagcttgaataacaaccttggcgaataatttgggactagatttgtaaatggtattgattatttcaacagcttgaatgtgaatttcgttaggcaccaatgcagaacatgtcaaatataaccaggcatgaccatatggtctgctcgtttcttcatcaataaaggatagtacggaaactagagctttcaaaaaccaatagttttcagaagtggtggtaaatttggagtagattcttgaactcagcaacacagaaggctttttctctgatgcctcagtgagggccaatttagccaatccaaagttctccagagactttatcaacgattcagaatttttccagtctttcacaatcgatggcaatgcaattacaacatatgcagattcgattgctttagctgcaatgctggctagcgccgtatcgatcgtctcctttgtcgtgttcactaataatggtagattttcttcaataaacgcaaccaactgagacgaaacggtgtttttgttgatgttgatcatggtccaacccaaagcagtaaaccaacatcgtcgcaagttaagtttcttttcggagaatcctttctcaacgtcggcgtactttttgacatttaatccacggttcaaggcagcaaaaagatgcttgaaaaaggccaacagaagagccgttaacgaaacctcattctggtctttgaaaataactgtcgacaagttttctaatatagcagtggtgacaacctctgaatcgtcgggtacagaataaattagggaagcgaacgtctccttaagatcggcagaggatactgactttagccccttgaataattcgttaactacaacgagcagatctggggaagattccgcagatccagagtgtttagataagaccactttaaaagtggatagagatccggtacgaacaatttctttggatgattttaagttggtgattagttgggatagcaacttgttcttagagagataagctatcaggttgacggaatcttgaacgttggaaaacaacagaggagcaatatggcccaacgtgttctctgaagatttaaggatggccttttcaaaagaggggagaatgtcatttgtaagatcttccacgccaacaaactcatgaaaaaatgacttgaaaaataataatgtggagggtgaaattggagtctttgatgcaaacacctgacttgtaaggtacgtgataatttctggcttgttatttttcaaattctcatacacagcaggatgagtgggtagtaattgagtagcagattctgtgatcagcccaatacatagcaaaacgctggtgggggaaaatgtcttgtcagatattagaacggaaatgagagagtccaaataccggtacgagtcaacaggacttgctgaaaatgactgtgcaaaagaagtcttcaactgagtaacagaagaatccaatatcctcctcttgtgacgtgaagatttgttcagtggtaatattgaagattcctcagtatctcttgagatcatctcaaaggtattggcaatacagcgaagaattacgacatgatactgggcaaaaacatcgggaaactggcttataaacaccaaaagcgtatttgaccagtccaatagcgtcagaagatcagtcaaagctatggatattttctcatttcgcacaatgttgaatacgaactgcgtaaaaatgggcagataataatcggggttggtgcttaaaatggtcctcaaactgtcaacgacggcatttctagatttcgaatcttgatagtaataatagctgttcagcagcttcgaaaatatgatggcaatatcctcttgagggatgtcgctggggagtaattgagtgagcctcttcagagtgctaattctcactctggtggaggatgcagagagattttcgtccaaagagccactcaattggtcccaggaaagtgaagaaacaagttctgtcattttctgttatcaatatcgggaggttactcttgatctgaaccgtttagtgtattcccttggtaggcagtaccaaaattttcaatcctggatgataggtgttaggaaggatcttgcgtagtgtacctatcaaccagctggatacgatttagtcggccgtgccaacgatttctttcttcttcatcaactaaacagtcgatgaggaaaggctatagttaattcatccgttgcagtatttgactcggcaactttggtgtgttttcggatacaccgaggttctgggcgctgtggagagcattgtggcctttttaccaccttgacaatgcttaattgagttctgaggctgtcctagttgagatttttcagggtgttgattatgtaatttatattttgtctaggtaaatcgcaaaagggtgtatgtatcaatcgtgaggtcgtgtttcaccaaatctgagaatctcccattttcgacctcgatttctccgaaatgttccctcaaaaaaactaccatcctcacgtgatgtggttgaactttccaaagttcatacacaatatggaacatttttcttatctaaacaatcggtcctgaaaggaaaggtgcttttgtacggcgcctggaaataaaggacgacaaaagacgatcttatcatgtgaccaccgatattactgttgactggtatccaaagggagacgaagatacgaagcatacgaagagaagagcagggagagggagactggggcaaagacgagggatacgagggatggcaggtaaaactagggagtgacgcgagtaaaccgttgcacagactatatggaggaaaaaaatgaataaaatggattggaattgcccgaaagtgatcagtcgacttcttgaatttgctcaagaagttgttttacacggtttttgctccgcctggaactttccgcccttcgtttattgttttctcagacgacaataagaaattaaacttttccctgtcattgcgtctgattctggtaaattcactcacctcctgtacctctactcttcccctatccctatcccaacttttcagtgaaatgtcaggttcggatttaatttttcatccagcgatgtttgatcacgtgtctgatgaaaaagataatttggtggcagatttcagcttggacaagaaagaagacgtcagatggagcaacaaagtggtgaaaacttgtgtgctctagcaattaggtctgtggccagatactggccaaaatttcgtccaaaaagctcaatttttcaccgtaaactgacggtgttgtcatttggcaaagttgttccagaaatccagttttcgcaggtgctgttggaaataacattctgatttgtggtaccaggccagtcgtcacaaggagcaacaaaatagccaacctgtatataaatacccacaagcctcttccttccttggttcgtttgtactctgtcaatctgattaaatcttcacggtatccactaaacacgtaacattgtgccttcccacgcaacttcacacaaggcctaaactgttctggaactcgtcagctaaaagaatcaatattacaccagataccctccaattttcaaccacactgttcaaatatgacctggggacaaactctatctgtgcaagagccactctttgcaccaactcctctccatttcaagaaatcccgacaggacagtctcaactcagatttttcgtacccagtttcattatccccttcgtcgtcaacatcgtccatttctgaagatttcctccctattgataaagacatgttgaatctgatcccagatctgtggtctggtgagacagacgatcctttagtctccacgcagaagacacagaatccgccccagttatgcaccgccacctctacgtggcaacagagaccctcctcgtggtacagccacaccccatcacagacacagcttgcatcttttaatacgaccccgttaaccgaagaaaacttatttctgctctcagactctactattcgacagccacaggtggtgcatgttgagcagaaagagttggaacgaggaccacaacaaccgctttcaaacacacagtctcactcccacacctcacaaacaaaatcagtggattctaatcccactctgaatacagggctctacaagacagaactttgcgaccagtttaatcaaaagggccactgtccatatgggacaaagtgtcaatttgctcacgggactcacgaactgaagtccgtgaagagaccttccaactggaagacgaaaccttgtgccaactggaccaagttcggcaaatgccgctacggtaaaagatgctgcttcaaacacggagatgattaactagttcttactgtcaaagacaacgatgatgacacttatatttatttttacatttaaccttgattactcaaattatatacatacaaatagctgtgctacttaccaatagttactatcaatggaaatgacataatgatatacacattatcgtattctaaactctacacatacattattgatcaattacaactgttaaactaactcacaactttgtgtttgcctcctcgtaaacaagggcaaaggcctgttcaaggtctgcaataagatcatcgatgaactctgttccgacagaaacacggatagagtccttggtgacaccggaagccagcttctcctcgtgagacaactgttggtgagtagtgtagtaaggagcaatgatcaaagacttggagtcaccaacgttagccaagttggagaaaaccttcagggagtctacaaccttaggaccagcctcttcgaagggagtgagcgctggcttgccatgatccttgactccaaaagacaatacagcaccgaaaccgttcttcaagtacttcttagcggcctcgtggtagtcgtgagactccaaaccagggtaagagacccagctgacgtatggagaggtttccaagtatttggccagcttcaaagcattctcagcgtgtctctcagctctcagagataaggtctccaaaccgattatgttcaagaagttaccgaatggacttgaagcaggacccaaatctcttagcagttcagttctcaagtgaccaatgaaggcagctggtccaaaggcgtcattcaagatcaaaccgtggtaaccctcagatggcttggagaattgagggtacttctctgggtagtctttccatgggaacttaccagagtcaacgacaacaccaccgatggtgttaccgtgaccattgatccacttagtggtggagtgggtgacgatgtcagcaccaagctcgattggtctaacgtagtaaccaccggcaccaaaggtgttgtcaacaactaatgggataccgtgcttgtgggcaagctctgcgagagcctcaaaatctggaatattgtactttgggttaccaatggactcaacgtagatggccttggtcttatcatcgatcagtctctcgaattcagctgggtcatcaccatggacaaatctggattcaattcccagtctcttgaaggcgaccttgaattggttgtaagttccaccgtacaagaaagaggtggagatgacgttgtcaccagtgtgagccaaaccagcaatagccaggaattgagcagcttgaccggatccaacagccaaagcagcggcaccaccctccaaagcggcaattctctcttcaaagacgttctgagtagggttcatcaaacgagagtagatgtaacctggctcctccaaaccgaacagcttggcaccgtgctcagagtctctgaaaacgtaagacgaggtagcgtagataggaacagctctggcattgtgtggagcttcagcggtctgaccggcgtgcagctgcaaagtgtcgaagtgagaaggcatctttgtatgtgaataaggaaacgttagaaatcatttcatttggtcggcgattggatgatttaaataaccaacctgtgaagcattacatcgaggggtttcaatgttgacaactcacgtgatgtggtaaaactttatgggaacggagagttttatagtgaaatcgggtcacgtgatgcggcaaggcccgactaatattacggtaattgataaagaagtcaaattaagttttggagctgtggcgcttcactgcagtactataaaacagacaattacaatctgaagcggaggggggtatcttttggaaatgtggcagtgggccgccccctcacgatagatggtattgttagcattttttcgtttatctgagacccgttaaatctgttcacctcactggtgtgggggttcgttggaaagggtgggaaaacgtgtaattttttttgatgcaccccctctttgttgctatgttgtatgtcatattccagagatcttgttgtaagcatggataggaagtgactccattctctttgccactctctcctctcaaacttctccttggcaattgaacgttcctgtttccaaattccagctcatctcctgttcctctcatactgggatgaaaacggtaatgaacatctcaacagcatccaagatatcccgtcttctacaactcgttattgcccttatcagtctggttttgaccgcccaattggccaaagatggatcttcgttgtcctcacaagtagactcaatcaatcagttaataaccgatgatgtaataagagctactgaggagagcgtggaaatcggaactccgtcaagctctagcagttttcacgccacatcccaaaacccaacagatcagatatcccattcggtctcgtccacattgggactgaatgtcagtaccagctggcagtcatccatcctgagttttgtaagcactggcataactcttgtcaacaacccgctattaagtgtttttaagcgtcttgtctctagaaaattgcaatctttttacgacggttcggtgttgagagttggcgaaattccttatagttcgcttcacttgcccaaccatggggtagcaagggctcagttcttctacttatcctacagcgccagctcggagtttgttctgaaccttgtacacttttccaacgctgtttatcaaacagcgaaatacggatcgtggagttgtaatgaagtatcaggcctgctgcaccagtatcagctagaccgaaattattcctccgctgccgttgcggattttttcaaacgtctttccgataatgacaccgcatctccatttgatcagttggaagatgccatgcaagtttatctgccttcgaacttctcagagttgctacaaactgataatgtcgatatcacgatagagaaatctcagctatttttggatctttcttccgattgtacgaagaaaaaagctaacatggctataagttatgtcctttggggggtctatatggtatccacaggtctcataagctacactggtgtggtttttaaccaaatattgaacaagaaatatcgatctataatagaaactgggacaaaacaaatgatagaaagtagtcatttagactatgacgagttgagcctagaagaagcattattattaagagatcagatattctctgcagatacaagtctttcaggaagtatctatttggtctatacagcagctggtctgtttccgcaagtgaaagatgataatgagttgaagcatacactagatggccacaaataatcaatagctaaacaattgacgtatcatttataccaacagcagtagcaataatgggatgatgtagctaggtcttgagatttttggagcaatgttcttttcttgcacttctggttctccctgcgtgaatacttgaacttctggctcactctgtgtaaagattgcaacttgagcttccagagtttcggtaatagttgatgttctgaacacggtaggtgaagtgacagtaacagtgaacgtttggaattcggtgacatatacagtgttgtaaatcgtggaaggagcttcagcagcaatggtcgatacatttggaatgggaaccgcaactggtacatagtctgtgaccaataaggtgttggtcaccacttcagggtacagtgtggtcaacacagtatttctgtcaactattgttgaatagccagttcttgttgttgagctggcccacagtagataagtgtttacttctgtataataatcgtattgcgtcaaacatcgatcttgatattccgtcaatgtttctacttggttttcgccataaatagcgtagtttgtcctggtcttcaccttataaaatgtcgtccaagttgtataatttagatggctgacaggtgatgaggataaaaccacagtgtactgtaccgtatttattggttctgagactgtcttccaagtagttatttcatgaggcacaggtgtttgagtgcaggagagagaccaagcttctgttacagtaccacggataaccagagcagctgaactgacaaaagtgacaatggtttgagtaaatctatcttcatatactctactggagacaattggctcaggttgaaatgtagtgagtatagtagatatgacaggagaataaattgtagttgtcagagaaggtagagtggtcacaagttcactagtcaaagtgacaacagattcctcaactgatggtgttgaagtagtaacaggcgtttcaattgtagtgacatctggtggtccaatcgtagtttccacaaacgtttcttctgaactaggttcagagggaataaccagctctgtggtggtagtaattggaggaattggaggaattggaggaattggaggggtgtcctctgtggttggaacttgtggctcttcatgatcagttggctctggatcaggggttgtgggatccggtgttggaattacagaggttggagtagtagggtcgggcgtaggaggtaccacagttgtagtggtagtctcgtccgtaggaggttccacagttgtagtcgtagtctcgtctgtagtaggtacttcagttgtagttgtggtatcatccactgtagggatatcagtgctggtgttgatagtcccttgcaaggatgatgcagtggtgatcagtacacactccggacagtcaaaatcaggatttgtctagcagttgttagttcagacttgtcgttcacttagaactggtcaacaaacataatacgagtattctggtatgtctataccgtagacgattctctgaaaccagagaattgcgaaaaccaattgaattagttgggacatcgtggattctaaccaaaggtatagacagctaaacaaagaagaggagcgtaagagggcataacaagggtatttatacaaaggcaattttcggtctggagaacaagacaaagaaaaacgtcatgttgggattgagagagaatctgtgcggctcacagacaattgaaattttcgatggggtttaacatgaggcagattcaattagtattctgtagcacaatatgagagatctggcgtattaaagggcagattgttcttagaattctacttatatacattttgtaacaaagaaaatgagtttcaggattgtttggttggttattttgtgggctatggtgtcagcagagttgccaaacgatgatggtggggacgtgccctcccagatattggaatccgatagtttggatgtagctgtacaaaaactcagacaaatatactggcagcaggttggaaacaacaatgcttctctgataaatgtgttctccacaatagacactgagcagctagaagttttggaacccggtaatgagctgtatggtcagctgaatgaaaagttccatttggacgaatactttgaaaaacacaacgatccagttccagtctggaaagaagggctgccagaccttggagactgggagtcggaaaatgaaaatgacgggcgtgaagatgatgaagtatctgcttcagggcttgaactgcccacatcggagacattggactttgtctttcgcaatgtaatgaaatatggatccatggtactcatgccaaatggagaggtggaaatcctggaccctgaacaactatccccagagtcatatgccggtgatattattcgacgtgataaagatcagtttgccaaaatatgccgatacaaaagagtcagcgattttgaccttaaaagtgttcaagagatcctgcaggtgtatccgttcttttgtgaaactcattttcggtcactgatgggttggggatataccacagcaacgtacaagtaccgaatgtatgatcgtgctggaagacagagcaatgctgacttgaaacagctgaaaaaaaaaataatccaagattatccggatgttatctaccctccctccctcaaagtcaacaaaagactccgcaattattgttcgtccaacagttcttggccttacacaacagcgcagttagaactaagccatgtagttgcaaagttaagggaaagatccttctattacaacacctgtcaggggttgcctagctttcaagataaagaaatgagcaaagaaaaagtggcaatctttgcacgggatggcaaaatttcgtgtttgcacggtaaaacaagccaggatatctgtccgcgtaataatacgaacacccatgtcaacgtcccagagtgtttagagcaacgggggttggattggacagtttccgaagattacttcagggcaaatcccccacgtcacttgacacatcgaatcccgtccaaaagttattatcaggctacacgcaaccttttgtaatgcaacaatatatacaagtatcgagtaatactaataatgtttcctttttttcatttcttttcttgattttccagagaggttgaaggtaaatttagagagctcagagaaggtagtgctgtgctttggaggttctctgcttcagtggtctcatccaaagctttgtgaagtgtctccaagctattattggaaacggattttggaaagagtttgggagacactgcaggggtttgcaaaggggtgacttcaggagtggcatggttcagcccaagtcctaaaagatgcagagccgctgatgaaaccttggaatcaatatgggatggaggaaagttacccttagattgctgctgtgccaagttagatgtatgctgtgattgttggtattgttgaaaagtcgttggagatcgtcctgtgagcacaggcgaatttggtcgggattttttcaacattgtcggaggagtagtgaattcgtcagcaatctctgtgttggaaaaggttcgagtcaacgaagtaacagatattgatttgttgattgaaacacctccggacgaagaggaagaagaagaagggtttattggggtcattcttttaagtccgcttagactgctgaatggcttcggatgagataacggagggtttccaccatgagaggagtcttccgaagcaatgaagtattgagttaacgaaggtagagattttacttgttgcaatcttgaagagttttcctctgcagcccttaactcttgtagttcctgagaggcagcagtagccagcaagttgatgctcagagtagacgcacttcttagagggttgaacttggcctcagctgtctggctctgagacgactttgagctcggagttggggttgttggttttcccaccgtggtagttgctgctgcagttggaatcgacaccaacgggaaagaggaagcgtcatcactgccgtaaaactgctgatggccttcgcctaaagagtagttgccctcgtcactatatgaggctgacttgcctgccatctttggtctaggagtcttcttggggacaacacctggcccccttttccttgggtttgggttgttgtgtattctggaatgtctggtcaactcatccgaccttgaaaacttcttgaaacagccgggataattacagtggtggggcttctcacccgtgtgagtccgtatgtgtcttgtttgatgctctaatctgtggaaagccttttcacacatgggacattggtaggggcgtgataactctgattttttagagctggagctggagtttgcgttagaagactccgcggacttcctggagcccactttgatatcacccacagagtcccccgacgatctgacacttgccacacgtgcgttgggataggcagtggtcatgataaaaaaaa

SEQ ID NO: 113 - DNA, 51443 bp, Pichia pastoris
gggaacaacctggggcaaaattgggaagaccaggcttctcgtttttttttcgcccattttatttgttaggggaccgtcccgatccacctttcaaggtttttccttttttcttttttttttttgggcagaaggaatgaaccaatccgcgcggggattaaggccaatggcgttgtagtgtttcaagtgtaagggtgaaggaaagaggcaacgtggcggggaagatagtgattctacggtgaaattgacattgctttgaaattgcccctccaaggacttgctttgctttcgttggaagatggttacaggagtgattcgaccgttgaaaggaaggacgctacgacaattgaattgttgtgataatacataggttacgtactttcctattcttccggctagaagggatattatccttcaacctgaaaacttcgccgttgggatgctcctaattatctcacaacgttttgtattgcatcgtccgtcccgttctttctgctgtggtaccttctttcttacccaatcatgttcgtctccacatcggattattgtttttccgttagaccagatttccccttcgctgctgctccaattccaaagtctcaaacaatgctttgaaattgcctgctccaaacccgttatggttttctcgttggatcacttccaagaataaggtcggccggtcctgcatcggtttactgaataactgcaagaggtaaccgttctcgtcaaaatcaaccagaattccagccttttccaactcatcgagggattctttaatttcgtagttccgttttgtttctaggagacgctgccgcaatctagagtagtatttgggtggaacgtttataaactccacacctctaaatttcatgttcttcactgtggagacgatattgggggtcagcagcgctatatgctgcacaccggggccctcataaaagtccaagaactcctctatctgggacttcttaagtccctttgcaggctcgtttataggcatttttaccagttcgttgcttgaggccatcactgttgacctcaatgctgaatattgggtgcatatcacattctcatctaccgaccaaaattggtgaaatccaaacgctttggcataaaactcgcaggattgaaacatctcattccagtcttggttttggacacaatgatctatgcaagcaaatgaaacttttggtagcactttttcgttcaattctgtcaccgtctgcatgtagtcatggccaaaggcgtcctcatatgatatgtaccctggcatgaacacacctttatactgacttcgattgatcaaagtatgcacaacgtcacctaatgctccaactttggctattaccaaagtagacccttcttcttctagagctgtaggtttcaagattggccgtgctccatttgctactgccaactcaaatacatgtgaaacattctccacttgaaaagcaacgtccttcaccccatccccgtgttttgcaacgtgattttgaatttccttgatcatcagatcctcgtttttgttgtcactaaatgatcttaatgtactaacgaactggaacgtcacagatccgttagatacaacatgatgacagatattcttggagccagtttccaatcccttgtaggctatggggtaaaaccctagagagtttatgaagaaccgagagcttagttttgcattagacacatagaaggtcacatggtcatatgctacaaatccgtcgtttgcaagtttaggcatcagcgaggagtcgatagataagccttcgagttggttggttttggccaacgaggaggacaaatccaaactatcttttacaaggacatgctctgacaagggatttactggttctaccatgagggaaagaagattcgaaggagcaaacgggtaagttcaaaggccacaaagttggaggagtagagatcaggaaagcaggaactacatcgcggttctgaggaaggagatgtccgatgttagatgtaaaggggtttgcttatctcccgtaggcattcaatgcattaaaatgaagtctctcccaaaaacagcagtaactccttccttccccggtttcgtaactgcctatttatgtgaacaacatcctatattagtaattatctctgcaatagcccactgctcccccagatttctaatcaaacccccgaaaaagtcgctcccccactaatctcatagattttcccccactgttgtcaaaaccctgtaacctcccgattacgcaatatctatacgatattcacttattgttgcctagctataaataaggacggctcacccaaatttcaactcttcatcaaaatgccaggagaaagagttttacttaccggagcatccggcttcattgcccagcacattacagacgttctgctctctaagggttacagagtcttgggaaccactagaagacaggaacaggccgaccaattgactcaacaattcacggcagagtacccgaagatcgctgaggacaagtccctgttgcaattccatttggtccctgacatcggtaccgacaatgctttcgatgaagtcttgaagcagaacccggatatagatttcgtcctgcatactgcttcccccttctactttggtgacgacagacctttgaaggaggtttatttacaccctgctgttggtggaaccgagaacattttgaacgctatccaaaagtacgcttcagacaatatcaagaaggtagtggtcacatcttcgtttgctagtgttgtcaacatggacaagttcaaggataaacgtttcattcacaatgaagacacttggaatcctcttacttgggagcaggccgaagtagaaggagagacttctgcttatagagcctctaagaaatacgcagaattggctgcttgggatttcgtcaagaaggagtcgccaaagttcagtttgactaccatcctccccccatttgtctttggtcctcagaagttttcttctagcgcagccaaaggcacattgaacacttcagccgaaattgttaacaagttcctttccactgagtatccatcagatgacaagttttttgatgctccaacccacttgtctgttgatgttagagatgtggctctttaccatgttttgcccttagagattaatgctctggctaacaagaggttattcactgtccagagcaagttctctggtcaaagaatattgaatattctgaacgagaacttcccagaactcaagggcaagattgctgttggacaacctgaaaagacagcacagaatgaagctgccaatggtccagaatacaacaatagtttgaccgtagctttgggaggagtcgagttccgatcattggaaaccactattattgattcggtgaaacaaatccttgagtctgcaaaataataagatttgattaaatacattaagtttatacaaatcgaatacaattactccttctcctccttctttttggtcctctttacacagtacgaacaatctcaggattactagttctttctgagatggaagatgttctttccttatttgagatcactggggaaggctcgacagcctcattaccgaccaacatgtccttggggaacctgtctggtctatagaaacgtaagtcgattcttccaagcaaatagataacgttgatgactgtctcaaggaatccccaaagcatgtacatgacaacaggtttaaatatccagctttgggtctcaactgtcctatcgaggaaacaagtgatggcacggaagacggctccaatgaggatgaacgtggtggtaagtgtgacaataataatggaatagttgtgcttcagttgtcctgtactggaagagtaccttacaagattgtcctcattacctggttccagcttcagattctctgcagttggctctggaagtacgtcagactgagcgttgtagtgatatgaagaggcaatgattctagtcgacgcaaaggcagctgcgccgttacgaccgataaagatctgttcatgttgtttggcactgtcctttaatgggaaataagttggactgaaagactccaaccaagttggctggtaaatcaggcatcctttatctctcttggttggtttgaaaagataagacactaatatcaaaccagttgccaaaagagaatacaaaatgaccaagatactggacaccttgaccacgttcttgctcatctcataatttctatgggatagcagatagacgtatggaacaacggcagcaacgatggtcatcacaacaacggagataaccacagagtaaactgtcaataaagctccccaaaaaagcttcgaagaccccacatacggatgtctccaagtgaacagtctttgagctagaatcaaattgaaactggccagcagaatcgttggaatgattaagaacacttcggatgcaatacctacctgcactcgggtgatttccctactccatgcgactctaagagcgaacccaacgactctcagtagtgcataaaaagcaaacccaaaagaaagcaagaacttgtggcccctgctccaattgatcccaaaaagggtcaagtgtgccaggaagataaagaaaaacaccaccatgaaaatggctgaaggtgcagtatccttgccgcttggataatcaccaaaaagagcaagctgtttcccctgcacgtaattgattagctccctggggattctatcaactcctcccagcatatcagcggcagagtttagacggggcagaataccagttcctgggtctgcgccgttggttcgggcctccatcaaggataccatttgctgaattagtggacttagtggagcagacattgttgagtaaattcgattaagtttggctcgtttgttagaattattcaaaggattttatcaagggcaaatcaggagaaccagacaatgccttttataaggaccctggtcatcatggacgatgggtttccagaatgacacgatcttttaccccacttattcaaagtttttagcccaacatgccaacacgctaatttgttgtcttgcgaagagcaatcgaatcacatgacaaaatggcgatgcatcgcattaactactttgggatctactggttcgctagtgcatacccttatgtcaaaattggggaatgcccctcgaaacagttactctaaccggcgtttcggaataattgcgatagcatatgtcatttcgggaacacgcttgcacactcacaaatatattatctatttccctgttctgcaacaggagggacattccataacctatttcctaattaaactttatcattaccaatgatatttgtttcagaatcaatgtctgtattggagttggaggactcagggtcgtctccgtctccgtgtagctcgtaactcaactgctcaagcgacttgcgtttcgtttcagggatcagcaacgaagtaaacgttcctagcaacatgaacagagcgaaaatctccataacgtgtggaaggaaacagtttggctcttccttggaacagccgtgattggtcagggttccgataaccgtttgggcaataatggctcccactttaccagaagcagcactgataccatgggatgtacttctgaattttgtggggaaacattctccgggaacgatgaaagttgtggtattggggaggttttgaaggaattgggcaacaatgtagcatcccagtaatccatgttccccgatcttgtggtatccaaatccaatgatgcagaaaatcatagtcagtagaataaatccaacaatctgtagtggttttcggccaagcgtgtcacaggtaaaggccgtgaaccaataaccagggatagaaccggcacagatcagaatcagatttcctgcggcagagttgaatagtttgttgtaaacattgtcattcttggcataaccaatggtttgcagaatcacagcagtgttcaatcccagtccataatatgcaatatccaacatgaaccacgaacctgcggtaccaatgagaatctttccatgtttccagtgtttataatgatggtagaaatcgtgccagttgacttttcttgacttgatttcctcagctgtcttcttaagttcttcctgttccacttccaaagctagttgcttagcatttctcaagatgacaatatcgtcttctgtggctgctccatggagaccagacgtaaacttcatggtgtcacaggcggctttttcaatttcgtgcgtaacatcaaaggtgtatcttggggattctggaatcgtcaatctgaaatataaagcgaccactccaggaacacaaccaaaaccaatcagaatacgccacatttggtcacaggccttttgacacgcatacccacattcggctccatttttggcagtgatcaaatcatctttgtatccggcaatacagatcaaagcaaccagtccagccaataattgaccccaaccttggttagcaaagacagcacccatagttaatcctctccatctaacggatgagaattcagaagatataatggaactcattggataatctcctccgataccaattcccattataatacgataaaaggtcaaaattgctgggaaggaaatggctttggattcaccaacagtgcactgaagaacagtagcaaaaatcatgataaccagttccaaaccatatattttctttcttccaaagaaatcagcagcccaaccgaaacctaactgtccgataacagttccaacagaggtcgaaactttcaataatgtctgagtagaatcgggaattgatcctccccagtagacgaaaaccaacatagccagacccaaattaatagcaaaaatatcgtaagcgtcagtcatgaaacctacaccggcgacggcaatggctctaacatggtaccaggagaactttgcattatcgattgactgtaaagcgagtcttctcctctctttcggatcttcgatgtgagcaaagtcattaatatgattatggaaagcggagtttccacccttggtcttgtatccggagctcattagaatgtctatgcttgctgattaacagtcggtgttttacgactatttatacagtgacggttagaagagacgcactaacaagctttctatcaacgtgggagtcttcatgtctcttttttctcatttctttgcatagattacaatagatgaatttccgagatgttcaaattaaattgactccctcgatgtagagcactcctaaactcttggctgcagtaagtacggacgtatgaagataagtccatcaagtccaaagagttcagaatttactaaccaacgaatcgtctacttcagttcaggcctttcttttttttattttctcacacgacaagtactttctactgattatcaaaaagcttgattgcacacgtgggtaccccttgtcactggatcgtctcatctttcctcccacgtgagtactgcaaatgtatcatgctttaaattctacctattgtaagttaacaaatagtcctccgtccaccaacacctgggctccggtaacgtactgggacatgtcgcttgctaggaaaactgcaggcccagctaggtcatctggaactcccaatctttgtagaggcactctcttttccatggccacacgtttttcgtcgttggccaaatcctcttcattgagtccggttctgatggtacctggcagaagagcattacatcttattccgtattctccaagagcaacagcttcactttgcattagcgataaaataccggcttttgttggagtgtaatgagtttgaaaccctccaccaactagagcactgatactggacactccgatgattgaaccacctttgccctggagcttcatttgcttcgcagcagcttgagtggagaaaaatgctccgttcaagttgatttccaccgtcttcaagtaagtttcagcaggcatctcagtgaactctgcaaaagggcagatcccagcgtttgagacgaatacattcaactcaccaaacttttcaacggtttttgcaacaagatcctttccagtctcaggttttgaaatgtcacctggaacagctagaaacttgtcctctccgatttcttttcccagctccttggctagttgagcttgctcttcggaagggaagtggttgatgactacgttagcaccctcatcagccatcttgacagcaatcgaacgaccaattcctgtagctgctcccgtaatcgccacggtctttccttgcaacagattgtaacccattttattatttctctgtattattcaaaggacgttgatctgaagtgaaatctgttcaaccatacttattataaatggggttacggaatatgtttggtccgcttttaattaaaaaataaaggtagtgctatacacagatccctgacgagtaccccggaaacagaaaatacgtgagtgtgaaatataggagactatgtaaacatattcaaagattgtaagccttcaagacgttgtcgtagtaaatggcctgtttttgttccggagtcaatccgtgccgatcaaataacttttcagtaatttcaatccaccgagccacagcaacttcgcccccattgatcgtacaaactggataatcactaccccagatcatcctttctgggccccataaattcaaacatgtttcaaaccatgggttaatcagatccacaacttcatcaacttcaaactttcccgctttgatacgggcagaaagagctggtgatagctcggaaaatcctccggaaactttcatatacgagtctgagtgctgttttatctcggacataaaatgcttccatttgtcaaaccgatcttgatctatatccatgttgtagtaatccggcttagtcaagtggttcactattaaacgacatcttgtctgcttgcacatttcaatggcttcttcaaactgccataaacctccacatcgcagatcgatccctaaatcaaatacaaatccattatcggaaagccagtttagagactcgatgaagggtctctttatcattgttcccgaaggcttgtcctgaactaaatacctgaatcctttgcaatacttttgaaatgcgaattctcccttggacacctttaatttctccacaaattgggtcaaactccgtactccttcgttcaatggagcccatgggattagaccaaacaccttgaactcttttgcagattgaaactggtcaacaacatatccatactcctttactgcatatctccagtctgcgctgtatttcacatccacctctataaacaccaagccttcaaccttataggcggagtttttcacgctctccgcgtactgaaccacctggtgatctccacaaagaggactctctggagtcatccagctgaggtcaagagcattctcttttgaatacaaatgaacatgagagtctatcaccttcatgatttgcaaccacggaccttgaactcttgatttagtaagaactaagcaccgaaacctatctctaacccacaaaacgttatccttggctctcggtcaaaagatatcgcgcgctaagtgacttttttcccctaagtcttacgtactcctgagtaattttcaggtctgatcttagatcatcatctatccttgaagactgtcgattacgcagttcttacacaactgtatatggattcaagctctaatgtggtcaaaaggcggagatcaagcaccgatgaagaaggaaagatggtagaatccggggaccctaacgaatccagtaaccattctagactctcaaagtcctgcaatggttgtagggcccggaaagtaaggtgtaatggagagaaaccttcatgttcttactgcttgaaaactggtatcacttgcgtgttttctcctttaaggaaacctggtctcaagaggggctacggtaagcagtttgatcaaaggctagattcagttgaggagcagttgaaaacttttggcgatgagataaagatgatgaaatttcaccttggtgaagctcattcttctaacggagagcttttgttgataaaggataaggttagcattctcgagtcaatgaccaactctctcaaccaacagatgaatactcatctgaaccaacagcaattgcgttcaacgccagaacaacctaacgaatattatccactgcgtcaacaactgcaagtatcacaaaaaaataagccgccgaagagtcttggaccggattgttacatgcctctaaaggtagctgaccaaaattataattctactccacactccagagtttcagattcacggaatgttatcttgaacagttacgatcctttgatgcccaacgtacctccagtcaagattgttcttgatctgtacttcaaaaaaattcacccttcgtttcctgttttgcacgaagagtccatcactgccactgttctcaataaaagcaagactgttcctccaatttattacgctatcgtccttttatgtctacgatttatgaacgttacgaaaaaagaggaagcatcatacaacacctactgtaaggagaaggtcataatgagctctctttctgtctcaacaatcccacaactgcaggcgatgctcctgttggcctacagttctttcggtactttaaacaatccagagacttggtcgtacatttctgttatcagcgctggtgctgttcacttgaatttgcttaaagaaattccaaactcccagcaactacaattcttcgagagtaaggtaagaaggcggtccaccacaagttctgacctgagagacgaaggtgccagatcggtaggatcaaactctaactatggccagccgactcccagcgaccatgggggtgtcagaaaacccttgaagccaaaatcgatctctaccaagagtgccaagttacttcgtcgccctgataattggttggaagaggaatctagaagacgtctattttggggcatctacatgctagacattttttccgctgtatccaattctttccctttgaaagtgccctcaaatgaaataactgttatgcttcccgtaaaagcagagttgtggaattggaatccggtttcctctcagcactccagtccgtccgggatctacttggataagagatcaccccaatcagcagaaccggtgcatgatttgttaaacgatgaattgtatgactcttttggatattatattgagctccttcatcttttaggtgaaattcacacctttttgcgtattccagtggatatttatgttgcttcagaagtactcaaatttcagaacaaattccttctgctatataacaagctgatgaaatggaagtcatctattccagagagaatccaaaatttactgaataattccacaccttggaatgatatgactcctatggatttcaacctggctgctttgtacattacaacttctgtcagattaaactctgcagtaggataccctcatgctgaatcagacttcttaagctcctccaaaattgccaaagaacgatgtataaaccatgttaatgagtttctcagtctcacagccttggttgagggttcaccgttgtttcaagacaaatcaacaggttcctgcgaggatgcctaccgagtgctaggtccgtgctatacgttcacatgctgggtctgcagtcgtgtgttgatggtcaactgtatctacaaccaaactccctttcccaaagagctggacttgttagtggagaagcttctaaggtttggaaagtactggcattatgctaccaaatacggaatcatcattaaattcttgatgggtgatcaagtaaaccttcagaaagaccgaatggaaaacgcaagcgtactaaagacggaaggaaatgatgattctgattcagaggacttgtcgaacaattacaagatattctctgatatgcgatacaatgcgtacattctagattccatcttcagcaagaaaattgattcccttaggaattctactggtatgggtgaaaccactgcttctgccgaagagactggtggtaacactgataatcagcagcaacagccgtccctatttggaaacacatccaacaataatattaacaataatgataacaatgaagaagcaactgaattcaataacttttcaggaactggaaaactgggcgtgaacgataaggttgaaagtcttgataacatatttcaatggttcaagtttcctgtgggcgtttctgaagctacctcaaatgttactaggccacaatactctgttatgccacagcaagttaatccccagcatgagttacttcatggtgaacataagagtgttgcaaacacacctaaagatagatcaaatagagcaagtcccgcttttattacatccaacggtgatactctcttattccggaacttgaacatgttagatcaagtacctgaaacagagttcaattcggttttggaatccaacgatccatcccaggattggttacataatgctctgaacttctcctacaggaacaactaaaaaaaattatgtagcatgaaaaaatattttagtgtatgacgcgttttctacaaagtcctttcaacagcttgaatctccttgaagtagtgctccaagttttcccaagctccagcaggcaaatcctggttcaatggggccctacctagatagttttcacctattccggctcccaaatgaatagccttcttgattccaatgacgccaaaattaaccacgatctcctcgcctctagatacagtgttctgcagttttactgcctcctcaatcttgccgtcctgcaccaattgaaagattttaacgtaaattttaggaaaggcaccagaaagagcatcgatggttcctttacagccgatggtaagagttggaactagcaattgtccaaggccagtaaaagtgttgaagttattctgctggacattcttatcagtggcaattattgtgtgatgggatacgtcaccgtgtgaaattttagtgccaacaatgtttgggtgcccagatagcttgattactgtggcagggtcggtgaacaagttattggaaactcctgggtaaacgtacaccaaaattgggagagaagctttgtctgcaacggcagtaaaccagtcaatgataccttgttgcttgataccagcaccgtagtaattacttgaaaggactacagcatgggtggctcctgcagctttgatggaatcgatctcatccagggcatcttgtacactgttttgaaccacaccaccaatgatggggaaatctggaagagcgtcatgaacagcttttatagttgcagctctctcctctttagtcaaatggacaccttcaccggtggaacccatgataactaaaccagcaataccgttgtctttcaaaaacttcgcatgcttgacattagcgtcgaaatcgatggtataaccgtcgttcttaaagaatgttggtactggagtgtaaattcctggagcaggaggtactggagacattggttggagtaaccgggaagctggtagaactgttcattatttatactggtgggttacagagggaatccccagatttcggtgcgacattaccccggatgatgcgacaacctactgagattatgtaataacaaacaaaactttttcatttaatctaaagatgggggatatttcgttacgtaaggtcgttagtagagaacaacttcggctacttgggctccatatgaataatcttgggggtaacctagaacatctgtgaactcaaataagacatacctagaggctgtcagttcggaaaacgtaaaattcgtacaattgtgaggcaagatttggactttcttgatgtgagattcgtcaaaagggctggatgctgtgacattcccagattcgtagatcaaatcgtagttttcaacgttgttgatgactctgtagttcgttgaattaaaatctctcaaaaccgagactgaaaagctctctgcaggatatgttccccatacaaccaagcctccttcaatgtcaagctcatctccaagatcaaatatcagatgagtcggttcttcacgagattcaattttccagatagtggagttatctccgtcagcaactgcctggatagggtctcctaccacgccaggttgcaatgcagtgacattctttaccgtgcattcaatgaatgatcctggaatattctgctctgtttggtataatgggatggaaaggctctttcctggttggatcttgtgttccttacctcccatttcatttctagaatccacataaacattgatggtggtagcatttccccgatgtgcaattgtagcatacgtatcgttcacagtgatgtccaacgtctggttcatatagacaaatccatttatagagaatccgcccggtaaacacggtagttgaaggggatcgaaggccagccttctcttgatagatttgtctgtatcgttgtaaatatagctaaatcttaatccggtcaaaccataaatagaactttgcaagaaagctccatgaccggttaaaaatgggaaggcagggtgagttcctccattggtatcatactgatccgttgactgttcactcatctgtccaaatggaaacctgaaataaggttctacagatttcaagagataggtttgagaagagcatccttctttgttaaacttcgcattgaccgcagagtaaacagagaaagtcatagccgggccttcatctgtttgtttatcagagtaatatctaacgtcgctgatagccctatcctcatcgtaatcgaaatattcctgtaaggcaccatcctcatcatctaaaggataagaaataagaaccacatcagcttgtttgacttcgatagagttgttcatccctgtatattccaacgtaacatctcctgcatggttgacaggtaaatacattttggtcatgatatcttcccatttgtcgtaactcctttcatttccgactttaagatgctttccaaggatgagagcccatttcatgagctgagaaataccgacgttggtaaatgctgcgttatttttgaactcagcatactcatctgggtctgtcagatttctggtcgtatatttatctaaagttgaattgtagtcaacgtaatccacgaaaaaagaggcaacatcttcaattattgggtatccaaattccttcatataatcatcatcaattgcacctcccaaatataatttccagaacatgaaggcaatgtctatattgatatgatactcgtaatcataacacggaccagttgaggtacaatttccaaatctaccactagtccaggggtagactgccccattcatgtcacgagtttgggcattcttcttagcttgatcatgggtatggtctctaaatttggataaagaaacggcatgtcggggactaaaggcttggacactcggtagcatccaaaagtcagtgtcccaaaacaccattcctccgtatgaatccgaagacagcccggaaacccctaaagcagaagtgcctccattggcttctgatcttgtattggccatcaagtggtaaatgcttgaatcggaagccaatgtcaaaaaatcattgtcgtgaaagacaatagactttccatttaacaattcgttccatgcctctttatgagatttcaagatccacgaacgcccttttatttcagcaaacttagcagtttctctagcaaattggtaagaggtcaagttagtttcaatgctatctagatagtcgtcagagacaacgccgacgtatttttgaaacgatgcagcttggttcttcgatagatttacccgaagtgtttgagataccgtttgattttgctttaaaagggacgaggtcgaattagagctcatcaatgaagagtaaatcgtagcattcgtcggaacatttgacggttgaaccttcatgaaaatactctgttcatttactcctgagtccaaataagaacacctggtgctggttgcgaaatcaagaatatcagtgacggaaacagttatattcttctgcgatgatagctccagagacacgaatcccaaacttacaatgtctctatgggctaggacagagattgaaacattgaccagtcccaaccatgtgtaattagtagtgacaattccatctaacaacgataactgttgagaatagtcactgatgtgggttatatcgacatcatctgctttgagagtttggttggttccattcacattaacggttaactctaggctagtccattgaggaatagaggcaataatactctcataaccgtctttttccaactcttcgaagttggtctcaggtacggtcggttgagagttgaaaaatccagcaataaaggcccctgagtacctcttgttgaataagggccagccgtttttcagattctcggaagtcttattatcgctagtgtcgtaggtaaatcctgacccaactcgggggattcgggaaccaatataaccgttggcaacataaggttgcagctggtaattgttatagcgagggaatcttgtagttctcaggacctttagctctttgtcgtaatatgtctcagtgtcttcatcgacaaaataagtggctcctgaactgagaccttcagagatattagctctggtgaagttgtgactcagaagattcctaatctgcaaggaatcacttgaagtgccaacaggaaaggttgtaaccaagtgaaagaaaaccacacaagaaagggcaaccaacaacactctattcagcatttctctagtctgagaggtgggaggaggtttctttggtattctgctattatatatggatccatacggcattgccctaatctagtgaagtaaaagccaaatgttccgcatcggtccacggagaaatttgattgctctatctggcacctgaaagtttgcgagttcctaaattagaaatttaggtgcattaaacatggggaatgtatgacttttttttttccgtctttgggatcttgctcgccagatcgagaggttttggagtaagtgctccaccatagaaaaatagtccgtatgactgtcttcagaggttgcatcgatatccattccggcaaagtcaaacagattgtaggcggcaagctggtgaaggatgacactgaatctgatgaagtagaaacaaattttgtcagtgaacagccctcgtcctattatgcacagttatataagcagaaccaggttcatggaacacatgtcatcaaattgggctctttaaaggctaatgacgacgctgcaagagaagctctgggtgcgtggagagggggtttgcagattggcggtggaataacggattccaatgctcaagaatggatagatcaaggtgcatcgcatgtcatagtcacttcatggttattccctgagggtcagttttctatagaaagacttcaacacctgtccagccttattggaaaagagaaactggtagtggacttgagttgtcgtagacaagagatagatggaagtccccaatgggtggttgctatgaacaaatggcaaacattgacctcatccgtgctagatagagagtttttccaactgctgtcccagtattgcgatgagttcttagtgcatgctgcagatgtggagggactttgtcaaggaattgaccaagagctggtacggaaattaagtgaatggagtgatcttccagttacatatgctggtggggctagaagtatacaagatctagaaactgtcaaacatttaagcaacggaaaggtcgatctcacgtttggaagtgcactgaatatttttggcggaaacctagtaaagtttgaagactgtgttaagtggaataaaactcagtagattgctaccttagtttatagttaatagtagagggtctggtcagccctaggcttccaaaaatccgtatacctgcgtttcttccgcttgcgaatatctttctcaatgctggtcttagtatgtacaaaagctctgcccacaagaagccttggataaatggtttgataacatggtcaattgcaattgtataagcgacaactttggcggttacctggggcttagcggaggaaatgcgaactgaatttgcattaagagtcctccaaaatgattgctcgtaacggagatcggggatgactaatgtgttcatgatggtcgatgagccaagaggggggttggactgggtcaaccttggataagctaaaaaagggagccccgcgaagggtctccctgaagcaaacccttgcacggaaggaagaggttttcgctttgggcgcggtagttcaattcaacgtaaaaattcaacatcctcccaactaaaacactcatgagcaaggaacccaaggttaatatcatcaacgcccaagatgatgaagttgagttgatgcttagcgatgttaatctatcgttggccaactctcttcgtagaacgatgttggccgaagttcccacattagctattgacctcgtggaaattaagatgaatacctcggtgttggcagatgagttcatatctcacagactaggattgattcctttggtgagcgaagatgtggaagaaatgaaatatagcagagattgcacatgtgaagattactgtgacgagtgctctgtggtgttggaactaagtgccaggcatgaaggagaggaaggtaccaccgatgtctattcttcttctctgatcaaagtgtccggtccaggaaacttgaacgttggtgaaccagtccgtagggatgattatgatcagggaatcttgctgtgcaagctgcggaaccaccaggagttgaacattagatgtatagccaaaaagggtattgccaaagaacatgctaaatggtcaccatgctctgctatagcattcgaatacgatccacacaacaaactgaaacatacagacttttggtttgaggtggatgccaaaaaagaatggccagattccaagtatgccacctgggaggaaccacccaaacctggtgaagtttttgattacaaagccaagccaaatagattctacatgacagtggaaaccacaggttctttgaaagctaaccaggtgttcagcagggggatcaagacgttgcaggagaagttggctaacgtcctgtttgagctggaaaactctaggcctgccaatacaacagcctatggaggagcgaccgcttatgggggacagacggtatatggaagagaaaccagttacggtggcaacaccaattatggagattacaatgcaccatactgatatgtactatagaacctttcaagaaaatacacaaattttagatatattatgtaatcgatctagcatggacaccaaccatcgtttcccctcgacgtcgctggccaaatatcaaatctttccatcttacgctccatagcacgccatgtctgataaattcattggtaaaaccatatcgttggtgtcccagaaggactatagatacgttggtgtgctgaagcatatcgatggagaagttggaacaattactttgagaaatgtccgattctttggttcagaaggtagaattcaggatccagcccactatatacctcctaatcagggagctattgaccaattgattctgaaaggacaagacgtcaaggacttgcaagttttagacgtttcagttgaagaggttgttcctgagcccggtccattttatccaggatacaactactatggtcaagttccccaaatggtttcacctcaacaggttccgccacaacaggctccaccgcagcagattccaccacaacagcagcagtatcaacagcagcaacaacaaccacagcgcatacagcctcaacaacagcaagtacgccaacaaccacacccttcacaagttcagccccaacacatccctaaggctcaacaacagcctcagcagaccgagccacctcaatccgagaccaaacagcaaagtcaagaaagaccttcaaaggagctcgaatcacgaccacccaaacagaacgcatctagtcaacagcaaaacggtgctccggcacgcaaggagcgtcctagacccattggtgagattggtgacgttgacccgaatcaggaatttgattttgaatctaacaatgcccgatttaccgaggaagcagccaaggagacccaaaaggctgctcaagatgaaacggcccaaccttcctacaacaaacaatcctcattctttgatactttgtccagtcatgtggaaactcgaccagccaacaatagaggcagaggccgtggaagaggaagaggcaggggcaggagcaacagaggaagaagtaacaacggagaaactcctcagtggaattagcaaaagcttgaagattagtactagattgtgaattagttaccttacataagcaatatttaatctcaccaacgcaagtttccttctttgtcacacagaacttggataggccccaatgacgtctataaagccctttcaagctacagacctgtttgacatcaatccagtaaacctggatgtgctgactgagaattatcagccttttttctacctccagtatttggtagactggccacctttattcttcaaatctgtctctggcagtgtcattgacagttccaatggttcaatattaaggaacgacgtcatgtctggttatatgatgggtaagacagaaggaaaggcaaaagagtggcacacgcatatcactgctgtgacagtgaatccaacctatagaagactgggactggcctcctttttatgcgagcatttggaccaagctaccgatcaagagccttacaatacctactttgtcgaccttttcgtccgagtaaccaacaaattggccatatcaatgtatcataagctaggctattcggtgtacaggagagtggtaggctattacggtgacggtagtaacgagaataggaacaaactcgatgacaatcatgatgcatttgatatgagaaaaagtcagacgagagatgtcaagaaagaaaccgtacgagaaaacggtgaaaaagttaatgttttaccctatgaagtggttttttaaatccttttggtgtaaattctgtaaatgttgatcaaactcaaaaagaccagctctatttgatctttgaacagaaatagtaatccctgccctaaggctcctttgaatatttgggagagaagacccctccatagccccttaaatttgtcagttttccaaaggtgacataacacttgctgaaaggaattgaactgtttggctcgaggatcgtcctgcgatttctgtagtacagtcttggaaacaattaggggttgggtaaccagagtcgctatcattttggagatcatgcccaatactaacgactggaatgccgataagtactttatatccccataaattagtttcttcaacctctcatatgagccataggtgatcgatgggtttaaagtgaggatgagtgacaccttgagtcctttccaaagagcactaacacctcttttccttactattttactaccggtggctatcaactcgttgtttcccagtagttttttgaataatgatgtactttcctcttgtttattattgcgcatgatcttgtagtattggtataataatggagaatcttttctcagatcgatgttgctctcttcgatggcaatcaattggctgtgggcaacattcttttgaaattgagaggtttgcaactctgtagtaattacattgaaaggagtaacaaaaaattgagataaagctgcggccagtatacttatactgagttcatcaaatattcttcctttggaactgtttttttgggagttagagtatagcttcttcagtgcttcgtagaagtaaaaataactaaaactctggacagctgctgaggttacagaagcttgcagtccatggtaccaacctttgaagccttcctgcttcaaaatttttaatagggcatctactgtgtttctgtagtagatggggtttattcttgccttatcttgtaactccaactccaatttctgagataattgatcgttttcttcaccaattagctcttcggctatgcttgaggcctcattctcaaatccggtagcacctggggacaaaagaatattctcaatagtacctccttcaagcttcagcgcctcattatggtcctttctggtcttgaccttttcttgagtttgtatcaaagctttggtcaggtccaatggatacagcacaaccgtagaaactattgctgaaagggttccaaacgtggctttttcagtcaacgatagttgatagtctgctcctgacattaactcccaattgttacagttcaaagaagcatcaactgcctgtccttgaggaggctattgcccgaaaaagaataatgtgggggaaaaatatctcgcgccaaaacgggggtgctaaccggaggaaggtcgaggaggggtgacagaccatctcttggtacgtctatccgtggctccagaggtgaaaagaagctcgtcgccatcattggaagtgaatgcagctgcgctcttgattcgtccttcatgagatttcagctcttcaatgatcgtcccagacgacaaattcaatcctctgatgactccgtcgtctgagaagatccatactccattcttggaatctctggtagcaatttgctgtacagagtatttatcttggggtgccgatgtgttcacactggaaagtatcacatttcttatcacatgagttttgtttgtgaattgttgctcgtgtacctgattgatagataaagagcgtagttgcaatagaagatcttcttcggtgttctctttcccttcctcttttatccaataatctattaactcgttaaggtctggcagaaccaatgtgatcagtctcatgtagggaatatggttcgtcgcagctgatatcaaaagcttttcctcggtgatgtgatgagcaagagccccaatctggaatccatggctagaaaactcactgtcatctgtagaaagccggcacaactcaactagcttcttttcatcattgacgataaacacggatatgagtgatgtgtcgaccctattggctatcaccaagaagtggttttgaaatgtgaagaaatctatacatgtaggtcttgtaagcattttgaactgagatttgctgaactggatattcttaatgtctgtaaaatctattgtggtcaaggttacattattgtccattccaacggagaccaagtatccatgactgtcatcaatggggagatatttcatgtcggagagaagtctaccatgcaactgaaacgactgtatttcttttgttgctacgtttaaaatggatagttgtccatccatacccccacagagtagcagaggagaactgtcaatgattaataccactttggagatggacttgagaactttttgaaaaccagctagcttaacaccattgagatcaaaaacctgcagttcattcgatgaggtggagatcacaatacacgaagagggttgatctgaaagcttcaagttcccaacagtagttgaaactactaaatcagagcccaacggaaccaattcttcacctatcactggatttggcaatttccatacaggcaaagctacactattattgagcgcctgaggatcgtcctcgtttgcctttttcaactctaagaacttgtatctgtcttccacgatgtcgtagagacgctcctccaacaaatccctattgtcagagaaagttcgattgagttcaagtttgaacgcagccaagctctccttaagccctctttcagaaagatactgtgcgatcaacgactcgacaatttcattgatagacatacttttcacaatcagacctaaatgggatctcttgtgctgtatctcatggatagataggtcatgattaagtaatctaacatacagatctcaggcacgtgatactgtagtagctgctacgctgctacatctctacatccttacaaataaattcattgaattactttaccacgtgatgcgcattagggcaatgtcactgctctccctaaagagttaacaccacctatcggttcgcgacatggatcctctcactgcccaaaaatttcaaatttctctgttcaaagttctattatcacacaacagcaaaaatgggtaaaggtaagccaagaggattgaacgccgccagaaagttgagagtgcaccgcagaaacaacagatgggccgacctgcaatacaagtccaagttgttgggaactgccttcaagtcttctccattcggtggttcttctcacgctaagggaatcgtgttggaaaagattggtattgcttccaagcaacctaactccgctattagaaagtgtgtcagagttcagttgatcaagaacggtaagaaggttaccgctttcgttccaaatgatggttgtctgaacttcgtcgatgagaacgacgaagttttgttggccggtttcggtaagagaggtaaggctaagggtgatattccaggtgtcagattcaaggtcgtcaaggtctctggtgtttctttgctgtccttgtggaaggagaagagagagaagccaagatcataatggttttgtagattatcagtatttacaatacaaatattagtactatacttattgcggaagccctcttccttcaatggagattcctcctttcttggccgacgacttgcgtttggtccccatagtgttgagccttgagtttaatctcttgtattggtcctctccgctcagggatgatcccactccggaaggcagagtccttctggctgaactcatcagcagctcggtattgacttgaggagcgatggtgtaagcagctgttcttgcttgggggatggccgcacgctttcttctttcagctgcctcttcgtaaagggttttggcctcctggggtctgacactgacccttccaggcaaggattccgcaaactgggcaggatcaaattgctgggtcctaacacgcatgtctttgtaattatccgatgctcccattatgggtctggtccaatcactgatcaatttctcggcagttctcttaaggttgggttccactctcttggatttctggtagaataccatcactttgcctaaaccactttctctcaaatgagatgtcttgatgggaagtgacttgatagcgtcaaatagcactttctgtatttggtaagctggcaaggatgcatctggtaatggttccagccatagtcttactgaggccaataagttgttgtccagtatagaatcggccaagttggctctcaaaagtatgtcctttaccttgggaagtagtttcaatttgaaaatggcaggttttccctgttcaatgttgtttgcatcacggatggcggattcttccatttgtaatttaagttgttgtataagctcatcctgcatctgctctagatccacgtcatcgttcttctttctcttgtttggcttccttttgattgcagcatccagtttctcttcgaacaatcttgttcttctggcggcttcgtcttccacgacatcaggctcgtattgagtttctctggcggtttgttgctttggtcttcttctggtgggctctttcttcttgtgagtcgaggaaggttgggcagctttatgttttgacaaagatgcagcggtctgttcatcgagatatctcaatccctctgcgaccttctcttcgtccacatcggaaatatctgacaaatctgagtctgagtcgtcgtcagaagcaggctcattgggttcgttctcaggagcttcttgctcagccagcgcagcgtctgcttcgggctgtgtttcttgatcggtcttttcaggcagcacctgatcaaggagctttttattctctgattcctcgtctgacattactattcaagggcaagacagtgttctgtttggctctgaaatgttaaacaggataggagaactttcgcgagtctgctagagctcctcccagctgagtacgattttctccttctactaggcctgtgccttctcgtccctgtagtcgagaatcaacagcaaattttcgaaagctcaaccaaaactttcactcagtcattttgctacaacttatacacacagaaaaatgaactttccaaaccaacaaccatccgaagaggagaagaaaattcaccaacaatacagtgaaagaacaatccaaaccgctgttctcatcggtgctgctttgtggttaatccctaccgctatccacttcatcaagagagccaccaaataaacctgactaaccattagctgccctgtttattacctatgtacataaatttacacccagtttgaataataataagcagagctacgttcctgtctgattttggttacgaatggatggtttatcacccgttcgaactgatttgccttcatcatttcaagtatacttggaggaaactgttgtagatataatcgatggaagaattggccattcaagtcaaactttcccacaatgacgttttttctttgatcgtagagatatgacgctccgtcttgcagtatcataagaaacggactcttacgcttgtagttttcggggttcaacttgaactcattaaaattgacttctgggagccgtttcaccttgaaagttttgagcttgaactctttgtaatggcttttcgcattaaatgaatcctcaggcgttctgttgccatctgtagcttcgacgggttggttagaaccccatggaaagacggcctcattccctaacccttgactgtgttcttgattctccaacagaaaggaagtttcgccggcaaatggatcatctgcctgatactcaacggctcggtcctcaattcccaattcttccagagggatttcttcaggacctctcgtctcatcaatgggttcagcgtctgacatttaccagttacctaggcaccattctccacttaccatatataaccacttctcaattccgtcagacccttcctactgaacactagagtttcctaatacagctgccctttaacctctcttgggatcctccagtccccctggccggatcggctagtttattatgctgcttaccggcaaccatcaatcttcacatgcgtaatctgctcctcccaaattttcagtgtgataccccgataccgagcaccatgtcgcgcttccttaaaacaaaaggtggggcttgcttcccaaatctccgaatgcaatgactaggcctatataagcaatggcatctcccttccctcctccaaatctttaattattcctcgtttgaacaagctctcgtcttctgttgagtttaccattctcgtttccttgttgccttcatgtcacatctcaaaaagatccaggataggactccggtcgagagtttgtcacctcaggacaaaaaggaaatcaagtcgctctttgacagtctgccattgccctcttctgacctagctaactcctacgcagtcccagggtcagccaaaactggatattcacctacattcagaaatagttatgtcagaaacggatcgttgatcgagacgctacatccttctctgaggactctgcatgagttgttcagtaactctgttcagttgtatggagaaagggactgtttgggttctagactttatgaccatgatgtaaaggacggttatgacgattatttcacgtttgagaactacaggacgatttgcgaacgaaagtctaatttgggagctggtataattcattccgtgctagataacgaatacagaattgacccaaaagacggcggttttgaccttgcagattataacaccaataacttcattgtcagtctgtatggtagaaatagggctgaatgggtgctatctgatttggcctgtcaaacctacagtttaccggacactgcattgtatgatacattaggacccacaacttccgcttatatccttgagctgacaaagtctccagtagtaatttgctgcgctgagaagattgaaaaacttattgagctcaagacaaacaatccagagtcactcaagcattttatcaccatcatttctatggataatcttgattttcaagatttttccatcaacgaccttataaaaagagccaacagtgttcaaattaaactgttagatttgggacaaacagaagagctgggtaaggcttctcctgtggcagaaatacctccacttccttcgaccatatacactatttcgtttacctcaggaaccactggagttcccaagggagtagtattgacacacaaaatagccactgcagcagccacgtttgctttatcgcatatagggcttcctgacagcggaagaacgctgagtattcttcccttggctcatatttttgaaaggcaagtatccaatctagcgcttgtcgctggagtagctttaacattcccacatctcccaggcccagagcatattgttccaaaccttcgtataagtaaaccttgtgctctaactgctgtgccgagattgtataacaagtttgaaagtgcaatcaagtcttcccttctaagtggaccggagacaattacccagaagctggtttccgccataattagccaaaacatccgaactcaatcggccaaagatgggaataagggcaacaattttatttcacgacaattggtcacaaagaaaatcagggcatctttaggattagataactgtcaattcttggttactggctcagcacccattgacccagaaacgatgaagttcttgaagggatctctaggagttggatttatgcaaggttatgggctaacggaatgttatgctggaatctgcatctcatcagcttatctgaaagaaaatggttcctgtggtgccattgggatatctgctgaaatgaggttgagagatgtgcctgaaatgaactatttctctggaaaacaacttgcggatgggtcgtatcacggtgagctgcaattacgtggtcctcaggttttcagctactactataaaagacccgatgagactgaaaaagcatttgataaagacggctggttctgtactggagatattgctagaattgacaaaaatggaaagctttacattattgacagagttaagaattttttcaaattatcccaaggggagtacgtaacaccagagaaaattgagaacatttaccttagtagttctcctttgatttcacaagttttcattcatggtgactctctgcattcttttttggtggctgttgttggtgtagatgaaacgtttttcaataatttgagatcagttgacccgtcaatcattaagaattatgaactcaaatccactgaagacaccattgaaaaatgcaatgctaataaagatttgaagagatctcttctctttctattcaataagagtgtcgaaagtgctggattgttgggttttgaaaaaatccacaactttcaccttgcgtttgaaccgttaaagattgaagacgatactctgactcctacgtttaaacttcgtagggttcaagccaagcacaaatttgacaccgaattggctaatttgtacaatgagaagagtcttctgagggagactaagatgtagtttttagacttgaatttatgacctctgttttttatttcatttttggtatagctcaatgtgtcattatcacaggttttccctcctcccactctttgatggcattatcaatgttgaaccagtattttagtttgatactctccattgctgcattctcgtaatcctcgtctttgaacaactggcccaacttgctgatggactctgcaattcgttcatcgttactgattttgagggcagccaactccgaatcgtcggaaacattctccaattcttcatgtatctccaaaatgtcaagaagaagagctttatccttgaattggtagctttttgaggcttcatctgtggtaatgtcaatgtttgcattcaattttaagatgtactgtgctcgtgttaggggtgatttcaatgtggcataagcattgttcaggagacttgaatattcttcatcgtccaggtgcactttatcatccccactattcaaaatatcaggatggtatttggcttgtagctttctgaactcctttcgaagttgtctttggtcgacatcgaaacttccggcgggtggaggaccataagggaaggtgttatgaaagattctgtaataattcacttttgccgcatcaagcagcacgcttttctggctaaacaaacgaatacgagtggagctagcaaatcttgggatcaattgtagacctctaaacatgttcaaagtggggtattcttggaggcaggtgtttgaatactaaggatcaattgtggaggaaaatgaaatactcggtgcttacgttagcaagacctcatcgaaactcatcttcttcactaggaaacatccctcagtcgactccacatgataccaaaacctttgtataactccctagtgaggttgcatctacaggtctatcccgctccactcacagcttcacagtccacttttgtgtttaatcgcgttattcagcctattataaccgacatgaattccaactataatgcaaagagacttgcatcagagaggatgtactattctccagtctactacaagactcatttcaacgtacagcatcagaaatttggaagagacatctccctcatactagacattaatggagtggaaaacttcgattccctggtcaagtataagaaacgacccgagctatcacctacactcaaagacgaaagaataaatgaactttacatccagtttaacagaatcaagggcatactgaaacctcatttactagataatattccaaccagttttccaatcaaggccaaggacgaagaatcacccgaaattaatgtgactgacgctacggcggaaagaccatactggcttgcgaacgaccaggcaactatggatatggaactggttgcagatttgagtcggatgtcactgtttattctaaaagatgtcacggtgggaaagaatatatttcttaacatgtacaatgctgatgcatttcacaacaacgatgaatcagggttgttggagggaaaaacgtcagaggtgatgttaatgggatttaatggctttaaatgattacatataatgaatgcactaatagatagttcagttgactttttccagcagtttgtccagtttctctttatctgtttgaataagctcatacagatattggataccctgttgctgtttgcccaggacatctgtcactttactagttgtggataaatctctctcttggacctgctcttgggtgatgagtagaccactttctttttgctgctgttgactgaggtttttggctctttctctcagattagaaagtctaccccataattcgtttgttcttcccaatcccgcaggatcgttcaaagtgttgaataacttttcaaattctaacttcaaatgctcttcatcagttgataatgggtaacctctggacttcaaaaccgatagaattatagcgagtctgagtaatttcttgctcaggttcttgtacttcactttgcactcggttaaccttgcactggtgttgagatcgtgtttttcacctagatcggtaagattatcgtttatcgtattgagaataattctggactgacgaacatgctctgtttgcgtgttggctcttgttaacaaatcatcaaatcccttggccttaacagggatggaattatacttggtgggtcggttcgacattgccttttcccattcctccggtagttcatcctgcggcctttggacattggcaagactttcatttgaaggaagcttgttgtaaaagtgagttttcaacatacaattaggggacgaaggatcccaagagttcttgactttaatgatttgatctgtaatggtaggagtgtagttattagaattattgttgaacgtggcaaccgcttgatttgattgcatttgttgcagagcattagatggctgtgatttttgctgctgactccaggcaaacgaaggttgggccgatgttggaacgttgttgttcacttggttgtttgcatttgtgttggcattgttaccgaataatccgccagctgtgtttgaggtattggtgctagtgttaccaccaaataacccactggaagtaccagtattattagtgcttccaaacaagcctcccgaaggggcaccagtgtttgtggtatttccagtgttgctggtaccaaaaagtcctccactgttcgtgctagtgcccttgtttccaaacagtcctccagacgcagtattgttattgcctccaaacaaaccccccgatccggcgttgttcgtgttgccattatttggattagcattggcattaccgaacagtccaccggaagttgtgttattggcattggaggcattgttcccaaatagcccccccgatgctgtattatttacattagtgttgttgttattgccaaacagtccaccggatgtggtattagaagtgttccccgtattggcccccgtattggctccaaatagaccagtgcttgcaccagtagttccagcaggcttggcaccaaacagtccgccggaattggaagacgaagggtttgtgtttagattcaacccgccgctagttggtttggcaccaaacgaaaaactggaagaaccagccgcaggggcagcattgttgctagtattcgatccaaaggaaaatccccccgtggaagtgtttcctggcgccgcattcgtcttagctccaaaattgaaagacatgggcgatgatatcaatggtactcgttcttccttacagatctcagatgttatgtttcttcactgtctaaaaatcttgtattggaatgtgctcacgacctttttttctctatactcagaggtgctcgaattttttccaaccaatcaacctcaagtgaagttatcccaaagagtaacactatcaaggcccaggtctgacgaaacacacacagaatgtctagtacgcacacaaatgactcccttaactcatctaactacgtggacaaactgaaggatacccacttcgtgtttgaaaatgataaattaccctctgagatcccagatgttgaggaagttggagccaccacagctcctctgttaagtgcagcatatttcatcggggccaagtgccaggactacaatgacgacttcatgttgtgtcagaaggaggccaagggcaacgggcctattgactgtttgaaggaaggtcgtcgtgtaaccagatgtgcctcaggcgtcttgaaagacttgaatacccactgctctgacgagttcagattgcattggcaatgtctgtcattttctaacctggagtacaagaattgtagaaaggccgagtcattgttaaataaatgtgtgtttgaaaagatgaaccttgtgaagaaaattccggggatccctgaagaccgccaaattcatctcaaacaaaacccagtattgaagcctgttgcattacatcaagattctgaagtggccttcaaaaaagcccagaacgaaaacagtatttagacatagtttgatgtatttatttatttattaatgtaggttaaagaaagaaagctagaaaaatacatcagagacaaaaattagttcaagtctcccaatgctttagtcttttaaattcatgtagacatgcagaaagtgcactcataaattcttcatttgtcaacacagttagtcggccatcatttccaagggcaatatccgtttcctgtcttagtgcaaggttattggaaatgttctcaattctagtaatgacatgctccaataatgaaaaatagtcctcatcaccaagcttagatgtcatcaccatggaaatctgatctgtaatgatagagctggtgtcattgaacactctgcctgactgcaaaacagtgagtatgtgctctaacctaaaagcaattcttctcaacttccaaatatcacgagcagctataattcccatgattccatagtccctgtctcggacaacttgtgtagcaaccatttcgtccttatccatcttctgctcagtacagtcaattctctcagccaatgatccgggataacccagacaaatcttttcaggattttccagtcccttcaacttacgctctccaataacgaaaaacacccacttatcaacctcaagctgttcgaattcgctttcgatttggcatgcgtaagaggcatcagttccataagcttcagcaacggtctgtttccattgatcaccaaacctttctcctgtgaatgatttcagcttctcgtggctctcatccagtttttcaaattcgtgaataaactgggaactcaatgcaatatgaccaccgtctgcaacaccgcttacacgcgatgccagattcaccataggcccaaaataatccattctacgagtaataagatcggcctcacagacaggagacccccaatgtatacccattctgacactgagtcctcgaaacaagtcgttgccatatttgtcttgaactctagcgcaatgaggactcttgataatctcctcaggccagctttcatgcaacaattgcttttgaacggagaaacaccataaaagtgcagatgttggggtaggaaacgcaaccataaaagcatctccttcggttttcacttcataaccaccaacaattttcagttgccgcctcattatagagttatgcagttttatggccgttctcatacttattggattcgtctcccataacttggtggaatttttgatgtcagtaaataccatggcaacgtttcctacaggtggataaatttcgtcttcaagtttgattaagtttgaatactcttgtctcaaaacgtcccttgtggtttggttatttgcaaccatctgtttatatctcaacgaaatcacaataacggtgatgtttccactgcaaccataggaaattgcatagtctcttagcgtttcggcggcaatcatcggattatttacatcatttctgataatgtcaaaagcgaggtccattgaaatcagtttccagagctcctttgtagcaagaacaatagccccatccgtagctttcaactcaaattgagaaattttaggagcagcattgaccgttggcaccagattccagaatccaaacgctctagaaatatcaaccacatcgttaacttttccctccgtggttacaaatcctcctgatgctctaatcctcttatactcggatggctcatatggttcatgtttctgggttaaaacatcaaattctccagtgcttgtagtcttgatggacagtgtatctccaacattggccacatgaattttacggccttggataaggattacagtcccgctacaccctgtctttcctccacttcgagctaaatattctttggtctggcctgggaaatgcgaaggatcgacatttcctgtacttggatcatcaatcagtgtgttaatttcttgattgcattgcagaaatgctcttcttaaagcgtctaccggcgtcccggaagccatcttgctatctatagcatccaattgagtttctagaaagtttttaaagacttcttccaaaacttttgtaacatggacatcgttgttcttaccatcaaaaagacagataagagtctcatcttccttttcacggaatttctctacaacacagtcacgcgtagttaagctgctattccttcccaatgtgtcagaaataccatatccatagcctccaaaagtcgaaggagtacttcttaccctggttttgatggagttttcaatcgtatcgttccaagtaacatcgacaaggccaagaatacacaaatcctgaaggctgccaaatttacttgtagttttttcacccatatccttcgacgtggaagtcgtggacgaaatcttcaaacttttgttgcctgaaaaattcaagtacttcaactctttgttcatgttccaattccaatatctgggtgaatctgagatatcatacttcaaaatattagaacccacgtccaacacggacaacctgggaatttttgatagttcataaggtaatgattggaatcgattgccgttcaaatgtaatacggttaaattcgtcagtgattctaaatcgtctggcaaaattgtcaactcgtttccactcagataaaggtgggtcaaattcttcaaatgacccaaagaaccgtttgtaaggtcataaataccattatacgaaatgttcagagatctgaggtttttgaaatttatcaaattggaaaggtatcgatttcttaatctgttgtgggacaaacttaaaattaataaagaattgcccaatttattctcccctgtaagtgctggagtatctggtaaagaatttgatgacaaaataagctctctcaaattaagctgccatatagttataggcaacgtcttgatgttattcaaatgcaaatctaagctggttagttcttgcaactctgatatttcatctggtagggttgtcaaattattattacaaactgatagtttcttcaattttttcagcgtggagatctctttggggagaaaactcaaatgattatgattcaatatcaaatgcgtgacttgaggaacattactcaatacagaaggtgaaagagatgttagttttgcctttgtcaagtccagatatctcaatgattctaaggtaccgataacggaaaagtgtgttactggattcaaatccaattggagtgttctgagactggcaacctttgaggtgtaagatgtacagaggttaccagttaagtacaagttttgtaaattgtccaaagttctcaaacagctcatatcttccaattgattgaaccgcaagtccaacgttttgatagatttaacttcaactatcgagtctgaaaccttgcccgctagcttgttacctgagagctttaaggttaccaacttagttaggttcttaatttccactggtatgtttgatatggagttataagacaaatctaactctgtgagattaggcagatcaaatatctcttgcggtataactttgatgtggtttgacgataggtttaaataacgaagtagggcaagttctccaaaattactaggcagttgagtaatacgattgttcgaaatctccaaattggtgagtgtagataatagagtaatgtccttgggtatctgtctcaggtagttagtttcaaggtccagattacgcaagtttgcaaattgaaatatgtttttgtgtagtgagtgagctctgtttccagtgaattttagggtctgcgtgtttcgacaaccttgaataaagtctaatgggataaatatggatgggtttttggacacatctagatagatgatgtcttctgcctgttgatgaattgtgtttggaattgttctcaagtctagattctttaagtcagccctcccatagcggacggatatcctggactttatgctagggtttaaacctttttcctcattgtattcgaaaatgaacttgtataagtaggtcatgtcaagttgtttccaatcatccggatcggtgaatccgctcaaattcaacaacctttcttgaatccggaggggatgatcatccaacgataagacttcgtgtagcccaccacatctaagcaatattctgtaatcttcattgggattaagccaatggccattttctagtctcttgataatctgcctaaagttctcattgattgtcacattaagcgtccttccattattatccttaaaaactttgagccttcctaccaaaggttggttatggtaaagatggtggtgtggctctgagacttttttctcttcattggatgcatcacctacagtcatatcatgaggatgcccatgaacgggacactcagtgtttggttcatgaatgcaattgggatcgattgcttcggattcgacatgatctttcttctttccaaatgagcttattgacgattgttcagattcggcgtctgtggacgatgttgaagataatgtcagacttttttcctgttctttcatattcgatgctttaacactccaactctgtggcggctgccaagctgacatgtgtgttatattcccatttgtaggtatatcatcatcactcaagttgttgaggttgaatcctgtgaatgacttggtcagagtattattattagcatcgtccccttcatcatcactgtcgtctttccttgatataaaagctgatagatcctcgacagatccagtgggtgaaagcgtagtaggctcttcagtggtagaccttcgtctggagtcaccaacagagggcgaaggggtctgaaacacattcttcaaagcaaccgcaggattgtgaatatggatatgatgatggggttccattttttcatccttctttttgtgtattggtccaggcaccagagaataacggtgggatgcaactgaaactcttctggggtcattatcatctgtcttgctagatgtacgtctcaacttactcaaaatccttcgggtcttggtgtatttgggggtcaacgactgtttccctggatggtctggatcgtgttgattccccaacccattatcggtgattgacataggcatgggttagagaagaaaaggcttgatgctgtcgcttatcagtttttgcccgccacgaaaatgccccgtggtttggtggaaactcaatcctgcgagtattaaagcaatgtacaaccttgaagggtacaaaaatagacagaaaaattaatgaaagtgaccaaaatgaggtgatggttcagttaactatggtgcctaaccaacaagtcgaatgcagtctaatctggggacttgagtgcaattgacagccaaacaaaaatagaaaaaacgacctcggtgagggttgaactcacgatcttgcgattaacagtcgcacgccttaaccaacttggccacgaagtctttttgcggaagtgaaacattttaagtttgccagaatattgtggtgatactcaatagtcagcaggaactacatgttgaaaatagtggtctaaagagtagctatgcttggtaacgtgtgaaatgaccttggtctactactaagctcaatgcgctttcaaccaatgaaagatgggagtctctgaacagccagattaagttagctacaatgctcgatggttgcaagtccctcttgtgttcttagcataaccagatttctacgcacatgtggtggcagcacgtgctattcaaggtgactaactgtaaagtgaaattttccgtgggttttggtttctacatcaggtgatgcatacaattttaggtagatcatatatatatttttgtgaccctatctggaaagtcgagactacagaaagtgtgacaaacctgcatacgatgtgcggacatctgggataagatcagcaggtatgaatgacagctgagacaacaattgtcagatagatgaatgcgatgaagaccgatttgggcatattccgaaacaaatttccctaagtggactaatggacgacccatgtcacgtaaccgatcggaaatgtcagcggattacaggaccctacaataaaaggagtcatgcaggtctatgaatagtataatgcgtggtattgcaatcattgttaccagaggcacaaacgacaaatttctagttcagttgaagaccatggggttctcacacagttaagatttaacccacggctcttgttaaggagcaaaaatagacagctaacactcttgtaacctagacaatcaaaagcgactcggttcggccttctaatcacatttcattaatcacgcatgcacaaaagtaggcaactgcagcttagagttggactcgagcaaatccctccactcatcctgtaatgaccccagattgattctattcatagcattgagcattggtagtgcgtcaaagctcgctcagaaccatccttgtaatccttcttttataactattactgaggaaaaagccaatttcgtactctccactggaaaacttccagcgaatgcagaggtcaaaacacccgtagatgagcttttaagctggcgatgagggaagcttttccatggtttgcttatattctctgccaagaaacacaagctgtaatggatacatgcttcacagtattgcgcaggaactataactctagcctcaaaatagatttcatcaggtcacagtgaacggtcaaacattcctgattggaaacacatcaacgaggtataaatatctggctgtgattgccttgtttcgtcaacagctttatcgaatcaaaatgttaacaacaattcttgcactcgctttctttagggctttggtgttagctgactcagtggaattttacatatatgtttggcaacctggctttggtgtagaagatgcctattggggagttgatgagtctggcctgattactgcagttggtcccggatacgtctctgacgacatacctcaagttctatttgttgtcaccacggatggtaaattacaaggaaacggccaactagtggaaataaccccaccatatgacttcctaactctgagacaaaataatactggtaccagtggcttttcgattgactatgatgacatccccacactcctactaaacggagcagcaattgatcatgtatggtcttgtttgagtccagacggtgaccatggtttcgttatcagttcggattcaccaaatgcaagttgcagcggctttaccgttaggatttctttacaacaggaaccaggaccatgcgagggtgacgaatgtacagaacctccagaacctccagtgtgctctgatgacgatgacgaatgtacagaacctccagaacctccagtgtgctctgatgacgatgacgaatgtacagaacctccagaacctccagtgtgctctgatgacgatgacgaatgtacagaacctccagaacctccagtgtgccctgatgacgacgatgaatgtccagagccaccaactgacacaactgatgagactccaaccgagaccccaaccgaaaccccaaccgaaactccaaccgaaactccaactgagaccccaaccgaaactccaactgagactccaaccgagactgcctacccaccaactctaccaactgacacaactctcacaaccgctccaacttcaactagtagcgaggtctcgacaccttctccaagcccttctgtaggagatgccaatgtcattgttaatacccttggattaacaggactgattgctgtagttgccatggtgttattggcttgagtggtcatccaagtgtcaacgattcacacaatcttctttcaattgtccctaatccagtaattttttattctatttttctttttaattctcgacaggtttacttatttcttgaacctatcactcaggtacggctcagccctttcgttagcctaagaaattagaatcaattctatttcgagaataggcaattacacaactcttgtctccaaatcagtacagtgatatggtggaacggtgtggctgtaagatgcgcatatctaaggtttattgaatattaatagaactcagaaaacagttatcgcttagagtctggcccaagaatgttcccctggcatcatcaataagagaagcattccaaaaataaaactgcttaaaatagtctccaagcccctaaagaccctggcgtggtcgcgctgcgaaagttgcatgacaggtgcagttatggttggtacagatcaacatgtgccagaatcctaccgggttccaacgtatgaaatatccaaaaatgagaccggtgaaaactaatggttgatatagaaaaaaagacccaacaccaattattttattagacaattcgtctattgcttctctccgagtgcttgcccaaaagattgaatagagagatctgcggttgactcgtagtccgcttggcttcgacaattcatcagatttggtgccaagaacggggatcatacatttttataaagacgaaaatagcacgcagattacttccttagcctcgaacgagtacctttccaggcgtaatgaccgccacaagttcatgattatgattcccgatgacagtgtataaattgacaagaataattctctgattccgtttattcaaatcaacagtatctgtctgtttatcaatatgtttaaaaaattacttcccctagctctcttcaaagcaatagttttggccgattccacctcttttaccatcaactttggacctggtgaaggtcatagtggtactcctttgggtgttaacgatgctggcgtcatcattccgagcaccactggagttcgattttatgtcaatgatgacagtcaactgaaggttgacaaccacgagctgcaggcggcctcaccattagatctcctgtccttgattaatagcggtgctgaaaccaaagggttttctctagttaccgacccaccggcccttttgcttaacgacgcgacccctagtctatggatttgtgaatcaagtgacgtttctcgaattgcaatcagtatagattcaccagctgatggctgtattccatactccatcaagcctaaactcgaggcaaacgtccgcaaaggtggtttgtttgccagagatgatgatctcactgacagcgatggcgttgacactgatacagaagatgatttgactgacaacgatggtgtcgataccgatacagaagatgatttgactgataacgatggtatcgatactgatacggacgatgacttgaccgacaatgatggtatcgatactgatacagaaggcgacttaactgataacgatggtgttgacaccgacacaaatgatgattggactgacaacgatggtgttgatactgacactgatgatgattggactgacaatgatggtatcgataccgacactgatagtgatgatgaccaaagtctagctgggcctgtcaacccaccaacgagtgcaactctcgcaaccacttctacgtcctcaacaagcgctactttcacaagtctgacaactggaggtgatttgactgactctgatcctgatagctggactgacaatgatggtgttgatactgacacagatgatgattggactgacaatgatggtattaatactgacactgacactgatagtgacgatgaccaaagtctaagtgggccaaccaacccaccaacgagcacaactctcgcaactactgctacctcctcaacgagcaccacttctgcaagtgctctggccactggaggtgatctgactgactctgatactgatagctggactgacaatgatggtatcgatactgacactgacagtgacactgatagtgacgatgaccaaagtcaaagtggaccaggaaattcaccaacgggtgcaactcttgcaactactgctactacgtccgcaactagcaccgtttcaaatggtcaagtaacatcctcagataatggggccaatcatttcgctggtgcagttggattatcaggagcagccggtggagttattctagctttactgatttgatcaagaattagttgcctattgctgatcctgtttagttattttcttagtatttcctctttttcttcttctttgctttgtttgtttactttaaaaaaatcatttccaactcctgtcttcgtagtactttgcaccaagctatcatgatgaaacttagaattattggggataactaacttcttcgtaatttggtctctttcaaactccgaagacatttcagtctgaaagatcatgctttcccatgcgtccgaaatattaatagatcttagattgtggatgttcaattaattcaattcaggagggttctaaattttgatagggatgttaagcactaagccttcaggctccaaaaataacacagcttggcatcgatcttgatgaccctgaagatgttatttcgcgaatgcatcagctgcattacagcaacgtatcttaacggataagagatggagaggcaccttcgacacaattgaaactagtgaaaaggcagtgtgagcaagtaagccggagtggtcaagtatttttaagcaaagtatacttaatggcacttcaatgttccaaaaagatagatttttttatgagggactccaaaacgaacgagattcagatctaagcaatagcttggttgatttgccaagaggatgctgtagtgttcgcacccacaccatatatttcaatctggacaagaatagaactaactgcttgctaccatcgttgacaattggaagacatataaaagccacatgttgcaccgtcacttctcgtttcttcactcaacggtttattcccctttttaagttgaaatgtatagaaaattgcttccccttgctttgctcagtgttccagtcttcgccgatgacgatgactcattaccttttgttattgttaactccgcgtcaggagaaacccatgatggaacttactggggtgtgaataacgccggagcagtcgttccaagctccactggagtgcgatttgtggtcaacgacgacggtgagttggaaggtaatgacgaggaagttgaagtgacctcaaacgggtttttgaccttaagagatgacaatgatgaaaatgaggggttttctctcacagatgatgatccaccggttttgctgttaaatcgtcaaactcctaccgtgtggatatgtggatctgatgatgacgcccgtattgctctgggttcacaatcgccacaagatgattgtgtagagtactccattgaagttcagctgcaaagtggttcaagaagcgggtccagcacaagaacaagcagtagaacaactggaaccagtgcaaccagtgcaaccagtgcaaccagtggaaccagtgcaacagggacgactactggaagcacctcgacagctactgatggagcccacaagcttgttggcgggctgtctggattggctggtggtgttgccattgccctattgatctagctggctccctgatctcccaggagcgatcccacagatccttgttttgtttgttttggcttagtaggttacttagggaacactgatttactaacattgtgtgtaataggcaagtcaatgccaatggaacaattgcatcctgagccagttgtccttcttgtttgtcaggggaacctgtatgcaaagcctgtaacatagatcaaccgcgaactagatctctgacttgaactgaaacaaggacattccagctgtcatcgaaaaatagcaccactggcaagtcggttattttttgagtgtccgcgaatgtattgttgcataagcttcctgtacatacagaacaattgtgtggagctattagccaaatttttcatgcatgttcgagatcatcggctgtcaagaaaaccctttacgaataactctggcaaacgaactggcactggccaacttgtgatgacagctattctcggcaatccgttactcttgctacagtggtcaatatggtggagacgatttcgcttgattttgtagaacactctgctcgccaagaaagatgactataaatacatacatgcatcaattgaagtgcacaccatttcccgcttctagcctcaaaagaccccatcatgccatgatgaaaaatcagccatagtcaattagcttctttaccgagaaacgtataaatagccatgtgccacgtcttggggcagtttattttatttatgacaatgttcaaaacgttactactgccacttgttttatgggaagcaagggtccttgcagaaaatgaggacgagcttggcataccatttcatatcgttaatactttacccgaagatgagtactacaattcaactgcaagtaggtacattgatactctttggggcacacaggcaaatgcaattgctgttgctggatattattatgagcagttaatcatccaagaagttttattcaccctaactaccgatggtatattgcaaggcaatgactctgactctaaggttgaagtaacttcaccaggtggtcgtttgacgtacagggaagaaaatgagggtactcccggattctctctagatctcaatgacccacctgcccttttgctggatggagcaacaccaacaatatggatctgtccatcaggtaatactcctgaggtacacatctacgacgagtcacccggagatgactgtcttgaatatttagtttcggttcaacccttggagccaggtacaattgatccaccaggtgatggtgatgatggcccaggcgacggtgatgatggcccaggcgacggtgatgatggcccaggcgatggtgatgacggtccaggtgatggtgatgatggcccaggcgatggtgacgatggcccaggcgatggtgatgacggtccaggcgatggtgacgatggcccaggcgatggtgatgatagcccaggcgacggcgacgatggtccaggtggtggctctggtggtggctctggtggtggatctggtggtggatctggtggaggttctggtgatggatctggtggtggtgatgatgaggacgacacaactactactacaagtagttcaaccacctcaagccctgcaactagtccaaccacctctacaacatcagctacaggtacttcaaccccaacaagcacgccagggactaccacttcagctcccacgacgacttctagcccagaagcaaccaacgctggtggagccgccaacctagttggccctaatgggctgccgggattgattggaggggtagcaattgctctactgatttaattaccacccgctgtaactatgaaatggcagcgaacccctgtgaaaccccttattatacttgaaatttcatgtactctaaaaatgccattttaatttcaatttttgattactgtaggaacccctagtcaaaaacgtcgttcgttacactctccttcgaccattcatgagcttaactgaatcagacttgcccttgaccagacaagaggggctgaaaccgttgaaggtggaagtccactttggaatttcataaactaaaaataggtgatattaattttcaagtaccgaaaggaaatagttgtgcgtgcggtaggcaattaaagccggtgaagacaattgcatcctgaggcaagtggtacttttcctcctaatttgtcaggggaacggtatgcaaaacctgtaacatgaattccaccgcgagaacaaatctctgacttggattgaaacaagcgcattcctgctgtcatcgaacgataacaccacttaatatgtcgacttttctcttgaatattggcgaccacatccttgcatacgctcccagtacatacagaacaagtgtgggagcgaatattgacccgacttatttatgcaacattcgagctcatggcaaaaacacactttaaccactagctttagcacaataaccaacactagccaacttgtgatggcagttattcttagtggcagcagctactctgttgggtcaccctgagcaaaaagtttcccgatactgtagaagacacctgatcatccctgctcgccaagaaagatggctattatacgtacatgcatcaaataaagtgcacatcaccttccgcttttagcctcaaaagaccccatcaggccaggatgaaatatcaaaaatagtcaattagcatctttactgggaggtgtataaatagccatgtgccacgtcttagagggcagtttattttgctaatgttaatgtttaaaaagttactaccccttgttttattgaaagcaaaggtctttgcagatgatacggattggcatgcttcccccgtcacatttcgaattgtcaacattcgacccgagccaccgtacaatggaacaggcaccagagtgggttattggagcgtacaggatggtgtgattgttgacactggcctcgcaatcgaattttttttaaatgacactgtattgcaaggtaatggctctaactctaaacttgaagtgacctcaccgggaggccgtttgacgttcaatgaagaaaatgagggtaccaccggattttctatagttttaaacgattcagcagaacttttactgaatggagcagccccgacagtatggatctgtcagtctggagatacttctgaaatacacatctacgacgagtcacccggggatgactgtgaacaatatcacgttgctctagaatctgaacagtttagttcgattccagaggacccgtgcgataatccagagtacgccgacgaatgtgacgacgccggaggatccggtggtggatctagtggtggtaatgatggtggatctggtggtggatctggaggtggatctggaggtggatcaggtggtggatcaggtggtggttctggtggaggatctggtggtggttctggtggtggatcaggaggtggatctggtggtggttccggtggtggatctggtggaggatctggtggtggctctggtggtggctctggtggtggctctggtggtggatcaggaggtggatctggtggtggtaatgatggtggttctggtggtggtaatgatggtggtaatgatggtggttctggtggtggttctggtggtggatcaggaggtggatcaggaggtggatctggtggtggatcaggaggtggatccggtggtggtaatgatggtggttctggtggtggtaatgatggcggtaatgacggtggttctggtggaggatctggaggaagttctggtggtggtgatgatgaggacgacacaagtactactacaagtggttcaaccacctcaagccctgcaactagtccaaccacctctacaacatcagctacaggtacttcaaccccgacaagcgcaccagggactaccacttcagctcccacgacgacttctagcccagaagcaaccaacgctggtggagccgtcaatctagttggtcctaatgggctgtcaggattgattggaggggtagcaattgctctactgatttaattaccatccgctgtaactatgaaacggcagccaaccactgcggaaccccttattacacttaatttcacctactttgaaaaatttattttggtgttatctttgataactgtgatggatttcaaactaagtgcctcgtcctttacacagtccacgtacaaaaaagaactttcatttggttccagaatgttcgccttactacatggcaggggactcaaaacattgagcgtggggtccactgctgaatccgatccatcaaaagtacttgagaccaaatatcaactatctgaaaggatagaattgatacaagatgattcacccaccttgtttctctaagctttttcgagtaacccattacatgtgtgccagcgtgatgcacggagtagactgattcccaacgttctgctcgtatatgtttggaatataaaatttaagtttatttgccttgccgtgtttactactgcaatcccctgttactttttcttagattagcggtaagtcattacagtactaactatgacgtgtttttgcagtttagtcgccggtattgatgtgctttctcaattttatgctaatcaaccttaccacatgcgttaaagttgtgtgttggatcgggacatgtaggaatagtttgttaatactgtatgtgtggtaagaaagagtatacaggcatgtaatataagatggagagattaactacaaaactatacctactgttagtatcgcatcttccagaatttttgaacacccataaacacttgtcattaaaccgacgtgaccctattccatgtagagtaacttgaagcatcattgtggcattccctcaaatcttaataaataactacatcactgggtagtttgaatacgtttattgcgaagaagtagtgatcatccagtgatcaatcgcactatcagctccacttaccctatatagaagtactttgaaataagctttcggttgcggccatatctagcagaaagcaccgtttcccgtccgatcaaccgtagttaagctgctaagagcctgaccgagtagtgtagtgggagaccatacgcgaaactcaggtgctgcaatctctttttgtctctctaacattcacctgatctctctatctcatcacagactgtcaaaatcatttattaaaatgtacaattgcaatctatagtgggttcagacttgcagttttttttcatcttgctcgtctagcaaaacaggtcctcaattgagttcaattttcaggcgctggccacctgtgttttaccagaacagatcgtccctattcgttgtactccaatcaagacgggcttcaattgcagatacaggaaggtattgaaggtccaattgagatatgaagatttaacacatggcaaagttctgcacgctcactccgtcttcacaactgggacaatgaagccagattttccagacaccgagttttacaagaaacacagtgcttatcccgttggcacggtccggattcgcaaacaaagggaataaaatgtccgcataagttttgagcttgttttcctactgtaaacttttcagtgtacgaacgcccgagccaattgataaatctaggtagagcagctgttgcaactagtttacaggaaatgaatacagcattaatcagaaacaaagaattaaaaaacctaaatcaaaagaaaatcagatggcatatcatgcgcatggagaagaaatcgactggactaacctcaaatgaataccgctgcaaatagagtaccaattatactcaacgcagtgtttagtcgtacacttaaccaagatgctccattagaaggagaaacttggtaaacagtagatgatgatatggtatgtgtcacagtagaagaagctttttcctcactcttaacagtatgagggatactagaggcatgataatcacttaaactgccagtgacagtgtcaatagcactatgtgaaccactaacagttgtaactgtgccaagtttcgtactagtcttttcctctggtttcacgtccgtcgtcagtgctgttttgtagctgtggctacttacagaggcaccgtccgttttgactacagtggtagttctggaagaagtgccatgaggttgagaaataataatagtcacagtctcatttgaaatttttggagtaactgtgatcgttttgggtatagtacaaacagggcaggaaataaattgtgtgacagtgttaattttagtccatgtgctggtagatgctgaaatcgaagtgttcaagtacttaattggagtctcaataatcacagttcctggctccgtgccacttgcaggaaccgtgtgagtagtttcgtaagtaccagtccaaggtttagtggtagtgacataggtcactggagtctcgatcacaacagttcctggctcagtgcctgttggtggaacggtgtaagtggtttcataagtgccggtccatggttgggttgtggtcacataggtcaccggagtttcgatcacaacagttcctggctcagttccggtcggtggaactgtgtaagtggtttcataagtgccggtccatggttgggttgtggtcacataggtcaccggagtttcgatcacaacagttcctggttcagttccggtcggtggaactgtgtaagttgtctcgtaagtgccggtccatggttgggttgtggtcacgtacgtttcacagtcatctcctggacagcagacattttcacactcacaaacgtctctccttctaagtgggtctgatgttggcactgctccacaacaaactgcttcacaatcagtaatttcgggagtctcgatcacaacagttcctggctcagtacccgaaggcggaaccgtgtaggtggtctcgtaagtgcctgtccatggttggg
